United States Patent 8,781,750 (CELL-TYPE-SPECIFIC PATTERNS OF GENE EXPRESSION) - sequence listing, part 38

SEQ ID NO: 37563 - DNA, 1356505 bp, Homo sapiens
atgaagcttccagaggaacgatcaggcagcaacatttgctgttctgcaatattcgctgttctgcagcctccactgctgataccaaggcaaacagggtcgggagtggacctccagcaaactccaacagacctgcagctgagggtcctgactgttagaaggaaaactaacaaacagaaaggacatccacactaaaaccccatctgaacgtcaccattatcaaagaccaaaagtagataaaaccacaaagatggggagaaaccagagcagaaaagctgaaaaattctaaaaaccagagcacctcttctcctccaaaggaatgcagctccttgccagcaatagaacaaagctggaaggagaatgattttgacaagtggagagatgaaggcttcagacaatcaaaattctctgagctaaaggaggatgtccctttgaacccactgcaaagaagctaaaaaccttgaaaaacgattagatgaatggctaactagaataaccagtggagagaagttcttaaatgacctgatggatctgaaaaccatggcacaagaactatgtgacacaagtaggagcttcaatagccaattcaatcaactggaagaaagggtatcagtgattgaagatcaaacgaatgaaatgaagcgagaagacaagtttagagaaaaaagagtaaaaagaaatgaacaaagcctccaagaaatatgggactatgtgaaaagaccaaatctacatctgattggtgtacctgaaagtgatggggagaatggaaccaagttggaaaacactctgcaggatattatccaggagaacttccccaacctagcaaggcaggccaatattcaaattcaggaaatacagagaatgccacaaagatactcctcgagaagagcaactccaagacacataattgtcagattcaccaaagttgaaatgaaggaaaaaatgttaaggacagccagagaaaaggtcgggttacccacaaagggaagcccatcagactaagagcagatctctcggcagaaactctacaagccagaggagagtcgaggtcgatattcaacattcttaaagaaaagaattttcaacccagaatttcatatccagccaaactaagcttcataagtgaaggagaaataaaatcctttacagacaatcaaatgctgagagattttgtcaccaccaggcctgccctacaagagttcctgaaggaagcactaaacatggaaaggaaaaactggtaccagccactgcaaacacatgctaagttgtaaagaccattgatgctaggaagaaactgcatcaactaatgagcaaaataaccagctaacatcataatgacaggatcaaattcacacacaatattaaccttatatgtaaatgggctaaatgctccaattaaaagacacagactggcaaattggataaagggtcaagacccatcagtgtgctgtattcaggagacccatctcatgtgcagagacacacataggctcaaaataaagggaaggtggaagatctaccaagcaaatggaaaacaaaaaaatagcaggggttgcaatcctagtctctgataaaacagaccttaaaccaacaaagatcaaaagagacaaagaaggccattacataatggtaaaggaatcaattcaacaagaagagctaactatcctaaatatatatacacccaatacaggagcacccagattcataaagcaagtccttagagacctaaaaagagacttagactcccacacaataataatgggagactttaacaccccactgtcaacattagatagatcaacaagacagaaagttaacaaggatatccaggaattgaatgcagctctgcaccaagccgacctaatagacatccacagaactctccaacacaaatcaacagaatatacattcttctcagcaccacaccacacctattccaaaattgaccacataattggaagtaaagcactcctcagcaaatgtaaaagaacagaaattataacaaactatctctcagaccacagtgcaatcaaactagaactcaggattaagaaactcactcaaaaccactcaagaacaaggaaactgaacaacctgcttctgaatgactactgggtacataataaaatgaaggcagaaataaagatgttctttgaaaccaatgagaacaaagacacaacataccagaatctctaggacacatttaaagcagggtgtagagggaaatttatagcactaaatgcccacaagagaaagcaggaaagatctaaaattgacaccctaacatcacaattaaaagaactagagaagcaacagcaaacacattcaaaagctagcagaaggcaagaaataactcagatcagagcagaactgaaggagatagagacacaaaaaatgcttcaaaaaatcaatgaatccaggagctggttttttgaaaagatcaacaaaattgatagaccattagcaagactaataaaaaggaaaagagagacaaatcaaatagttgcaataaaaaatgataaaggggttatcaccaccgatcccacagaaaaacaaactaccatcacagaatactgtaaacaccctatgcaaataaactagaaaatctagaagaaatggataaattcctggacacatacaccctcccaagattaagctgggaagaagttgaatccctgaatagacgaataacaggctctgaaattgaggtaataattaatagcttaccaacgaaaaaaggtccaggaccagaaagattcacagccaaattctaccagaggtataaggaggaatggtaccattccttctgaaactattccaatctatagaaaaaagagggaatcctctctaactcattttatgaggcctgcatcatcctgataccaaagcctggcagagacacaacaaaaaaagataattttggaccatcatccctgatgaacatcgatgcaaaaatcctcaataagataccagcaaaccgaatccagcagcacatcaaaaagcttatcccattggtagaaagctgaaactggatcccttccttacaccttatacaaaaattaattcaagatggattaaagacttaaatgttagacctaaaactataaaaaccctagaagaaaacctaggcaataccattcaggacataggcaagtgcaaggacttcatgtctcaaacaccaaaagcaatggcaacaaaagccaaaattgacaaatgggatctaattaaactaaagagcttctgcaaagcaaaagaaactaccatcagagtgaataggcaacctaccgaatgggagaaaagttttgcaatctactcatctgacacagggctaatacacagaatctgcaaataactcaaacaaatttacaagaaaaaaacaaccccatcgaaaagtgggtgaaggatataaacagacacttctcaaaagaagacatttatacagccaacagacacatgaaaaaatgctcatcatcactggccatcagagaaatgcaactcaaagccgcaatgagatatcatctcacaccagttagaatggcaatcattaaaaagtcaggaaacaacaggtgctggagagaatgtgagaaataggaacacttttacactgttggtgggactgtaaactagttcaaccattgtggaagactgtgtggcgattcctcagggatctagaactagaaataccatttgacccagccatcccattactgggtatatacccaaaggattataaatcatgctgccataaagacacatgcacatgtatgtttattgtggcattattcacaatagcaaagacttggaaccaaaccaaatgtccatcaatgatagactggattaagaagatgtggcacatatacaccatagaatactatgcagccataaaaggggatgagttcatgtcctttgtagggacgtggatgaagctggaagccatcattctcagcaaactatcgcaaggacagaaaaccaaacaccacatgttctcactcgtaggtgggaattgaacaatgagaacacttcgacatgagaaggggaacatcacacaaccagggcctgttgtggggtgggggtaggggggagggatagcattaggagatatacctaatgtaaatgacgagttaatgggtgcagcacaccaacatcgcttatgcatacatatgtaacaaacctgcacattgtgcacatataccctagaacttaaagtataattaagtaaaaatacagaaaaagaaggataaaaaaagcttatccaccatgatcaagtgggcttcatccctgggatgcaaggctggttcaacaaaggaaaatcaataaacataatccagcatataaacagaaccaaagacaaaaaccacatgattatttcaatagatgtagaaaagtcctttgacaaaatccagcagcccttcatgctaaaaactctcaataaattaggtattgatggggcatatctcaaaataataagagctatttatgacaaacccacagccaatatcatactgaatgggcacaaactggaagcattccctttgaaaactggcacaagacagggatgccctctctcaccactcctattcaacatagtgttggaagttctggacagggcaatcaggcaggagaaagaaataaagggaattcaattaggaaaagaggaagtcaaattgtccctgtttgcagatgacatgactgtatatttagaaaaccccattgtctcagcccaaaatctctttaagctgatgagcagcttcagcaaagtctcaggatacaaaatcaatgtgcaaagatcacaagcattcctatacaccaataacagacaaacagagagccaaatcatgagtgaactcccattcacaactgcttcaaagagaataaaatacctaggaatccaacttacaagggatgtgaaggacctcttcaaggagaactacaaaccactgctcaacgaaataaaacaggacacaaacaaatggaagaatatgccatgctcatggataggaagaatcaatatcatgaaaatgaccatactgtccaaggtaatttatagattcaataccatccccatcaagctaccaatgactttcttcacagaattggaaaaaactattttaaagctcatatggaaccataaaagagcctgcattgctaagacaatcctaaacaaaaaagaacaaagctggaggtatcatgctacctgacttcaaactatactacaaggctacagtaaccaaaacagcgtggtactggtaccaaaacagagatatagaccaatggaacagaacagagccctcagaaataataccacacatctacaaccatctgatctttgacaaacctgacaaaaataagaaatggggaaaggattccctatttaataaatggtgttgggaaaactggctagccataggtagaaagctgaaactggatcccttccttacaccttatacaaaaattaattcaagatggattaaagacttaaatgttagacataaaaccataaaaaccctagaagaaaacctaggcaataccattcaggacataggcatgggcaacgacttcatgtctaaaacaccaaaagcaatggcaacaaaagccaaaattgacaaatgggatctaactaaactaaagagcttccacacagcagaagaaactaccatcagagtgaacaggcaacctagttcaaccattgtggaagacagtgtggtgattcctcaaggatctagaactagaaataccatttgacccagccatctcattactgggtatatacccaaaggattataaatcatgctgctataaagacacatgcacacatatgtttattgtggcactattcacaatagcaaagacttggaaccaacccaaatgtccactggattaagaaaatgtggcacatatacaccatggaatactatgcagccataaaagaggatgagttcatgtcctttgtagggacatggatgaaggtggaaaccatcattgtcagcaaactatcacaagggaagaaaaccaaacaccacatgttctcactcataggtgggaattgaacagtgagaacacttcaacaagggaaggggaacatcacacactggggcctgtggtgcggtgggggagggggaaggatagcattaggagatatacctgatgtaaatgatgagttaatgggtccagcacaccaacatggcacatgtatacacatgtaacaaacctgcacattgtgcacatgtaccctagaacttaaagtataataataataattaataaataaataaatacacacacacacacacacacacaaaccagaaagcaacaacaacatcaatagaaaagacccctcaaaaatcccattcaaaagtcagcaacctcaaagactgaaggtagataagcccacaaaatgaaaaagaatcaatgcaaaaatgttgaaaactaaaaaagccagagtgcctcttttcctccgagtgaccacaacacctccccagcaagggcacagaactgggctgagtctgggatggctgaactgacagaaattggtttcagaaggtgtgtaataacgaatttcactcagcgaagggagcatgttctaatcaaatgccaagatgctaagaatcatgataaaacattacagaagctgataaccagaatagccagttgagagaggaacataaatgacctgatggaattgaaaaacacaacatgtgaacttcacattgcaatcccaagtatgaatagccgaatagaccaagccaagaaaagaatctcagagcttgaacaatatcattctgaaataaggcaggcagaaaagaaaacagaaaaaggaatgaaaaggaataaacaaaacctctgagaaatatgtgattatgtaaaatgactgaccctgtgactgattggggtacctgaaagagacagggagaatggaaccaagttgcaaaacactctgcaggatattgtccaggagaatttccccaacctagcaagacaggccaacattcaaattcaggaaattcagagaaccccaataagatactccatgagaagatcaaccccaagacacataatcgtcaggttcttgaagatggcaatgaaagaaaaaatgttaagggcagccagagagaaaggaaagtggaaaccttataagccagaagattttgggggacaatattcaacattcttaaagaaaagaatttccaactcagaatttcatatatggccaaactaagcttcataagggaaagagaaataagatccttttcagacaagcaaatgctgatgaaataagtcaccatcaggctgtgctttgcaagagttgctgaaggaagcactaaacatgaaagagaaaaactgttaccagccactacaaaagcatgctgaagtacacagaccagtgacacaaagaagcaaccacataaacaagtatgcaaaataaccaattatcatcatgatgataggatcaaattcacacataacaatattaatcttaaatgtaaataggctaaatgccccaattaaaagacacagaatgacaagctggataaagattcaagccccattggtatgctgtcttcaagagacccatctcatgtgcaaagacacacataagctcaaaataaagggatggaggaaaaattaccaagcaaatggaaaacagaaaaaagcaggggttgcaatcctagtttctgacaaaacagtgagaaatagacacttactatagatatgagtttgcctattctctgcccttttcatgatgctcttactccagatatggatttgccaaacctctgcccttttcatgatggaagaggtctgatataatcaaccagtcaccaggtagctggctgatcaccccgaggaatggtgccatatcaagggctcagtgttggtctctggtgctggcaaattgggcactcagctaatctccatccctgccaccatggccactttgtttatgggctcatggggtgatgacaggtgtggctggggaaagaggctgagtggtatccacagaacgggtcaccctatttaattgattattaaactcctcctctgctgatgtcacccattggtgagcgctcacatggaatacaaatatcttcacagtttttcaccactaagagaggcacatccacatacctcttccccaaacttctttgtcaccaatttttcaatcatgcttcctccctgaccacccagccaaaccattggctacagcccgtgaatcagtatataattgcacatctggccatttttccttccaagtaaggtgcacaaccaggtgcactgctcaaacttctacccactgggaagatttcccttcaccattgtccttcagggatgtcctagaaaggggctatagtgctgcagctgtacacttttgggtggtgcctgcatatcgtgcagaatcatctgtaaaccaggccctactcttctcttcctctatcaactgatcatagagaactccccatgaggccatcagtgcaggctggaggaaagaaggcagggtggcaggagtggagacccatgggcctttgagctacttcctcgtgtaacttacttgtgccttcaggaacttcttgagcctggtcacatatataccacttttatttgatgatggaatgctgctgtgcatgacccactttaaggctagattggtcagaaagcacccagttcatgataggtagttcaggtcacattcatgttgacttgatgacccatagtcaaacgttcagtttccaccaaagccgagtaacagtccaagagctgtctctcaaaaggagagtaattgtctacagaagatggcaggaccttgctccaaaatcctagaggcctctgctgttattcacctataggagcctaccaaaggctccaaacagcatccctatctgccactgacacctcaagcaccattggatccactgggtcatatggcccaagtggcagagcagcttgcacagcagcctagacctgttacagagccttctcctgttctggacaccactcaaaactggcagcctttcaggtcactcaataaatgggctggagtaacacacccaaatgaggaatgtgttgcctccaaaatccaaataggcccactaggcgttgtgtctctttcttggttgtaggaggggctaaatgcagcaactcacccttcactttagaaggaatatctcaataggccgcacaccactggaccccttgaaattttacagaggcagtagatccctgaattttagtcagatttatttcccatcctctggcacacaaatgtctcaccaataagtccagtgtgtttgctacttcttactcattggatccaattaacataatgtcatcaatgtaatggaccagtgtgatatctgtggaagcaaaaagctatcaagatctcttctaataagactatggcacaaagccagagagttgatacacccctgagataggacagtaaaggtatattgctggctttgccagctgaaggcaaattgcttctggtgggccttatgaacaggaagggagaaaagagcatttgccaagtcaatggctgcatacaaggtaccacgagatgtgttaatttgctcaagcaatgaaaccacatctggtacaggagatgcaattagagtcaccacttggctaagcttaagataatccactgtcattctttaagatccatctgtcttctgcacaggccaaataggagagttgaatggggacgtggtaggaatcaccaccactgggtctttcaggtccttggtggtggcactgatctctgcaatccctctagggaagtgatgttggtttttatttactatttttctaggtagaggcagctctaatggcttccatttggcctttcccaccataatagccctcaacctaccagtcagggagcctatgtgggggttctgcaggctgctaagtatgtctatgccaattatgcattctggcactggggaaatgaccatgggatgagtccagggaaccactgtaagtcagacctgagctaaaactccactaattacctgacctccataagcccctactttaactggaggaccacaatgatattttgggtcccctggaatcaatgtcgactcagagccagtgtccagtagtccctgaaatgtctgatcatttccctttccccagtggacagttactctagtaaaaggctggaggtctccttggggaaggatgggagaaagatcaatagcataaattgttgatagtgaagtggggcccttcctcaagaagacccaggcttcccttcattcaaggggttctgggtctgtaaactggctcaagtctggaagttgattgaggcgccatgattctctgtttcataattcaaattagtcttttgtccatttgacctggaagttttctgcttatataaattaagcaggaatggagaaggcttcctatcaatttcacatctaggaaccatgattaattagccagtgccagagtgctacatgagtcagattattctgattgctgttttgcttctgctgtccattacagtaactacacccaccttgcctttgatgctcgagtgccacaacttagcccctgccacctcagaatccaattattcccattgtatttaacttttgtagttgagtgactgtgattctcactgttagatatgacatacagagaatagcaattacagggctcttcaaagaggcaggtgctgccctcacaaatctatttcacaaagcactggtcaagggtatattttctgcaccctcccagctgggatgagtatgtctaaagtaactaatccactccaccatcccaatctccctaagcctgtggatcccttcctttacattaaagcaaggaagatcaggcatgtccagcttgctcacaatgggccatcttttaatccatgtttcagctaaccaagcaagtaaactattaaaaccttttttaacttcctgagctgcaacattaaaatcagaatctctatttagtgggcccaaatcaataaattcagcctgatccaactctatgtttctttcaccattatcctacacccttaatatccattcccatgactgttctccagatttctgcttatataaatttgaaaagtcaagcagttcttttctattgtaacacacctcctcatgggccacactctgaacctgacttctaggggcccaccagaactttagtctagttataggtcttgaagcaaacaggagtgttgggggtggctactgaggagaatcaacattatcttgcctcagacagcacagggtttatctactcagacaaaggaggaaaggctgatggcagcatgggtcacagagcggatgttgccactactgggaacagaagctgtttcttctggcaaaaaagacttatcagagtttacaagcttagtgtccccagcttcatcagggtcctcccacacatccccattccaaattgcagggtcccattcttttccaatcaatgccctcactttaacagtaaacccctggcaaggctgttcattcacctttcattgcaggttagccacttgtataagagcttgtgtcttttttcccacaatttcagctctttctctacaggagataagattcccactcagggcaatcttagcagatttgaggctcagtatccacttctgaagctgggagttagaatccctgagttcatcattttgtttcatcactttatccagtgaacttaggagcaaccaaccaacttcattatcttccttggttctccacatgtagtcaaaagtattatgtatagagtcactaaactccttgcatctcacaagcagtgaatcaggactgtcaaatgcatctattttgcataaccctctaaacagttcacaccaaggactatcggtgttctccatactattagaagtagagtcgttagcatttttgggtcaaatcatattagcagtcaactccacaaaccccaaaaccaatgaaagaactccatgcttaatattctgttcatctagaaccactcctggtaccaaaatctgtatcagtcagggctctctagagggacagaactaatatatatataaatggagtttattaagtagtattaacacacacgatcacaaggtcccacaataggccatctgcaaactgaggagcaaggaagccagtccaagtctcaaagctgaaaaacatggagttcaatgttcgagggcaggaggcatccagcacaggagaaagatgtaggctaggaggctaagccttttcacattttttttcctgctttacattctggcctcactgagagcttattagatggtgcccacccggattaagggtgggtctgcctttcccagcccactgacccaaatgttaatctcctttggcaacaccctcatagacatacctaggatcaatattttgcatccttcaatacggtcaagattggattgtgtctgagtatcagaatagggagtgtcaacttgattggattgtgattaaccatcacaccatctgacaaaggtctgatatccagagcctacatggaactcaaacaaaattacaagaaaaaaaaaaacccattaaaaagtcggcaaaagacatgaacagacacttctcaaatgaagacattcatgaggccaacaaatatatgaaaaaaagtccaacattcctgattattagagaaacacaaatcaaaaccacaatgagacaccatctcactccagtcagaatggtgattattaaaaagtcaagaaacaacaattgctggcaagattgtggagaaaaggaatgcttttatactgttggtggaagtataagttagttcaaccactgtggaagacagtgtggtgattcctcaaagacctagtgccagaaataccatttgacccagcaatcccagtactgagtatttacccaaaggaacataaatcattctattataaaaatacatgcacatgtatgttcattgcatcactattcacaatagcaaagatatggaatcaacccaaatgcccatcaatgataggctggataaggaaaatgtggcacaaatacaccatggaatactatgcaaccataaaaaggaatgagatcatgtcctttgcagggacatggatggagctggaagccgttatcctcagcaaactaatgcaagaacagaaaaccaaacaccacatttctcacttataaatggaagctgaacaatgagaacacatgaacacattgcaggggaacaacacacagtgaggcctgttgggagggggcacaaggaggagggagagcatctggaagaatagctagtgggtacttaacaacagggtgatgggttgatctgtgctgcaaataaccacagcacacatttacctgtgtaacaaacttaatcattacggaaatacaattaaaattacaatgagatacttcacacctgtcataatagtttttatcaaaaagataagagataacaagtattggggaggatatagaggaaaggaaccctgtacactgttagtaggaatgtaaattagtatagccattacggaaaacagtatggagcttcctcaaaaaactaaaaacagaattaccatatgatccagcagtctgggtatccacttctgggtatttctccaaaagagctgaaatcaatatgccgaagagacaactgcacccagtgttctttactagcactattcacaatagccaagttatggactcattctaagtgtccatgtacagatagatttttttgagacagggtcttgctctgttacccaggctgaagtgcagtgacaccatcatagctcactgcagcattgacctgcctggctcaagcaatccttcagtcttagcctcccaagtagctgggactacaggttgggccaccatgcctggcttagattttgttagtgtggtatatacacacaatgcaatgcgatactattcaaactttaaaaaagaagggaattctgtcatttgtgacaacatggatagaattggagaacatcatgctaactgaaataagtcaggcacagaaagataaatactgaatgaactcactcatatgtggaatctaaaatgattgaactcgtagagacagtagaatggtggttacagaggctgggggatgggaggaatggggagataatagtcaaaggatacaaaatctcagacgggaggaatatcttttttcattttttgagttctattgcacagcatagtgaatagttcataatagagtatcatacatttcaaaattgctaagagagtacatttcaagtgtttatcattaaaaatgctaaggatttgaggtgatgggtatgttaaccagcttcatttaattattctacattgttaataaactataatttcactttgtaccccataaatttatacaattgtaaattgtcaacttacagttaaaaggtacattttcctgtgctaaattttatctcaataaaaaagaaagtaggtgctaggtgggccagctcgggccaaggtgggggtctgacccagcagggcctcacaccagcgaggtcgctggcgccccacacgtctgcagggcctggcagaggagaagccacaagaccacaagatattggggtggacccctagcctgcgaccaaggcttagagaagcagcaagtacctggcaggactgtgtatgagccgcctccactcctagtgatcgcagatttggggtgctaaagacctggagtcatggtgttcctgacccctctagtggactctcaaggaggtctgctgattatgcaatggtagcagagttgcaaggaaacaggttttgaaccaatgaagctgtatttacttaaaaagacggaccacccatcatgtgacctacagcattcgtggacagatttacattgggttcattgtgccatcaggcatgcagtttcagccaagtttccctaagctctcagagggttgctttaacttttgaatctgagttgcaaagttcaataaataatggccctatggataagcacaaagtcaagagacagtgattgaacagaatttgtgaagggtgaaggtatccgctttcagaccgtgaacaggccctttgcaccccagcaccccccagcccccagtggcactgctggactgaggccactgcaccgtggagatgactatcctgaaaaacttagccaccgtggccttctgtgacacgcagtccacacaggagatccaagagtaggtttaaacgaagcggtaggcaccatgaggcaccacaccaccaccctcaacagggaggacttggagaggttaaaagccctgagagtgaccgtgcagataggcagcagctacgactatgagaacatcagggctgccagcaagctcaggatcgctgtgtgcagcatcctgtccatagcagtggaacagatagtcaattccacttccatctgtaccggaagaacaggtggctgtaccagacgctgcgggaagcgatgcgggtacagagtatggagcagatccgcgaggtcaactcgggaggagcctacatcttagggagatggtgggcctcatcggctgcaattgcagggggcaggcagttgctgttctatccaaggtctttggattgagtgtcatattttatgacccctacttgcaggatgggatagaatggttcctgggcctgcagaggacctacaccctgcaggatttgttgtatcagagacactgcgtctccttacactgtaatctcaatgaacatcaccaccacctctttgatggtgatggtgactttactataaagtagatgaggcaagaggcattccttgcaaatgtagcctggggcatcctgttggataagaaagccttagctcagggccctcaaggagggcaggaaaggagaggcagccctccaagtatatgaataggagcccttcagctgtgttcctggtccattgaaagatgcaccaaattctatctgtactccccacaccgcctggtatagtgagcaaacatcactagagacaaggaaggcagctgccaccaagatctgcgaagccttcacatcccagaaagcttaagaaactgtgtgaagggttgggcgtcatggcacagcccagtaatcccaacacttcgggaggccaaaatgggtagattacttgagctcaggagttccagaccaggctggccaacatggtgaaaccccgtctttacaaaatatacaaaaattagctgggcatgttggtgtgttctggtaatcccagctactccggaggctgaggcacaagaatcgtttgaatctggtaggcggaggttgcagtgagctgagattgcaccactaaaacaaaaaaaaaaaaaaaaaaagagagagaaaaaagaaagaaaactgtgaacaaggaattctttgtcacatgagctccttggtcagtaataaaccagcaagcaatttatctcgagctcaatggtgtgcatgcagatatcggccaaacacggtggatctggctccaggaggacttcctgccgccatgggagggatcatccctggaggcattccagtgattcacaatctccccaccgcggcacacccttcccaagctccctctcccaaccagcccataaaacatggggacaatcaagaacaccccaacgaggccaggcggtggctcacccctctaattccagcactttgggaggctgaggcaggcagatcactgaggaaagagttcgagaccagcctgaacaacatggcaaaaccctatctctaccaaaaacatacaaaaattagccgggtgtggtagcgggcgcctgtagtcccaggtactcgggaggccaaggcacgagaatcgcttgaacttgggaggcggaggttgcagatagcgccactgcactccagcctgggctacagagggagactctgtctcaaaaaaaattaaataacacctcaacaagcaattccagagaatgccgaaagataatcattcaaataaacttgagaccaacagacagtaaaaaattaatgaagagaaaaggaatttgatggtctttttaaactgattctggatatatgcatcattaatgttgcagtgttaaaactagctggaaagttgaagatgtcctctgcttacagaagagctgaaagactatgatgttatttgttaatgaccagctgctgttattgtatgttaagtttttcatctgtgcatcaaaccataaagaatagagatttttcctttatcagtcctttgggcacagcaggtcctgaacattccgctctaaaatgttacatcaagagtttcaaacatcaaaataaaaaatgttaggaggaaatccccattttaagactctagtcccttcaggctacagaggctgattatctctttttgctaataggaacattacattactacaaaatggagacaaaattgtttgcctgtgttagacgtctgcatgcataggattggagacagcacagactcctgtagagagaactgtctttcacatctgaacggcatactgagtgggcaagttggttttaagttcagtaaaaccttctgatgatggggaaaaatagtattaagtttcacaacctgtttttactcaaatatattttctcagtctcagatcctctgctattttattaagtggaaagtcattaactaaaagagttcaagaagataatgttgcatttccttatatctcagggaacactttttatgataacttgtcagattttctatgaacaaacccacttttttagacattgataaagtcttcttttcttcccatgacattttatacaagtacactccagatgtattagatatgactaattttaacaaatcctatcagatttgtatcaactagttacatgctttattcatagtctttgtgaatcattgcctttttgtttaaaaagatggcctattctgagcctttgtataagtatattcttgtttttgtgacgaaagaaaaactttaaaactgtcccaaatagaaaaataatggctatcagaagtatgttttgtttcagtgtgagttaccattactatatttgtttattgtaaaggtggacatttagcattcagtgcaattcacaataaaaaattttctgttaagttctgaaattcagttacatctcactaatgtaaaagttctctacttgagatgtttaaggcaactgcattgtcaattagccaatttccaacccttgttactccagggttctatctgcctaataccataaccagactcaagaacactgaaaattacctcatatgatagaaagataaattaaaaattaaaacctcacacaagtccatcattatcaaatcatgccatccttaagatataatagtgagttagagctaagtcaattcaaaaaacaaagttgctcaacttttagagttttgattttaatttaacccaaagcaaaattacctggctcaagggagggaagtgaaccttgaaactcttttgccaataaccaaacaattgtgacatttacaaagaggtgttgtaaaataatttacatcagccatttccataggttaagaactttaagttaatttcatggatcttcctttttaaatagcattaaacctttatactaaaaacaaaagtatgtttctacgttgtatttttatatcagcagcagcaagcaaaaaaatgttttcattttttgctgttattttttcagtggccagttctataatttattttttgttttttttaatttttttgttgaaaacaatgttttgttttgtttttgagatggaatcttgctctgtcgcccatactagaatgcaatggcgcgatcttagctcactgcaacctccgcctcaagcgattctcctgcctcagcctcctgagtagctgggattacaggcacccaccagctaatttttgtatttttagtagagatggtgtttcaccatcttggccaggctggtctcaaactcctgacctcgtgatccacctgccttggcctcccaaagtgctaggattacaggcatgagccaccacacccggcctgttttgttttgtttttgagacagggtctgctctgttgcccaggattgagtacagtggcaccatcatggctcactgcagccttgacttcctgggatcaatccgtgtttctccctcagcctcctgagtagctgggactgcaggcacatgccaccacacccagctaatttttgtagagatgaggtttttgcccaggctggtctctaactcctggacttaagcaatctgcctacctcagcttctcaaaatgttgagattacaggcgtgagcctggccaaaaatgaaatttttaaactgtcatttataatgtcaaaaaattatgtacccattaagctaagacattacatgcaaaaattctccaaaaaactataacactttattgagaggcatttgagaaaatgaataaacgaagggatataccaagtccattgattggaagactcaatactataaattctcaattcttattatagattgttaattctctccaaacttaccagtagattcggtgcaacttcaatcaaaaccctaacaggctttttttcttttcctttttgttttattttaatttgggttttgagacagggtctcactctttcacccaggctggagtgcagtagtgccatcacagctcattgaagccttgacctcctggactgaagcgatcctcccacctcattctcccaagtagctgggactacaggaacccacaatcatgcctggctaattttttaatttttctgtagagacaggggtctcactatgttgcccagactggtctaaaactcctgggctcaagccatcctcccaccttggcatcccaaagtgctggaagtacaggcatgagccaccatgtctggcttttttcctttttgtaatatttgacaagctgactccaaaatgtatttgaaaatgcaaagacaagtaataggaggaggaggagaaaaaggaagaggaaaagaagaaagaaagttttactctaccagaaatcaagacttgttataaaactaagtaataggtgatagacacagtgacagaacagaatatgtggattcttgatttatgaaaatggcagcatagtctcttcaatgaatagtgctgggaaaattattaaatatgtatcattataaaaaatgaaatgggctgggtgtggtggctcacacctgtaatctcagcactttgggaggctgaggcgggcagttcacaaggtcaggagtttgagaccagcctggcctatatgatgaaaccctgtctctactaaaaagacaaaaattacccaggtttggtgacaggcccctgtaatcccagctactcaggaggctgaggcaggagaactgcttgaacccaggaggtggaggttgcagtgagctgagatcactccactgcactccagcctgggtgacagagtaatactccatctcaaaaaaaaaaaaaatgaaatggactactacgtgctaccatacacaaaaatcaccttcagatgtattataggccaaatataaaaggccaaattataaagtttttaataacatagaagaaaatcttaataattttaagaaagggaagaatttttttacataagctatgaaaagcattaaccataaagggaaagaagggcaaatttgattgtacttaaattaaaaatgtgtatatgtgtgtacgtgcatgtgtaccagggtaaatgcataattatttttatagcgtcattgttcccaacagccaaaagctagaaataacccacatgtgtatcaacagtaatataaagaaatttttatatgctcatacaatgaaatactgtataggaatgaaaattaataaacttgagatacatgaaacaacttagaaaaattctaaagacaaaatgctgatgtaaaaagtcagacacaaggacatacagactgaattattctatttctataaagtttgttatgggctgaattgtgccttccaaaattcacatgttgaagttccaacccccaatacctcagaatgtaaacatttttatcatgcctttactgctactcatacccatgctactctgctattttatcagattcaaagctgtcatccagaactcagattcaaccagttgcctctgttaattacacccaatgttggacataccttccatgcccattcatgtggatctagccaacctctttatccgcactattcttctgtgtccctggcccaggattccctggattgtctgtgaccctcggtctctcattcaaagttaacatttcctcaggtgatttctttgatgaatcctttccagattctaatcacatttgttaacctaatcagctgaatctaatcacaatcttctgtgatgactcatttaaatatgacagcacattgcttatcattatcgtgtgtgtatgtgttctgtctagcatcaaagtataggcttttatgtagcaggaatcataacttctaaatattttaccttttaaattttttaatgcttataaagcgtgaaaatcacatgtagttcttaggtatttaaacatctttcagatatcacgtttgtggcacaccgaaatatcagtgggagaaacaatcagccagtgacttacataagcagtgagaaccaatcagccactcaacgggtcatattctacctgtaccctattgatcaggaaacagccaatgaactcttaagggttgctgaggcacagaagagcttttaaacattctccaaaacagagttttgagggaagcaatattattaatcaaaacaggaaaagccttatagagctaaaaaaggatagctctaataatttattcagcagcatttataatcttctactatgtgtcaggcactttgccaagcacaaggaaaagatagattaaaatatataacatatacgttatgtgtatatatatgtataactacatatacataacatatatttacatatccctgccactaaaaaatatataatctgcatgaaacataatactttatttcaaacatattaagcttagcatttaaggtaagagcttagaaagataatcaaaggtaatattcatcttttatattatattctattttactgttttaaaagcatttcagtagtaccttgatccagtttgttttctcaccatacacctccacggaaatccagacacatatttctgcaatttctattttgcagcagaggaaatgacagttgaaaaatgtcagtctgattttctggcaagatagccgaataggaacagctccagtctgcagctcccagcaagattgatgcagaaagtaggtgatttctgcatttccaaatgaggtatctggttcatctcattgggactggttgggcagtgagtgcagcccaaggacagtgagctgaagcagggtagggggtcgctttacccaggaagcacaaggggtgggagaactccctctcctagccaagagaagccattagggactgtaccgtgcactctggcctagacacttttcccacagctttcgcaacccacagaccaggagattgcttccagtgcctacaacaccagggccctgggtttccagcacaaaattgggtggccatttgagcagacaccgagctggcctcagttttttttcataccccagtggcacatggaacaccagcaatacagaactgttcactcccctggaaagggggctgaagccagggagccaagtggtatgtcttagcgggtcccactcccacggagcacagcaaactaagatccactgccttgaaattctcatgccagcaccgcagtctaagctcaacctgggacactcgagattggtggggtgaagggtgtctgccattgctgaggcttgagtaggcggttttaccctcatagtgcaaacaaagctccaggaagtttgaactgggtggagccccctgcagctcagcaaggctgctacaaccaaactgcctctctagattccctcctctctgggtagggcgtctctgaaaaaaaggcagcagccccagccagggacttatagataaaaccaccacctctctgagacagagcacccgggggaaggtgcggtggtgggcacagcttcagcagccttaaacatacctacctggtagctctgaagagagcagtggatctcccagcacagcattcaagatctgagaagggacagcctgcttcttcaagtgggtcactgacccccgtgtatcctggctggaagacacctcccagtagggactgacagacatctcatacaggagagctctggctggcatctggcaggtgcccctctgggacaaagcttctagagggaaaaacaggcagcaatctttgctgttctgcagcctctgccagagatacccaggcaaacagggttgggagcagacctccagcaaactcctgcagacctgtagcagacgggcctgactgttagaaggaaaactaacaaaaaaggaatagtatcaacatcaataaaaaggacgtccactcagagaccccatccaaaggtcactgacttcaaagaccaaaggtagataattccacaaagatggggagaaatcagcgcaaaaacctgaaaattccaaaaaccagaatgcctcttctcctccaaagaatcagaactcctcaccagcaagggaacaaaactggatggagaagtagttcaatgaattgatggaagtaggcttcagaaggtaggtaataacaaactcctccaagctaaagaagcgtgttctaacccaatgcaaggaagctaagaaccttgaaaaaaggttagactaattgctaactagaataaccagtttagagaagaaaataaatgacctgatggagctgaaaaacagcacaagaacttcgtgaagcatacacaagtatcaatagttcaatcaatcaagcagaagaaaggatatcagagattgaagattaactcagtgaaataaagcaagaagacaaaattagagggaaaagagtgaaaagaaatgaacaaagcttccaagaaatatgggactatatgaaaagaccaaattgacatgtgatttgtgtacctgaaagtgatgggagaatggaaccaagttggaaacgctctccaggatattatccaggagaacttccccaacctagcaaggcaggccaacgttcaaattcaggaaatacaaggaccatgacaaagataatctgctagaacagcaaccccaagacacataatcatcagattcatcaaggttgaatgaagggaaaaatgttacgggcagccagagagaaagatcaggttacccacaaagggaagcccatcagactaacagcagatttctctgtagaaaacctacaagccagaagaaagtgggggccaatattcaacattcttaaagaaaagaattttcaacccagaatttcatacccagccaaactaggcttcgtaagtgaaggagaaataaaatcctttacagacatggaaaagctgaaagattttgtcaccaccaggcctgccctacaagagctcctgaaggaagcactaaacatggaaaggaacaaccggtgccacccactgcaaaaacatgccaaattgcaaagacaattgacgctatgaagaaactgcatcgactaacgggcaaaataaccagctaacatcataatgtcaggatcaaattcacacataaaaatattaacctaaaatgtaaatgggctaaatgtcccaattaaaagacacaactggcaaactggataaagagtcaagacccatcagtgtgctgcatgcaggagacccatctcacatgcaaagacacacatagactcaaaataaagagatggaggaatatttaccaagcaaatggaaagtaaaaaaaaagggttgtaatcatggtctctgaaaaaacagactttaaaccagcaaagattaaaagaggcaaaaaagagcattacataatgttaaaaagatcaaagcaacgagaagagctaactatcccaaatatatatgcacccaatacaggagcacccagattaataaagcaagtccttacagacctacaaagagacttagtctcccacacaataataatgggagactttaacaccccacagtcaatattagatcaatgagacagaaggttaacaaggatatccaggacttgaactcagctctgcaccaagcagacctaatagacatctacagaactctccaccctaaatcaatagaatatacattcctctcagcaccacatcacacttattccaaaattgaccacatagttggaagtaaagcactcctcagcaaatgtaaaagaataggaatcaaaacaaactatctctcagaccacagtgtaatcaaatcagaactcaggattaagaaattcactcaaaactgcacaactacatggaaactgaacaacctgctcctgaatgactactcagtaaaaacgaaataaaggcagaaataaagacgttctttgaaaccaatgagaacaaacacacaacatgccagaatctggaacacacttaaagcagtgtgtagagagaaatttatagcattaaatgcccacaagagaaaggaggaaagatctaaaatcaacaccctaatatcacaattaaaagaactagagaagcaagagcaaacacattcaaaagctagcaaaaggcaagaaataactaagatcagagcagaactgagggagacagagacacaaaaaacccttcaaaaaatcaatgaaccaaggagctggtttttttaaaagatcaacaaaatttatagactactagcaagactaataaggaagaaaagagagaagaatcaaatagacgcaataaaaaatgataaaggggatattaccaaccactgatcccacggaaatacaaactactatcacagaatactatagacagctctttgcaaataaactagaaaatctagaagaaatggataaattcctggacacatacacccttccaagactaaaccaggaagaagttgaatctctgaatagaccaatactaggctctgaaattgaggcaataattaatagcctaccaaccaaaaaaagtccaggaccagacagattcacagccgaattctatcagaggtacaaagaggagctggcaccattccttctgaaactactccaatcaatagaaaaagagggaatcctccctaactcattttatgaggccagcatcatcccgataccaaagtctggcagagacacaacaaaaaaagagaattttagaccaatatccctgatgaacatcgatgcaaaaatcctcaataaaatactggcaaactgaattcagcagcacatcaaaaagcttatcaaccaggatcaagtcagcatcattcctgggatgcaaggctggttcaacatatgcaaatcaataaacataatccatcccataaacagaaccatcgacaaaaaccacagttatctcaaaagatgcagaaaaggcctttgacaaaattcaacagttcttcatgctaaaaactctcgataaactaggtattgatggaatgtatctcaaaataataagagctatttatgacaaacccacagccaataccatactgaatgtgcaaaaactggaagcattccccttgaaaaccagcacaaggcagggatgctgtctctcaccacccctattcaacatagtgttggaagttctggccagggcaatcaggcaagagaaataaatacagggtattcaattaggaaaagaggaagtcaaattgtccctgtttgcagatgacatgattgaatatttaggaaaccccatcatctccgcccaaaatctccttaagctgataagtaacttcagcaaagtctcaggatacaaaatcaatgtgcaaaaatcacaagcattcctatacaccaatagagagccaaatcatgagtgaactcccattcacaattgcttcaaagagaataaaatacctaggaatccaacttacaagggatgtgaaggacctcctcaaggagaactacaaaccactgctcaatgatataaaagaggacacaaacaaatggaagaaaattccatgctcatggataggaagaatcaatatcattaaaatggccatactgcccaaggtaatttatagattcaatgtcatccccatcaagctaccaatgactttcttcacagaattggaaaaaactattttaaagttcatatggaaccaaaaaagagcccacattgccaagacaatcctaagccaaaagaacaaagctggaggcatcattctacctgacttcaaagtatattacaaggctacagtaaccaaaacatcatggtactggtagcaaaacatcatggtactggtaccaaaacagatatatagaccaacggaacagaacataggccaaaaataacaccacacatctacaaccatctgatctttgacaaacctgataaaaacaagaaatagggaaaggactccttatttaataaatggtgctggtaaaactggttagccatatggagaaagctgaaattggatcccttccttataccttatacataaattaattcaggatggattaaagacttaaatgttagacctaaaaccagtaaaagcctagaagaggacctaggcaataccattcaggatacaggcatgggcaatgacttcatgactaaaacaactaaagcaatggcaacaaaagccaaaattgacaaatgggatctaactaaactaaacgacttctgcatagcaaaagaaactaccatcagagtgaacaggcaacctacaaaatgggagaaaatgtttgcaatctacctatctgacaaagggctaatatccaaaatctacgaagaacttaaacaaatttacaagaaaaaatcaaacaacctcatcaaaagtgggcaaaggatatgaacagacacttctcaaaagaagacatttatgcagccaacagacacatgaaaaaatgctcatcatcactggtcattagagaaatgcaaatcaaaaccacaatgagatgccatctcacaccagttagaatggcgatcattaaaaagtcaggaaacaacagatgctggagaggatgtggagaaataggaacacttttatactgttggtgggactgtaaactagttcaatcattgtggaagacagtgtggcgattcctcaaggatctagagctagaaatatcatttgacccagcaatcccattactgggtatatacccaaaggattataaatcttgcttctataaagacacatgcacacgtatgtttattgcagctctaatcacaatagcaaagacttggaatcaacccacatgtccatcaatgatagactggattaagataatgtggtacatatacaccatagaatactatgcagccataaaaaaggatgagttcatgtcctttgcaaggacatggatgaagctggaaactatcattctgagcaaactatcacaaggacagaaaaccaaacactgcatgttctcactcataggtgggaattgaacaatgagaacacttggacatagggtgggaaacatcacatccttgggcctgtcttggcatggaaagcagggggaaggatagcattaggagaaataccttaatgtaaatgacaagttaatgggtgcagcaaaccaacatggcatatgtatacctatgtaacaaacctgcatgttgtgcacatgtaccttagaacttaaagtataataaataaataaataaataagaaaacttacaatcatggtggaaggggaagcaggcacattttcacatggtagagcaggagataaagcaacagctggaggaagtgctacacacttttgcaacaaccagatctcatgagaactcactcactatcatgagaacagcatgcagtaaggctgcccccaagattcaatcacctcccaccagacccctcctgcaacactgtagattacaattcaacatgagatttgggtggggccacagagccaaataatttcattctgcctctagcccctcccaaatctcatgtccttctcacatttcaaaacacaatcatgccttcccaacagtcccccaaaatgttaactcattccagcattaactcaaaggtccaagtccaaagcatcatctgagacaaggcaagtcccttccacctatgagcctgtaaaatcaaaaacaaattagttacttccaagacataatggggatacaggcactggataaatgctcccattccaaaagggagaaatcagccaaaacaaaggggctacaggtcccatgcaagtccaaaacccagcagggcagtcattaaatcttaaagctccaaaataatctcctttgactccatgtctcacatccaggccacactgacacagggggtgggctcccaaggccctaggcagctctgcctctgtagctttgcatggtacagcccccttggctgctttcatggctggcactgagtgcctgcagcttttccaggtgcatggggcaagctgtcagtggatctaccattctggggtctggagaacagaggcccttttctcacagctccactaggcagccccagtggaaactctttgtgaaggctccaaccccacatttcccctccacccttccctagtagaggttccccatgaagactccacccctgcagcagacttctgcctggaaatccaggcatttccatacatcctctgaaatccaggcagaggctcccaagcttcaattcttgccctcagccaacccacagacttaacaccacatggaggctgccaaggtttgggacttgcaccctctgaagcaatggcctgagctgtactttggccccttttagccacagctggagctggagtcaccaagatgcatggcactgtcctgagatgtcccaaagctgcacagagcagtgaagccctggtctacaaaatcatttttccctcctagacctctaggcctgtaatgggaggggctgctgtgaaggtctctgaaatgccttggaggcattttccccattgtcttggctattatcatttggctcctctttacttatgcaagtttctgcaacaggcttgaattcctccccagaaatttctaccatatgatcaggctgcaaattttccgaacatctatgctctgcttcctttttaaatatgagttccagtctgggtgtggtggctcacacctataagcccagcacaatgggaggccaaggtgggcagattgcctaaggtcaggagtttgagaacagtctggccaacatggtgaaaccctgtctctactaaaattataaaaaaaataagccagaagtggtggcctacacctgtaatcccagctactcaggaggctgaggcaggggaattgtttgaaccagggaggtggaggttgcagtgagccaagatggcaccactgcactccagcctggttgacagagagagactccatctcaaaaaatatatatatgtatatatatatgtgtgtgtgtgtgtgtgtatatgtgtgtgtcatatatacacacacacagacacacacatatacacacacacacacacatatatatacacacacatatatatatattccagtttcagataatctctttgggcatgcatatgagtgtatgctgttagaagcagccaggtcccttcttgaatgctttcctgcttagaatcttcttatctccagctcctaataagttcctcatctccagctgagacctcctcagcctgaacttcattttccatatcactatcagcattttggtcacaaccattcaacaagtctctagaatggtccaaactttccttcatcttcctgccttcttctaagcctgccaaactgttccaaattctgttcattacccacttctgaagctgcttccacattttcaggtatctttgtagcaatgccccacttctctggtatcaattttctatgttagtctgtcctcacattgccataaagaactacctgaggccaggtgtggtggctcacgcctgtaatcccagcactttgggaggccgaggcaggcgtattacaaggtcaggagttcaagaccaccagggccaacatagtgaaacctcatctctactaaaaatacaaaaattagccaggcatggtggcgggcactggtagtcccagctacttgggaggctgaggcaggagaatcacttgaacctggtagtcagaggttgcagtgagccgagattgcaccactgcattccagcctgggtgacacagtgagactctatctcaaaaaaaaaaaaaaaaaaaaaaagaactacctgagactgggtaatttatgaagaaaagaggttaagttaactcatagttccgcaggctgtacaggaagcttggctgggaggcctcaggaaacacaatcacagcagaaggggaagcaagcacatcttcacactgtggagcaggagacagaaaaagagatgggggaggtgctccacacttttacgacaatgagatctcatgagaactcactcaccaaataagaacagcaagggcgaagtcagcctccatgatttaatcaccacccaccaggcccctcctccaacactggagattacaatttgacatgagatttgggtggggacacagagccaaagtgcacccatgctcatcacagcattaatcacaatagccacaatatggatgtatattattcaaccttaacaaagaaggaaattcataaaaaataataatactaatatactaaatataaatatttatgtatgaataaatatatttatatattatatattttcttatatacattattctattatatatatcataaatatatatttactatatattatgtttataatatcaacataatatatatttgtaaataaaaatatactaaaataatacaattaaaaataatacataataaaaacaaattatttaaaaagaaggaaatcctgccatttgccacaacatggataaacctagaggacattatgctaagtgaatagtgaatgaaataaatcagacacagatagaaaatactgcacgatttcacttatacatggaaacttaaaaaaaaaaaactcgaatacatagaaatagtagaaaggtggctgccaaaggtgagcgagagggagatggagaaatggaggtcaaaaagtacagaatttcagttatgtaagataaatagccctagagatataaagcacagcatgaggaatacagttaataatacatattgtattgtataccagaaattagcaaaaagagtagcttttaggtactttaccacatacaaacaaatgtaactggctaggtgtagtggttcactcctctaattccagtactttgggaggctgaggcaggaggattgcttgagtccatgagttcgagaccagcctggcaacctagtgagaccctcatctgtacaaaaaataaattttaaaaaaatagcaagcatagacatgcttgtagttctaactacttggtaggctgaggtgggaggatcacttgagcccaggagataagaagttgccatgaaccatgatcaggccactgcactccagcctgagacagagctagaccttgtccaaaaaaaaagtaaccatgtgagatgaatctgttaatttgcttggcggaaatcatttcactatgaacatgtatatgaaaacattatgttgtacaccttaaatatataaaatttaaaatgtatatgtaatagaagaatttaatattttcccttgctgttacaggtacagaagttagtaaattgttgttctttctcttttccacaggagtaacaaaataaataaaattgaaatcttgccctgtaaagtcaaaagactagaggaaatccaatttagaaccctgaaagtcagttttaatgaggaaattatgccacctcgtggtaatttagtatattgccacatataactgttttcaggatacagtattactaaattttgagattgttctccagcttgcaagtagaggacctcctatgatttcatgtcaacttacttgagggaaagaaaagtgttgcctattaaatgagatagttatgatctgatcttcgacgaacctgacaaaaacaagcaatggagacaggattcactaataaatggtactgggacaactggctaatcatatgcagaaaattgaaactggacccctttcttacactttacacaaaaattaactgaagatcacttaaagatttaaatgtaaaacccaaaactataaaaattctagaagaaaatctaggtcattggcacaggcaaatactttatgaagaaaataccaaaagcaatttcaacaaagacaaaaactgacaaatgggacctaactaaattaaggagcttctgcacagcaaaagaaactatcatcagagtgaacagacaacctacagaatgggagaaaattttgctatctatccatctaacataagtctaatatccagagtctacaaaagatttaaacaaatttacaagaaaaaaataaacaaccccattaaaaagtgggcaaaggacatgaacagacacttctcaaaagaagacattcatgtggccaacaaacatatgaaaaaaagctcagcatcaccgatcattagagaaatgcatatcaaaaccacaatgagatagcacctcacaccagtcagaatggcagttactaaaaagtcaaaaaacaacagatgctggtgaggttgcagagaaaaaagaacacttttacactgttggtgggagtgtaaattagttcaaccattgtggaagacagtctggtgattcctcaaagatctagaagcagaaataatatttgacccagcaatcccattactgggtatatacccagaggaatataaatcattctactataaagatacacacgcatgtatgctcattgcagcacatttcacaatagcaaagacatggaatcaacccaaatgcccatcaatgatagatcggataaagaaaatgtggtacctatacatcatggaatactatgcagccatagaaagaaatgaggtcatgtcctctgcaggaacatggatgaagctggaagctgttatcttcagcagaataacacaggaacagaaaaccaaacacctcatgttctcacttataagtgggagctgaacaatgagaacacatagacacacggggataacaacacacactggggcctgttgggggcaaggggagcattaggaagaatagctaatggatgctgggcttaatacctaggtgatggattgctctgtgtagcaaatcaccatagcacacatttacctatgtaacaaacctgcacatcctgtacatgtatcctggaacttaaaagttgaagaaaataaataaataaatgagacggttataatgaataaataaaatgtttgtatataattgaaccactactatcagtaacaggaaatcatttgagttagctaattccaaaataagggttgttcccaaatgaaacattataattcaatgtttggagttaaatttttatactggctgcagagagagactgaagtcactaacaaaatttttaccttcattgttcagtggaaaacaaaaggtctgaaggacacctcagaagccaagctcaccagtgaagccatttaactgggccttggtccaaacccatccaggcccaagtgagattcttgcaggcacagtaatgatgagattattagtgctgggcatggggcgggggtgggggcagttggtggagaatactgccttagctggaggcctaaacaggcagttaataggttattcagctaaaaattgctccaaggtaattttcttttaaagcaaaaagatctaaaaacaaagttgcagagaacaaagtaaaaaccaagcagtaactaataacagtgaaaatctggcaaaagatggcacaatctttatcatatctggtgatgaaaagagtcaaactctgtaaattatttgaagagattaattctgagccaaatatgagggacatgcccccgtgagacagccatcaggatgtcctaagaacatgttcccaaggtgttcagggtgcagcttggttttatatattttagggagacataggactttaatcaaatactttcaagaaatacattggtttggtccagaaaggcaggacaactcaaagtggtgggggcagtggggcagagcttccagcttataggtagatttaaaaatgttctggttgacaattggttgagtttatctgaagacctgagatcaatagaaaggaatgtctgggttaagataaaggattgtggagaccaaaattcttatttgcaaaggaagccttcaggtagtaaagggaataggttgtaaaatgtttcttatcagacttaaagtctgtgctgatgttaatgctggacaggtataatgaggcatgtcctacccccacttcccgtcatggcctgaaccagtctttcaggttaagttttaagagtgccctggctgaaaaggaagtccattcagatggttggggggacttagaatttatttctggtttacatatcattcccttaacataaaaataaaagcagctattagaaaagagttcaatgacttatgctgttatttaatagacattaatttttgaagcagaaaagcatattggttgtttaacttgaactctcacatgaagttttgcttaacagaagacctcataacaatttgtattaaaaagatttagcgtaagtaatgtgctttgaacagtacacagagtagctcaatacactatgcatacatggtagcaattatcattagactatcactatagtatgtttttcttgttgtctacaagcttgcctctgacaaaaaaaacaaacaaaaacaaaaaaaaaacagcataactcacaaaatgctgaggaaaacagaacaaaacaaaactactgccctttggatgattataactgcatgtgattcaaaatgctgcttcatatctcagtgacaaatctgaaaaggatgaaaatactaaccattatgagaatcatgaaacattaatgaaaaaggtgatatttaaattaagcattaaagaataggttgggttaacaaaataatgcacattgcttccaaagaccatttcaaatatctccaactggttttatatttccttgcatttgagaatcacaattctggagggaagtttgcataaacacctcacttctctctgtacccataaactttgccatgtaactttgcagtgtcctcccaccatgattctgggcttgcccctgtgactttctttagccatgggaaattagctgggatgcaagtagaggcttgaaaagtacttattcaatttcacttacttttgcgtctctgcctttgttatgagaagatcgtgtctgagctagctctttagtggcagaaggatgagaaaaccttctcagcagtctcctcaaccccattgagtctaaatcaactgaataccagctggccacagatgtgagtctaaccaaggccagctgagccaatcattcaagccctgcctagaccagctgaccacagccaactcacaaactcagaaataataagcattttaagccactgagctttgagggtggttttgtacctggcagtggctaactagtacattccataattactagggcattttgcttattttattcttgttccaacttcttagtcaaaaaatgacttttattctgatttataaatatgtttttgagatcaagatagctgactgaatgcccttgtttacttcttctccctcccaatatcttcttttaaatgacaaaataaatataaaaattaatctatggcagcatcgaaaatccaggaggtgaataataacagaccataaaattgagaaacttctagaagactaagtatatggaaataaattgccaacaaaatacaaccaacctaaatttcaaaacatcagatatgagaaaagagatttctttaaaaaataagagtttggcaaggtgtgggggctcactcctgtaatcttaacactttgggaggccaaggtaggcagatcacttaagcccaggaatttaagaccaacttgggcaacatggaaaaaccccctctttacaaaaaatactttaaaaaatatagctgggtgtagtggcacacacctatagtcccagctactcgggaggctgaggtggaggatcacttgcccaggaagtggaggtttcagtgtgccaagatggtgccactgcactccagcctgggtgacagagcaagactttgtcttaaaaagaaaaaaaaatctagttgggcatagtggcacatgcctgtggtcccagctacttgggaaggatcacttgagcccaggaggttgagactgcagtaggctatgatcatgccactgtactccagcctgggcaacagagcaaaacccaggctcaataaaataaaataaaataactggactactaaatttatttgtttatgcatgatgctctactatcactgttgtggttcaaatacaccttcaaagtcctctgaccataattccaatttgaggacaggtggaaaatatgtgtaacttcatgatgacaaaagctgggcaagcagaaaaaaatatagcatgtcttgttaagagggagactgttctaagtgtcaaagactacaggtacaagccctattatcatagatagttgtgtgataaccttcctgtgagtatcttcttgtcagcctcccccatctccaactgaatctttgacaatcaacttccaggcaaagatacaaataagacccacagacaggttcttcctactatatgatatagcagcatacttggagttagactaactaaaaagtgagggcacaattctccagactgcaagccttctgacaccaactataagttttgagtttcccaaaatcaccctcagattcaataacttgcttgcaagattcatagtactgaaagcttgtatattctcagtaaccagccaaaggaagagatgcatcgggtggagttgtggaggggtccaaatgaaataggagagttccttgacccccctctcaggacgtgcaacaggggtgtggctcacctgtttggtgctcaaatccttgacaggtgggggagcatgcagacagggaggtggagtacctagggtgagtgatgtggactccagccccatagtagtctctaggggtgggtgcctgcggccccagtgtcacaatgctcttttaaccttgccttcctcagatggcttaagtgttaaccagctcaatgggccctctgccttttcacaagagcagagggctagtgtgacagctttctgtatcctgagctcttgcccagtgtcctgaaagaattgggtcacacacgggcttgaaggatgaatgcagaggttttaatgagtggtggaggtggctctcagcaggatggatggggagctggaagtggggatggagtgggaagatgatcttcccctggagtttggtcatccagcagctgaacatctctcagactgcccccagccgaactcctctttgtgttcagacattccttctcttctttctctgctgtgccattctaccatttgcctccttatctccttgtctctttgtctcctcatctgcttctggagcctgaggttcggggtttatttgggtacaggatacaggggcaaggcaaaccaaaaggcaacttttggggcacaaaaacagaagtgcctgttctcagttagggccatgggtctccaggcttgagaatggggcctttgctggggaaacgcccttcttctacccagtatttccctgtctcctgtccacatcgcaaatgctgagctttccgttaacctctacccatggatccatagccagtgttacttcctcccagccacagtgggctacaatacctgtacaaggcaaagctcatcctactgtctatgtccaggggttttattcaggcttaatggttaattcattggccacaggttaaatgtaggcatcagctctcccttcttcccaggaggtcagtctgacatcatgggggcccaccattacacaccttattttattttgagatagggtgtcactccttcatccaggctagagtgcagtggtgccatcataactcactacagcctcaacctcctgggctcaagcaatcctcccacctcagcttcccaagtagctgggatcacaggcacacgctgccatgcctggctaatttttttttattattatttttagagatgggggtctcatcacatcagccaagttggtctccaactcgtgggctcaagctatcctcccacttcagcctcccaaagtgctgggattaggggcataaaccacagcactcaggccatgaatcaccttattagcactaactagccttgtggtctgaggggcccaccaagaataacaaagacattcctatcacttaggaaattccaatagcttagagattacctcctaggagccaagacaaaggccaggtctctccttggatgaggccagattctttaagaagaaacttctctgttgaccagaaaaggttctgtgattcttattggggaagtagggtaaatatatggtaaacaaaaggccaatataatgatctgcagtcatgagttaactgagggatatccttgttatctacaacaagtgataataatgtaaggaagaaaaaataattttctctaccattcatagttcttcactgggactccctgtaacaaaagataggttaacaggagaaaaggtttattaacatgtatattttcatatatacaagaaagacatgtaaggaataagtaattttttagagtacagagaaaaagagcatggggaaaaagcctggttaagatgagagagccaggaaaagcaccttacacaaaggtaagatttgttatctgagggcaccttctccatttagtcatccctctcttctttgtgcaaagaagatatccttactgaggagaggaaagatcacctcggccatcaagcagaccatctggaggcaaagccccttatctgaggaattcaagaagtaattacacttccctattatcttgtgaaaggaaaataaatctcaggaccccaaaatcacaagtcaagggaaaagtcaagcagggaactacaaacctgcctcccattttattccaaaataagatagctaaaaagataaaagagctacatacctccctcacaatttgcccacaaggaaattccttgtgggcctcaagatctttaccctaaaggagttctgttgaatttcactgacaacaaactgatagcttatcttcacaggtgcagcacagaaaatcatccctctgctatctgagacaaatgcatatctgattgcttcctctgccctactgtttatgtaaaaatacagattcattgagccatattaaattgtgtattctgtggaaggctgatcaaggactcaaaagaatgcaacattttgtctgttatttacttatgacctggaagcccccccatgccctcccctctttcaagttgtcccatctttcccatcccatctttcccaaccaaaccaatgtacatcttatacatattgattgatgatacatatatatatgtataaaatgtataaaagcaagctgtaacccaaacactttgggcacatgtcattaggacctcctgaggctgcatcacaggtgcatccttaatgctggccaaataaactttctaaattggttgagacccatctcagatattttgggtgcacaatctaaaacacgcttgtccagcccacagttcacaagctgcatgtggcctgggacaggtttgcatgcagcccaacacaaattcatgagctttcttaaaacactataagagattttttgtgatttttttaagctaatcagctatcattagtgttagtgtattttgtgtggcccaacacaattcttcttctaatgtggcccaaggcaggcaaaatattggacaacgctaatttaatatccgttatttctttcttttgcctgattgccctggccagaacttccaatactatgttgaataggagtggtaagagagggcctccttgtcttgtgccagttttcaaagggaatgtttccagtttttgcctattcagtatgatattagctgtgggtttgtcataaacagcgcttattattttgagatacgttccatcaatgcctagtttattgagagtttttagcatgaagaactgttgaattttgttgaagaccttttctgcatctattgagataatcatgtggtttttgtctttggttctctttatgggatggactacgtttattgatttgcgtattttcaaccagccttgcatcccagggaagaagccgacttgatcgtggtggataagtttttgatgtgctgctgaattcagtttgccagtattttattggggattttcgcatcaatgttcatcagggatactggcctgaaattttcctatttgttctgtctctgtcaggttttggtatcaggatgatgctggcctcataaaatgagttaggaagaatttcctctttttctattgtttggaatagttccagaaggaatggtaccagcccctttttgtacctctggtagaattcggctgtgaatctgtcaggtcctggatttttttgttggtaggctattaattactgccccaatttcagaatttgttattggtctattcagggattcgacttcttcctggtttaggaaaagaagaagtcaaattgtctctgtttgcagatgacatgattgtatatttagaaaaccccatcgtctcagcccaaaatctccttaagctgataagtaacttcagcaaagtctcaggatacaaaaccaatgtgcaaaaatcacaagcattcttatacaccaataacagacaaacagagagccaaatcatgagtgaactcccattcacaattgctacaaagagaataaaatacctaggaatccaacttaaaagggatgtgaaggaactcttcaaggagaactacaaaccactgctcaatgaaataagagagaacacaaataaatggaaatacattccatgctcatggataggaagaatcaatattgtgaaaatggccacactgtctaaagtaatttatagattcagtgctatccccatcaagctaacattgactttcttcacagaattggaaaaaactactttaaagttcatagggaaccaaaaaagagcccacattgccaagacaatcctaagcaaaatgaacaaagctggaggcatcacgctacctgacttcaaactacactacaaggcttcagtaaccaaaacagcatggtacttataccaaaacagatacatagaccaaaggaacataacggaggcctcagaaataacaccacacatctacaaccatctgatctttcacaaacctgacaaaaacaaacaatggggaaaggattccctatttaataaatggtgctgggaaaactggctagccatatgcagaaagctgagactggttcccttccttataccttatacaaaaattaactgaagatggattaaagatttaaacataagacctaaaaccataaaaagcctagaagaaaacctaggcaataccattcaggacataggcatgggcaaggacttcatgtctggaataccaaaagcaatggcaacaaaagccaaaatagacaaatggatctaattaaactaaagagcttctgcacagcaaaagaaaccaccatgagagtgaacaggcaacctacagaatgggagaaaatttttgcaatctatccatctgacaaagggctaatatccagaatctacaaggaacttaaacaaatttacaaaaaaaaaaaaaaaaaaacaaccccatcaaaaagtgggcaaaggatatgagaacagacacttctcaaaggaagccatttatgcagccaacaaacatatgaaaaaaagctcatcatcactggtcattagagaaatgcaaatcaaaaccacaatgagataacacctcataccagttagaatggtgatcattaaaaagtcaggaaacaacagatggtggagagggtgaggagaaataggaatgcttttacactgttggtgggagcgtaatttagttcaaccactgtggaagacaatgtggcgattcctcaaggatctagaactagaaataccatttgacccagcaatcccattactgggtatatatccaaaggattataaatcattctactataaagacacatgcacacgtatgtttactgtggcaccgttcacaatagcaaagacttggaaccaacccaaatgctcatcaatgatacactggattaagaaaatgtggcacatatacaccatggaatactgtgcagccataaaaaacgaagagttcatgtccctcgcagggacatggatgaagctggaaaccatcattttcagcaaattaacacaatagaaaaccaaacactgcatgttctcactcgtaagtgggagttgaacaatgagaacacatggacacggggaggggaacatcacacaccggggcctgttggtgggagggatagcattaggagaaatacctaatgtagatgacggattgacgggtgcagcaaaccaccatggcacatgtatacctatgtaacaaacctgcacatgctgcacatgtaccccagaacttaaagtataaaaatatatatatattggacacctctgactaaagccacatctggtatcaggcctctttcccaaaaatgtgtaagtaacaagaatttcaatacatctccagaatgcacgcatgttgaaacccattgtgcaaacttcgctgacatcaaggcaccaaaatgtctacacatgtaaccatttatcatgacctacattactaatatggtccaaagtatccttaagctcctgctttaaggtccataaatacccctacggaaaatccacaactgcacactcagtcctctcttgctgaagtgtcccagtacactctgctgcagtgttctttctaataaaactttccttttcaaacctatactattgttggtaaattcttttaccagcagggagccaaccagtcttcactgcccgggctttgacaccttgcctggcacttaaaagtggagatttcctgtgtaaatttatcttacaaatgggcaccttttcagaactactcctgcatctgcagtttcttaaaataagcagttcaaaataatcagttcatcaaagaggcatattttggggtggtatattatggtctcctgcagtcatagagactttggggtgatgtggcctgatcccaaacaatgactagattcataatacaaatattaaattactagtatgtcaagttacgttataaaatcattcccctttcataaagcaaaactttgtttatggaatttttgttttccagcaaggaaccaagaagactacttaacctctctagtagaatttcttagcctgggcaacatggcaagaccctgtctctacgaaaatttaaaaataaaaaaattggttgggtgtggtggcacacacctgtggtctcagctacttcagaggctgaggcaggaggatcacatgagccaaggaggttgagactatagtgagctatgtttgcactactgaactctagcccgggagacagtgagaccctctctcaaaaataataataataataataataataataataataataataataataatttcttgaggttttgaagaacgaataaataaaaggaaaatccttgaacatttgtaggggacagtattcccggcttattcaacattctcccctacctactttttccttcctaacagagtaataccaatgtaattcagttatccacccatttccccaggcagctaaataccttggtggaagctgatccaacccctacatccagggagcagcaaaacataattttgcatatattgccagagattgcctcaggaatttgacacaaagattcatgatgggaactctcatggcaagttttgagggagttatcttgttcctaggagagcaccaaaaatgtagtctctcttcatcctctggatgtggttgtttctgggtgtgatgcctggaaacacttgctaccagtatgagaatgaagctgccactgaagaaaagcatgatgagagctagaaatacctgcatgacatcactgaaccagagtcaaacagctctgaagcatgtccaaatgtaggctttctattgttacagtaggtagctagacaggcataagtggggcaggagagggttccccccacatcccaggtggccatcaggtgatgatcaggtggttaactgtctccataatataactggtcacagccaacaccagggaaaggcagtctcccaacatatacgaaacacctaagactagtgatcagcagcttcctgataagatctcaggagttgggcgagtaacctcaagcatgcacattaacaggcaaaacggcagagtttaactggtatattacctttcagaggcattccaccagaaaagcgatcctagatgccagatgtaggccagcatataaaaccctaaggccaaggtcaaatagtgcacttgacctccaagatgttcacttggccctcttccaagtgtactttacttcctttcatttcctgctctacaactttgtaataaactttcactcctcctctaatatttgcctgtctctcctttgccttatgcccctcaaattatttcttctcaagaggcaagaattgaggttgctgcagaaccgtatggattcaccaccagtaacatatttgggccaacaggaattgttctgggggttggtaagcaaaaggggaaaaaaccacatatgggggttgaacaccaccaaagaaggtgaggcatagagatttcttaccactagggaacatatctgagccacatggctattgtaacactattatgtgaagtagtaaattatccctttatttaattaatttatttatttttttgaaacagagtcttgttctgtcgcccaggttggagggcagtgatgcgatctcggctcactacaacttccgacccctgggttcaagcgattctcctgccttagcctcccaagtagctgggaatataggcatgcactagcatgcccagttaattttttatttttttattttttgagacagagtctcacgctgtcacccaggctggagggcagtggtgcaacctcggctcactgcaacctccacctcccaggttcaagcaattctcctgcctcagcttcccaaatagctgggactataggtgcccaccaccacgcccagttaatttttttatttttagtagagacaggatttcaccatgttggccaggttgatcttgaactcctgacctcagatgatccacccacttcggcctcccaaagtgctgggattaccgccaccgtgcctggactaatttttgtatttttagtagggatggggtttcaccatgttggccaggctggttttgaactcctgacctcaagtgacccacccgactcggcctcccgaagtgctggtattacaggcatgagccaccgaccctattgtttttattttattatccctgcctagagtaagtgctgaaatttccctattttttaaaccagcctgagttgaggctctcccaatcaaaatcatcttagttgataatagcaatgaatagaggagatgaagaaaaaaatctcatagaactccaacaaaaggaaaacctgagccacaaaactgaaaatataagtcatgagaaatctataaatcttcttgttaaaactaaaataatgctgtttataacagatgtaactaaagtactgaaaattaagaaatgaaaaaatatatttctgataaaaactaacaaagtgaaaatgggataacaatactactattaagcaaattaaaatgaataacattaacaaggcctgagagaactatggctagagattgttttgtcaattaaattatataacaattatgtgccttaaagcatctgacagcatgacttcaacatacaaaaagcaaaaaactgacaaaataaaaattttataaatccataatcatgataaaatatttttaaaacctccctcaaaattaagcagttcacataagaaatgatataaaggatttgaataagtttgaacgtgtgcgtgtgcatatgtgtgtgtgtgtgtagatcaggcaggcttggtccacatagaggatctctagaagagaaaaaaagatcagcagtgtttttggctgcttctgagtctggcatgacacatttaaactttgacaaacccctaatacatatagttttgtccacaggacatttgctgaattctgtggctacaaatgaaaaggtgagtagactggtggcctctaaaaagagtgaaatttcccataatctcaaattacttagaaaacaacattctactaagagtcctccacctcaagacacttgccagattttgaagctgcaggggaaccagaggctcaagagccaattagatcaaaacctctaaacggcaaaactaaattagtccttcagggataaggagccagagactcacaagactataaatcaaaagccaaggagaaccatgctcatagaagacataaactaggccgggcacggtggctcacgcctgtaatcccagtactttgggaggccgaggcaggcggatcacaaggtcaggagatcaagaccatcctggctaacacggtgaaaccccccatctactaaaaaatacataacattagccgggcgtggtggcgggtgcctgtagtcccagctacttgggaggctgacgcggaatggcatgaacccggaaggcggagcttgcggtgaaccaagatcgcgccactgcactccagcctgggcgacagagtgagactccgtctcaaaaaaacaaaaagagataaactagaggtgaactaagttttaccaagatttcaacatagcccaaacccaataaccctgatgggattgaagagaccaacccctcgtgattaatatgttgtttaaaaaaagagggaaaggaattaaaagataaacaatttcagctggtaatattacaaggaattaaataagcattctggaactcaacaatgcagcatctgaaattaagaactcgctgaatggattttaccaacaaactggaagattatataactccgttatatatgagactagaaaactcaagacaggtcaaaaatctcaaactgagcacagagaaaaaaaaataatgagaagactaaagtagtgaatgaaacatgtgggatatatccaaaagatctaaagttagaatctctgaaagaaaggagacagagaatggggtatgtggcaaacagacttgaagatggcctccgtgattcccacctcctttgttcacacctttctgtgacctcaaacgatcctgttggactgcatcattctttgttgtaaggggttgtcctgtgctttatgtttagcatctccagcatctacccactggattacaatagcactctacagttttaacaaccaaatgtctcctgatcttgacaaatgtcctctggaggacaaaatcacccaactgagaatcactgatctatactgggggaaaagaatcccatcagtggctgctcctgaagctggaggtggggcagggattgactaggctataacacaaggaaacaactggagataacagaaatgatctgtatctaggttttaccagtcattatacaaacatatatacatatgtaagtataaattataggtagcttatagacattttatatataagtaaaattacaagtaacttataaaaaactgtcaaaattcatgtaattgtacacttaaaatgcacttattgagggctggagggggtgatggtctcctatgacgtcagaacaggaggttgtctggggaggggacctctgagacttgagtcccacaactcaagactcaagcaggatttcaggacacagaagttcaggacagagcccaagggcccaggaagtaccgtggggtcttttggggcctgaatctatccctgactctggtgcccaaagaaagaaaagcttcaatgatgcgtccacctgcacatgagcaactgtttaaggatggagggtttgacccaagtgatggatgaaccagctctactttctctatacttcgcccattactaaaaagaccttaaaatgagcaaataccaggtatcagttgtgtacagaaatatggagtctttaacacatatatttctcaaaaataattaaccgagcagtcaaaacataagcacatagctacatatttattaaacaggaaaacatatatagagaaatttaccctcaataatcagaaaatatacattcttttcaagtacaactggaagcattcactaaattaactatgtactaggccacaaagatgcaacaatatactccaaaaagttaatatcatgcaaatcatgttctctgacaataatccaatatagaaagaaagcaatgatacaattttaaaagaatataccagcaaactaaatatctaagaaaaccttcagttaaaaggaaatcatgaaagaagttaaaaaacacaaaattaaataacaatgaaaacagtaccagtcaaaacttatgagaaaagtctaataaagcatttagggaaaaaattatatctttaaatatcttattacagaataaacatcgaaagcaaatcaagcatttaagatgttgcttattttatagcaaacacaaattaacaacgaagaaatgtttaagatgaaagcaggaatcaacgaaacatgtcagagatttaacaaaactaaaagctgattctgggagattaatataataggcagaactggcaaagctaaccaaaagaaaagcagagatgcaaaaaaataaaatggaagaaatgcaaaattgaacaattgccacattatgagaatggcaaaaattaggcaaatgaagtactggcaaggatgtgaggaaatgggtactcaactcagtcctgctggtaggggtgtaaactcacaatcgttctgaaaagtacataagtacttagtgaaatttaccagagaaattcttgcatagttctgtaagtgaataagttaaatgtggtggatacacactgaagaattaaatgtacacagagcaatatgaacaaatctccaaaatatagtagtgagtgaaaactaagtaacagcatggaacattagaggtagcacatcctacataccaagttgtcaaatatacaatccctgtacacctttattttttgagacagtctcactgtcacccaggctagaatgcaggggcacaatcttggctcactgcaacctgtcttctgggttcaagtgattctcatgcctcagccaccaaagtagctgggattacaggtatgtgtgccaccacatccagaaaactttttgttttagtggagacggggtttcaccatgttgaccagactagtttcaaactcctggcctcaagtgatccgttcgcctcggccttccaaaatgctgggattacaggcatgagccactgagcctgaccccaccccctttacatttttaaaaatgtctgaggtcctcaaataacttttacttatgaggattacattgatcgaagaaattggaactgaaagtttcggaatatacaagcacacattctattacccatcagtgatgtcatgacattatatagcttctgtaaaactccactgttcacttgtgaatatgaggaaaaggcaaataacatcatagtgccagtataaaaattttgatctcacatattccctgaaaaggatcttgaaggttcaataccacatcttgatagtgatcaagagatacattaacttccttttttctgtctgtgactcttggttagggcaaatttcaaatccattataatacatacattgcagcaacactgagtttcttataataggtactatccaaagctttcttttttttacatgtatcacttaatcctcacaaccacctgaggattaataccatttacctgtcttacagataaggaaaacaatcatttttcaattatgactatgcccccaaacactggtttggatggagccttcactggtatagagaatgaccttcttcccttagactagactctggctataataaaggatggtttaatcatcccctgaagcaatgcataagataatctgcaatgtatcttcacatactgtaccttatttgataggcaagagacccataaaggaagctgagcatggattatcagcttcatcacaaatctgaagaaactgacatttatgttatgttgccttacccaagttgggacatcagagcagcaactaaaatccaggtcttcttcctattacatgccgtaaaaggtattgtttctttccctcccctcaaaattttcagtcaaatgtcagcttttaggaagagccaatcactctgaactagaattgttctcttcacttaaaatttctcaagcctaacttctttttgggtcctacaaaccgggaaaatacctcagaattggaaccacatgtttacagtataagaaatgacacaagtgtgacttgggcaaaaagaggataactttccccttcagagaaataatccctttatccaaggcctggagattagtgtttgaggtagaataaaagcacagtaaaatgattctatggtttgaattttggctcttctgctcaagtactttctttggtagtatactaattaccactgaattactaattattaattattattaattactaataaaagtaaaatgtagtagtggtggtggtctctttgagttattgaacattaagtagcaaacattacattaagtactttatgtacactctttcacttaccatgtccttgagatgattatgactaaatttaataaatgtccttttgtgcactaacccatttaaaccccacatccttgagataggaataactattacttcccgcacttgcagaacagtttataactgctacagccaggccttagctactatgcaatattataaaactaagagtacaaaaacgaagaaatcatgaaagtcccttcagtacagccagaaaagaacacttctaattactcagagaaatacatgttgtgccagtcgctttatctcctttagcgagggaaatcttctaaggtcttcaatgacataatgtcactgaaactattccctcacacttaaataatgtacatgaagataaaattctaggctgtaattttcttccttcgacacactggaaattttactttttatcttactattaaaacatctgttatcggccaggtgcagtggctcacaccctgtaatcacagcactttgtgaggccgaggcaggcagatcacctgagttcaggagttcgaggctagcctggccaacatggcgaaaccccgtctctactaattaaaatacaaaaattctgggaatggtagtgggagcctgtaatcccagctacttgggaggctaaggctggagaactgcttgaacctgggaagcggagattgcagtgagccaacatcgtgccattgcactccagtctgggcgacaagagcagaactccatctgagaaaaaaaaaaaaatctattatctgatcaatgttcctttgtaggtgacctttctctgaaagatttctaagattgtttttgatgctcttatttgctctataatgcatacaggtatagggaatttcttgttttctgtttaacagttaacaaatgaggtctttttttttttttaagtaagaaacaaggtatcgctctgttgctagactggagtgcagtgacgcgatctcggccacatgatccactagcctcagcctcccaaactgctgggattacaggcaccactgcgcccggcctcatttatttctttaattctaggaaacagtattttttttaatccagtgtattcgcttggtttttctagctttattactgctttgtttccaacatgctgttatatagtggtgacaaaacaaacaagatgctcaatctcatggaaattatgaggcagacagattagcaacagtgggatattttgcaggggagagggagaccatacattctaggtgaaatgtgagctaagaccaaattagcaagcagctatcatgcacgtatctgagtgaggaacacagctaaacgtcaattccaaacaataacgaattgatcaatgatgaatttaatctcagagttgctggatgcctctcttcaggtctgctcagacctcaattttccaatcttgtcccccaagaaaaagattaaacctgtcttgtgctgagtagtgtaatattccagtacggcttctcttgcgccctagtgctagtacgaagagaaatcaatgaaaaatgtagaaacaagtttgagtacaataggaacaggaaaaagcaaagcttcttgccacgccatgctcccaaatgtgcctgtgtctgattctcagcactaactactcatgtgagacatctcaacttgataaaacattaaaatggatttttgtctcacaccattcaaatacccagacagaataattttagtgttcagtggcacttccaaatcctaactcaagtacagtaataaatggtagagacttaagagaggcaagatatacatgtaactgatctggtctcacgagggattctcttacgatgtatttcatctacagtaagagaaatcatcttattaacattccccaaacttcattacttaacacacctatcatagtttttgctatgcagaattaatccatggtaatacggattatgaaagtgaatcaccctgagatggggttattaactaaaagggcaaagagaagctaatgaaatgctaatgtggatggtaaagtggtggatatatactgggcgcagtggctcatgcctgtaatcccagcactttgggaggccaaggtgggtggatcacctgaggtcaggagttcgagactagcctgaccaacatggagaaacctcatctctactaaaaatacaaaactcgccgggcgtggtggcacatgcctgtaatgccacctactcggaagatggaggcaggagaatcgcttgaacctgggaggtggaagttgcaatgagccaagatcgcaccactgcactccagcctgggcagtaagagcgaaactccatctcaaaaaaaaaaaaaaaaaaaaaaaaaaaaagaggtggatacagacaaaaagtgtaaatcaagctagcgcttgcaagatgtttatattgtactgaaagaaaattgtgggctgggtgcggtagcttatgctattgggaggccaagacaggaagattgcttgaggccagaagttgcagccgccagaagttgcaacagtttgcaaacaaggctttaaaaaaatttaaaaaaacacctcaattctacaaaaaaatttaaaaattagccaggagtactggcacacgtttgcagtcccagctgctcagaaggctcagtgagaggatccctcaagcccaggagttggaggctgcagtgaattataatcacgctactgcctggatgacacagtgaagaaaaagaaaaaaaaaaactaaaaaactgccatatctgtgttatgactatactgttttacaaataacatttctttttaaaatgaaaaaagaaatgaaagagacctttctttgaccactttaattgtatgagttgtggtagacagtatttagcatgacaaccactcatatattattttaaaaatgtcctaaaataccttagagaagagcaacagttcacatgctactcttttagggtgctgtaagaaagacagtgaaggatatagaagaatttaaagtgctaagactcaggaagacataaaagatacagtgacatgcttgcagggccaatctataattaggctaaaggatatgtaagatttctaaaaaggacaataggaaaaattattaacaagttcatactgtctttagacctcatttatcctcaaactggaaactgtggaataagttttaagaatacatttcaaccaaatgtaaataaatttataaacatattctagactaatttaaatagaaattcagaatgaaataattctttgaaataaagactacggaacttaaaactatcagaagcacttaatgttcttaatgtaaaaattagggctttgtaggcttcttataaaatcttacctcaggccacgcagtggctcacgcttgtaatcccagcactttgggaggccgaggtgggcagatcacctgagatcagttcgggaccagtcaggccaagatggtgaaaccctgtctctactaaaaatacaaaaatcagttgggtgtggtggcatgcacctgtaatcccaactacccaggaggctgatgcaggagaatcgctggaccccgctcggaggcagaggctgcagtgagccgagatcacgccactacactgtagcctaggcgacagagcaagactccgtctcaaaaaaacaagacaaaaaaaaaacttatctaaaattgctaagactaaaaaaatcatataccattgctaagacattgatgaaagatttcatcacacgtttgcttggaaatgttcaagtaccacctttaccatacctcttaacaccttcaaaatatggaatagtgactcactaaagaaataaagccaaaaagtattttttatactttgatcaggttctcaaagataaggcctagtttaagaataatttttcatgtaagacaagacagggagtatttgtttctacatcatgaaatgagtccatctattcccctctgtcccttactaaaatctggaaactaaatgactgtaaaaaatgaaacaggtgttaaacacccccagacaataaaatagaagcaatggcaaagcaagattttgggaactgaaaaataaatggatcagtgttaactgactcaatagacaacagaaatgaaagtatcagtgttagatagaggttttcactaaaaaacccagaagtggttgaaagaagagtcaaacaccatggccccatacctccctgtaaagtaattaccactccccctcacagtgtaagaaatgtcacgactaactcactgaaaagggtgaatcagtctggaataggggaatccacatatagacagggtagagtattttactgaaaactgaggaagtctacattttgaacagtaaaatctctaatacactgtccctcctcctcaccccaaaagaaaactggcaaagtacatatactcacacaggacaagtgattagagaatttctctcagatatatatgtacatattctctctcatatacatatactgacaattgggtgaccctcaaataaatggtctagtgaaatcacactggagtaaaatccacctgttgagaaccctcatgcatggagcttagagagatttcttctagctcttaaatttgaggaacagtaaatgatcccaaggcatttgaagaagcatcaaaataaaagacagactaaactttaaaaagggaagaatcatttaatgaaacaagactatgcagatgggggaaagaaattttgttacgagttctaggcagaagtgctagtggtggtggctcatacatataataccaatgctttgggaagcaaacataggaggaccctctgagaacaggaattcaagacgagcctgggcaacatagcaagaccctgtctcaagaaattttttttttttttttaaattatctgggcatagtgtcacatgcctgtagccaagatattctgaaagctgagatgggaagatggcttgagcccagaaattcaagaatgtagtgagctatagttgcaccactgctctccaacctggacaacagcaagaccatgtctcattcaaacaaaaaaattctaggcagagaagggaccacacattcaaaagacaaaaccctccaagaaatcattctaaaaaatccccatgaattaaaagacagattttcagactgagctgattcaagagtaaaacaaaacaaaaataagatacacaacataaagatgggcatggtgtcacatgagtgtagtccacattacttgagtgacatagggggaaagataacttgaaaccaggaattcacaagtctgtgcaacatagcaggagtctctttaaaaatgaaaaaaaaaaagaaaaaaaaaaaagacccataccaagacacatcactgtgttattaatttagaatacaaaagacaaagaaacactggaagctcacattaacaaaaggctggttccccccaccttcaacagactggaaatcaaagcagcattcgggccaggtgcaggagctcacacctgtaatcccagccctttgggaggccaagccggggggaattgctggagcccaggagttcaggaccagcctgggcaacatggtgagaccctgtctccacaaaaaattaaaaatttagcagggcatttggtgcatggctgtggtccaaactaaattggtggctgaggcaggaggatcacttgagcccgggaggtcaaggctgcagtgagctgtattcatgcctaggtgacagaatgagaccctgtctcaaaaaaaaaaaaaaaaaaaaggaaccattaattttctctcccacaacactggaagttctgagacaacacaacaactttcgaaattctgagaagataataattcctactctaaaatcccaaaccagaactatccatcaaatataagaatccaacaaaaatacagccagatatgcgagttctcaaaaaattcatttcccttgaattcttttcttgggaaaacacaagacaacataatccatcaaagtgagcgagtaaaccaaggaggaaaaaaagttagatccagccaggcgcagtggctcacacctgtagtaccaacactttgggaggccgaggagggtggatcacctgaggtcaggagttcgagaccagcgtggccaacatggtgaaaccctgtccctactaaaaatacaaaaattagctgggcatggtggtgggcgcttgtaattctagctactcaggaggctgaggcaggagaatagtttaaacctgggagacagaggttgcagtgagccgagatcaagccattgcactccagcctgggcaacaagagtgaaactctgtcttaaaggaaaaaaaaagggggggggggggagacacaagacacagtaaacagtaattccaaaacatgaaacagccaacaggaatacccaggagtatggtaaaggaaggttccagatggaatcagttctacagtccaaactagaagaatgttccagggagtagaggtgatgggatatatttggagggggaggtttattactgaatcatgagatctgttttaatatactgaggggcttatatttccagagtgattagatataaattactggtaggtaaaaaacagttaagtattaacttcagggagaaaaaaaaagctgcacaagaatgaaaataaaatcacagcatattccatggcttatctaaagctttaataatacttacacagccataataaaagtaattattgagccaatcaaaagttatataactacactaaaaagatgtaagggatcattatttcatgttgaagtggtgagaggtggtaggaatgcaggcttttcaagaaggtatttctaagaatttttaagcatttgctcttaaatatgaggaacagtaaatgatcccaaggcatctgaagaaacatcaaaataaaacactaaactaaggggaaaatcaaatgaaacagactatgtggggggtggcggggggtgggggcagagacatgacgacttttatagaaagtaggctgggcgcattggctcaggcctgtaatcccagcacttagtccgaggcagatgatcagttgaggtgaggagttcgagaccagcctggccaacatggtgaaaccacgtttctactaaaaataagaaaattagccaggtgtggtggcgcacacttctagtcccagctactcgggaggccaaggaatgagaatcacttaaacccggggggcagatgttgcagtgagccaagatcacaccactgtacttcagcccaggtgacgaagtgaaactgtttataaaaaaaaaaaaaaaaaaagccagatgtggtggctcacgcctgcaatcccagcactttgggaggccaaggcgggcagatcacaaggtcaggagttggagaccagccttaccaacatggtgaaacccagtctctactaaaaatataaaaattagccaggcatggtggcatgcacctgtaaccccagctgctcaggaggctgaggtaggagaatcgcttgaacccgggacacagagattgcagtcagctgagattgcactactgcactccagcctgggcgacagtgcgagactcaaaaaaaggggaaaaaaaggaaagaaagaaaaagtacaggcaacaagatttcctttagaatcagacatgaaatatgagggaaggaagagaagaatgactctaagatttttggtttaaataactggaagaataaagttgtcatttattgaactaaggaaaatgcaaaagaagtaaatttggattaaacaagatgaaaagtacagatatagttatcaagcacctagtaaacagtcggatatgtgaatctggaattcaggagaaaggttctggctggagatataaatttgagtcaccagcacagttcccattaaagaaatgaagaccatcaagggaatcccaaactaggcttaggatatttcaatgtttagaggatagaaaaggaaacagcaaaggaaactgagaaaagagtcagagaaataggaagaaaaagcaggaaaatatgtttcctagaagccaaataaagtaaatgttttaatggagaagagtcaacaactgtatgaaatgctgctaatagatcaagtaaaatgaggtcactgacgtcacgagaccttaaaaataccagctccaatggaaatgaatatctgattggaatgggttcagaaaaaacagaacaaactaaaaacaatgaatacaggcaaggagttttgctataatagaactctttttcaaggagctttgttataaaagaaatgagacattgcaattggctcaagctacgacaaacaatatatccgcagtatataataaagggcagatggggacagatgggcacagatgctaggtttacagatgcaacggtgacaacttttaaagattcttttctgactgcgtctattttctcagggcaatagggagcaaagtgagagggaggagatatgagacgtgcaatgacagagtaaaactatgaaaccagtcatttaggacaatgtaacaggaaagactgggtcactaaggacaagatcacgagtttcaagcaagcctaggtcagcatgcttatgtaatgggttaacattttgacttaaaaaacaaataaacctgctctatagtcttttatttaaccaaatgttctatctgaagtttttcttcaccaccaaagaacttatccatgtaaccaaaacccacctgtacctcaaaacgattaaaataaaaatttaaaagaaaagacctgtgccaataggacacagggaaaaaaaattaagtttttcttaagtgacggttccattatccttaacagatcatctgatctgcatttgaatatacatggcaacagcaatatttttccatgaaataaacactaacacagaaatgtatggcttatggagtatgtcccctctccagggtacattcaggatttctcttcctcattgtctgatatcctttcacacagggtctaaattgtgcctcttttggcctttatgctgttctattacagattgtgcattacttacatattcctaaggcctattctcttatatttggttctagttaacccactactataaattttcagggtctgtcttgttttgcatgatacactaccatttccaatttctagtcgtttctcaagaccctaaagtttcattcagaaacttctcttgtgctaacacaatgtccacttgaaatctctatatgacacactcctatagtactagtgaatgaaaccaagaaaacaaaataaccaaatcctaccgacagccaagtcttttgctattattgcacctaagctattcctgaagaaataatttaatgagatcatcttataaggaacatttatttggtaaactatctcatagaaatagactctaaaatcaaacagtttcttaaacaacagagagcataatcccaatctctccccatgaaaagcctacttcataactgaagtacctaaagcccatgaactgcattactagaagaaaggagggaaaaagacatttactaaacttccacaggaagactgtataaatctggaagtggttaagtacacatcagcctgtatccaagaatactactcagtctcaaaaattaactgaaaatctaaacttaatatggatacttctttgttcttggtaaggctcagaaaattaccatctatttaagtacgcatggtactagttacatgtcaactgatataataaaaaaggtgaagtggacaatcagtatttcaaacccaatacagggaaatcactagatgtaaataagaacttttaaaagctattcttgagctccactttaaaacaaacattcaggactggaatcttcagaattttctaatatcttgaatatccccatcttctctttaattggtcctgaagcattcatttgatctaagggaaaaacattaaaacaggtacattttagaagtataagaagaagaaatcgtaaaagaaacatccaatatgatgttatgagaagtgagtcatctgtccaaaattataaaactcacagtaatacagggcactctcttccttaatcaccaagatttaatagcagtgaaagcaaaaaggtacactattcttaatacaacaactagaatcagactcttgggagcatacaatctaaagcatcagtttgctagtcaaaatcgcttttgctgaatttaaggtaagataaacaagtcaaagagcaataaataatatcaatttgaatcatgttgtcagaaacgttttaaaaagaggcccaatcacgattcgtttaatagctgaaaacacaccacaaaaagcttaccttgagaaacattttgaatcaatgacaatatgtagtctcctaaatttttatcaacatgacagctgtgaaatgaaatctgattttcatttgtattactgatttctaatcatccttgtctgttcatcagacatttctttctctcttggtaatagcctgctcttatattatccgttttcattatcaacttttatttacttgcatatcctaaacacttcctgttatatgttgcaaatattatttgtggtttgtctcttatctctttatggtgtcatctgtcttatagtagtctttcctattaatgtaattaaaatctatgaaacctatcatataatttgtgatttctgtattataaagaattctaattctaaaatcataaatatattttcttgtctttttaggttaaaattctacctttaatatttaggttttgaacacgtggattgttaatttatctgaagtttgtaagtgcagtgtgaggagaggagaatctaagttaatttttcccctattaattactatttccccagatcatctattgattaataggaatttcctatcagttgtttgaagttccatttcacatttattagcttttcgtgaaagttgtctttctagattcaccatattgtacttctagccaatatatcacaccatgtgctaattctaccatcttgattattatgacttttaaatttttaataagactttatacctggtatagaatatcttgtgcttcaaaactgtcttggttctggccctttattactctctcatataaattttaacaacagtctgttttacaaaaagtcattctgggatttttttttttttttttaagagacagagtctcgctctgtcacccaggctggagtgcagtggcacaatctccattcactgcaacctccacctgccaggttctagcaattctcctgcctcagccttctgagtagctgggattataggcacatgcctccatgccccgctaattttttctattttagtagagacagggtttcaccgtgttgcccaggctggtctctaactcctgagctcaggcaatccacctgcctcagcctcccaaagtgataggattataggcatgagccaccacacccagccatcattctgggattttaattagaagaaaaattcaagaatataagttagttttggggaccactgacttacactttgtagtaaccattcatatccacaaatacagctaaatctgcatgtttactcagtctttctattaacgtccttcaatgtttcataattctgtccttatataaacatgttaaaaattgttaaactttaattgtaggcatgttaattttgtagctgttgtaaaaaccttcattattaaacaattattgctgttacacatattattaataagcaatcttcttaaattctattttaaaagattctggattcccttggacttcctatgaagataatcaaaccagaccacttgcaaataaaagcagtttcgataatgccagcactttaggaggatgaggcagacagatcacttgagcccaggagtgtgagaccagcttgagcaacatggcaaacccctgtctctacaaaatacacaaaacaaaattagcaggacatagtaatcacacctgcagtcccagcaacttgggaggctgaggtgtggggattgattgagcccagcaggttaaagctgcagtgagccatgatcacaccactgaactccagcctcggtgacagaacgagactttgtctcaaataaaaaaaaattatgaagatgattacgatattatggcaagttggtttttggtatctaattaggtgatcatctagttctccattatttaattgatatgaattatattatcagatgttaaacagtccttacatgcctcacataatgttgttttttaatatagtttagatttgaccatgatgctgtatgtctcatatttctccctaaactatttcaaagttaaaactcaaataaacatgcaaataatccagaatatctaaaacaattttgaaaaagaacaaaactagagaaagtacacttcccataaagctaccttaattaaatcagtgcgatactggcataggaataccacagagatcaatgggacagaattgagaatacagaaataaatccttatatttatgatcaaattatttgcatcaaggatgacaaggccatccaatagaaaaaggatcatctttttaacaaattaatattgacatgcaaaaagatgaaaattcattgaaaatagatcatagatctaaatgtaagagcaaaaactataaaactattaaaagaaaatatcaacaccttgaattaggcaaagagtagttacagatgacataaaaatcatgagtgaacagaaaaaaatttgttaaaattgaaattcattaaaatttaaaacttttgctcttcagaagatactaagtaagtaagtgaagagacaggccagagtagaagaaaatgtttggaaaatacatctgattaaaaaaaaaaaaaaaaaaacttccaaccaatatattttattttgattcaataagacacagaattgaattttaaaatgaacaacatatttgaaaataagatatcatgacactgtagccagtgccacgcaggtaaatgtttaacaattgggtctcaaaaaaaacaaaaactgaggcacaatggctcatgcctataatcccagcttactccaaaggctgaggctggaggatcccttgagcccaggacttttaggctgcaatgagctatagtcgcactcctgcattctagccaggaatacaaagcaagacccttttttgttaaaaacaaagactggggtttctagtttctgcctgtatccgtgatatgaatgttactgccatcaccaatttcaaaagaccaaaatgtcacggaatacagttgggaaaaaaagattatacagtatctccaccatacagatgcaacagacaaataatcaatagcctagacgacagtaatatgttgtaaaataattaggaaattatgaagtacaaaatattatttttgttttcaaaataattcatggtcatcactgtaggcatcagatcataaggtggtattctaaaaactgataaaaaaaaaaaaaagaagcaatatatcctggctctcttctatctcagggaaactgtaagggaaagttcttaaataacccagctaataaaagaatgacagaacaagaaaaatcaccattttgcaatgattaagttaataatggttcttatcagccactttcaagggatactaaaaatcaccacgttaggcttggtgcagtggctcatgcctgtaatcccagtgctttgggaggctggggtgggcacaacacctgaaatcaggagttcaagaccagcctggccaacatggcgaaaccctgtctctactaaagatacaaaaattagccaggtgtggtggcaggcgactgtaatactagctactagggaggctgaggcaggagaatcccttgaacccaggaggctgaggttgcagtgagctgagatcgtgtcagcgcactccagcctgggcgacagggcaagactctgtctccaaaaaaataaaataaaataaaataaatcatcgtgttaagtaaaggatgaaggctgacaagacactttataacattatcttgattaatcttagctcactggaaataagaaatccagatacgatgtgcctcctggtatgacgaaaaatatgagaacaaagcactggtattcttaactaagacaggaacttgaatatattcatttacaagtgttatttaccagtttacagaaaatatctgaattatggaagaagttaaagataatgacatttatgggcaaaatgtcatgtctgagatttgattttaatactctaagaagaaaaatgacaataaaacaagattggatacatgtggctgaatgaattgcacaaggggttcattacattatgctaattaagtgtatgtttcgaagcttccattaaaaaaaagcataatacttaccaataagatcacttcgatctaacaacaactctagatctttatcactaatgaccttctctcttgatccttttatttccctatagaaaacaaaatattcaagtctatgtgaataattcaaagctacaaattaaatctttctaaaattaaaaactcacctttcataatctctagattttaataattccattaattccttaggatctaagaaattcttagacagatttaatccagactgaccacctttgaaatgatctaaaaaaaatgagaaattaaaaacattaaaattccttttaaaactacaatacaacatattacaaaccaatcacaatggcttgcattaagaaggacggcaaaaaaaagtgttgataaaaaataaaagcaaatgaagctctcaggcttcgctggtaggactggaaaatgatatgtccactttggaaaaggctggtagtttccagtagttaaacacgcaccctccctaagatcaaggaccaaaaaatgcattatgtccacaaagacttgtacaggaccaacttattcataataaccagaatctagaaataatttaaatgtcgaccaacaggagaatggaaaaaacaaactattcaccaattaaaagaaaaaaattctactaaaaacaacacagatgactctgtgttgaaaaaatatattcaacaaaatagctaaacagaaaaaagactcatcagtgtgacaaaaatcagaatactggatgcttcctagtgatggtaaggggagcataggaattactggaaagggtgaacaaagaaaatttcttggatgatgaaaatgctaccttgatctcgatgatagttacataggagtacataaatctggtcaaacttcattaacctgtacatttaagatctgtgcattttgctgtatgtatgtaataactcaactgaaaaatgtcagcatttaaaaaaatcccttcaaaattttctacaaaattaatctactaaaaaatcgaaaatagggctgagcacagtggctcacacctataagcccaacacttgaagaggctaaggcaggaggatcacttgagtccaggtgttcgagaacaacctgggtaaaaaagttaaatggtctcttaaaaaaaaattatgctttttccccaatgcaagttccaattacaatctaaatgtttcaccaaattaattttgtctaaaccttaatacactcttacctcaaaacccagagaaagtatttacaagtggaaaaggagtataaaataaattattagtgatttccaacattacttttcacattaacattatcatgttcccatttctctagggcttgatgatttacataaatgattttcaacatttcttcaggtagctatcaagccatttattcaaagaaaattttatggtgaatggatagaagtataacttctctaaggaatctcaggaacaaaactttttcacctatgtcagttccccacctcctcagaattttttctagattaaaaagcattgttgagacccatctggttatgataaggaaatgaaaaaggaaaaaaaagtgtccaaaactataaaaagggcattctgcagtgaaatattctgtgaaacagtgggttcaataaataaatagattttttataacacttaaatacacttaatattttaatacatggaacttgcaaaatatttatcttaaaacttttagcaagccaatctcttatcaggaacatgtagttatccttgaccccttttctctgcccatctgctcttcatctacatatctacatactcgctaacattctttcttttatgtctatggtgaccaacttagtttaggctcccaaattccccactgcttatttaaatcctgtcatatcaggctgttaatatttttttttttgagacagagtcttgttctgttacccaggctagagtgcagtggcacgatctcggctcactgcaacctcctcctcccgggttcaagcgattctcctgcctcagcttcctgagtagctgggattacaggcgcccgccaccgagcccagctaatttttgtattgttagtagagacgcggtttcaccatcttggccagcctggtctcgaactcctgacctcgtgatccactcaccttggcatcccaaagtactaggattacaggtgtgagacacagaactcggcccaggctgtaatattttataaacaaaataaaaacaaaatccacaacacacaatgcacaatttaaacaataaagcactacataagtgttatttacttttatggatgatcaacttttccagtttccttttagcagctgctctttccacaattttctgatcgatagtatttgctgtaacaaggcgataaacaacaactggctttgtctgaccaattctatgacatctatcctgggcctgaagatccgactgggggttcttaaagttaaaaagaaaaataatatttaacggtattaggttaaaattaacataaactcatgtggataaagtcaacatgaatgatctagccaggaacttttaaatagtggtgtcttaatttaaacttccagagtggcttcatagacaaaattatcattccacagatccttgacaatattaacaaaaaagtttaaataccctaaagaaaacatttcaggatgggcacgatgactcactcctataatctcagcattttgggaagccaaggcaggaggatcatatgaggatacaagaccagcgtgggcaaacagtgagacgtggtctcactaatttttacattttttgtgggcatggtagcacacccatagacccagctacttgagagaatgaggtgggaggatcacttgaatccaaaaggtcaaggctactgagccgtgatggtgccactgcactcaagcctgggtgatagtgagaccctgtcactaaaaacaaaagtaaaaaaaaattttcaatttttacttgcaaaaaactttatgaagaaataactcttagctgaaaatgggtatcttttcaaaatagataagtaaatttgtaacatgtaccattaaaaattaaaaattcagaatggccgggcgcggtggctcatgctggtaatcccagcacttaatcccagcctgggcaacaagagcaaaactccttctcaaaaaaaaaaaaaaaaaaaaattcagaatggaggctgggtgtggtggctcaagcctgtaatgccagcactttgggaggccgaggtgggcggatcacctgaggtcaggattcaagagagcctggccaacatggcaaaaccccgtctctactaaaaacacaaaaattagccaggcattgtggtgtacacctatagtcacagctactcagggggctgaggcaagagaatcacttgaacccaggaggtgaaggttgcagtgagccgagatcgtgccactgcactccagcctgggcaacagagtgagactccatttcaaaaaaaaaaaaaaattcaaaatggaaatataatcagcatattccttgctatacttccaacttacccaatcactatcataaatgataactgtatctgctgcagtcagattaatgcccaggccaccagctcgtgtactcactaagaagataaacacctctggatccgtgttgaagctgtgcatctaaaagcaaaaaggatgtaaatacaacagattaaaataaattaaccaacaagactgaaggagaaaaatgttttcaattacaactattaaagacttaaacaaaggaggccaaacaaatcattcagatctataaaacaattatgttaacaaaacctgtgctgttagctttatcgtccaagcacctatattaaagagatcttaattttgttaaaaaccatgtatcacaacaatgtttaaataagaaaagctaatatcaaaaaatgatgaaaaaattgtagttgtctaaacacatggggtgggtgcaggggagaattgactagaagggggcacaggaaactttctgggctgatggtaacattctatatcttaataggggttaggtataaatttacatatgcatttgtcagaaagattcagcaaatgtatacattatttgcttcagtatgtgtaaattttaccccaaaagataaaatatgctgaagtcattacggaaaagggtagtatcatctatattttatttttaaatgcaccaaaaaaccaggattaaatgctgaatggatacagcaaggctgctattacaggaaatgtgtttttaaaaaggtatagtcaaatgttaacagcagattgtaggcggatttacagttgctttttttttttcaactttgccatatagttgatattttcataatagaaagttgaggacagggcaaaaaggcaaaaaatttcctgctatcccaatattcttacagtgatggttaagtaggatattattaataagattgtgccagaagatatatatatttgtgaatcaaaaattaagacttcttagtactaaatcaaaatgtttgtttttgataaaaccacagggtttctggtcatttctatctttttatcaatttgtgggtctatttggaatattacttcagaaatcaagataggaattataaaagaatagtttggtatgtatgacataagtagtcttacgtttttttctctctctgagtaagacatggacccatcaagcctgctgaagttgaaatctctgagatggcagtaatccatcaaaatgtccaacatgcttgtcatttgtgaaaaaagcagcacctgaaattaaacatatcttaatatttctaatgattgataaaaaaataattgaacaatccaaaattccaatcaaaagtaccaccttgtgacctcttttttttagttctggcagcattcgatccaaaatcaagaacttcccagaatttgttaccaattcttcatcgatcttaaggaggggcaaaggaagaaaaaatagagagaaaactgttatttgctttgttaaaacaaaagccatttggaaagttcaattttcaaagccaagtcacttaaaaaacttaaaaactgacctgttattcaatctttgtaaaatcagaagatagttattactcaaagacatactctagaatgtaaaaccagcaatttcacaaaaacaaagtacaaatataactttgatctaacctcaacactcctctctcaaagtcattgtgaaagaaaacaattatgtcaaacttaatgggtacatactcaggcttattctttataagtgagttatttccaactaaatgtatatgtaaactactgctagaattcttaccagaaattaagagaaaatacaggagctgataagtaatctaaatattgtggacaaagactttttcaccttctggtgaaattccctcatgagagagctactttcatttgagtgggaaagttttgtcttccttcttactctaataaagatgtaaagcagtgcctctcaaatggggacaattttgccctccacctatccccagggtatatttggcagcggcagcaaactttttagttgtcataactgagggaagtgaatactagtggcatctaatgggtagaagacagggatgctgctaaatgtcctaagtgcacagaacattacctcctaagaaagaattatctggcccaaaatgtcaatattgccaggagtggaaaagcctattgtaaactaccttgaaacaactgtgattgagggttactaagaatttatttctattgatattatgctatcattctatcaactacccaagaaagcaacttcatttacttaatttgaaaacctccaaatcaaaactggttttattctatggctacctgttgatctttaagcaatgagcaaccaggctgattttgataagccaaatattaatgataaaagaaatagtgaaaagatgaccactctctctaaaatataacaagtaaacatgcagagtacaaatcaattactaaatttagaattcttagttgttcacataaaatatgtaaataaaaatataagttgcatagaggccaagcgtggtggctcttgcctgtaatcctagcactctgggaagctgaggcaggattgcctgagaaaccaggaagtttgagaccagcctgagaaacatagcaagaccctgtctctataaaaaataaaaaaatttaaaaaactagttgctcatagaaagtgaccatttttctaaccctgataaggttctctgaaatttcggaaagaagactgtctcagcttactgaaggattacaatcttcatgacaaatagcaccatacttatttttaataattataatcaaaaaaagtaacactttccaccaatataaaagtaatggaaatcaaaacagtaaattagaattaaacagtattcaccttaaattcttgtgtaacagggtctataggatattcaatcaaatatggatgattacaacatttacgaagtagcatcattatattctgcagcttcagattaacttcagattctacagggatattcacttccacaacagctctaccaaaacaaataatgcatatatgggaaatgcaaaaaatggtcacagtttaaagaatacttaaattcacttttgaattcaaacctttctcggtccacctctggctgtatttgactgatcagtttttccaattcattagggaaatcatctattttgctgtaatttattgattttctagttcgtcgttttggtcgaccagtaggacttaactcaattgtttctttctaaaagggaacgaattaaaagaaattcagtttataaagctatgtccttaggttctaaatgtaaacaaaataaggcatattttatgtacaaaatgacaatctatagacaaatacaaatgttgtgggaaattagtttaattttaacatggacaacaatatctgaaagtaagaggaagggccttcatatctcaataggtaaaaatgaagggtgtataaaactactttgaacttacacaaaaggatttaataccttaaagttgaaatatggctccggaaatttgcagtacagaggatatttcttcagactggtgtaacactgcatgaaactgctcattatgaaattgctcattaacagacaaataatgtaaatttgtaaacggctagacccttcctttaattataattaattattaaaaagggagaagaggccgggtacggtggctcacgcctgtaaacccagcactttcggaggccgaggcgggcagatcacaaggtcagaagatcgagaccatcctggctaccatggtgaaaccccgtctctactcaaaaatagaaaaaattagccaagcgtggtggcgggcgactgtagtcccagctactcgggaggctgaggcaggagaatggcatgaacccgggaggcggagcttgcagtaagccaagatcatgccactacactccagcctgggcaacacagcgagactctgtctcaaaaaaaaaaaaaaaaaaaaaaaagtcggggggagaagagtctggtggtcctattgtttaaaaatgcatcacaataaatattttgaaaagaaaatacgtaggtttatagtgtacaataaaaaacctggaaagttaaacaaaacttaagggtctccttcagttacatgataataacatcccacctctatctcctataatatggtgggtgatgaataatcatcatcaaattgattattaatctttttggttatcaataaccttctgtaaggaaactgtacaggtagaacatccctaacgggaaaatacaaatgctccaataagcatttcctttcagtttcatatcagcactcaaagtttcaaattttggagcaactcagattttggatgctcaatctgtatatctggagattagtctagttgccaagtccttagtacagggattctcaaatacctacctgtgtgcttgttaaaaatgcatttccaagttcatctccagaaagcatgattagagttaatctgtacggaaatatacattttttttttatttattttttttgagacggagtttcgctcttgctgcccaggctggagtgcaaaggcacaatcttggctcaccacaacctccgtctcccgggttcaagtgattctcctgcctcagccttcctgagtagctaggattacaggcatgcgccaccacgcctagctaattttgtgtttttagtagagacagggttttctccatgttggtcagactggtctcaaattcccgacctcaggtgatccacccgcctcggcctctcaaagtgctgggataacaggcatgagccaccgtgcctggcctaaatttttagtaagtattccagatgactgtaaagcaattaatacaaagattatcacttaacattttagcaggactccagatactaggaaacaacttttgccactaagccttatgccttataccccagttagaaattcacccaagtcctaaaaatgaacaaggggaccttaaaactggaatttaggccaggcacaattgctaaaacctggaatcccagcactttgggaggccaaggtgggtggactgcttaagcccaggagtctgagaccaacctgggaaacatggcgaaatgccagtctctacaaaaaaatacaaaaaatttagccaggcaggtaaaggctgcagtgagcagtgattgtgccactgcaccacagcctgggtgacagagcgacaccttctctcaaaaaaaaagggaaaaaagagaaattttatatgtcaagtttcatttacagtacatttcaaaaccactatacctcactggatccaaacatgtttgcaattgtacggttcacaatggctgtataaaagatctcctgcttctttgaaagtggagcataaacgactacttctcgtttaggaggaacttcaagagcaacatcagacttcagtcttctcaataagaaaggtgttaaaatctaaaattaaaacatgaacagaaaaatatgagtattaaacattcttgtttttcaaggaatactgtccccatatactcctttaccttatcttttgacttcctatataaataatgccaaatctcaaaaggtgaaaatatcttgagattttcccagaccagaccaaatgataaactcacagttgtccgcagcatttcagaatttattttcttttaaaaactgtaagaatctatctcaaataattttaaaagtaaaaatataaaggtagcatttgtatttcttagggttgaagtttcagttatagcccacaacttttagaatgagatgttatcagcaccatacaaaaggggaaataataaaaatgaataaaaattaaaaatatttgaaataatgagtacaaaaagtagaaataataagacctaatatttggtagcacaacagggtgactacagtcaataataatttaacttttacattttaaaatataaagaagagtataactagaggccaggtgcggtggctcacacttgtaatcacagcactttgggaggccaagacgggtgaatcacctgggtcaagagtttgagaccagcctggtgaacatggtgaaaccccatctccactaaaaatacaaaaattagctgggtgtgctggcgggtacctgtaatcccagctactcaagaggctgaggcaggagaattgtttgaacctggaaggcagaggttgcagtgaaccaggattgtgccactgcactccagcctgggtgacagagcaagactctgtctccacacacacacacacacaaaagtgtataactggatcatttgtaacacaaagggtaacaaatgcttgaagggatggataccccattctccatgatatgattattatgcattgcatttctgtatcaatatcaaaacatatacctcataaatatatacatctactatgtacccaaaaaactaaaagtttttttaaaaattaaaaattttttaatagaatgaggttttaagactcagtaaaaagccagctgacctagggatgcagacatacaagtttccttctataagttctaaagtttcaggcttaaaattattctctttcattagctggggtggttacaaatgattatcacatttataaagagaacacagaagcaacagacaataattatgcattaaaatattcgggtcactaaaagagcacaaatactagattaaaatcattgtatactctaggtcggacgcagtagctcacacctgtaatcccagcagtttgggaagccgaggcgagcagatcacctgaggtcagaagtttgagactagcctggccaacatggtgaaatcccgtctctactaaaaaaacaaaaaaatttagtcaggcgtggtggcgggattacagaatcccagctactcggaaggctgaggcaggagaatggcttgaacttgggagacagaggttgcagtgagccaagatcttgccactgcaccctagcctgggcgacagagacgttgactcaaaaaaaatactactactactactaataataataaacaaataattgtatactctttatacccctgccattaaatactgacaatggtttacatatagtaatcatatataataaagctcattttcaggactctggacttaaatacccaacaggtatagagctaatcatagacagactattaccaaagatagtaaacacattaccagtgttggtatctaccaacccaaaaacaaatatgccgacaggcaatcaggaaaaatatgtaaatgtttcataaacatgttaaaacatgtccggccgggcgcggtggctcacgcctgtaatcccagcactttgggaggccaaggcaggcggatcacgaggtcaggagatcgagaccatcccggctaacacagtgaaactccgtctctactaaaaaatagaaaaaattagccaggcgtagtggcaggcgcctgtagtcccagctactcgggaggctgaggcaggagaatagcgtgaacccgggaggtgcagcttgcagtgagccgagattgcaccacggcactccagcctgggcaatagagcaagattctgtctcaaaaaaataaaaataaataaataaaattaaaaaaaacatgtccatgtctgtaaggaaaacatgaaataaccagatatttttctaccacatgcactgacaaatgctatagtttgatgttaactgaaatggcaaatatgtggaagaagaggcacactataccgctgaaacacatgtataaaaaaggtatttatatatgtttttcctagtatacaagctttcaaagcagacaaaaacaagacttatacaagacccatctaccaaaaattagctggacctggtggcatgcacctttggttccagcaactcagaaggctgaggcaggaggatcacttgaacccaggagtatgagttggaggctgcagataacaacccaataaccaacgatggcaccactactctcctgcctggatgtcatagtaggacattgtctctaaaaaaaaaaaaaaaaatctgttggccaggtgcagtggctcacacctgtaatcccagcactttgggaggccaaggcgggcagatcacttgaggtcaggagtttaagaccagcctggccaacatggtgaaacctcgtctccactaaaaatacaaaaaaattagccaggtgtggtggcacacgcctgtaatcccagctgctcaggaggctaaggcaggaaaatcgcttgaacctgggaggcagacgctcactgcactccaggcctgggcaacagagtgagactctgtctcaaaaaaaaaaaaccaaaaaaacaaaaaaaaaaacaaaaacaaacaaaaaaaaaaaacaaaacaaaaaaactattagttatactttggagataagaaaggaagtgcagaaggaaaacagaaatttttacttcttactttttaatttctaaatgtttataacatttaaaaatatcttaccgtgtacgcataattttaaaataaaaaattttaaataattaatttgtaaaggttatactgcttttggccttcaatatggggtggaaatagaaaagtagcaagcttagagaactttaaacggaaagtaaaaaaaattttttttactatgcaaggtttatgtaaacattgcataaaaaaaggaaaggaattctttcatatagaaaatagttaagaaaatatactagcgatttaaaactatctccacctaatctgaattcattttgaatgaaaactttttcctgtagtaatgcattaaaacataattaggacaaagcgtaaaagtaatataaactcaaatttaagcacagtattacagagaatattcttattgctagaacattcaaaactgcccctatttttgataaaactgttgaatttggatataataaaagttcattatcatatcttaatattaatggaaatctgaagttatctatagtaaaacaattccagtgagccctcttatggaattatcaactatgacaattactacaaatgttcaatcaaaaggcagatgatcatttctaaggaatatctatctacctgtatacactgtgaggtaacgtgtaagtgacaaattctataaatattcattgtcttgactctaattaaatttcctaagaacagaaacttaatcctttgctacactatatggatgtatacactactgatgaggatgtgatatccaaacacatctcttcctaaataagtcatttactccaataattcagactgggacatttaaaagcttctataactattggtgcattgaaatttctgtcattgcccagagtcacagtgggaaaaaaagaaaattttaaatataaacacacacgcttgtgcacatgaacacacacaaagataccataaacaaagtttatcccaaaaagtgaggggaaagaaattatttgcaacattaacttatttttaacatatagttattataaaccattaataaataaatattccaacacatgttggaatatggccacaaggaactaccaatagtcaataaacatctcaattcagcaataatcatcctttttaatctctgcaacactgaaaaggacttctaacctcaaaattggtatgaagcttgagtaaataagtattttcatatggacgtatatcatataaatcttttctggagggcaatttgccttcaaagaagccctcatctgtaaactctgacacatacattctaggaattctttcctaaggaaatagccagaaatgggcaaaggtgtagttttaaatacagatactacaaccttgtttatattgttgaaaattttgaaaagaggaagagatagatattattaattatagtagaacaagacaatgggataataagcagctattaaaaactgatttaaatctacatgtagtaaaaggaaaataattttctgataactgtttaaaagactatcttaaggaacaattttatttttaaagtccttttcttcataaaatatagataaaacacacgtgtttacacaaagacagaaaagagtttggattgtcatataacacaacataatcattccacatgcactgctaggaaatacaattttaagaggaagtgatatttttacttttcacttctctcctgcttcacgtttttctcatgaacatgtataaactttaatatcagaaaaaacgataaagactttgaataaaattgctaaaccacaactgagaagcttttcaggcccatatgactagattacccttgaaagataatgtttctctaaattaaagataggtaggatggggtaggaattacaggaagcaataaaaatagattagacagcagccatgcaaggatgtaaattataaaagtattattggcaagcattccataaaaaccacatacttctgttttgtgcttgacaaacttatcagtaaccattaggggtaaaatgagtatactatctgaaaaggacaaaacttaggtaagcacttgagttctgtcataaaaccatgtgacctctgggagaagaaaggacaaaggagtcatttaaatgtaggaggatcttcatttttcaaatctctactacaaagggttagacaggtgatctccagagttccttttatactctatcgagcctatggttaagcagaataagaaaacatggaaaacctggtgcagcatatgcaatacattctgttctctttctttagcaataatatcttcagcagtttcagaaagactagtgatgtcaaaccaagactcaaagctggaagagaaaaatgtttaagttaaccatcacataaattcaattatgtcaacatgatacatgatttatcatttacagtaataatctgataatgaaacgtggtattgttgcatcaaatccttaggtgcaatttttaaaatttataatggaagagaacacattccaacaacaaagataaattggttgcatttttgaaccatcaagaactgtgagcttaaagggaacacttttctgatttataaatagattaacaattgtacagtagtataaaaatcaaaaataagattaaggtatatatttataattttacattacaaaagtgagaactatctctgaaaaccaaagccatatgatttttctccatcagtctaagtatggcccactacaataaatattttaaaattcaacatatacataacttgacaataatatacatgcttattccttcccaatgttgaaaatatatatattacaatgagcaattaagtatgagcatgcagattaataatatagaataggtaacattatacccaattctggaaaatgctagtaacatttatgcagtagactagaagttcccaaacttggatcaccagaagcatgttcaaaaaactcagattctcaactcctaccttgacactgtaactcagtatgtctgcacaggacctggaattcttgtctttcaataaaagcgcccagagtcacaataaggtagcctgccttgagccaccattcggtaaccagatttgaaataaattcccaaaatttaaaattatttttccacacccaattagcttacttccttcactgatgccaaaacaagtataaattattttttgcccaagttatatttccgttgtaatcagttttaaattatgtcaacattacctcctcctccattctgaagctactaattactttctgaaaactacttttatgtctgattttattatataagctaagattcaaacagtttccagaattaaaacactgtgtttacattgggagaccttggttttaactttggctctggtgctaactaactagtcttatcttgtaacaactttacacctaggttttcttttatgtgagataggaaataatttaacaactctattgtccctggttgtttaatgaggatatagtaagaaaaatccatcttaaaatgttttacaaaggtaacacataaaagaaccttattataaaaatattatcttaaagttgcattcagcagtcttcctttaatcaatgcaagtaagttttaaataatcttttcttaatctgctctcacataatttgtggcaggagtagaacatacaatatacaccacaaagaacttgccaaatatttggcattttaattcagtcactgaaaagaaagtaattttaactaacagcacagatttttgaggttaaatcattaaataactggcttacccaccttttcaagtcatcaaatacatctggcaacaaaaagtttagcaatgaccaaagttctgataaattgttttgcaagggagtaccagtcaaaagaagtttgttatcagcattgaatcgttttaactccctgattagacggcacttcatattcttaatcctgtgtccttcatctactattaagtatttccaatagcaatgctagaaaacgaattgaggaaaaagatttttaaacaatgatctcacaatttttctaacaagaattctaaaaataaaacctctattatgagggatggatgttgaattttatcaaatgtaatttcagtaactactgaaatgatcatgttttcatttgatccacttacaaggattcctaaaactgatagatatttctgttcctggaagagacctactaaaatatgcaataaagtttgaactccacctattttgaatttaagatttccctattcacaccttagtcaacgcagttgtagctttcttttctaatattttcccaagttttgatattaatgttacactagactactaaaaattgagcttttattagttccatatgtgctgaaacatcaaatagcactagaattttcccttatttaagcaatttatattttcacagaaagtcacccactcactttcataaagttatcaaggaaattgttttaactttctcattttaatatctgtgatttctcatatatcttaatcaggaaaatttataattaatctaatttatattaacatacagaaatatgaagtatttctggaaatataaataacaatctgaaaaatataactatccttaaaaaatgggactgacaaattgaggaaagagtatagagaacgttttgcattttgctttatacatcccaaaagaatgaaaaaagtttatagtactgtatcttctttattaaaataaccaagaaaggatttattttcctggcaatatgttaaaccaaaaaacctgaattatctctcactgtaagacagctatctaaaaatccagataaaaatataaaatatccttggccgggcgcagtggctcaggcctgtaatcccagcactttgggaggccgaggcagacgcattacctgaggtcaggagtttgagaccagcctggccaacttggtgaaaccccgtctctactaaaaatacaaaaattagctggacgtagtggcacatgcctgtaatcccagctactcaggaggcgaggcaggagaattgcttgagcccgggagacaggttgcagtaagccgagatcgtgccactgcactccagcctgggtgacagagtgagactgtctcaaaaaaaaaaaaaaaaaaatgtgtgtgtgtgtgtgtgtgtgtatatatatatatatatatatatatatatatatatatatatatatacttttataatgggtatgtgagagaaaagaaaacaaggaaataaatgatgaggaatctgaaagccaaattagcaagtgaactcagtcacttccactcgcactcagcaacaaaagccctggaacctcacactccgttaccagagtaagctaagatccttgaaatgataatataagctcacttaaatggaaaaagtcaaaagtttctagccactggcaaaggaaatggacaaggaagcttaactatttcattacaggaagggtcttcatgttatactactgagtagaaaacacaagttgcaaaagtgaatgcaggctggaagtggtggctcacacctgtactcccagcactttgggaggcctagacagttggatggcttgagacaccctgttcctacaaaaaaatacaagaatcagtcaggtgtgatgacggacgcctgtagtcccggctactcaggagacagaggtaggagaatcacttgagcccaggagattcaggctacagtgagctgagatcgtgccacaggactccagcctgggtgacaaagtgagaccctgtctcggaccaaaaaaaaaaaaattgaatgtatagtatgatcatatgtgtaaattatacctacatgttagctataattatttagtataaaagtagtagttctctgggaggctgaggcgggcggatcacgagggcaggagatcgagaccatcctggctaacacagagaaaccccatctctactagaaatacaaaaaaattagccgggcatggttgtgggcacctgtagtcccaactactcggcaggctgaggcaggagaatggtgtgaacctgggaggtggagcttgcagtgagctaagatcgcgccactgaactccagcctgggcaacagagcaagactctgcctcaaaaaaaaaaaaaaaaagaaaaaagtagtagttctcaggtagaattacaggtgcttttacatcttcctgtacactaccctttaaaaaaaattggtatatattacttttactgtaaagaaatgctttaaatcaggggtccccaacccccaggtcacagacctgtaggggtccatggcatgttaggaaccaggccacacagcaggaggtaagcagctgtgagcgagggaagcctcgtctgtatttacagaaaagggaagcttcatctgtatttacagccactccccactgctcacattatggcctgagctctgcctcccgtcagatcaggagacattatattctcataggagcatgaacactattgtgaactgcacatccaagggatctgggttgtctgggttgtgcgctccttataaaaatctaatggtggatgatttgtcactgtctcccatcatccctagatggaaaacaagctcagggctaccactgattctacgttatgttgagttgtaaaattattattattttgagacacagtctcacttggttgcccagccaaccaagcggcatgatctcggctcactgcaacatccgcctcccgggttcaagcaattatcctgcctcagcctcccaaggagctaggccactatgcccaggtaatttttgtatttttgtagagatgtggtttcaccatgttggccaccatcttggccaggatggtctcaaactcctcacctcaagtgatctgcccgcctaagcttcccaaagtgctgggattacaggggtgagccactacggccagccctattatttcattatatatgacaattttataataataaaaataaagtgcacaataattataatgcatttgaatcattctgaaaccatcccccacccatggtccatggaaaacttgtcttccacaaaaccggttcctggtgccaaaaggttggggactactggtttaaatttttttttctttttgagacagactctcactgtagcacaggctagagtgcagtggcgcaatcacagctcactgcaacctccacctcctgggtttaagcaatccttgtgccattaaacatgtgcaccatcacacccagctaatttttgtatttttttttttttttttttttttttttgagacggagtctcgctctgtcggcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtaatttttagtagagacggggtttcaccttgttagccaggatggtctcgatatcctgacctcatgatccacccgcctcggcctcccaaagtgctgggattacaggcgtgagccaccgcgtccggcctaatttttgtatttttagtggagacagggtttcgtcatgttggccaggctggtctggaactcctggcctcaagggatctgcccacctcagactcccaagtgctggaattactggcataagccttcatgcccggcctggtttaaatactttttaatgctgtacacattcataaactttgctaaactcctgaactgagatttctgcaaatcatattccaaagttttaccagcagacacataaaacctgacaatactggtcataattatgcaagtcataattattctatttatgacttatgtgttttgattttatgttgaaaccattaaatactttcctatttccaagcaagcaagataaacctaaggggactgcactaagagggttctcacatggccagagaaaggaaaaaaaaagcagtcaagaattataaatgaatgaggtagagcagtgaggaagaagttcaaaacaccaataaatgaaaacagaaggcatgaaagaaaaaaggtcaatctttcaattctgttatgctaactggaaattatttaaataagtagctagaacatcaagaaaatagaaacgaaaatgctaccaaatagtccaataagatactctaaaaataacttgtcttcaaatactcttatttgattaaaatacgataagtaaattccatatattcaaagtacctgtcacaaatatatctgtaatacattccgagattaggtctatttctggatgattctaagccataggttaaactgccataagctttaattatattgttacaaatgatggccttcatcccaatcattctgttaataaaagtttccagcttctacaggtatatgcacaatataatctattatttcgacaacaaaaaaaaattagacaaatgctcccagatggtgagaaagtgatataaatgaagaaaagcatgttttatgtattacaaagaaaccaatgaagatcatttgtacctgtaacgcatttcggtctctcatggctatttcaaatgacgtgattaccacaggatgaatctgcaaagtccctttccgtttgtaaatatttcttaccaatttttgacgttcctcctgggttccatgatataacattgtagggatctgaaaaattttatattgatttttatcagacttaagaacaaaatgtaaatattgactatttagaaaatataaatcattctgagggaaaaaatataattttaaaaaattttatttctatttttctatagcaaaataagccaagcaattctaacaaatcattgaactattatgggagaaaatgaaaaaaaaacaaacaaaaaaacaaagtcaggcccagcacaatggctcacacctataatctcaacactttgggaagccaaggcaagccgatctctaaagtccagtagttcgagatcaacctgagcaacatggagaaatcccatctctacaaaaaatacaaaaattagctggtgtggtggtacgcacccgtagtgccagctactcacccagtggagtgagatgggaggttcacatgagctactcaggcgtgtgagatagcaggctcacatgagcctgggaggtgaaggccacagtgagccagaatgacgccactgcactccagcctgagcaacagagcaacatcctgtctgaagacaaaaaaaaaggcataaaaacaaatagacgggccaggtgggatggctcatacctgtaatccccagcactttgggaagctgaggcgggcagaccacctgaggtcgggagttccagaccagcctgaccaacatggagaaaccccgtcactactaaaaatacaaaattagccaggcgtggtggcgcacgcccgtaatcccagctacctgggaggctgagacaggagaatcgcttgaacccgggaggcggaggttgcactgagccgagatcgtgccattgcactccagcctgggcaacaacagtgaaactctgtcatacacacacacacacacacacacacacacacacacacacacacaaacacaaccccccccccaacaaaaaacctacaaatacataaaacacatataggctgggcgcagtggctcacacctgtaatcccaccactgtgggaggccaaggtgggcggatcacaaggtcaggagatagaggccatcttggccaacatggtgaaatcctgtctctaccaaaatacaaaaaattagcctggccttgtggtgtgcgcctgtagtcccagctactacactccagcatggtgacagagacagactccatttcaaaataaataaataaataatatatatataaatatataaaatgagacagatggtgatactacgtctagaatatatatatttctcataaggcaaaaatgtgcagaagggctgggcccgggaggtacagtggctcacgtctataatcccagtactttgagaggccaaagtgggcagatctcttcaggccaggagttcaagaccagcctggccaacatggcaagacatcgtctctactaaaaacataaaattagctgggcatggtggcacatgcttgtaatcccagctactccggtggctcaggcacaagaattgcttcatcatgggaggcagagattgcagtgaaccaagactgcatcactgccctccagcctgggtaacagagactccatttcaaaaaaaaaaaaaaaaaaaaaaattgcagaaggtaacaagtacagaaaaaacagaaaactctcttcttagccttttggcaaagatcaagtgaagaacaagcagaatttttaataaaatctctacctaagtctgtctcagtcgaatcaaattaccaatgcactgaaaatcattcaggaatattttaggaaagatgtcagggatttccaaaacctatactatataaatttaaattagggtattgtgcagattgagtaagtcaaatcagacaaaatatttatacagaaaccaatataattataagagttctacaatttaattcctactacaacaaagcataagaaaacatgtaaaattataattttaacataaggaagcatgtcttacatctggtgtaaatcttttgaattcagccatccagttaggaagtgtagacaaagggccacagacaagaaaaggtcctggtactcctctctgaatcatcaatgcaatagtagcaatgcactgaactgtcttacccaatcccatttcatctgctaaaatgccattaattccattttcccaaagcatctggacaaaataatagatactgtatttaaacttggatataaacaactacaggattacaatattttatttcttctctttaaaaaatcacacccaaagatgagaattatgttaaagctgatatattcacaccataaattataacaacactggaaagtcctttatcaaagccataaaagtgctggaagccattaacaaggtaatttctacttctaaaaattcagggtaaagaaatcagaaagcaagtatccacatacaaatgtataatagtgaaacatgatagaaatgactcaagttgtggtacctcaaatcattaggctactatagaaataaaaccagtatcttgtattaaaaattccaattcattaccctaagccattccatgccttctacttggtaccatcgcatcactcctccagtgaagtgctttggttgttgaaaaggtactggctgaccattacacttccggactgggtcaaaaaagaatttagtattctgcctaaccgtttcagacaatctatctttaattatactattcgaatctttatttttctgaagatcttccacacagagattagtagaggaggagttttcatcctgtagagaaaaaaagtttaataagatgtgttatacaaaatgctgctgtatgccaccatttatcagaaaatgcaactaacaaaatctactgagtcctataatcattaagtatagaagactaagatcacacctggattaaaaaactggagacatcgccatccctctacaaatgaaaagctactaaaaaaaaaaataacaggctgccacagtggctaatcctacaatcacagcactttgggaagctgaggcaggaggatcacctgagtccaggtatccaagacaaccctggacaacatggcgaaaccctgtgtctactaaaaatacaaaaaattagctgggtgtggttgcacgcaactgcctgtatcccagctactcgggaggctgaggatcacttaaacccaggaagtcaaggctgcagtgagccatgaacacagccactgcactccagcctgggtgacagaagactccatctcaaaaaataaaataaaataaaataaaataaaatataaaaatctgagaataacccttacaaattaaaatcaggcacatacttttgaaaagatcattagaattgtatctctcttccaaacttctaatattgtgatactcaataatttattaaactgttacacagaaaatacagtacgcataaataagacgggcaaaagatattaacagatactttacaaaagaaaacatacaggccgggcatggtggctcacgcctgtaatcccagcattttgggaggccaaggcaggcagatcatgaggtcaagtgatcaaaaccatcctggccaaaatggtgacacactgtctctactaaaaatacaaaaattagctgaacatggtggcatgagcctgttgtcccagctacttgggaggctgaggcaggagaatcgcttgaacctgggaggcagagtttacagtgagccgagatcgtgccattgcactccagcctgggcgacagagtgacactccatctcaaaaaagaaaaaaaaagaaagaaaacatagttatcaaagaacataaaaatatactctacttcagtagtaattaggaaaatgcaagttaaaaaccacacaagttaccatttctcatctaataaaatggctgaaattaaaaagactatcaaatgctgacaataatgtaagctggagttttcaaacattgctggcgagagaataaaatgatgtgtttactttgggggggaaaatctgtactttcttatgaacacacatttgccacgtaacacaacaataccattcccaggtacacaggcagaaagtatgaaaacatgtctacacatggacttgtgtgcaaattatcatagcaaccttactcataaaagtcacaaactgcaaacaacccaaatgcccatcaataaggggatggatgagaaaattgtaacattcattcaacagaatactagtcaataagaagaaaccggttactaatatgctcaacaacataaatgagtatcacagacatgttgagtggaaaggaaataataagccatcctataaaaggtgtaaaaagtggcctcctctgggtttgggggtggaaagacatagaagagatccctttacaatggaaatgttctataccttgatttggatggtggttacacaagtgtatgcaagtgtcgaaattcattaaaataccatacttaacaactatttcttactgactgtaagttataaaatgaagccaaaatcccatagtaaattacagaagattacatctagactttatcttaaaaatccaactaaatgtttatctaactaaatctttaaaaatccaactaaactgcacccataaaccagtccttaataacttaacaaagaataaaaaccaagacacttttacaatataaattttggacaaaattatatgaccaaatagattatctctcattttataaacataacattaatttcccaaaggcctaaaaatctttaatatgtaaattaactacctgaagttcatatccattcatgaatattttcatgtcatgattattttgcttccctaggcaaccttgtaattttaagtacttgaacaataaaaagtcagataacaaggaacctctctacatgaaatgggctaagtgaagaggtggctcggaaatcaagccttctcaaacagaacttttaagaaacttaaaaaatctttaaggtctgaagcaagattaaggcatccctcacagcttccataagatgattcacggtttatatccacatggttacgagcacttgtatcactgccagattcacaagttaaaagcaacattgctagacccataaattaacatttatacatcaagaatcatgcaataaaacaactaactaaagttgatacataaaaaagaagaatgttggatatggaagaagtgaatacataggtatttttttttaaagcaaagaaacaggataatagtgagaagaacgtatactgctgattaaagaaaaaggactagtaactgaggagtaaatatgacttctaaacttaatcttacattataaatttcttacctcattctcctttttattttttttagccacagacaaaatttcctagtagtttgagaaaacaaaaacaaattaataatgtatgaagttcatttatttatttattcaacaagcatttattctgtgctcattttgccaggaaatgaggatgagattctcaagataaaactagtagccttcaggcagaaataagcctatagacattactggctcataatatttcataacattctaggctaatttgggaacacttatacaatgggatatttcatcaaatacagtgattttccagcttttctttcttttaatctgagtagattaagtacaaattcacacatggcaacaaacctctagtcctggggtcagcaaactacagcctgtagaccaactccagctaagcgaatacacaggtatttttttaaaagcaaagaaatgggataaattggaacaaagtcagcctcacttgtttacggtttgtctatggctgctttcaagcaacaacagcagagtacagggttgagtagttgcccacaaaactactcaaaagctaaaaatatttactatctggctatttacagaaaaagtttgccaaaccatgttacagcccactttaggcctctgtggatagacatctgagtttgcattcctgggtaagaggcaaagacagaaaaaattaaaaatacagaataaagtgctctgattttgaagtacctactagatgctgctggtagggagacaaacaatacccgagtatgtcactggatgacttagcaaataattatcttacataaaattatctaaaaagttgtcaccaggcttcatcattcaagatagtgagggtagatttcaagcagagagaatatagaaggcataggggatgaagtagattcaaaacagcaatatcaaatttaagattcatagaagagtaacaggacatgtaagtggctgacacacacacatatatatacatgggaatatatgtatatcgtgtgtgtatgaagtattatgtatgtatagatattcatattataaggctgaggctaaaaggattttataccaggaactgataaaagctgtcctgtaaaatgactagataaaatgaaacttttgaaagaacaatttggaaataaatcaaaatctataaataccaccaatgaagtattcttattaaaaatcaagcatgggcaacatggtgagatcccatctctacaaaaaatataaatgttggctgggcttggtggtacacgcctgtagtcccagctactcaggaggatgaggtgggaggattgcttgagcccagcaatcagaggttcaatgagccgagatggcaccactgcactccaccctgggcaacagagaaagatcttgtctcccaaaaaaaaataaaaataaaaaaaaaaataaaaaaacaccttaatcacaaacttccgtatttaacttatagttactatagttaacaggaaacacaagaggcagagaaatcatggggatacaatcagtaaagtctagaatgtggggaattatacagaattactcattttcttcaacaaataatgtttcttaaaaaagatgagagacactctagatctaaaagagacccaagatacgcattaatcaaacacaatttatgtaactttttcggatcctgatttgaaccaactatttttttaaaatgtatgagctaagcagatcacagcggtaagtgcctatagtccctgcactactactcgggacactgaggcaggaggatcatgtgagcccaggtgtttgaggtgtagtcactatgacaatactcaggaatagccactgcactccagtctcgtcaatacagcaagcccccatccctaaaaataaaaattagcctattgagaaatttaaatattaaggaattcccatcgactttcaaaagtgtggtaactgtattgtggttatggttctaaaaaatagtcttggccgggcatggtggctcaagcctgtaatcccagcactttgggaggccaagtcaggcaaatcacaaggtcaggagtttgagaccagcctggccaacatggtgaaaccctgtctctactaaaaatacaaaaaattagctgggcgtggtggtgggcacttgtaatcccagctacttgggaggctgagacaggagactcacttgaacccaagaggcaaaggttgtagtgagccgagatcatgccactgcactccagcccaggtgacagtgcgagactccaccttaagaaaaaaaaaaagtcttgctgagctttttgttaaaatatcccagaattaaaaagcgattggctgggcgtggtggcttatgcctctaatcccagcactttgggaggccgaggcgggcgggtcacctgaggtcaggagttcaagaccagcctgaccaacatggagaaaccccatctctgataaaactaaaaattagccgagcatgatggcacatgcctgtaatcccagctactcgggaggatgaggcaggagaatcgcttgaacctgagaggcggatgttgctgtgagccaagatcatgccactgcactccagcctgggcaacaagagtgaaactctatctcaaaaaaaaaaaaagtgataaaggtggacattcaatttactatcctctaaacatttgtaatttttgagattttccgtaatacaaagaaaaagaacatacatataccaaaatgttagtgattatctgtgtgacagcttttcaggtgatttccttgtattttgtttattctcaaatttttctacaagaaaatgcaattccttgtgaaaccataaaaagtaatggaggttatgagtaattatatttgagtttcagaaaaaccaatctggtactcttgacaatgagagctagactaggattataaaaatcaattaagaaactactataaatagggcacagtaagggcataaacaccagagtagcagcaaatgaaatgactcacagaaatcgataaaaatctagatatataaggaaattcagataacctcctaaattgttttagatgacacagtagatactggttctgatattaacaccaaaaaaagagaaaacaaaagagcaagattcggaagagaggaaaagataaattgtttgctttgtgctaggtatcaatttcaaagataccaataaattcaactggtaggcgtaaaactgctcaactgcataatgtgtaaggaaatatgcacaggctactctttaaaaaaaaaaaaaaaagggccaggcgcggtggctcacgcctgtaatcccagccctttgggaggccaaggcagatggatcacaaggtcaagagatctagaccatccaggccaaaatggtgaaactccatctctactaaaaatacaaaaattagctgggcgtggtgacgtgtgcctgtagtcccagctactcaggatgctgaggcaggagaatcacttgaacccgggaggcggaggttgcagtgagtcaagatcgcagcactgcattccagcctggcgacagagcgagactctctctccaaaaaaaaaaaaaaaaaaaaaaccagggtttcattctcttgcccatgctgcagtgcagtggcgcaatctcacctcactgcagccttcacctccccaggctcaggtgatcctctcacctcagcctcctgtgtagctgggaccaaagtcatgcaccaccacacctggctatttctgtatttctttttgtagagacaggatttcgccatgttgcccaaactagtcttaaactcctgggcttaagtgatcctctcaccctggcctcccaaagtgctgggataacaggtgtcaggcatcatgtccagtccagcctactcttaaaaagcttggaaataggccggtgcagtggctcatgcctgtaatctcagcactttgggggccaaggtgggtggatcacctgagatcgggagttcgagaccagcctgaccaacatggagaaaccccgtctctactaaaaatacaaaatttgccaggcgtggtggcacatgcctgtaatcctagctactcggaaggctgaggcaggagaatcgcttgaacctgggagccggaggttgcaatgagccgagatggcgccattgcactccagcctgggcaacaagagcaaaactgtgtctcaaaaaaaaccttggaaataaagaataaaaaacagggcaatctagaaagactggatcaaaaatttttgttctgcagacaggaaaacacaatgtatctataattgaaaggcaaagacccagtgaggaaggaaaaggtgaagaaacagaagggataacttggaggagcagggtccacagtggcagaacactcaattgggttatacccctccaaatgcattcacagatttagagattcttcagcaagtaaggtgagaatgaaacaatggaaagaatttagttaggcgaagaggaaaagagagcaggaaattcagtaaatatacagaagaaagaagtaacagtaaatgaaagaataactggtatgggaccaggcatggtggctcacacctgtaatcccagcactttggaaggcagaggcaagcagatcacttcgggtcaggagtttgagaccagcctggccaagatggtgaaaccacctctctatgaaaaaatacaaaaacagccaggcgtggtggcacgtgcctgtagtcccaggcgctggactactcagggagctgaggtgaaagaattgcttgaactgggagacggaggttgcagtgagccgagatcaccactgcactccagcctgggccacacagtgaaactctgtcttaaaaaaaaaaaaagaaaagaaaaagaaagaaagaaaaactactatgcccacagatctctgaataaactagccaagtgatttaccaaaatggaaatttgcttaaaatctttcaatagcttcctactttacttatggcagccttaaactcctgaccatgcttacatcgacagcttcatccttccttcatcactcttttcacttatatacaaattggaggcaaatataatttacttcaagttttttgaaactgccagtctctcttgaccctggatatttgttcaatgctattatttcttcctaaaacacctcccccactatcttacctgtactttactctttccctattaatcccacctttaaataatttaacttttatccttcaagtcacaacacagatatcatttccttttcatagatgaaaaggttcaggaactgcatgccagagtgaagagcccctctaatatggtgtataaacatccaattcccaaccggacacagtggctcagacctgtaatcccagtactctgggaggccgaggcaggagcccaaaaattcgaggccagcctagacaacatgacaaaaccccatctctacaaaaaatacaaaaatcagccaggcctggtggcacaggcatgtagtccctgctactggggagtgtgagatacgaggatcacttgagtctgggaggttgaggctgcagtgagctgagattgtgccagctgcattcgagccagggtaatagaaacactgtctcaaaaaaaaaaaaattcaatttcattgactacttactcctatatctctctctgtatgcaggctaaggtgaagacagcatttacctttctttactaatggatttcatccacctatgacaaagtttgcccaaaaccgatattccacaaccatttaacaaattaaataaacagctgtatgactggctaaacttcagtatggcatattaaaagtggtttttcttttttgagatggaatttcactcttgttgcccaggctggagtgcaatggtgccatctcagctcactgcaacctccgcctccggggttcaagcaattctcctgcctcagcctgcccaagtagctggaattacaggcatgtgccaccaagcccagctaattttgtatttttagtagagatggggtttctccatgctggtcaggctggcctcgaactcttgacatcaggtgatcctcccaccttggcctcccaaagcgccggggtttacaggtatgagccaccacgcccagcctaaaagtgttttaaactgcaagttgaatagataccataatgaatttcagtggaccctaactttgttttttttgagacagagtcttgctctgctgcccaggctggagtgcagtggcatcatctcagctcactgcaacctctgcctcccaggttcgtgattctcctgcctcagcctcctgagtagctaggactacaggcgcaagccaccattcccagctaatttttatatttttagtagagacggggtttcaccatgttggccagacaggtttcgaactcctggcctcacgggatccacccgcctcagcctcccaaaatgctgggattacaggcgtgagccactgctcccggccccctgacgattatttttcagtgaaaaactatcattgcatccctagagaaaaggaaaactattatgtaaatttttcttctgaagagctagagtttgaacttcaggtaaaagaacaacagtagacaatagagttgtgcttttttttttaaatataagaatgtggccaggagtggtgcctcatgcctgtaatcgcagcactttgggagataaaggcgtgaggatcacctgaggtcagtagttcaagaccatcctggccaacatggcaaaaccctgtctctactaaaaatacaaataggtacctgtaatcccagcttctcagaagctgagacataagaatcgcttgaatatgggaggtggagcttgtagcagtgagccgagatcgcgccactgcactccagcctgagggacagagcaagactgtctccaagaaaaaaaaaggaagaatgtgacacattaaaaacatgctaaggaactggtttgtcagaactgaagatgctctaattcattcatatttttaagtaaaaagtgagaaatgaaaaaaagaagctggttttagaaaagagcatatgatttcagtttcgtaaaagtcttcaacaaaaaacaagaataaagttcttaagacaaggttaggggttacaaaaagttaaattatagtgacaatttctgactaggccaggctcagactcgtttaacaaagagctggtaccatctttttccctgaaatacttatctgctctggtcagacagtgtctttactaccctaccctttccccccaactctccgcaacatatatgtaattttaagctctatgcccatgcctgttgtttccacagttccttgcaaaatgctatacaagtccactaggtacttaacaagcacaagataataggtagagtcaaagctattactgttatctgtaataacccaaataagaaaaccagcaaaggccgggtgcagtggctcacgcctgtaatcccagcacttttggaggccaaggcgggtggatcccctgaggtcaggagttcaagatcagcctgggcaacacactgaaaccccatctccactaaaaatacaaaattagccgggtgtggtggcacatgcctgtaatcccagctactcaggaggctgaggcaggagaattgcttgaacctgggaagcggaggatgcggtaagcctagatcgcaccattgcattccagcctgggcagcaagggtaaatctccgtctcatcaaaaaaaaaaaaaaaagaaaagaaaaccaacaaaaagctgggcacactggctcacacttgtactctcagcagtttgggaggctgaagcaaaaagatcatttgaacccaggagttcaagagcagcctaggcaacatatgacatctcattgctacaaaaaatttaaaaattagccagctgtgcatggtgtcacacacctgtagtcccagctactcagggggctgaggtaggaggatcacttgagcccatgaggtcgaggctgcagtgagccatgattgtgccactgcactccagcttgagtcacagagtgataccctgcctcaaaaaaagaaaagaagaaaaaaaagaaggaagctagaaaggaaggaaacgaaagaaagaaaagaaaaccagaacaacctaaaggtgtaagcctatttgccacttaagtgaggatgggcgcaatggctcacgcctgtaatgtggcattttaggagaccgaggcgggcggatcaccttaagtcaggagttcaagaccagcctggccaacatggtgaaaccccatctctactgaaaatacaaaaattggccaggcgtggtggttggcacctgttatcccagctacttgggaggctgagacaggagaatcgcttgaacccgcgaggtggaggttgcagtgagcagatatagtgacactgcaaggcagcatggaccacagagctccatctcaaaaaaaaaaaaaagtctatgaaggtcagatgacattagtttcagattagtctcaagtctactgtaggttggtagatagcttcaaacattttggcagcttcacctataaatgatatataatattaaattcaaaacatatttcatgtgatattgaatattcaatctttacagatttaaggtggtttaaaacctacattttactcaacatcaaatgttaggtgccctctcccttttatttttacctcttttgacatgacctctgaaatattgtatgattcatcttctcttcctctttttttcctcataactataaaaaaaaattttatttttgatagcaattaaaatagaaatataaacgcatattcttcaaaactagaataaggatatttacctggcttctcttcacttgcatcaattgaatttttaccctacaaaacaaggattcagaatattgattttattaaggaccttcatagtattatacgttaaaaggcactgattaacttgagaaaaaatatgtttcctgcaattgagccacatccacaatttttcactattatacttacctacatgtaatatttttctgtatttccctactataacttgttcataatctctgctttttcccaagggctctacttctgtccatttttttccatttagaagagaaatttcaaaattaaacatagttggcatttcgtttgtttgttttttggagacggagtttcactcttgtcgcccaggatagtgtgcactggtacaatctcggctcattgcaacctccgcctgccaggttcaagagattcccctgcttcagcctccagagtagtggggattacaggcacctgccaccacgcccggctaatttttgtatttttagtagagatggggtttcaccacgttggccagctagtcttgaatttctgacctcaggtgatccgcccgcctaggcctccccaagtgctgggattacaggcgttgagccactgcacccagcccatagttggcatttttatttagaaataccatgtacatcttggccgggcgcggtggctcaagcctgtaatcccagcactttgggaggcagaggcgggcagatcatgaggtcaggagatcacgaccatcctggctaacatggtgaaaccctgtctctactaaaaatacaaaaataggtatttttgtagggtagggtattgaaggaatacccttcaataggtagggtattgaaggaatattcattgtgaatgaaattcatacattaaatataacccaaagcagaaataaaagagaatactaatggaaaattattagtgaggaaggtaagagaaatgagatgttaagaaacagtttctggccaggtgcagtggctcacacctataatcccagcactttaggaggactaggtagtaggattgcttgaagccaggagtacaagaccagcttgggcaacaaagcaagatccccacctctataaaaaatgcgaaaattagctgagcatggtggtgtgcacctgtagtctcagctactcaggaggctgaggtgggaagatggcttgaccccaggagttcaaagctgtagtgagctactatggtgctactggactctagcctgggctactgagacatcacctctaaaaaaattttttaagtttcaaaatagttgacgcccttatgaaaaaagcagaggggaaaaaaatcaaaaccctggtataaaaagttaggtggaataaagtgaaggatatattaaattaacaggttaaagagcagggaataaatgactaagccagtaaaattgtcatataaataaaaacatgttcttcaaaacccctaggtaaggccagttgtgctagctcatgcctgtaatcccagcactttcagaggccaaggtatgggtgtgggtgtgggggatagcttaagccaaggggttcgagaccagcctgggcaacatagtgaagctctgtctctatgaaaataaaaatctgaaaagccctaggtaagtctctgaaattagcaagtgagtcaaggatcagagggttttttttttgtttttttgtttttttttttgagacagagtcttgctctgtcacccaggctggagtccagtagcatgatctcagctcactgcaacctcggcctcctaggttcaagcaattctcctgtgtcagcctcccgagtagctgggattacaggtacccgccatcatgcctggctaatttttgtatttttagtagagactgggtttcaccatgttggccaggttggtctccagctcttgacctcagatgatcggcccaccttggcctcccaaagtgctgggattgcaggcgtgagccaccgtgcctggcccatttttattttttaatactctctctctcagtgactcagtattaccagttttatgtatttatttatttatttatttaggaacagagtctccctctgtggcccagactagagtgcggtgatgcaatcttggcccactgcaacctctgcctaccgtggttcaagtaatactcgtgcctcaacctcccaagcagctgggactacaggcacacaccaccacgcccagctaattttttgtatttttagcagagacagggtctcatcatgttgaccaggctggtctcgaactccttgcctcaaggaatccatctgcctcagcctcccaaagtgttgggattataggcgtgagccaccacacctagcagtattaccagttttaaataatgggttttgttgcaaaacagtctgcaaaatactttatcaggcattttaacatcaccattaactagtctaagaatcaaataactggacttaatctcagcactttgggtggccaaggcaagtggatcacaagatcaggagttcaagaccagcctggccaagatggtgaaaccctgtctcttctaaaaatacaaaaattagccgggtgtgctggcaggtgcttgtaatcccagctacttgggaggctgaggcagagaattgcttcaacccaggagacagaggttgcagtgagccgaaatcacgccactgcatcccagcctgggtgacagaacgagactccgtctcaaaaaaaaaataaataaataaaaggcagtttagcacagaagctaagtagaagctcttaaactaatcctgggttcaaatccgtaattttcagcaaattagagtcagctctcattatctgcagtacttgtggttcgataaaatcactatgactattgacttattgcccctaggaaaaatacaagcttgggtctctgactctggttatgacattttcaaccaaacgatacacaaccctgttttatttgtgtttctgtttttaaagatatcttatttaatatatatgttgattaatattgaactcagggccagctgggtgcagtggctctcgcctgtaatcctagcactttgggaggctgaggcgggtggatcatgaggtcaggaattcgaaaccagcccacccaatatggtgaaaccctgtctctactaaaaatacaaaaattagccaggcatggtggcgcgcacctgtagtcccagctactcgggaggctgaggcagaagaattgcttgaacccaggaggtggaggtagcagtgagctaagattgcaccactgcactccagcctgggcgacagagcaagactctgtctcaaaaaaataaaataaaataaaataaaataaataaataaatatcgaactcagggccaacagcactgtacctcatgcctcaatgaagcttacccaagacatactttctccatatggcacagcctttttgtacttagaaacactagacagcactttggtacaatagttgggggccattttaacagcaaaatcaccatgaaaaagcacaaaaaaacgcaaaagttatggtgctaaataaagaccatgaaaaggatatatgcttgacatacatatggtagcagaaaacaaagaacagcaacccatgtttgagctgagcttggaacatatgtattggaggactaaaattctttgctgctctgaacataagcatatccaaaaatgaccatgacggtgtcaggaatcttgactctggggttacaaataaatgtaagtgagtaggcgaattcacaaatatagaatccttgaatatgattgttctttatctccttgcatcagcctatttatgtaaaatgggggaaaaaagtacctctacctaaaaagaactgttgtgagagtaagggaaaacaggctgggcgtggtggctcatgcctgtaatctgagcactttgggaggccgaggtgggcagatcacaaggtcaggagatggagaccatcgtggctaacacagtaaaactctgtctctactgaaaatacaaaaaattagccaggcatggtggcgggcgcctgtagtcccagctactcgggaggctgagacaggagaatggcgtgaacccgggaggcagagcttgcagtgagccgagattgcgccactgcactccagcctgggtgacagagcgagtccccgtctcaaaaaagaaaaaaaaaatagagtaagagaagacatgatagcacacctgacccacagtatgtattcaataaattatttctcttttcactagcaaaacttcattacaggtttcaaagaaggtggccacttacaaaatgccttgaagtttaaatttgcagattctttccaattaagaaagtcaaattttgccaacgtccaaaataatccatagaataagaaactaaagtggaccatactttggctctttctccatttcttaaatagtgaggaacagattttacatgtttctgcattgcttgtaacaaagttaggtttatcactaaagaaacttaaaattaaacagatgatcaaaaaagtcagaagaatacaaaagtatttcttcaatatttaaatgacataaaaaatattccggctggctatattacctttttaacttttaaagactccttttttctctccaatttttctttcttcttctgttcctgtaagacaattttttcttatgtcacaagtggaaagtgcaacatttaaaaaaaaaacgcatatcaattctcaaataacttatgtttacaatgagaaactaaggtctatcataattaaaaaccagggaggaacttgtacttcaagcctttatggactaatgggacagatttagcctcctgccttaaacaactaaaatccagataaaatttattaaacaatggttttcagacaacatgcagtaacggactgtaaacactgacaaaacggaaacaaggttaatcttctgactgcccagcttactgcctgatacaattttaaagtacaaataatggagaaaaatccaaacagagcccaacagtctctttgtgttgaggagacagaatccaaaacttaagagcagtagcattcccagggtcaagtaccagagaggacaaagctgcacaaaggcagctgttatctctctctcaggctgagtactggtaagtgcatggtaaccaaggccaggagaagagtcaccagaaagaagcaggtggaacctctcatgttccaaggggtcaggcataataaggtatacctcacattctctcagccaaagtagaaagtcctcttaatataaagggcatcaagtagagtgctcagaaaagggatcaacttattcctagactaaaagctattctagacatactcttacaaattttttaaagacaccaaaaattcaaaccatttccaagaggtgatgaaaggggtagatgctgtgtaactcattaagttgaatatttgtttttccatttgttttactttaccataaaaaagtaataaaagggtttcaaacaaaggaaaaaggagatttgacaaatacagcaaaatttaaattgataatttttaaatgtgggtgatggggacaccgggacttactgtattctctcaatttgcacaagtttttaaatcttcataacagtctagtggaaagacaaacaataaatacaataaatgatgtatatcagatgaaaagtgcaatgggaagaacagaacaaggtaaagagaatcaggtgtgttagcaactttcttaaaattgtgagggcaggtctcatctagaaaccatttaagtcagggcttgaagatgaagttaagccatgcagttatttagaggaagaaggttccaggcataaaatagcaagggcaaaagcccaagacaggaaacacatctggagacaggtctgaaaggtaatgggattgagggaggcagtcaaattgcttacagacatatagacattatcaggactttcacttttcagaaacaacataagctaggagacagtgaaacatctttaaagtactccaagaaataaagtactaaagaaaaaaaattctttacccagtaaaaacgtatttcaaaaatgaaggtaagtgaagacattcagacatatgaaagctaaaagaacccatcaccaacagaaaatgcaaatgaacctataataacagaaaacagatcaattggctatctgtggatagaacatggggtagggacgggcgagaagaattataaataagcagaaagaattttttggaatcagtgggtatgtccactatcatgattgttatgtcttcacaagtatatccatatatcaaacttagggaattgtacattttaaatatgtgcagtttagtgtatgtcaattacaccccaataacgacatttcttaatggaatccttctcaggaataaaaaaaataacctacagaaaaacatgacatgaatgaatctcaaaaatacactgagcaaaagtaacaagacaaagagtgcatatgtgcaagaatattgagaaaaaaacaaactcagtttctccctacacactcaacaatcaacacaaaagacttctgtgacccaatgtgtgggggttttccctatacaccaaacaagcatttctgcagtgacaccagctgggtgtcctctattgtaattcaattctgacactatctacggggtgaaagcaccataccccataggttgagggttcagtccccaagacttttaactaccagttccagatgccaatcgcaaggcccaagtcgccttacctgtgcttcttactgaatagctataaatcagggttcccacaagcccctctttgggtttgactaatttgctagaggagcttacagaactcaaagaaacattaaagtttattggtttattataaagaatatgacagtccaggcgcagtggctcacccctgtaatcccagcactttgggaggccagggtaagcagatcacttgagcccaggagttccagacaagcctcggcaacatggcaaaactgtctctacaaaaaatacaaaaataagacagacataatggtgtgctcctgtagtcccagctactcgggaggccgaggtgggagggctgcttgaacccaggagtcagaggttgcagtgagctgagatggtgcactgcacaccagcctgggcaacagagtaagactctgtctccaaaaaaaagaaagaaagaaagaaagattacaacatattcagaggaacaccagagaaagagatgtatagaacaaggtatggagaaagaagcgcagagcttccatgccttttctggatgcgccatcctctccaggaacctccatgtgttcagctatccagaagttctccaaaccctgtccccttttggggttttttttatttatttatttttgaggcagggtctcactctgtcatccaggctggagtccaggggtgcaatctcggctcactgcaacctccgcctcctgggttcaagcgatcctcctgcctcagccttctgagtagctgggcttacaggcacacaccaccatgaccggctaatttttatatttttggtagagacgggttttcactatgttactcaggctggtgtcgaactcctgggctcaagtgatctgtctgccttggcctcccaaagtgctgggattacaggcgtgagccactgcgcccagcctgttttatttttgagacagggtcttgctctgtcacccaggctagaatgcagtggtgccatcacagttcactgcagcctcaatctccttggctcaagccaacctcctgcctcagcctcccaagtagctgggactagaggcacatgccaccttacctagctaatttttctattagagatagggttttgccatattacccagcctggtctcaaacttctgggctcaagcaatccacccacctaggctccccaaagtgctgggattacagatgtgagccacacccagcccttttgggtttttaatgaagacctcataacatagacgtgattgattcaatcgtgaccactggtgaacaagttaactttcagtctcttttcctcaaagttgagggtgaggctaaatcccaaccctctaatccaggttttgtctttcttaggctcccatcctgaagctacctaagggcagctagccattgatcattagcattaaaaaaaaaaaaacaaaaaaaaaaacactattactttgaagattccaaggatttcaagagttgtataccaggaaatggtgatgaagaccaactatttactcactagcacaataccatgatttcatttatacaattttctaggaaaaaacaatactggtctatagtgacagaaagcaaatcagtagttgctggacaccagccatggggattactgtcagcacaagacaattttttggagttcatggaagtgcactgtatcttgattgtgctggtggttacacagatctatatatttactagtcaaaactcagcaaaccgtacacttaaaatctgtccattttactgtatataatatacacttcaataaagctatttttaaatttttttaagctttcacttgtagtcagttacatatacatacctctaattgttgctgttccattttcgtcaataaaaatttggagtatatattgcttttttcaagcaaatgttgaagtctacggtaccgaatttctgtcgactctctatcccaagacatgcgagcctatccaaagagaaaatttccataattatgaacactttctgacataccttaatttttttggcataaagtttaataaaaatggctaaaataacattttttaaaccaaacactttcaaaccaaaaactggaacaaataactgttaaaaaaaaaatagtttttgggtttaacaggcaatctgatagatgcaattcgtatatcaaaatattataatttcaaatattgaacacatggtttctggcactactgagttggaaggtccatttaaaaaacaattgaaggccgggtgcggtgactcacacctgtaatcccagcactttgggaggccaaagcaggcggatcacctgaggtcgggggttcgagaccagccggaccaacatggagaaaccccatctctactaaaaatacaaaattagccaggcgtggtggtgcatgcctgtaatcccagctacttgggaggctgaggcaggagaatcgcttgaacccgggggaggcagaggctgcagtgagccgagatcatgccactgcactccaaacaagagcaaaactccgtaccaaaaaaaaaaaaaaaaaaattggggccaggcacggtggctcacgcctgtaatcccagcactttgggaggccgaggagggtggatcacctgaggtcaggagtttgagaccatcctggccaaaatggtgaaaccccatctctactaaaactataaaaattagcaggacgtggtggcgcatgcctgtagtcccagctactcaggaggctgaggcaggagaattgcttaaacccgggaagcggaggttgcagtgagctgagatggcaccactgcactccagcctgggtgacagagtgagactccgtccggaaaaaaaaaaaaaggtatgtgtaatttgctaaaacattgatgttgtggttccgtgttattatattaccttgttatgtacagataaggaaaatttttgattaattttgcacttgaccctcataaaaagtgattgcctaggtgacactagagaattctaagacaagttttcagagtctctccctatttgagattaataaacaagttgatttggatagaacattttagaaaaatactaccaacacaattcatcctaacaatcaaaacagacatctagccaagattaacacccccaccccgttttttaaggcatggtctcatgctgtaattggtgcaattgtggcttactgcagcctccaaatcccgggctcaaaccaccctcccacctcagcctcccaagtagctgggactctaggcagatgccaccatgccctgttaattttttgtattttttttttttgtaaagacagggtttcaccatattgctaaggcaggtctccaactcctaaactcaagagattcgtctgccttgtcctcccaaagtactgggattacaggcatgtgccaccatgcccaaccaagattaccaattctgtaacatgaatccagcctagtaaatcaacaaacatgtactgcaacaattatataaattatgtaactggtagaagacagaaagtctgatttatactacagatgagacattagtgtaatatctgaaaacaacaagtattaaagacatatacatagcagtaaactgtacagtactatctaaatcctgaaaaattgtaagaattactaaaactggagaagtcagatttcaggaaatagatgacatctgaggggtctgaaggatggataaatgagagcagaaaaactcaagttttgtcaattactgtagaagttcctgctttaagcaacactggcctcagcaacagcactaaaaatcacacttaagttaactttagaattaaaaagattctaaattttatagattagatagtagatatgtttcattttatacaaactcttgacttaaaaagtctagtggcagattttttagtattttgttttctcaactaaaccaattcctctacttttcaacaaggattagtaaaaacacaaagtcaaccaataaaatctaactgcccctttccccagtaattggtggtttcaacttaagaggaaagtaattgagcattgtttacagcgtgtttgaaatgggggatatgaggctgggcgcggtggctcacgcctgtaatcccagcactttgggaggctgaggcgggcggatcccgaggtcaggagattgagactgtcctggctaacacggtgaaaccctgtctctactaaaaatacaaaaaattagccgcgtgtggttgcaggcgcctgtagtcccagctacttgggaggctgaggcaggagaatggcgtgaacccggaaggcagagcttgcagtgagccgagatcgcgccactgcacttcagcctgggcaacagagcgagactccatctcaaaaaaaaaaaagaaaagaaatgggggtatgaattcatttttatactctaaataatgccctagcacttgggtagttttgctgctccagcttatcaatatctctaagatatcattttatattgccttacattttcctagctattacatcatcactatagctttctttcaaaatatatttctttttcttttttgagatggagtctcactctgttgcccaggctggagtgcagtggcacaatcctggctcacctctgcctccgcctcccgggttcaagcaattacctgcctcagcctccccagtatagctgggactagaggcacctgccaccacaccccgctaatttttgtatttttagtagagacgggctttcaccatcttggccaggctgctcttgaactgacctcgtggtccacctgcctcagcctcccaaagtgctgggattataggtgtgagccaccgtacccggcatcaaaatatatttctattataaaatcagtgactacagtaagattctaagaatggacctaacaaaagtaatgcatactcattacagaaaaactaaatgtcaaaaaatatataaatcacccataatcccacctacacagataattcttaatatcttgaactcaattttcagttcttttaggacagaatttcttttactattaccagtatactactgtggttacaatacgcaactactgaggtgaatatgaaaacagggagatgaaaattacttacacaatatatggattcttaaatttttaacttttaaaatttaagttcagttaaaataacgtgggtttaacttagatatagttgataccttaaatcctgtacagaattagcactttttcttttttctgagacagggtctcgctctatcacccaggctggagtgcagtggtgagatctcggctcaatgcaacctgcgcctcccaggctcaagcgataatcctcctgcctcaccctcttgagtagctaggactataggcgcgtgccaccatgccggctagttttttaattttttgtagagatggggtttcaccctgttacccaggctggtcttaacccctgggctcaagcgatctgccccgcctcagcctcccaaagtgctgggattacaggcatgagccaccgcgcctggccagcacatatttttaaaacaactaaatacagccaggcatggtggctcacgcctgtaatcctggcactttgggaggtcgaggaaggcagatcacgatgtcaggagtttgagaccaggccggccaatatgttgaaaccccgtctttactaaaaatacaaaaaaaattagctgggcgtggtggcacgcgcctgtagtcctagctacttgggaggctgaggcagaagaatcgcttaaacccggcaggtgaaggtcgcagtgagccaagatcacgccactgcactccagcctgggtgacagagggagactccgtctcaaaacaaacaaacaagcaaaaaaaacctaaatacttgcctggtgctcctggaaaaatttttcctaaaaaaaaaaatcagctgggcatggtggctaatgcctgtaatcccagcactttaggaggtcaagacgggcggatcacctgaggttgggagttcgagaccagcctgaccaacatggagaaaccccatctctactaaaaatacaaaattagccaggcttggcggcacatgcctgtaatcccaactactcaggaggctgaggcaggagaattgcttgaaccccggaggcagaggttgcagtgagccgagactgcgccattgcactctagcctgggcaacaagagtgaaactctgtctcaaaaaaataaaaataaaaataaaaatcactaaagctttaagatgccatcatggaaaaaaataatatacaattaatattaaaataataccatgtaagtggttaatccttaaacctggtcttctgtatttcaaatcttcctatcactgttttttctttatttatcaatttcatgattatattacggtaaattgcaactccatctattaaaagcactgagtgcctggcaggaaacaactctgggtaactacagtacagagtatgccaatggacaccgagggcagaaattcctcattatctaccccattatctctcccaacaccaatcccagattttttattggggggtgggaggagttctattttagcctacacatatcatgatccttttacctctccaagaaatctcctgactccaactattccccctcctccacttcacaggcactatcagtactcaaatctcctagactaacaatgacttcttttaaagggaaatacatgtgaaaagtcaaagaaaataactgtagccaatgaatgtcaaagtcattttctaggttcctcacaaaccttaggatttcctaaagccaaatgcttctcattaaggaacttaagctagctcttcctctgttaagtacttctaaatacatgcccatacagactgtattctcccaaaagaaaaggaatctctacctgtgcatagttaattgtttggcctccaaagacatgtttattaatctcaagtaggtagagactctgaaaacttttcttagaattttctagtgtcatctaggcaatcactttttatgagggtccagtgcaaaaaataatcaaaaactttccttatctgtacataacaagacaatgtaatacgaaaccacaacactaatgttttagcaaattacacacttatattaagattgaaaacggctacatacttttttttttgagacggaatcttgctctgtcacccaggctggagtgcagtgatgccatctcggctcactgcaacctctgcctcctgggttcaagcaattctcctgcctcagcctcctgagtagttgggactgcaggtatgcgccaccacatctggctaatttttatatttttagtagagacggggtttcaccatgttggccaaactggtctcgaactcctgacctcaggtgatccacccgcctcggcctcccaaagtgctgggattacaagcgtgagccaccatgccaggccatgaaaacagccatatacttttttaatggaaggattaaaaattactctttaggttctatgatgcataattattaaatttaggactaactgcaaaatgtttgttcataagcttaaaaatgtcattaaaagtagcaggtcatttgacctcagcaaatatataaaatactacatatttgacttatcttttttaaatgtgaagtgtttcttccttgaatgaataataccttctgaaaatgtactgttgtcatatctcaggcatatctttctttaaatgctatttccctacccaacactcataatgggtatatgaagaaacaagataaaactgaagatacattactcaagacaaaattatcacatccctcttagacttcttcagttgattccattctgggcacttgccccagaatttatactttataattcatctggttatatagctaataagtatatttagtatatgtatataatcttgtatattataaaataccattttatcatcgttagctattcaataagcacttactgattgcctactatgtgccaggtgcaaagcctacaaaaacaaaacagcaagtgatgcaccctcaagaaacaaagtgagaaagaatcaaaaagtagtatgaagtatttatcattacttatttggtcatggtaaattctgtgtaataaagtactatgaaaattcaaagaatgagaaaaggtggttcaggtcagacctctcaattctgttaattcacatctaccctgaagcaaaaagtattgatgttacttaaagaaaatttgttaatatattaccttaactggttatagtcaaccagagatcatcagtaataacggaaggagtattactggagtggaactatagcatggtagttaaaaaatgtgcattctagaaccacatggcctacactggaatgttagctctgccatttaccaactgtggcacccaaacaacctctatgtgcctcagtttcctcatctgtaaaataagatgactaataaaacctatttggttgtgtagttcaataatagcaattgtttatactagtaattaaactagtaagtttaatagcagtaatagtaataatgaacatctactttacagaatagttgaggattcaatgagtaaatacatataaagcattcaaaacaatgcatgactcctaataaatgttcaagaagtattaacaatgctgacaaaaaaattattgttgacataacagggaaccaacggcctcattactcgtttttggaatgcattattttccaacttaagtagttttataatcatgagttaattcactattattaaggacagaaattctgcaggcagcctgagttgaaatttgacttcaacacttactatgtgcccttctccctcagtttcttcatttgtaaatgaaaataacaaaaaataacctatatcataatatcggtagagtttaataaattaataaagcacaagaaaaccacgtactaggcagtacttaagagtcaacgatcattctttttcttgcatatgaatcaagcagcagggtggggctttagaataaacaagaatttttcaggttaaaaactgtttttagtaacttacaaaatgctctctacaagaaaactacagcaacttgtcattgaaaaagtacggcacatttttagctaaagaatcttatgtagcaatacacaggccatgaaaccaaaagaaaaacaaacagcaagttgatcacttaggtggaaaacagcactacagtataaggaaatcattagacttggattccagcccagcctttgattgatgctaacttctcctgccctcagtctagtacattacttctgcaggttttagcgattcctgtttgccatgagacatacatttaaggtaatttttaaaggaaataaggatgacaaacgaaaaaactcactatggactttgaaagacttttcatggctaaacaagcaatctgaaatgctcatttaaaagtgatgggactaccaagactacatctcatagaaacacaccattcaaagcacttgcgaaaggattctcaaaggcaatatctgtaaacatacaaaaaagacaagtaataaagctgttttctttcagttattaaaaagcccactaaataggaaagcaaagaacacaaaccacacctccgggttaaagccgaggttaccacaggctttcacgacgacgaacctgatgcctaaattaccttttccagcatcttccgctctctctctagtccagcagcttcaagctgttcttcctcttctagcatggccggggtaatcacagcagtgtccagttgttcaaccattgctggagcctccgagcctgacgggggagaaagctttcaaattgcagttttaaaaaaattaccaactactcaactccaacaagaaacagcctttctcccacccgagatgcactggagcaaaagctgaagaccgaggggacgccagcatcacctctcagaagacaccgtaagtcttcacaatgtctacaagtcgcctggaccacagtttacaactcgggatgctcgggaaaatgcagttgcctatgtgaaatcttcaccggcatgctaatacgtgcgattccggggtgtcctccactcaccgttgcagtttcccaaccctcctttcctcctcagtccctgcccggggtcggctccctccccgaaactccgccgcagcctccatgcttgcccacctcagccccgcaggctgccacccgcgcccaaaaggttttcctcactcaccgccgctgcccgcgggccgttccgctggcatgcctggacactcacccgggaaccgggtcccctcctctcagagcctgcaatgccgcgagctaactcctcacaaccgctgccggcccagccttctagccaaatcccccgccagggaaaaaagcgcgcttctccttcgcgggaaaatcctgtcatctcgcgataccttacattccccacccgccctcccgccccgctgcgcgagatttggcgcagcttgcggttttcgtcaggactgacctgtggcaaccgtaaacctttacctggacctctctcaggaggaaactgggtcccgctgccgaactcagcctgtaactatcctgtgagattgggcgaggtggccgatcgtggagaacccagtttcctcacatatctggttccgaactacgcaattaaagtttgatagtgctgttaatactttgcaaggcgccttccaacgctggctgctgtgattgagcacccgctagcccatgatcctgtaggtagagacgtctgcgtatctgcacgaggatgtcagaaacagaaacatttttatagggccagcctcgccgcacccgcagcgcgcggctcacatcttaagtgaaaaatcccccaaaatgacaaagaggagggcttttttgtgggtgggacgggagagagaaggaacaggaaattaagattatgactgggttaaagaaagctgtttaggataagggcaagctgaaagaagtgatggaccaagcggagtggccagcagaaggaagattcaggaaaccaaacaggattcattcattcgagtgggcagtgaaggaaggagcggagcttttcttgtccctggttttcacttcagctttcaattcctccttttcttgtttgcattccttttcaactatttcctttgtctccctctccagggctccctttcccacctccaatttcttaagatgtatggcattaaatatacctaccatgtaaccacccgtttccttcattttgactcccacaacttgtatgattgtgtctatacaaaatttaagagtttacaagccgggtgcggtgactcacgcctgtaatcccagcactttcggagcccaaggcgggtggatcacgaggtcaggagttcaagaccagcctggccaagatggtgaaaccctgtctctactaaaaatacaaaacagccgggcacggtggcaggcgcctgtagtcccagctactcgggaggctgaggcaggagaatcgcctgaacctgggcggcagaggttgcagtgagcagagatcgcgccattgcactccagcctgggcaacagggagagactccgtctcataaaaaatagaaacgaaacctagtctctatattttattttattaagatagggtctcactctgtcgtccaggcaggagtgcaatggcacgatctctgctcactgcaatctccacctcctgggctcagttgatcctcccacctcagcctagcaagtagctgagactacaggtgcgtgccaccacgcccggacattttagtgtcggacattagcccattccaggctaatttttgttggtttggggtttttgtgtgtttttgttttttggtagagacggtttttcgccatgttatctagactggtctcgaactcctaggttcaagggatcctcccaactcggcctccggaagtgctgagagtgcaggcgtgacacattgtgcctggcccctacaaacatttccaaaattagccggctgtggtggcacatgcctgtggtcctagtacttgggaggctgaggtgggagaatcacttgatcccaggtggtcaaggctgcagtgagccgagattgtaacactgcactccagcctgggtgataaagctacactttgtctcaaaaaaaaaaaaaaaaaaaaaaaaaaaaaaaaccatgggaataaagggaaatcttgagttgcttcaagggaaattccaggaacctagctagccctgacaagtaaataagcaacttgataaggaagaaggtaatggtagcctaaaacaacagcccaggaagttagattcaggagatgtttggttcctttataaaaactagagataatatcttaacacatgtctctgagttgttttttagaaaccccaagcgccaccaaacacatgtgctggcactctgctgcctcatttgttctaaatttattcctaggggcctggaggaggtcacacacacaagcagagctagcattcttttctgctgatcccaaatttttattttttaatttttaaaaattgagatggagtctcattatattgcctaggctggtctcaaactcctgggctcaagccatcctcccactcagcctcccaagtcaaagggaaagaaattttgggattacgggcacactctaccacacccagctccccaaatttttagacaaagcttcacctcctgaaccaactgcaaatcagaaaaccttttaatccatctatgacctaccttttaatccaccttttgacctacctaccctttgagatggcggtcgaaacaatacatagactccatgtattaatcaatgactttgcctgtaatttctgctttcctgaaatttacccctgcctttaaaaatccttacctgcaagccatcagggagtttgggtcttaagcatgagctgccccaattcctacagctgcaaaagctcagtgtggaagtcttgtcttcctgagccaggcaagtggaccacagttcagttctataacagtaccttacgttaaatggttcaatttgaagccctccaatcagaccctgccaagccaacattcctaaatcttttcccttgctctctgatcccttaaaatttgccctagacctggccgggcacggtggctcacgcctgtaatcccagtactttgggaggccgaggtgggtggatcacgaggtcagattgagaccatcctggctaacgtagtgaaaccctgtctctactaaaaaatacaaaaaattagccgggtgtggtggcacgcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaattgccctagaccctaaatcagggagacagacttgagcccactcctgtctccttgctgaccacttgcaataaagcctttcgtcaaaggcaggtgccatagtttttggctttagtgtgtaacgggcagtgagcccatttgcttgataacatttttactcctagttcattcaatattatttcaagataaaatgtagcctctgttaatagctactcttaaatcctatctcctaatcgaaaacttagctgtttcattctacttaagatttgctttttgttgtgttttgagacagggtcttgctctgttgcccaggctaaagtgcagtggcacaatcatagctcactgcaacctcaaattcctgggctcaagtgatcctcccacatcagcctcctgagcagctaagtctacaggtgcataccactacacccagctaattttttaaaattttctgtagagacagggttttgctatgttactcaggctggtcttgaactcctgggctcaagggatcctcccaccttgacctcccagagtatgaaattactggcatgccagagcgtgagccacttcacccgccaccctcactctacttaaggtttttggggccgggtgcagtggctcatgtctgtaatcccagcactttgggaggccaaggtgggtggatcatgaggtcaagagatcgagaccatcctggccaacatgatgaagcccatctctactaaaaatacaaaaattagctgggtgtggtggcacacacctgtaatcttagctactagggtagctgaggcaggagaatcacttgaacctggaaggcagaggttgtagtgagcgaagatcatgccactgcactccagcctggcgacagagcaagactccatctcaaaaaaaaaaaaaaaattttttttgacctttaccaacctatcctccaaaatttctttccctttgacttttgaaacactttttatggggtttttccctaatgtactgaaaaatctttccttgttccttcttttgaattctgatatggtttagctgtgtcccccacccaaatctcatcttgaattgcagcttccataattcccacatgttgtgggagggacctggtgggagataattgaattatggcagcagtttcccccatactgttcttgtggtagtgaataagtctcacgagatcaagatgagatggttctataaggggaaacccctttcgcttggctctcattctctctcttgcctgccaccaagtaagacatgcttttcatcttctgccttctgccatgattgtgaggccttcccagccacgtggaactgtaagtccattagcctctttttctttataaattacccagtcttgagtatgtctttatcagcagcatgaaaatggactaatacaaattcaactgtggcccacctccccaaatctttcttccattcattgtttttctctagaaactttgttccttggaccttctgctccacaggcaagagagagaatttgtccaaatacacgaaatggagctcaagaaaacttcatctgattctcaaagaacacacatctcaactgacatctggccccacacttggtaataaaagtgcattggtgcatttcctggcacgtctttgccgttgtgcaaaccctcccttcaaagtggctgtgaacactcttgttcattcacttttatttaagggtctacatttattttgttttttctttgttttttcaatgcctcctggttagaaagaatgaataacacctactattgattgcctaacagggttactatagtcaataataattgtacatttttaaataacttaaggagtataattggtttataactcaaaggataaatgcttaaggggatggataccccattttccatgatgtttttatttcacagtgtatgcctgtatcaaaacatctcatgtaccccataaacatatacacctactgtgtacccacaaaaattaaaaattaaattaaaatgtctcctggataccaggaactatcacaggagctgtacagcaatgaaccagacagactacatccctgttgatatggaacttacattccaggagttgggatgaaaagggggaaattgcaaaatattagaatagggtggcatgagagtgacaggatagttattttagattgggtaattggatgtctgaagaagtgataggcacttttgtgtgtgtgtgtgtgtgtgtgtgtgtgtgtgggatgaagtttcactcttgttgcccaggctggagtgcaatggcgcaatcttggctcaccgcaacctccgcctcccgggttcaagcaattctcctgcctcagcctcccgagtacctgggattacaagcatacgccaccaagcctggctaattttgtatttttagtagaaacggggtttctccatgttggtgaggctggtctcaaactcccgacctcaggtgatccacccgccacggcctcccaaagtgctgggattacaggcaagagccaccacacccagccgaagtgataggcactttaagcagagaaccaaatgccaagaagctagccagcctgggggaagagcaatccaagcagaaactacacgtgtacagagagtaaagcaggaatacacttgggcatgtttgaatatcagagagaaggccagtatcactgaagccgaattggcaagggggaatggcacaaaaagtcagaggcagaccctccagataaggcactggggattttcttctaagtatgatgttacaagtcatttttccctacccacacaaaatgtcttcctcttatagaatccttttcatatcaatgtgcataaccatccatccaatcatagaagtcaaaacaaaagaaaaccctggctccctcttgttacggtagatggccccacttctggcctacctaacaaaggaaacaatagctacaagacagaattccccattcagcttaccaacatcaaatttacaaacccatctgcatcctgaatacctttctcactctctcatcttgtgctctggatccaactccctgctgcctattcagaaattattttagattagaaatcattattccctctttttaaaagataaaatctcactctgtcacccaggctggagtgcagtggtaccatcatagctcactgtaacctttaattcctgaactcaaggaatcctcccaccttaggctccaagtagctgggattacaggtgcaagccactgcacccagctggaacctcctatttccctaccaactattttcagttctctcttcccctttaaagcttacttttataattgtctacactagcaatgtttaattccttgcctcccactgattcttcaaccctctgtctcattgcaacattcagcatacatcaaagtagcccactaaggtttaatgacttcaatgttgctcagtttaatggacattctcagttcttatttgaatctcattgcaacataacactgttaatcactcctttatggaaacactcttgtccgttgtcttttctgaccccacattctcttgatattcctattcctgacttttactagttctcttctacccaacctttaaatgtttaactttccgagtgaaccagaaactatttgagtttctggtcactgcataatatctataatagaaaaaaatttaaatgaaaaggtaagtgcagtgaggaatggaccgaaataaaaacaatccagtcatccatatctaccataggttagtgccatgcactattttgggtactagcgcttcagtagtaaataagacaatgtttttgacctcagagtttacactgtagtggaaacaatagacagcactataaagtagtgtcagttggtgatatataatagaaattataaagaaatatgaagcagggtaaggtcatgagaatagtggatacatgttgagagaaaagtcctctgaggaagtgaccttaagcagcggtataaagtataagccatacaaagacctagacaaaaaacacttcagagggaagaaagacctcaggtagatagaaggctgacaaattgaaaaatggcagtaagtccactgtgtctacaggcagaatgtttataaattgcagctgaaattggaaagatgcacagtgaccagatcaagtaggaccatggagactaggataaagagtgtggatttttattacgaggaatgccattagaggatcttgagtaaaaaaatgatagaaattaatttacacttttttttttttttgagacggagtcttgctctgtcgcccaggctggagtgcaatggtgtgatctcggctcactgcaacctccgcctcttgggttcaagcgattctcctgcctcagcctcccaagtagctgggattacaggcacctaccaccatgcccagctaatttttgtactttcagtagtgacagggtttcactatgttggtcaggctggtctcaactcctgacctcaagtgatccgcccacctcagcttcctaaggtgctgggatggcaggtgcgagccaccgtgcccagttgatttacactgttaaaaggtaatgaaacatgtaagctaattaaaaatttcataagatgtgtttgcttttcaagggctcacataagaggcttttttgttgcctaacttaccccatttttttttttttaagacggagtctcgctctgtcacccaggctggagtgcagccggcgatcttgggtcactgcaagctccacctcccgggttcacgccattctcttgcctcagcctgccgagtagctgggattacaggaataccccaccaagcctggctaattttgtatttttagtagaaatggggtttctccatgttggtaaggctggtcccgaactcctgacctcaggtaatccgcctgccttggcctcccaaagtgctggaattaaaggcgtgagccaccgtgcccagcccaattttttttaaaatgtttttgagaaagtgtctcactctgttgcacaggctggagtccagtggtgtgatcagtgtagcctcaacctcccaggctcaggcaatcctcctacctcagccttccaagtagctgagactacaggcacatgctaccatgcccagctaatttttaaattttttgtagagatggtctcactatgttacccaggctaatctggagctcctcagatcaagtggtgctcctgcctcagcctcccaaagtgctaggatcacagacatgagccaccgtgctcagctgtgaccagaatttgaagcttcactttctgcttttataccattgtgtatagcattatgcctgaggatgaaaaatgagaacatatataccccattgttgtcaattttatatactccttcaagtctatattcatttatcatttacatatttattataaagatgatttttcaaatacattgcaataatacaaaagtcattttactttaaatttaataaagtcattattgtttacgtaaatgttcaaatgaaacactttcataatgtaattttagtcaaatttccttcctggtgtttactggaaaataaatggaatctacaaaataaaatgcacataagcaaattctcattaattgagatcaagggatgatcaatatgaacagcagaatatcttgaaagaaaggcaattttggaatttcccaaatcttaaaactttatgtagcctaacaaaatattaagaggcagtgcttggcaataatcagggcttaagacatataagtgtattaattcaaatttcccatgtttgcaattacactcttaccaagcaaacaatatttttaaagagcagggctttctctggagtggttagtttccctgaaatcctggatttcattttagtttttacatgttgtaaagcagtgatgttctagttaatgaggttttattagagttgagaattcatattttagacaatgcttgtcaaacagcaaaataatacgattccatacaaaaataacatttttttcctctcagaagactgttttctgacactatcaattagtcatgacaaattttaattttaatgtaacttactgtccaatgctaccttacacttttttgactctattttatactagtccctgctgtctgaacacactcttggaatataaaataattttatcttacccaaacaaaaacataaaattaaaaataaaaataaatcatatgacattatgaagtaagataaattatttcatgattatctgctttagaattatacccttcagtagtgtagactctaaagagttgactggcctaggtcaaaataacattagttcctaagctgcaaggaacgctattatcttgaagtcagagattttgaaaatgtcaatgtcattttgcaaatgctacctaattttataaagtcaaacaaatatactcaaaggtcacatatgcaaaagacatcagcaaaagctgactatacaaaactatgcgagttactggagtcttctaacagcatttttttttctaacagcatttaaataaggcattgtagacctggactaaaggaacattaagtaagaaatatatatattgagtagacaaacaaatgaaacaccatattaaatttcacattattttgagtattttaggaaaagtttttttttaattgaaaatatactgtaacaacaacaacaaaaactgccatatactgaccatgtgaattatcacatatttcctacatactgggctcaagagaagatacagtacaatattttagctgccagtactgtcagtctaaaaagactgaaggcttagtgcattccttggaagacaaatttggcaaacaaaaacaaagattatttcctttgtttccttgagatgcagttaaataaaacagatatccccaaagtaatgaagactcatttcaagtaattactctgcttaccagttttatttacacagtaattgttatgagtggtttttagtgaattctttgtatttacattttatatacacatttatacttgaaaggtaaagaaactgtacaataataaaaaaataagaaaaacaaatacagtaacttaggtccaactgaggaaacaaatacatgaaagtatgattaaatttagtcaggtagtataacctgaatgagattactgccagatgttatattccctctatcaaggataccaataccaaggaagtagttactggagttaaaaggtcattctaaaacctgctaagaccatggccactccttcaatattttattatattaccagtctccaataagtaagtccctataatagcaattaccttttgagggttctactagtagtccttagactagaatgacccatggggtaaaaatatatggacaccctagggccccatactcctaaagaggcagtcactacactaacaaggatcgcaggcttgttagtttgaaaactatatacactaacagaaatagtgtgcttaagtgttgtttcaaactaaactgcaacataaaaacacactgtaaatctaaccaaacagcatgttatatagccatcactcataacactcaagtgatttaggttcaaatttaaacataataggacaatagcaatatgtcattagagatcagagatctctgtcaatcagatatagccttgcccccacctaaagatgtgttcgctgcctcatgtatgtctctagtagcagttccgaaagccaatgcattcactcttggaaagacaatgtcaattgttctgacattgctgttgactacatttaactaattctatgatatggtactagagctcaggaaatacatcaagccaggtcactctgttcagacctcccaagggaaacatgttccctggacagcacctgactgggaaaagactgttaatgttgctataaaatgcaaaatagtaaaagcagcattttccccaatttacttttcagtgagaaagccaagcagaaacccaatgcagcacattgtgaagagtttcaatgctctattttcagcagttaagccaggcataccacctccttcatctgacctggatcctgctctggacttcaaggaaacacacacctgattagcagttcaagaactcgacataaaaataattcatgctatgtttcaattggagggtcatgacactgttgggcccacaggcaaagcattcataagtcaatttaatttaagttcatatctacctttttgaaaatgactccctatgttacaatgaaagaattcatcaaataatgattcaatcatgcagcactacttcctagagttggcagggaaatcatgcatttcttggcggttgagagaaggctgatccaaaaacacagtgaagagatgttcccattcctcaaagtatttcacctccatgggcatgatgatttaaaacctgctaagttcccgaacctatgcaaagtggccaatgtgaggaagcagaagttggataactcattcagaggctaccaattttccaaagagtcactatctagactagcggatagtgaggtagacgagggcagtatcaagaccttccttgaagaaagcaatgatgagtaaagaagatgaggatgggttataggcagcatttagtgtaccatgtgaagagattaagatggcactgacacataaaagaatcaataacaagactaatctccttacccagcttcttcaggcaactgaatcaagagataggatgtagacttagaaaaaaaattaactttacctttttcttttattcttatttccactgattaggaaaaattatgcatagagttttacaagtcacagatttagctacatattagatttcaaatttcaaactggagttaaacagtggaagaattgtaactaaaaaatatgaagtcttgccaagtagcatgctgtttaagaactctcaggattcattactttttactcttatcactgagaaacatcatatatgtttttggacttactctcaaagtcaagtcttcaatccactgaagtgcaaagcactttccttctaccagttatttatagttttcttaatgtcaaattattagatgaataatttgttagactagaaccagaatggctaaaattctctgagtgataggaattccttaaggaagacaaaaaatttcccttaaaaaacaaatggacaccatactatggaaaaacatctaaacaaacaataaacaatctcccaccaacatttccagttcctaggtaactcgaatttgccccaacttgtgaatgaagataaatgacatcttcagtgacttaaataatttacaaccaaatctgttcattactggtctataatatcttcaaaaggtcagaactggaaacaatgtctgtactatagtactttggaggttaacagtagtatttaacaatcctactctagcctccagaatatctttgtggtaactgttacaaaagaaaagatgtaaaaatttgaagtatcttcaaagctattttaaaaatttattgcattttgtttactccaaattgtggaatataaactcaccacttaaactttttcctttgaaaaatgactctacctacaaaataatagtttattaatactgtcaataagttacttatttcatttacttcagccataaaatgtaaaatcagcagttttccacctcttgattcttttaggtatctccaacattttcttccacgccttttacataggaaacaaaaaacctttatccaaaaaccactttttctatgtcagttagtctgtcaattttgaagactagcttttcaaagcaggactactgttcttgtctccttctttaatatccttcattacagatgcaaagacctgaaaattatataaaataaagattaatcctcaaaaactaccacccagattaaagagatttaaataactatagttcataaacatgaaaaagctttattatacttaacactgtccccgaaagtgtgtcattctcaaatcccctttatttttttctaatcatgaaatatgattagattccaatttttaccaattgccaactattctgaaattactatttggtaacataacattttctgaaccaataagactgtgaatttaataatgccaattgtttatatcattcatggattgagtgatactgctatccttttatgtcacttaacttagattgccaatgcttttactttcctaacaagactaagcatctaaaagccaggaccatacattatatattctttcaactacaaaccctagtacacagtaggtatttaatataataaaattgttgtctatttgaaataccaaaataataactactctggcaaataaatgactactgtgggttgtacttcactaaattgataatactggacttaaataaaataaagcccagtcaagtgcagtggctcatgcctgtaatcacagcactttgggaggctgaggcgggcagatcacaaggtcaggagatcgagaccatcctggctaacatggtgaaaccccgtctctactaaaaatacaaaaaattagctgggcgtggtggcatgtgcctgtaatcccagctactcgggagactgcagcaaaagaattgcttgaacccgggagacggtggttgtagtgagccaagatcacaccactgcactccagcctgggcgacagagtgagactccgtctcaaaataaaataaaataggccaggcgcggtgactgacgcctgtaatcccaacactttgggaggccaagacgagtggatcacaaggtcaggagattgagacaatcctggctaacacagtgaaaccccatctctactaaaaatacaaaaaattagccgggcgtggtggcgggcacctgtagtcccagctacttgggaggctgaggcaggagaatggtgtgaacccaggaggtggagcttgcagtgagccgagatcacaccactgcactccagcctgggtgacaataaaataacataacataacataacataacataacataacataacataacatataaaataaaataacataaaataaaataacataaaataaaataacataaaataaaataacataaaataaaataacataaaataaaataacataaaataaaataaaataaaataacataaaataacataacataaaataacataaaataacataaaataacataacataaaataacataaaataaaataaaataaaataaaataaaataaaataaaataaaataagccctatgtttggatagctgcaaagtgggcaatttgatttaaactcttgcttcttagaagtcaaaaattatttttaaaagacatatttttaagtactaacttttaagaaatacctaacttttttacaataagtcaactgctttaacacatctattaaagataagaaaatgtcactctacctgagtccattttttggtgctattctgcatctgaatggctgcaatacaactgaacagcttttccgatgtgatatcttctggcaatttagttagaaactgtgctatatgaataaagtccatctgcaggagaatatcttcatataatcggaggattcctaatccagtcctaaataaaaattcttccccatctctgcaaaatacatcccagactcgacaggccagatcaagtggtagtgatttgctatatagtgtgaagatcctaaaattagagggaaaaatggtcactgaaatttttcattcattgactcatttactcagtaagcatctctataaaaaaagaacagtgtttaattagggataagaaggcaaataacatatggctttcccatcctggccaacacggtgaaaccccgtctctactaaaaatacaaaaattagctgggcatggtggcacacacctacagtcccagctacatgggaggctgaggcaggagaatcgctcgaacccaggaggcggaggttgcagcgagctgagatcgtgccactgcactccagcctggtgatagagtgagactctgtctcagaaaaaaaaaaaaaaaaaaaaaaggcttcctccctcaaacttgagtagtgggaaattaaataataaataacaaaattatgtgaatttacaaccttatgtagaggaaaggcctaatatatactagagtggtagaacagtctggtagttaagggtatgagctatgaaaccagaatgcctgaatttgaatcctgaatttgccacttattagttgtgttaccttgagcaggatagttgtctttactgtgcctcagtttcttcattagtaaactataagaaaactacctacctctcaggattgttttaaaaattatagtagttaataaacgtaaaagtgtttacatcagcgtttggcatgtaagaaatgctaaataaaaattattattattgtatgaagaactcaaatatcatcttttagtaacctaatataaactcaaagtctgacttctctcttttctcttccccttgcacaaacatccattgttttgttttgtctttttcctccacccagctttatttactacttcttttgaagcatgtataccttccaatagaatcaccaaaatggtttttcccaacctttctgacaatgtctgaccacgtaattctttatccagtggttctctgggagccattctggttgggggaagtggggagagtaagtattacaggacttgtcttgaagttgccttggcaaagaaagtatacaattgtttacactgattgtgtgtttatttgaggtagtgctgatggggtttgaggaagggaactaaaagcttcctcgccaaaataatttttaaaaaaatccttttgcactgccacttattcattcctatcccacaaaaatgtctctgggatttgtatataataaactcaacagagacatgaaacaaaagtccatccctatctcttaaattacaaacacgtatttaatcatatgacaaaaaccacttttggtagtataaaactccctgttcaaaatgaggagtgcctaggctcaggttctagtatacagtacttactctttattagttctctcctgtcccccacatcaattgtgatcctgctatcccccatgctcacacttctcaagactgacaatggaggacttttttttccttcttaatggaattagtatttaaacttggatctcagtcccataatattaaaaaacccttctcccattttcttgggtccttccctgagtaactctaatgctcttgggggacgggaagagaatacattgaaaaataattttttttttaatggagttttgctcttgttgctcaggctggagtgcaatggcaaaatctcacctcaccgcaacctccacctccggggttcaagcgattctcctgcctcagcctcccgagtagctgtgactacaggtatggaccaccacgcccggctaattttgtatttttagtagagacggcgtttctccatgttggtcaggctggtctcgaattcccaacctcaggtgatctgcctgcctcggactcccaaagtgctgggattacaggcatgagccactgtgcccagccaataacttaatttttaaaaaagcctaaatcagtcgggtctggtggctcatgcctgtaatctcagcctttgggaggccaatgtgggaggatcgcttgcatccaggagttcaaggccagcctgggcaacatagtgagaccccatctctataaaatagcaaaaattagttgggtgtagtggtttgcctgtagccccagatactcgagaggctgaggtgggcagactgcttaagcctgggattttgaggctgcagtgagctgtgatcacgccactgcactcagcctgggtgacagagtgggagcctgtctcaaaaaaattaaaaaaaaaaatcctgaaccaaagaagacctgagaagacacatttgaccaatgccattatttatttttctacattaaagcttaataccatttacgtgaaacccactggttgtgaattgttaagaattaaagtttaaatatgtcatctgtactcttccccctcctcaaattatcatgtgaattctttttttttttttttggagacacagtcttgctctatttcccaggttagagtgaagtggcaggatctcggctcactgcaacctctgcctcccgggttcaagagattctcatgcctcagcctcccgagtagctgggattacaggtgcctgccaccacacctggctaatttttgtatttttagtagagacaaggtttcaccatattgtccaggctggtcttgaactcctgacctcagacgatccacccgcctcggcctcccaaagtgctgggattacaggtatgagcctctgcacccatgtgtattcttaacaacaacctgtcttaagatcaactgctccatctctttggcaaaattcacccaccattctataatctactgggtattgcttcaaaggcaaactctccaagttaaaacaaaagattttcaacagaaaacatgataaaagacattagtgcctaaataaggcatcattcttctatcagaaaactggatacattaataataggtacaaaaataataaggagtaaacttaggagtaaatttaaccaaggaggtgaaagacctctacaaggaaaacactgatgaaagaaactgaagaggatacaaacaaatggaaagacatcccatgttcatagattggaagaattaatattgttcaaatgacaatactacccaatataatctatagattccataaaatccctatcaaaataccaatgacactcttcacagaaataaaaaaaccatcctaaaatttatataaaacctcaaaagacttcaaacaacaaaagtaatcttgagaaaagaagaaaaaaaaaagctggaggcattagactaccagatctcaaaatacactacaaagccatagtaacccaaacagaatagtactggcataaaaacagatacatagaaaaatggcacagaatagagaacccagaagttaatccacattatctatagccaactgatttttgacaaagatgccaagaacactaattcaggaaaggacagtctcttcaataaatggtgctgggggaaaaactggatatgcatatgaaaattaaacaaaacaaaactagacccccacttctcaccctatacaaaagtcaactgaagatggatcaaagacctaaatgtaagacacaaaactataaaactatcagaagaaaacataggggaaatgcttcaggacattagtcttggaaaaaatgttattagtaaggtctcagaagtataggcaccaaaaccaaaaataaacaaattcccatttttagattatatcaaactaaaaagcttctgcacaccaaataaagcaatcaatagcataaaaaaaaaaaccccacagaatgggaaaaaatatctgcaaactattcatctgacaggaaattaataggcaaaatctatgaggaacttaaatatctcaacagcaaaagaaaaaaaaaaaacaaacgccaggcaccatggctcatgcctgtaatcccagcattttgggaagctgagacggtggatcacttgaggtcaggagttccagaccagcctggccaacatggtgagaccccgtctctactaaaaatacaaaaattagccaggtctggtgcacacctgtagtcccagctactcgagtggctgaggcacgagaatcacttgaaccgtgaaggtggaggttgcaatgagccaagatcacgccactgcactccagcctgggcaacagagtgcagagaatgactccgtcacacacacacacacacacacacaatcaatccagctaaaaaatgggcaaatgatctgaacagacattgctcaaaagaagacacacaaatgaccaacagatatattttaaaatgctcaacataattaagcatcagggaaatgcaaatcaaaagcataatgaggtatcctcttaccccagttaggatagctattatcaaaaagacaaaaaataacaaatgctggcaaggatgcaaagaaaagggaactcttatacactgttgttgtgaatgtaaagtacagccactatggagaacagtatggcgattcctcagaaaactacaaatagaacgaccatatgatccagcaatgacactactgggtatatacccaaaggaattgaaatcagtatgtttaagataggtctacactcccatgtttactgcagcactattcacaatagccaagatatggaatcaacctgagtatccaacaacagatgaatggataaagaaaatgtggtacatacacacaatggaatgctactaagccacaaaaaagaatgaaatcctgtcatttgtggcaacatggatagaaccagaggacattatgttaagtgaaatactgcatgttctcattcatatgcagaagctaaaaaatgctagtcactctctttttctttctttttttttttttttctcagagacagggtctggttctgttgctcaggctggaatatagtggtacaatatcagctcacttgagcctcctaggctcaagccatcctcccacctcagcctcccaagtagctgggactacaggtgatgccaccatgtaccatacagctaatttttgtattttttgtagagatggggtttcgccatcttgcctaggctggtctcaaactctgagctcaagcagtcagcctgctgcagcctcccaaagtgctaggattatgagcatgagccatcgcactggccagctgatctcataaaagtaaaaagtagaacagaggatactagaggctgggaagggtggagagaaggaagagataggctgaaatttgttaaaatatacaaaattacagccacataggaggaataagttctagtgttctatagcactgtagggtaactatagttaacatatggtttcaaataggacaactatactgaatgttcctaacacaaagaaatgataaatgtttgagatgatggatatgctaattaccctgatctcatcactatacattatatgtacagaaacatcactatgtaccccatggatatgtacaattattatgtgtcaactaaaaaaaatattttaaaacttcaaaagagtgaaaagaaaaagaaatcttaattccattaaaccacatagcttaagaaattaacttttagaaaatgtaatatacattgttacattgttgcaattacggtttttttgtttagctttttttttttttttttttgagacggagtcttgctctgtagcccaggctggagtgcagtggcgtgatcccggctcactgcaaccttggcctcctgggttcaagcgattctcgtgcctcagcctcctgacttactgcaaccttggcctcctgggttcaagcaattctcgtgcctcagcctcccgagtggctgggactacaggcacaggccaccacatccggcgtatttttagtagaaacagggtttcaccatgttggccaggctggtctggaactcctgagctcaggtgatttgcccacctcggcttcccaaagtgctaggattacaggcatgagccaccatgcccagccattatattttctttaaaaaatgtttatttatattgtataatacttgaacagcaatgattcgaccttcactatgacattctacttctgcatctcaatttcttcagctctaaaatgatgaatttggattacttccagttctaaaatcccacctctcttacaactaaaaaaaccctaaatattcctcttcagtaaaatcagtgttggtcatgttgtagttaactttataaagaatatggtttctggaactggactgctgaggttttagtttctattctgccatttattaactgtgaaatattaggtatggtactcaagcctatcaaaatttcagtatcaattatccaggcatggtgacgcatacctgtaatcccaactactcaggaggctgaggtgggaggaatgcttgagcccaggagttccaggtgggaggagctgtgattgcgccactgcactccaacccgggcaacagaactagactgtctcaaaaaataaaaaataaaaaaaaaattttttaatgaacgaaaaaataaaaaacaaaatttcaggttccccatcagtatgtggtaaaaattacagtacatatctttttttttttttttttaatggagtctcgctctgtctagagtgctgtggcgcgatctcgactcactgcaacctccaactccctggttcaagggattctccaacctcagcctcccaagtagctgggactacaggcatgcaccaccatgcctggctaatttttctatttttagtagaaatcgggtttcaccatgttggccaggatggtctcgatctcctgacctcgtgatccgcctgcctcggcctcccaaagtactgggattacaggcgtgagccatcatgccctggtttacagtacatatcttatgtggttgttctgattaaacagaaaaaaagtatgtgtggtagaaactggctgtttaccaaaccatttctttttctttctgggcaaacagctaaaccacattttgcatcttcacttgcagttagttgtggccacatgactgagtcctggccagtggaatgtgagaggaggagatgcgtaatacctctaggcttagcttcccaaaatctccccttgtgagtctccttgttctctccccttctgtgaaaaccctgaaaatgccttgttaaagacggtggaagtaaaaaatggaaggaacgttggtgcctgaattacaggttgtaggagagctgtatgcctattaggaacaccattaatatcattagtcttaatatgacaaacaaaaagtctaaaaaactttgaactttaaacacaagtaataaaatggtgatcctgtctgcagtatacatgatttggcaacatacataatttttttttaataggatctcgttctgtcacccaggctggaggacagtggtgcaatcatagctcactgtaaccttaaactcctgtgctcaagcaatcctcccacctcagcctcctgagtagctgggactacaggaatgcacgactatgtctggccaatttttttatttttattttttgtagaaatggggtcttgctgtggtgcccaggctggtctcaaactcctggcctccagcaatcctcccgccttggcctcccaaagtgctgggactacaggcgtcagccactgcacttggcctttttttttaagctagagaaaatctaggaaataaaattgtgtgtggaacagtaaaaagctgagctattcatatgtgaaacttggagaaagtatatcgtatttacatttattacatttttaaaaaaaatttcagacaatatgtaagaagggagatcaaattaaaaaattcaaattggtgtcatcttggggaaaaaaagcttgataaaaccttgaaataaaaagaaacaatatgaagcccttagtaaagaaacactattataactatcataagcccttgtgtgttaataataaaataaatagcaactaactctgagagcttagtatgtgctaggcattgaatgagataatccacgtaaaacaccctcgctacaactcaagataaagataatattattcccaatttatagacaaaaaactgaaacacaaactgagagattctgatttcaacccagagtctatgctctttttttttttttttttttttttttgagatagagtttcgctctgttgtccaggctgcagtgctggggtgtgatctcggttcactgcaacatctgcctctcaggttccaacaattgtcctgctgcagcctacagcgactacacccagctaagttcttttttttttttttttttttgagctggagtctcgatctgtcaccaggctggagtgcagtatcgcaatcttggctcactgcaacctcccgcctcctgggttcaagcgattctcctgcctcagcctcccaagtagctgggattacaggtgcatgccactatacctggctaatttttgtacttttagtagagacagggtttcaccatgttagtcaggctggtttcgaactcctgacctcgtgatccacccaccaaagtgctaagattacaggcatgagccaccgtgcctggccaagactaagtttttgtatatttagtagagacggggtttcgccatgtgggacaggctggtcttgaactcctgacctcaggtgatccgcccacctcggcctcccaaagtgctcggattacagacatgagccaccacacccagccgagtccatgctcttaatcaaatgcgtccccacaaaaatttggaagtttctaaatttgtaaaagaaggctctttatatgtaaaatcctgcacatgagatttactctagttcctaaaacacacaaaaagttatactttatttccttttcattattatatattacgtatgttatgacttaccagtctatcaagtatatatctggtgtaagactgtaagatttgaagtgaagaaataatttggaaagattttcttcaaagaatacttcaaatgttgcaaaatatttcaacatctaaagattaaaaaatcaataaaattatgaaagtatatagtctagaaataaagaaattaaacgcttaaacactaacaggaaatcgtgctcattaagaatctcatctttttctgagtcttctcagcaaacattcattaataaactataatataatgataagtttatattagattagattgttttggccttctaattattgtttttcactctaagagggcattcaaactacagaaacaatggaaaacatgatccattcataccatgctgtgatccacacgaaaaaaggccaactggcatggcttattcaggagattggcaaatgcgataaaggcatctgcctcttccaaattgagaatgagtactgctgcaatgaaggacatcccttggaccttcaaagggagaaaaatttagtcaaaatggacttacaataataaatctatatagtttattttattgtactcctgaaaaattacagtgacattacaaagtagaattaaccaagatttcttttttccttcccagcaaaggtaaatacagagagcccctaatgattacgaaatctccctaatttcttgttcatatggtgtggtttttcaacattagggagaatttttgaaaaacaaaaaagtatcagattttactgctacaaaaggctatctcagcgtattacctagttttcatttcctctcagtctgaattctttcaaaatagagtacagaatcacaaaatttaataaaaatcaggtgattattttcattgttataacacatctgagtaaaaaatgaaggactcagaataaaagagatctatcagaagtgctgctgaaataccaagaaaggagacgttgtgggggttgagcctggagtcctggaaaagcaagagacagaaataggaaaaaacctaaaatggaaaagaagcatgaactaagacacaaaaatgggaacaataggaccagctcagctggagtaaggaaaggcatttagagaaggtaggatgtgtttatgttgtgaaagaccttgagtaaaaggctaagctgtatagatgtttgcttcttgcttgtaagttattggcagctatcatatacttcttctcctgttttttttttgttttttttttttttttggtttcttttttttgaagcagggtctcactcaagtcacctaggctggaatgcagtggcatatcatctcactgcaacctctgcctcccagctccagctatcctcctgcctcagcctcctgagtagctgagactatgggtgtgtaccaccacgcctgtccagcccatacatttgtttaattaaaaaaaaaagttatcacttacttctagaagagatttgtataatggacttacacagtgagaccattaagaataactgcaatgggccaggcgcagtggctcacgcctgtaatcccaacactttgggaggccgaggcgggcggatcacctgaggtcaggagttcaagaccagcctggctaacatggtgaaaccctgtctctactaaaaatacaaaaaattaaccgggcgtggtggcaggtgcctgtagtcctagctactcaggaggctgaggcaggagaatggcgtgaacctgggaggcggagcttgcagtaagccaagattgcgccactgcactccagactgggtgacagagcgagactcggtctcaaaaaaaaaagaacacctgcaatgataactctgtctcttgttcccagccaagtgttttgaaagggatgcctacaatcactatctctattttctcagctcccttttcttttatttttttatttttttgagatggagtttcacccttttagcccaggctggagtgcaatggtgtgatctcagctcactgcaacctccgcctcccggattcaagcgattctcctgcctcagcctcccgagtagctgggattacaggcatgtgccaccaccccggctaattttgtatttttagtagagacggggtttctccatgttggtcaggctggtcttgaactcccgacctcaggtgatccacccacctcggcctcccaaagtgctgggattacaggcgtgagccactgcacccggctctcagctcccttttcacctttaacacacttcagtatgtattcccactccattaccatactattttgagatttctcttgccagtatgaccaatgatacttattgaaaaacccagagggtgctatctctcttaacagcattcccttagcttctgcaatccaattatttctttgttctcatcttatttctctgtcttcttctgagtactttttgcagattctacagtaattgcctatttgattttctagaacttaagttccatgaagacagggactgtagtaggcataataattgcccaccaaagatgtccaagtccttattaataaccagaagctatgaatatgttgctggacatggtaaaagggactctacagatatgattaagtcaaggatcttgagatagggagcttatcctgaattatctgggtgggcctgaagtaatcatcatgaggttccttataagtgaaagaagaaggcaggttagtcagagagagatttgaagatgctacactgctggctttgaagatggagctataggcccatgagctaaggaatgtaggcagcctctagaaggtggaaaaagcaaggaaatgtattctcccctagaacttcctgaggaagcacaaccctgccaatactttgacttaaacccagtgaagtctatttcagacttctgacctccagaattgtcaaacagtaactttgtgttgttgttgtatgtgtgtttgtttaaattttgtttttgtagagacagagttttcctatgttgcccaggctggtctcaaactcctgacctcaagtaatcttcccacctcagcctcccaaagtgctgggattacaggcatgagccactgcgcctcgcctaatttgtggtgtttaaagccactaagtttgtggtagtttgttacagtatccatagggaactagcacagagaccacaccatgtttgtttgttcatagttgtattcttagtaccacaatatttgctgaatgaatacaaggggcaaattattaaccatctgtaatagaatggtagcaaagtaaatagaaggaattaaaattacatttaattgtacctaagatggtgtttaagtaacattattttacatactgctaaaaaagaaaaaatgctgccaattaagcaatggcataataccttatcacttggaatatttatttacttaattaatttttttggagacagagtttagctcttatcgtccaggctggagtgcagtggcacgatattggctcaccgcaaccttcccctcccaggttaaagtgattctcctgcctcaacctcccgaacagctgggaatagaggtgcctgccaccacgcctggctaatttttgtatttttaatagtgacggggttttaccatgttggcctgactggtctcaaactcctgacttcaggtgatccgcctgccttgacctcctaaggtgctgggattacaggcgtgagccaccgtgtccagcccggaatattatgcatatttttaaaactatttatagctcattcagatttattatatatcactcttgtgcatatatgaaaagaaaataagaaaaagttatttctataatttcttcagagtccaattcttctaaatattttgcattatttattgactcatggtgtgatgcactaaaaaagatacattgtttatgtagtattgctgacaaaactgtctaacctgaatctaatcatgaaaaaataatcaaattcaagttgagggtcgttccgcaaacagctagacttaacttttgaaaagtgacattgttacgacacatacaaaaggctgaggaactgttctgttttaaaggaaactaaaaagaacaactaaataccacacatgaccctgactggttctctactaaaaatacaaaaattagccaggcatggtggcatgtgcctgtaatcccagttactcaggaggctgaggcaggagaactgcttgaacccagagggcggaggttgcagtgagctgagattgtgccactgcactccagcctgggtgacagagcgagactctatttcaaaaaaaaagaaaaagaaaagaaaaaaaagaatgcatagtccttgagggagagtcctaggagaaaaaagagaacagcaattgcagtacagagctccatcacgcaggctggagtgcagtggcgggatctcggctcactacaacatccgtctcctgagttcaagcaattctccttgcctcagcctcccgagtagctcgaattacaggcctatgccaccacacctggctaatttttgtatttttagtagagacgggatttcgccacgttggccaggctggtctcgaactactgacctcaggtgatccacctgcctcggcctcccaaaatgctgggattacaggcattagccaccgcacccagcctgtggttcttttaaataagtataactgaaatgtgaaccaagattaccaaattttctcaagaataaaatctacagataaaactttcgtgagttatttatagattcagcatatgttattcattaacatagttaaaaacgtattttgtcaaatcatgacatgaaataggtattccaatatagtctacactatttttaacttataaagtaagtgtgatttgactgactggtttgtcagtgagccttgataccaccagttaagttatatggtggtcactttacataaattcagtgacctaacagagctcatttcagcagcaaatatacagtgacctaataagtctgcagccagggtaaaaaaaaatatttaaaacatattctaaaaaatcattatcataagtgtaataaaagtaacagtattttaattttccccaatttttctcagtataccaggttaaacaagtgcctttaagtgaggatttttgtttgtttgttttgagacagagtctcgctctgtcacccacgctggagtgcagtggcacaacctcagctcactgcaacctctgcctcctggattcaagcaattctcgtggctcagcctcctgagtagctgggattacaggcatgcgcctccacacccatgtaatttttgtatttttagtagagacaggattttggcatgttggcaaggctggtctcaaactcctggcctcaagtgatccgcctgcctcagtgtcccaaagtgctagggttataggcatgagccaccgcacgcagcctgaagatataattttaatatattttttttctttttttaaagtctagtgtaggctgggtgcagtggctcatacataaacccagcactttgggaggctgaggtggaaggatcacttgagcccaggagttcaagatcagcctgggcaacatagtgaaaccttgtctcaaaacaaaaaacacaaaacacaaaataaaatttagcctaaaatgtcagtaatagatattttgactagtctcaataaaggcttttgggatactttatagaaattgagaaagtgaacaattctaatgattggtaacaaaatgtttttgcatctcaagtagttaacagtcttctgtattcaataaagctaaaggagaatctaattgagttactgagataattaaaccatcattctcagcaaactgttcgcaagaacaaaaaaccaaacactgcatgttctcactcataggtgggaactgaacaatgagaacacttggacacaggaaggggaacatcacacacgggggcctgtcatggggtggggggaggggggagggatagcattaggagatatacctaatgtaaatgacgagttaatgggtgcagcacaccaacatggcacatgtatacatatgtaacaaacctgcacgttgtgcacatgtaccctagaacttagtataattttaaaaaaaacaaaaaaagttgattgaaaatttatatatgcccaaccaaaaaaataaatttgttttgtttttttcatttatgtagtttctctaatagatttgttttgatcagttatactaataattgtaataacacaaattagaaaaaacgtttaatatttagaatattatgtatatcagaaataaagctaatttttaattaatttatatatttgtagcagaagtataatgagattactaaaagacttttgggcagaaaagtgttacattagaataaaattctgtgagagaaatgaaataaaatacagtagtcctccactttccccagttttgctttctgaagtttcagtttcctacggtcaacagtggtctgaaaatattaaatggcaagttccagaaacaaacaagtcataagttttaaattgcatgctgttctaaatagggtggtaaaatctggagtggtcctgctccttcctgccaaggaggggaatcatccctctatccagtgtaaccatgtatatgctacccacctgcctagtagccatctcggttataagatcaactgttgtggtattgtagagcttgtgtttgagtaatgcttctttcacctaaattgttagaatagtgttataattgttctactttattattagttattgctgtttatgtcttattgtgcctaattaataaattttatcataggtatgtatgtacagaaaaaacatagtatatataggattctgcactatctgcagtttcaggacaagtacaaaaccctacataggccgggcagggtggctcacgcctgtaatcccagcactttgggaggccgaggcgggtggatcgcctgaggtcaggagttcgagactagcctggtcaacacagtgaaaccccgtctctactaaaaatacaaaaaatcagctgggcatggtggcgggcgcctgtaatcccagctacttgggaggctgaggcaggagaattgcttgaacccagaaggtggagggtgcagtgagccaagatcatgccattgcactccagcctgggcaacaagagcgaaaccccgtctcaaaaacaaaaacaaaacaaaacaaaaaaaccaaacctatatattccacttggtgtcttggaatatatcccctgaggataagcggggactgctttatatggctattaccaaaaagacaaaacataagtgttggtgaggttgttggaaaaaaaaacttgcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagtgagactccgtctcaaaaaaaaaaaaaaaaaagaaaaaaaaaacttgcacactgtttataggaatgtaaattagtacagctattatagaaaactgtatggaagttcttcaaaaaaaactaaaaatagaattactatatggtccagcaatctcacttctggctattacccaaaagacttgaaatcggtatgtcaaaaagatacctgcactcccatgttcattacagcactactcaaaatagccaagttaaggaatcaacataagtgtccatcaacagatgaatgggatgagagagtgtgtgtatgtatacaaaagaatactgttcagccttaacaaaggaagaaattatgtcgtttgggaaaacatggatggaactggagaacattatgctaagtgaaataaggcaaaaaacagaaaagcaaatattgcatgttctcacttaaatgtgtaatctaaaaccactgaactcatagaagcaaagagtagaatagtggttaccagaggcttgggggtggggaagacgataatcaaagagtacaaaaagctccagttagaaaggaggagtaactttaatttttttgagacagggtctcactctatcgcccaggcaccatttcggcttactacagcttcaagagcctgaactctagcgatctttccacctcagcctcttgagtagctgggactacaggtgcacaccaccacacctggctaattttttattatttgcagagatgaggtctcactgtgttgctcaggctggtcttaaaactcctgggctcaagcgatcttcccaccttggcctcccaaatgctgggattacatgcctgggattacatgcctgggattacaggcatgagccaccatgcctggcctgtttttttttttttgttttttttttgagatttattacacaacatggcaaatacaactaataactgagttctgtacatttcacagtcactcagagagtaaatctcaaattactctcattacaaaaaatgtcagatatttcagatgttgggcaggttaattactttgttttaattatacaacgttatatttaaaaaaatcataatatcagccaggcacagtaggtcacacttgtaatcccagcactatgggagaccaatgcaggcgggtcacttgagccaggagttcaagataagcctgggaaacagtgccctgtcttaacacaaaatacagaaaattagccaagcatggtggcttgtgcctgcagtcccagctacctgggaggctgagatggaagaatcaccagggaccaggggaccaggaagtcgaggctatagtaagtcatgatcacgccattgtactctagcctgggtgacagagtgagaccctgtctcaaaaaaataaaaataaaaaaagaaatacaagttcagagaaaaagcaaaaatgtaaaatattaatgaagagcttgttaatatatttttctttaaatggactatgatatatgtaaatttattacagtatttaaactccactacagacttttttttgagacagggtcttgctgtgttgtgcaggctggaatgcagtggtccaatcctagctcactgctgtctgggagtcctgggctcaagcgatcttcctgcctcaacctcccaaagtgctgggatttacaggtatgagacactgtgcccagcctggggacacttttttttttttttgtgagacagagttttgctcttgttgcccaggctggagtgcagtggcacgatcttggctcactgcaacctccgcctcccagattcaagcgattctcctgcctcagcctcctgagtagctgggataacaggcgcgtgccaccatgcccagctaatttttgtattttcagtagagacgaggtttcaccatgttggtcaggctggtctcgaactcctgaatatggaatctgcccgcctaggcctcccaaagtgctgggattacaggcgtgagccaccacgcccggcatgcctggggacatttttagaaaactataagatgtcaacatttaaccagtgctaaaaaattaaattatttacaagtaaacttacgatgaaaaactttaaacttcaactttaacatgtgaaggggatacaaggtgttcttacaattcattcacagaatacctgagtaagagagtttaaagactctttgctcaaatctaactttctctataaggactatcttacgatcttttcaaatactacaacctgccccaccctaaatctagcactttccccctttatcatctcacacttttctacagcacttatcttttaatataacatgatttacttatttgtttgttgtttattgtctgtttctttcttctaaactgtaagcatcataaggacagaaatcattttgttcattgaggtatttcaagtgcctagaacaatgcctgacatatagtcataagagcacaataaatatttgttgagtaaacaaacatagaaatgaacatgcaacagaacaaagtaacttgtaccagacagccaccctatagagaggtctaacattcttctattttaaggcaaaggtgagaagatgaaagttctataacttctagttaaaaatggcaattgaacatcacatctttctttgttctcctgcaaaatccaactaaaaatacagtaaagaaaaaataaatattaacccacaaggactacaagaatgaaaaattatacagtagatagttaatagtattttagaaattgtaaattaaataagtgtagaatgttaaaactaaaatatctacagaggaggaagccaataatcagcaagccaattcagctgtaaaaccctgaaggctcagaagctgaagttgtcaggtacctgtgaaatggagaaagagagctaaaaataggattgggtgaaagtctgtataaggagcaaatcccctcccctatcctttagggacaggtacctatccttcccttaacctggtagaacataggaggtttactctctagaggcacagtcatggaaaagagggttaggaagagggggacaaggcatcacactgatatcagggcatgagataaaagtttataaattgcatggtgaaatctcccgcagctcccccagaaagctggcagcctcaagtacatataagctcttggcaagagatagaaagattcttcactgggtaaattgataagcctaagaaaaacagacatagaaatacagacatttgggagctaatacaacataggatattttgataaagagtgtagataaaatgcttatattcaaaaaacagatggaaacaaatacttacataaccaacatcaggcctgtagcatgtgtatgcccctaaaatactatgcaagacatcatgatatggaccacccttaggagagaaaaatgaaatttgaaactgtacaaataattttctctaagttaattttcatataacatgttaataaactgtagcatttcctaaatgactagttttagcatatttaataaaaaatattataaatgtactctgccaagatgttttccaaattatgaataataaatatttaatactgcagatgggtgcggtggctcatgcctataatcccagcactttaggaggtcgagatgggcaggtcatttgaggccaggagtttgagaccagcttggctaacatggtgaaaccccatctctactacaaatacaaaaattagctgggcatggtgtcatacgcctgtaattccagctactcgggtggctgaggcacaagaatcgcttgaactcaggaggcagtggttgcactgagccaggactgtgccactgcactccagcctgggcaacagagtgagaatctctcaaaaaaaaaaaaaaaaaaaaaagaaatatttactactaaataacaacaacaacaaaaagccaaataaacttacttgatggatacaagctatataatttgtcaacagttttaaaatcttctagatttggtataagggtatgatgaatacacactgtttcattttatgtaatacaccatcagcagaaaaaaaaccatcaagctaaactaaactgtgttaataattttaatcttaatggtaaaaatttttatctcattttatttttatcaatctaaagatagaagaattccatgtataaagacttgaatcagctgggtgtggtggcacatgcctgtaatcccataatcccagctatgcaggaggctgatgcaggaggattgcttgagcctaggagtttgagtccagcctgggcaacacagcaagacctgatctcaaatttaaaaagaaataaaaataaagacatgagtcaaagataaagtatatataatgtagtcatttctcttttcataaggtataagcaacttcataatagcctatgtacaaagaaaaccatttcttcctattttaatgataattctgaaaatttttaagttttgtgaaaagttctttatactttaacaatttactaggccaaaatattaagaattcatatatcttacaaaataaaaagcaaaataaattcactgtaataaaattcatcaagtgcctactacataaaaggtattaaatgctatgctaactataatgtatttcggtcagtggaataaaataatagaaattcctttataattttataactagttttacactttttatacagggtccccaatttctatagttttgccttttttaaagtaatagctattcatttaaagaatctgttgccttggatattgatagattttttttaagtaattacaagctggttagaaaccctcaccttctgaaagatgtagagagatggaaatgtacgggatatgtccaacttaattaattccagactggcctctcgatcagcaacagatacacctgcatttaccaagcagatacaatttaaatgatcacttggctctaacaagtccaattttataaatacagaatgatcacacagcatgtgttatttaagttaaaagctgaataatcaagaaattataagaaatgtcacatagcttttgttagaacttgttattctcttgtacaaagaaaatagctatacatttatcagaaagttatatggtaaaggatttctaattccagtttttacagaagatatgggcagaccatcatttccatggtaacaactaggaaaaaaatttacaaatatcacatttaaaaaatcatcagagagctatggacacagagagatcaataggatttaaattccagaaaagtaagagtctttccttggtgagtagacaccagtgtccatttttcttcctaggggtatctgccaggtctaggtatgggcttaggatcgagctcgccgaagacaaagtcaccctagttggaggaagagaaaccagaagagctacacatggccaaataaaattgatgtgatagacaagaatctggaggagccctgaatgtgtatctggttttccctatgggacttttctgaatgcagaaggctgggctagaaatgcagaataaaatcatccaaagtcacaaggtcttgagagggcatatcattggagggagattacctgtagtcaaaatagaacactttggtccgggtgtggtggctcatgcctgtaatcctagcactttgggaggccaagatggatcacctgaggtcaggagttcgagaccagcctgaccaacacggtgaaaccctgtctctactaaaaattagccgggcatggtggagcgcacctgtaatcccagctactcaggggactgaggcaggagaattgcttgaacctgggaggcagagattgcagtgagccaagatcttgccactgcactccagcctgggcgacagggtgagcatctcaaaaaaaaaaaaaaaaaaacactttttcccatcaagaaatttgaaactcaagataaactaagtctatctaaacctacaaccttgccccaacctagatcaattaatggttgaattgaggtgataagcccttaatcgaactgcctaacaggaaagagcagcttactctgcaggggaaacctcagctttggtttctacattctttttatatacaatgtctggcatacaatttaaacatttaagatatacaaagaagcagaaaatgtgacttacaaccactttaaaggggaaacaaggggaaaaacagccgacagaggcagacctgcagatgatgcagtattggaattaacaggcaatgacactatctgttataaatatgttaaagaaaatatctggctgatatgcgctagagaaaaaaataataataaattttaaaaagaaaataagaggaaaagatggcggaaggaacatgggatgggaagatgaatttcaacagagaaacagaatgtataaaaagaaccaagtgaacattctacaattacaaagcacatctgaaattaaaagcccattacacagatttagatttaatagcagactagataaaccagaagaaaggattagtgaatttgatgacggatcaataaaaatcaatgaaactgaagcagagaaagagagagagagagagagagaaaaagaattggccaggcacagtggttcatgcctgcaatcccagcactttggaaggccaaggcaggattgcttgaggccaggagtttgagactagccagggaaacatagagagaccccatccctatatgatgaattaaaatttttttcaattatataaaattatatctatcccccaccaaaaaaagaaaaaaaaaagagagagtataagaggcttgtgaaacactgttaaatggtctactatacatgtaattggagtccagaaggaaaacaggcaagaaagggcagaagcaatatttaaaaagacaatgaccaaaaagttaaatgacacatgcaaattatacatatccaggaaataagaaaacagtaatttatgtagacactgcttctgactagaactcttcattacattcaattaatttctactaaagtgcaattttcaccatttattctttttctttggagatgaagtctgttacccaggctggagtgcaatggcgtgatctcagctcactgtaacctctgcctcccaggttcaagacattctccctgcctcagcctcccaagtagctgggattgcatgcacctgccaccacgcccggctaatttttgtttttttagtagagatggggtttcgccatgttgtccaggctggtttcaaactcctgacctcaggtgatccacctgccttggccccccaaagtgccaggattacaggtgtgagccatccgcccagcctcaccatttattattgaaaaaatatttcagaagtgaatacttataattttaattctcataatttcaatgcttcataaaaatgagtcaaaaatgatgaaatagctgctgtctgccagtataaacttctttaccttttacatacttttagttctccacaaatagctgacatagctaagaggtcttaggatgatacttacatgaacttttctgtaaatcaagtcttttttctagccttgtttactgaaagggttaagattaaataagatgatatatgtaaagcgattactacagcttctgatacatgctcagtatctgaattttcatcctaaaattcttatttaaaaaaagaaatcacaccttctgtatcattctctgaacttgtttcactgaaacttttccaccgttcttttgctcttgagaggaagatttcataaagttctgggggttggggggagaacaaaaatgtatgaataataggaaagaaatatatttgcaaattttaatttttactctttacctattacaggtcaggtctctctgatgtagcaagcatcaaaaaagtggcaaatctaagtacttgattctaccaaaactattcattatatactcagaaagaaagtaaataaaattactgcagagtaatcatccatacagaatgtacatatgaggcagaaagagatgcttctgctaagaagtatcattgtggaacagcagaaaaaaatgatttttggagtcaatcagacctagattcaaattctggctctgccatttactatctgagggacttcaagaaagttatttagctaccctggaactcagctttctttacctgtaaaccagagaaaaacaacacctactcatagggttactgatgattaaataatatatgtaaagctcctggcacctcatagcacttcaacagatgctcgatcttgctttctatcactactgaaactggtttctccattatgatattgctatctaaagctacttatatttcacacagacttggtgtgtgtcaccaacaaacaaaatctctacccctatctttttaatttaagtgcctagtcacggcactcccatatgcagggtctcataaaaacttcaggacaggaaagatttcaaaagttttctcaattcccaaatttttttggtctttattttgtaactaactattgcagatatttgaaactacataaaaataggacatttcagggacagaagaatagaaaaaatacgtcttgcccaaacaccaaagtttatatattgtccaaaataagttttttgcttcaattaattctttttaaaattttattcatttttaaaggtaatacaagaacatggttttaaaaaatttcaaaaagtaggccgggcatggtggctcatgcctgtaatcccagcactttgggaggccgaggcgggtggatcacctgaggtcaggagtttgagaccagtctggccaacatggtgaaaccttgtctctactaaaaatacaaaaaatttagctgggcatggtggtgcatgcctgtaatcccagatacttgggaggctgaggcaggagaatcacttgagcccgggaggcagaggttgctgtgagcagagatcgcaccactgcactccagtctgggcaacaaagcgagactccgtttaaaaaaaaaaaaaatttcaaaaagtacaaaatagtgtagagagaaaaataaatttcctttcctcagatgcaagtgtggttatcagagctctaattcttccaagaatgaaaatatgcatgcacaagcatatacataaatatataatcctttttaaaaaaattaaagtggcaacatgtttcatgcactggtctgtatcttactttgttatattagaggttgttccacgttagtagatatagatttgcttttgtttcttttaaacaactgcataattttccaaagtaatgactataccataacgagtattcttatattgccaagaagcatatcattatcaaatatctgagtagatatatttcaaacagactcttactattctaatcttttctcccttctatttacttttcatcattactaatggtttggaaagaagaaattaaaaaaaaaaacttagaattcctattcttcttcttcttattttttgagacagggtctttctctgttgcccagactggaatgcagtggtgtgacctcagctcattgcaacctccccctcccgggttcaagcaattctcagccttctgagtagctgggattactggcatgcaccaacacatccagttaattttttgtattttcagtagagtcatggtttcaccatgttggccaggctggtcttgaactcctggcctcatgtgatccacctgcctcggcctcccaaagtgctaggattacaggcgtaagccaccacaccaggcaaaattcctattatttatgcctggctccatcagtgatttcatagaagagatgaatataaggttaaaatttatacatataattatttgggggttattaggtataaaattgtaagtttttttaaaaaattcaaactggttctaagacagtcagcttcaatattatacccaaattttaaaactatctaaaaaaaagggggctcaccagacaaacccatcagttttataagtcataaaattgatctaataataaaaatgtggtaatgatttcaaaacatcaaaggacatctctccagtaagattcacagttaagaagacctgcatctcagttcactttgatgcttaggtcctcatgtcacacttactttgctttgaatctgcaaagggagagtttgaagcaggcttaaagatgatactttggacttgaacagagaatactttgatttcagtgtatattttgctttctgattttgtgacaattatgatattatccatactctcagcaaaatgcactttcactattgttttatattatcacaaataactgttagaacactcctttcatattcttacccctattttacaggtgaagaaaaactaagatttctagatgttaagtaatatgcccaaggtcacaaacctaatatattatggtggaaccaagatttgaaccatatttgactgactttagagcccttactcttagctactattctctaatgattataaatttcatgactaaaacaagtcaaattactaaagccattcaaaagtaaacaagattaacaaaaataaatgtaattcaatccaattttagcatcttttccgcactaataaaaaaggagagaataaacacacattccattcttgaatacataaatgtttagtgaagaaaatcgaaaattatgttggaaataaatgactcagttatgttacaaaactataaatttcaagctaaaaacgaaccttttgattatagtatcacaaaacgttaacaccaatttaaccaatattttaatgtctaagttatcaagataaatcagattctaaagccagttatcaataaaaattgcaaacataacttcatataaccatcaatacctcattacctgtttgcaaaattgattcttaagactttaaacaattacagtatgttcaaaaattcttattatttagaaaatctaactgaaagttctgactataatttaaaaacattcaatctgttccaaactcagaaagcaaaagtaatctctgtgtatatttggagagaacagttaagtcatataaaatctaactttttctaagttaaataaaaacttaattcttcctttaaattctattctaaaagtttttaagttctttgaaaataacatgttggctgggcacagtggctcatgcctgtaagcccagcactttgggaggccgaggtgggcctatcactggaggtcaagagttcgagaccagcctggccaacatggcaaaaccccatctctactaaaaatacaaaaattagtcagtgtggtggcaggcccctgtaatctcagctacttgggaggctgaggcagggacaactgcttgaacccaggaggcaggggctgcagtgagctgagagagcaccactgcactccagcctcagcgacagagcaagactccatctcaaaaataaatacataaaaataaataaataaataaaataatatgtttattacaggagacttgtgaaaatcaaattttaaaatcatacataatcataatatccaaagttggcattgcttttcagacaaagggtaaacatttaatttttgttataattctgtccaattatatataatgctgattgctgcaatgaacatttttgtagaaaagcttttgcatccaatcctggctatttcctcagagtaaattcttagaactgaaataaacagtcaaaggttatttgtttgagacctttggtaaatatttatgaatgattttcagtcatcctcgtatgggtaattctcattcattttaatctcttttgagggatgaaaaacagtacttggatgttaacatatatgtcttttttatagaatggcaggaaaaaatatatgtctttgatttggctatctcaaggaaaacagttaaataaattatagtacagccaaattgtggaatacaatgtagctgtagtacatatgagacagacttgtatgtactaacatggaagatgttcaagatagattatagtgtgaagaaagaaagccacagaataaccttatggcataaattgtgggtgaaaaaataaaaaagaaaagctttaaaattgatcatatgtagatgcacactttatgtacatagaaaaaagaccagaaagaatatacaccaaattgctaacagtgtttacagtaggatcaagaatagcagttcaggtggaagagcagacacttgtaccttctcattactttaactttttccaataaatataaaaagaaaaattttagaagtaacagtgacaatatattatttctagtattaaagtccttaagtctttatgtggtgccattgtctagcattaacattatcatttagaccaatttagcacattttattattaactatttatttatttagagacagggtctcactctgtcgcccaggctggagtgcagtggcacaatcacagctcattgcacctcctgagctcaagcgatcctcccacctcaccctctcgagtggtgtgaccacatgcgggctgcctggctaattttgagattttttttgtagagacggggtctcgctatgttgcccaggctggtcccaaactcctgggctcaagagacctatccgcctcagcctcctgaagtgctgggattacagacatgagccaccatgcctggcctataaactattttactttcctctatttgatattattctaattttatctaattttaaaaatttatttatttatttattctattttatttttgagatggagtttcgctcttgttgcccaggctggagtgcaatgacgcaatctcggctcactgcaaccttcgcctcctgggttcaagcgattctcctgcctcagcctcccgagtagctgggattacagacatgcgccaccacgcccagctaattttgtatttttagtagagacggggtttctccatgttggtcagactggtctcaaattcccgacctcagttgatccacccgcgttggcctcccaaagtgctgggattacaggcgtgagccaccgcgcctggccaaattatttatttattaatttagagacagagtcgtgctctgtagccctgtttggagtgctgcggcacaatcatagctcactgtaaccttaaactcctgggctcaagcaatcctcccatctaaacctcccaagtagctaggactacaggcatgagccaccatgtccagcttaattttttaaaaactcatcaaaactactctgcaagccaggcacggtggcttacacctgtaatcccagcactttgggaggctgaggcaagtggatcacttgaggccaggagtttgagaccagcctggccagcatggcaaaaccccatctctactaaaaatacaaaaaattagccaggcgtggtggtacacacctgtagtcccagctactcaggaggctgaggcaggaggatcgcttgaacccgggaggcggaggttacagtgagccgagactgcgccactgcactccagcacagcaacagagcgagactccatctcaaaaacaaaaacaaaaaaactactctacattttgctcctatccaccaaagtttaagaaacttaagaaaataatataactctttgaaagtcttatttcttcttctgttctttaaaggttttttttttctttttttgagacagagtctcgctctgtagcccaggctggagtgcagtggcttgatctcagctcaccgcaacctctgcctcccgggttcaagcaattctcctgcctcagcctcccagcacacgctgccacgtctgactaatttttcgtattttagtagagaaggggtttcaccgtgttgcccaggctggtctcgaaatcctgagctcaggcaatccacctgccttggcctcccaaagtgctgggattacacgcatgagccaccatgcccggctaaagttttttctttatgcagctaatcaagttataaactttaaaattattttatttatttatttatttattcattcattcattcattcattcatttattcattcattcatttgagatagagtctcgctcttttgcccaggctggagtgcacaggcgcgatctcggctcactgcagcctctgcctcctgggttcaagtgattcttccacctcagcctcccaagtagctgggattacaggcatgtgtcaccatgcccagctaatttttgtatttttactagagacagggtttcgctatgttggctgggctggtcttgaactcctgacttcaggtgatccacttgccttggcctcccaaagtgctgggattacaggcatgagccactgcgcccggcctaaacttttcaaattaaaaaaaaaatcccaaaatgactggtttaggtaaagaaggaggaaaagaaacttttagccttcctccagtatttatgttttctgtataaaagtgaagccttttcataattgactattttcttttttcttgtatatacatattatccactgccaagtagaatcccagaagtttttgatatttgaatgccaagaagattattgatagttgtgaactaaagggaaaaccataaatctttatataaaatgtaataacttattaaatcataacaggtttaataacctgcttcataacagggggatgaagcatgcttttaaaatgacattatatatgataaaggccatttattttaatggtcactctactaatctgctatgtaactctgtagatggctatttgtacatgtgggaataactgaacgtagaatacaaaccaggagtgatatttagttcatttcctacagctagactccaaactttcccacggacactagggggcaatccctgccaccacaattctcgaactcttcttgtactacgcctagaattaaaggaggagaaaaaaggagaaagttactttttataccaaaaatactagttgcatgatggattatctttagtctatggccaagtgatcaaatcatttttaggactatagagaattaagtatgtaatgcattcttttctttgcgttcatgcttgcaggcaacaacagcctacaagatgtataggatcccaaaggggcaacagtaatctaaagggaactgcgttttataaatgtcaatgagagaatcagaaatatgcagtcaattatttaaaaaacaggataaaagggacataaaaatgtatcaccaattcagcaccaaaaacaaaacaaccaagaatctacagtgggaaggccctagtttttgagaagcagtaaagtctgctaaaaaaaactgtcggctttaaagtcagatagatctgagatccaatctagtttaaccattaattaaatgtataaccttgggcaaatcacttaacctctctgaccttgagtttccttataagataaatgggagtaaaaatacatacaccttataaaagttctaagactcaaatgcaattacttatgtaaagtgcctcagataatatgtcacactgtgccaatattcaacaaattcccaatgtacaaactacagtaggcattgcagaagatatccccaaccctccagtcgagagggaagataaggcatattttaaaatgttatgtaaaaaggcaataagaaagaaattctgtcatttgcaacaacacagatgaacctgtaggatattgtgccacgtgaaataaaccaggcacagaaaaatcaacacataacctcacttatatgtggaatccaaaaaagtcaatctcataaaagtagggggtagaatggtggttatggccggggagcggggagtaaagtgaatggagaaaggtgagatgttgatcaaagggtacaaacttccgttagaagaaataagtgttagtgacctattacatagaatggtgactataataaataataatgaactgtatgtttcaaaattgctaaatgagcagattttaaatgttttaccacaaaatactgagaaatacgtgagctgatggatgtgttaattagcttgatttaatcattccataatgtaaacatataccaaaacaacacattgcaccaggcaggtggctcacacctgtaatcctagcactttgagaggccaaggcaggcagattgcttgaacccaaaagttcgagaccagcctgggcaacacagtgagaccccatatctataaaaaaatacaaaacttagctggacgtgttagcacatacctgtagtcccagctactcaggaggctgaggcaggaggatcacctgagcccagggaggtcggggttgcggtgagccttgatctcgccactacaccccagcctgggcaacagagtgagacctcgtcttgaaaaaaaaaaaccctcaaaaaacacatcacggtagggtgcagtggctcacacctataattccagcactttgggaagtcaaggcaggctgatcacttgaggccaggagtttgagactagcctggccaatatggtgaagccctgtttctactaaatatacaaaacaattagccgggtatggtggcagatgcctgtagtccctgctactagggagactaaggcataagaatcgtctgaatccaggaggtagaggttgcagtgagctgagatcgcgccactgcactccagcctgggtgacagagggagactctgtctcaaaacaaaacaaaaacaaaaacaaaaaaacaaatcaccctgtaccatataaatatatacaattattatttatcattaaaaagatgctggcaaaataacttaaaaatgaataaataaatgcaaaggcaagataagtatattagtctcaaagtatgatgatgggacatttacataagggaaagatcatacatatttccttgattatgagataaacactttaaaaatcattttaacaataagtgcatcttctaatacatttatatatttaatattctctttccaaataactgctattacatcaatagtgcgtcttacaattgatggtatgttagcattaagaaaatacagtaactaggccgggcacggtggctcacgcctgtaatctcagcacttggggaggccgaggcaggcagatcacaaggtcaggagatcgagaccatcctgtgaatggtgaaaccccgtctctactaaaaatacaaaaaattagcagggcatggtggcgagtgcctgtagtcccagctactcgggaggctgaggtgggagaatggcatgaacccgggaggcggagcttgcagtgagccgagattgtgccactgcactctagcctgggcaacagagcgagactccgtctcagaaaaaaaaaaaaaaaaagaaaacacagtaaccaaagacattaaaagtttcataaatcaattagcatttcagttgggtcccaaaggataggtaagatttagcagacaccacggtgaaaccccatctccactaaaaatacaaaaaaaaaaaaaattagccaggcgcggtggcaggcgcctgtagtcccagctactcgggaggctgaggccagagaatggtgtgaacccgggaggcggagcttgcagtgagcggagaccacgccactgcactccagcctgggtgacagagcgagactccgtctcaaaaaaaaaaaaaaaaaaaaaagatttagcagacacagaggatggtcagtaagggaagtaggtggtagacactgagggatttacaaaagcaaaggcacagatgcaaatatggaaattttcaggcattaattaatagtataatttagccaaagcataaaatatatgctggaaataataaaaatacagaatcagaaacatgagatctcagcgcaccagcatggcacatgtatacatatgtaactaacctgcacattgtgcacatgtaccctaaaacttaaagtataataataataaattaaaaaaaaaaaaagaaacatgagatcttcggagacaaatgggaatttaggaaaagtctgcttacttacattacttcccaattgggcagtatttcattgatccaaattaccattgcacttgcaatattttcttcctgcttaaatcgttctttcatgattctttttcttttatgtgcttccttaatttctgttttaaacgagtaaaaattatttcaatacaaataagctagatcaaaatccttttctccatttacctaaactctacaaaatagactttctcaaaaagaatattatcataagaggaaggaaggaaataagggagggagggacagggaaagaaagggagggaaaaagtgaaagtaaatgaacttgattaacataattttctattctttgttttctctttttttagagatgggtctcgccacgttgctcaggtggccttgaactcctggacttaaataaatcctcatatctcaacttcctgaacagcttggactacacatgtgtgccaccatgcccagttattaacataattttaaaataacatctcctgttctactataaaagtaagtggaataaaaggtcagaaaaataatttaagtagattactttatcacatatttctatttacactaaatctatgaagtcaaatttcttatgaattaactatataaaaaacaaacaactgtgggcaactaaccaatacccatttttcctacaagggtttataaattttctgacataactcacatgacattccaaaatgattttgtcagtagcattattagtatattaactctttttaatatggtgtttcactttactagtttgaaattttaaaatgtcccccaaaacacatatattaacagtacatctcttagattctgaggcaaaagttagaggaagaaaatatctctctgaaaatcaaaggtgacaatttcagaagaagagatgtctcaaatacagacgaaagtgagtcataaatcaaaactttatgtaattttagaaccagtgaggatgtcagagaccagctagccaaactgttttcaaattgttttttcagatatgcctcagaccatcttgaggggcaagcagaaggccaagtaaacaatctctactttctttcttctttttttgaaacagagtctcgctctgttgcccaggctgcagtgcagtggtgcgatctctgctcactgcaacctctacctcccgggatcaagcaattctcctgcctcagcctctccagtagctggcattacagggtcacaccaccatgcccagctaattttttgtatttttagtagagacagagattcaccatgctggccaggctggtctcaaacacctgacctcacgatctgcctgccttagcctcccaaagtgctggggttataggcgtgagctaccgcatctggccgacaatctctactttcttttatttgttttatgtattcatattctatataagatttcttgggagaatgttccactgctttaccaacaacaaaaaaaaaatgatgaaagagaagcttcaaagccctgattaagctgacctgcctctcacatgttacgcatgagaaaactaacatcaggcctgttcagagtatcacaccaaggtagtatcaaacaaggttaaagctgtggccttctgattcctcagttcaatattatccctatcataccatgcttttaagatcatccagtaccaatagttatcttacatagtaatcatatagtaaaaattttaaaattaataaaaacttaactggagccaggcacagtggttcatgcctataatctcaacgctcttgggaggcccaggtgggagaattgcttgaggccaggagtttgagaccagcctgggcaacatagagatacatcatctctacaaaataacttctaaaaaatgagctggggctgggcatggtggctcacgcctgtaattccagcactttgggtggccaaggcaggtggatcacttgaggtcaagagttcgagaccagcctggccaacatggcaaaaccccgtctccattaaaaatacaaaaattagctgggcctggtggcgggcacctataatccccgccactctggaggctgaggtaggagaatcacttgaacccaggcagcggaggtcacagtgagccgagattgcgccactgcactccagcctgggtgacagagtgagattttgtctcaaaaaaaaaaaaaagagctgggtgtggtggcatgcacctgcaatcccagctaccagggaagctgaggcaggaggattgcttgagcccaggaattcgaggctgcagtgagctataattgtaccactgcactctggcctaggtaacaagtgcgaccccgtctctaaaataaataaatacataataaaaaataaaaacttaggctggatgtggtggctcacacctgaaatcccagcactttgggaggccgaggtgggtggatcacttgaggtcaggagtttaagactagcctggcctatatggcgaaacctgtctccacaaaaaaatacaaaaattaactgggcgtggtggtgcacgcctatggtcccagctacttgggaggctgaggtgagaggatctcctgagcctgggagattgaggctgcagtgagccaagttcgcatcactgcactctagcctgggtgacagagcaagaccctgtctcaaaaaaataaaaataagtaataaatagataaatacttaattggatatgtcagaaatatttcgaattctgtatagtaaaatacactcaactaatgtttaaataccttctagaacaatataactagccttatatatcctatgtttacttaacattaaagaagtaacttcaattccaaaatagcaccataaagcagaactgtatactattataacagtccattaacttaagtcaaaggaaaaaatatcagttgttaataaggtgttagatgttaagtctaaaaatgtatacagctgtgtaatatcttctaaaaatgtatgtttatcctgaaataacaactgtcaggaaataaacaccattaaattatcctgatattatttttttggttggaaaagagaatgaatgaatacgtaaatttatacacacaagagtatacttttatgcacctaaccaaatgacacaattgggcctctagagagactctgtaagtcacaaaaaaattttgagtttcaaatcatattctcacagccatatagaaagttaaaattattaaattataaaataattagaaattaattataaaatataaaaatggtaaaaagtgaaattcattaatagattcatgaattattatctttatttataaactaagatagtagaagtccaagttttatgactgtaatttcaagattcctcctattctgtaaaagtacatgcagaaaaactatgatcctggtatgtcattttattcctcctttagaacaaacttaattataaaaatagtagagaaaaataaaagcatgggcaacatggtaaaacctcatctctacaaacaatacaaaaaactagccaagcatggtggcacgtgcctgtggtcccagctacttgggaggctgagaggtaaaaggactgcttgagcctggaaggtcaggctacagtgagctgtgactgcatcactgcataccaggctgggcaacagagcaagactcaaaaaagaaacgaaaaaagaaataaaaaaaagaattcagtatcatcttgaagacagacttgatgaattttaccatccatcttcttattaaaatcagaaaattataccatttggagttaaattttatacctcgttttttagcctcagccaccatctcatcgtattcttgtcggtgacgtaaagcttcttccacagatttggcaggaagatttctggaaaaaaaaattacttaagtcaagacaatttttaaaagattaactttcaacttactaacttatttgtttttacacccagatgcaaagaatttctaaactaacctcatttcatacattaaggaagtgaaaggctgaaaagaactgtgcattttagaacagaatcagaatccaggttgttaatatgtggtgtgtgtgtgtgtgtgtgtgtgtagttctatgtcatgtgtatataagttggtatatatttaaacatttcagattaaaaaaatagagatggggtctcactatgttgctcaggctagtctcaaactcctgggttgaagcaatcctcctgactcagcctcccaaagtgctgggattacaggtgtgagccactgagcccagtccatttcagatttcagtcaatatttttaggttatttgttaaactcacttactagagttttctttagtcaacttttttcagatataattttcatataataaaatgaataaacatattttaagaatagtttgatgagtcttgacaaatgtatatacctgtgcagctaactaaccaatcaagatatagaacattcccatcattccactaagtttccttgtggtacccctcacaaaattctttctttgatttctatcactacagattaatttgtttcctcttcaagaattttatagactcttgtgtctggctttttttgttttaatttacattgaaggactaatgtctggcttcttttgctcagcacagttttgaaaatcattcatgttgttgtattagtaatgtattccttttaattgctgagtagtattccatttatccatgtgggtggacacttggattgtttccagattgaggccattattaataaaactactgtaaaaattaacatcaagtttttgtgtagacatttgctttcatttcccttagttaaacaaaagtcttgggttatatagtaagtgtggatatacctttacaataaactgtcaaactgctttccactaattagagttttaagacaacattttaactaaaaaactggatcatccatcatttgcatacatagtagtccccccttatccttaggagttatgttccaagacctccagtggatgcctgaaacctcagacagtaacaaaccctatatataccaggttttttcctatacatacataactatgataaagtttaatttaattgagattaagttaacccagcacaatatgttgccatcaattggaacacatttttgttcatatcttccacccataaatttaatgtcttttcaatcataactgaacaccgtgctctatggtagtaacttttgcaatttaaggtgcaacagtaacactagcataaatttctttttcattcttcacaatttcatggataggaaactgattcttaccacagatcttagcaacttcagcatatgatttttttttcttattaatttgagaactttcacctttttgcttaaaggaggaactttacagcttctctttggcatatctgaattgtcagcaccactactcttaagctttgggggcattactaataaaataagggttctttgaacacaggcgctgtggtatcaccaacagtcgatctgacaaccaagaaggttactaactgaactaccagatgggtagtgtatatagtgcagataaactgaactcatgtccctagcaggatggagcaggacagtgagatttcatcatgctactcagaatggcacgcaatttaaaaattaaaagttatttctggaattttccacttaatgttttcaaaccacagctgagtacaggtaactgaaattgccttaagcaaaaccgccaataaggggtaactactacaccgtattttggtttatcaaatcaatggcttcacagagtcagtgatttagatataaaaaatgcaaaaagaaatacactggtatattatcacttatccaaatataatcataatagtgtccagttttaggagtcagtcttttcttttcaacaggctagtgtggaaaaaggtatgtgacaaattttcaaattataaattctacctcctcttctcaaattagtcagttgatctggtaggttgtaggagggaggaataaaagttaagacctctgcttcaggccataatggaataaaagaaaccaggtttaccctttccccttaaatcattagaaaatggacaaaatatattaaactatagtttccagacaacagacactgggcagcacaagaaagtgatctttaagagaaaagaaataagcaaggtaaccctacaagtacctgacatttccaggtctcagtggtccatcaatcctaaggtgaggagaaagtttagagttggagagtccaagacagctaaaagttacaaaccagaaaaccagaaaagaagggagctgcagagagtcctctcaaggttttggctgagtactgatctgtgcatgtgtgtgattaactacagccagagaaagaaccaccagagaaaaaaaaaataggacattcttaaagttcacacaagaccagccagagtggaaaggcctcctgatagataagagtactaggtagagtgcttagaagaataatgcctcagtagtgaggacaaattactcctaaactaaaagctattctggaaccactccaacaaagattaggtcaaaaagatcaaaccatttccaaaaaactgcaaaccagactaaagccaaaaagtatctaaaagaacacacaaaaaagtccagcatccacctatgtaaaccacaatgtctgacattcaataaaaacagagatgtgaagcagaaaaatataatgcataatgagaagaaaaattaatcaacagtcacaatataaaaatgtcacagataataggattataacacaaggatgataaaatagctgttataaatatactataggcataccttactatactgtgatttgctttattacattttgcaaatattgcattttttacatattgaaggtttgtagcaaccctaatgtcaagcaagtctatgggtgccatttttctaacaatgtgctcattgtgtgtctctgtatcacattacagtaattcttgcaatatttctttttttttttcttttgaaacagagtttcactcttgtcacctaggctggagtgcaaaggcgcaatcttggctcattgtaacctccacctcccagttggtttcaagcaattctcctgcgtcagcctcttaagtaactggggttacagatgcctgccatcatgcctggctacattttttggtaattttagtagagatggagtttcaccatgttagtcaggctggtctcaaactcctgacctcaggtgatctgcctgccccggcctcccaaagttctgggattacaggggtgagccaccgcacccagccaattcttgcaatatttcaaactatttcattatcattgtatctgttatggtgatctgtgataggtgatttttgttgttactattctcattgttttgggacaccacacacagtgctaatataagatggcaaatttgtgtgccaaggcaaacatgtgtgtcttactgctccacagactgaccattcccatctctctctatctcttcaggcatccctatttcttgggatacaacattgaaattaggccaattaataactctacaatgacatctaagtgaaaagaagagtcccatatctctcaatttaaaatcaaaagccagaaataaatgagtaagcttaatgaggaaggcatgccaaaagccaagataggggggtgaagaaagatggcagaatagaagcctgcaccagttgtccaccctgcaggaacaccaaattttaactatctgcacacaaataagcaccttcatgagaaccacaaatcaggtgagcaatcacagtacctagttttaacttcatatcgctgaaagaggcattgcagagggtaggaaagacagtcttaaattgccaacaccacccctcccccaacccctggcagtggcttcttggctaggagacagaacccatgcactcaggggaggaacaacacagtgactgaggaactttgcattgaacttaatgctgccctagcacatggaaagcaaaatcatgctgaactcagccagcacctgcccatggagggagcattttgaacagcactagccagaggggaagcgcccatcccagcagctgaaacttgagtttcggcaagcctcgcaatcacaggttaaagtgctctgggatcctaagtgaacttgaaagacagtctaggacacaaggactgcaattcttaggcaggtcctgatgctatgctgggcttagagccggtggactggggcagtagatgacacagtgagacaccagacaggacatttgggggagtgcttacgccactcccctctcaatcccaggtagtgaagcttgcagcaactaaagtaactcctttcttcttccacttgaggagaggagaaagaagggtaaagaggactttgtattgcatcttagataccagctcagccacagtaggatagggcaccaggcagtggtgaggcccccatctcaggtcctagctcctggatgacatttctagagacaccctagaatagaagtgaacctgctgccttgaaagaaagaatccagccctggcaggattcatcacatgctgactaaagaccccttggaggccggaccggtagctcacacctgtaatcccagcactttggaaggtggaagcgggcaaatcacttgaggtcaggagttcaagaccagcctggccaacatggtaaaaccccatctctaccaaaaatacaaaaaattagccgggtgtggtggcatgtgcctgtaagcccagctactcgggaggctgaggcaggagaattgcttgaacccaggaggcggaggttgcagtgagccaagatcgcaccactgcactccagcctgggctacagtgcaagactgcatctcaaaaaaaaaaaaaaaaaaaaaagaccccttgggccctgaataacaaacagcaatacccagtggtgcaatctcagctcactgcagcctccgcctcccatgttgaagcgattctcctgcctcagtctcccaagtagctgagattacaggcacgtgccaccatacccggctaatttttgtattgttttagtagggacagggtttcaccatgttggccaggctagcctggaactcctgacctcaagtgattcacctgcctcagccttccaaagtgctgggattacagtcgtaagccactgtgcccagcctactcttaagtagaaagattaaaagatgaaccaataaaaaataatacctgaaacagcttttcaagacataggcagtaaaataagacataaagactaacaacaagtcagccattatggtggctcccatctataatcccagcactttgggaggccatggcagaattgctcatgcccaagagttcaagatcagcctgggcaacacagcaagacttcatccttactaaaaaaacaaaaaaaaaaccagctgggtatggtggcatgcacctgtagtcccagctactcgggagtctgaggtgggtggatcaactgatcgcaggagatagaggccacagtcagcgatgactgtaccactgcactccagctggggtgacagagcaagaccttgtctcaaaaaaaaaaaaaaaaaaaagagaaacaacagaagttaaaaaaaagaaacaacaaaaagtttttttaaaaaagtgaaacaacaaaaaagcaggaggatgaggttgaagtgtaaagtttttattagttttctttttgctagtttgtttgcttatgcaatcaatgttgtcatcagtttaaaataatgggttataaggtagtatttgcaagccacatggtaacctcaaataaaaaaaatatgacaacacaaaataaaaagcaagaaattaaatcataccaccaaaaaaaaaatcactttcactaaaagaaagactggaaggaacgaaagaagagaagaccacataacaaacagaaaacaaataacaaaatggcaagagtaagttcttacttaccaataacactgaatgtaaatggactaaactctccaatcaaaaaagatacagtaactgaatagatttaaaaaaaaaaaaaaaagacccaatgatatgatgcctccaagaaacacccttcacctataaagacatatatagactgaaaagaaaggtagagaaaaagatattccatgccaatggacaccaaaaaggagaaagagtcgctatatttatgtcagacataatagacttcaagacaaaaactgtaaaaagagacaaagaaggtcattatataatgataaaggggtcaattcagcaagaggatataacaattgtaaatctatatgcacccaacactggagcacccatgtatataaagcaaatattattagagctaaagagaaagatgcacctcaatacgataatagagacttcaacacaccactctcagcactcagcatatcttccagatagaaaatcaacaaagaaacattggacttaatttgctctatagaacaaacagacctaatagaatattaacaaaatacttcatccaatggctgaatatgcattcttctcctcagcacatggatcattttcaaggatagaccacatgttgcttccttagttaaaaacaaaccaagtcttaaaacattcaaaaaaatgagataatatcaagcatcttctccaatcacaatggaataaaactagaaatcaataacaagaggaattttgtaaactatacaaacacatgcaaattaaacaatatcctcctgaatgaccagtgggtcaatgaaggaattaggaaggaaatttaaaaatattttgaaacaaatgttaatggaaataaaacataccaaaacctacgagatacagcaaaagcaacactaaaagggaaatttatagctataggtgcctacatcaaaaaagaagaaaaacttcaaataagcaacctaaaaatgcatcttaaggaactaaaaaagctagagcaaaccaaatccaaaattagtgaaagaaaagaaacccaaaaattagctgggcatggtggcatgtgcctttagtcccagctactcaggaggctgaggtgggaagatggcctaagcctaggaggtcaaggctgcagtaagtcatattcatgccaatgtactccagcctgggtgacaaagtgagaccatgttcaacaataacaaaaaaaaaaaaaaaaaagaagaagaagaagaaaaaagaaaaagagcacaaataaatgaaattgaaagaaaacaatacaaaagatcaacaaaacaaaaagttggtttttttgaaaagaaaaacaaaattgagaaacctttagccagactaagaaaaaaagaagactcaaataagtaaaatcagagatgaaaaaggagacattataactgataccacacaaattcaaaggatcgtttgtggttgctatgagcaactgtgtgccgataaattggaaaatctagagaaaatggataaattcctagacacatacaacctaccaagattgaaccatgaagaaatacaaaacctgaacagaccaatagcaagtcacaatggaacaaaacatttaattacagagttgtaattaaaagtctaccagtaaagaaaagcccaagacctgatgacttcactgctgaattctaccaaacatttaaagaagaattgaactgacaacaatcctactcaaattactgcaaaaaatagaggagggaattcttatgaactcattgtatgaggccagtattaccttgatactcaaacaagacaaagacacactaaaaaaaaaaaaaaaaaaggaaaactacaggccaatatccctgagaaacatggatgcaaaaatcctcaacaaaatactagcaaactgaattcaacaatacattgaaaagataattcatcatgaccaagtgagccttatccctggaatgtaagtatatttcaatgtatgcaaatcaatcagtgtgatacatcacctcaacagaaagacaaaaaccatataatttcaactgacactgagaaaacatttgataaaactcaacatcccttcataataaaagccctaaaacactggggacagaaggaacatacctcaaaataataaaagccatatacaacagacttgcagtatcatatttaatgggaaaaaactgaagcgtttcttctaaaatctgaacaaaacaaggctgcagattttcaccactgttattcaacatagtactgcaagtcctagctagagcaatcagacaagagaaggaaataaagggtatccaaattgtaaaggaagaaatcaaattatccttgcagatgagataatcttatatttgcaaaagtccaaagactctgccaaaaaactattaaaaatgataaacaaattcagtaaagttgcaggataaaaaatcaacagacaaaaatcagtaacatttctacatgccaacactgaacaatctaaaaaataaaaaagtaatcccatttataatagccacaaataaaattaaatacctaggaattaaccaaagaagtaaaaggtcttcttttacttaaaacaataacaactgtaaaaacactgataaaagaaattgaagaggacaccaaaaaatggaaaaatattccatgttcatggattggaagaatcaacattgttaaaatgtccataataccctaagcaatctacacattcaatgcaaaccctatcaaaataccaatgatattcttcacagaaatagaaaaaacaatcctaaaatttatatgcaaccaaaaaagtccaagaatagccaaagctattttgagcaaaaagaacaaaactggccaggcgtggtggctcacgcctgtaatcccagcactttgggaggctgaggtgggtggatcacctgaggctgggagttcaagaccaccctgaccaacatggagaaaccccgtctctactaaaaatacaaaattagctgggtgtggtggcctgtaatcccagctgctgggaggctgaggcaggagaatcgcttgaacccaggaggtggaggttgcggtgagccggagatcatgccactgcattccagcctgagcaacaagagcgaaactccacctcaaaaaaaaaaaaaaacaaaagaaacaaaaaacaaaactggataaatcacattatctgacttcaaattatactacagagctacagtaaccaaaacagcatggtactgggataaaaatagacacataaaccaatggaacagaacagagaacccagaaacaaatccatatatctactgataatctgtcatttttgacaaaggtgccaagaatacacatttgagaaaaaacagtctcttcaataaatgatactgggaaatttggattatcatgtgcagaagaataaaactagacccctatctctcaccacgtacaaaaatcaaatcaaaatacattaaagacttaactgtaagatctcaaactatgaaactaccagaagaaaacactggggaaactctccaggacactggactgggcaaagatttcttgattaatacctcacaagcacaggcaaccatagcataaatgaacaaatgagatcacatcaagttaaaaatgttttgcacagcaagacaaacaaacaaacaaaaaaaaacaaaaacaaaaccaataaacagaatgggagaaaatatgtgcaaactacctgtctgacaagggattaatataataactagaatatataaggagctcaagcttatatatccacagggataaagctaataatccaatttaaaaataggtaaaatatttgaatagacatttctcaaaagaagacatacaaatggcaaacagccatattcaaaggtgctcaacatcactgatcagagaaatgcaaatcaaaattacaatgaaatatcatctcaacctagttaaaatgacttttatcaaacagacaggcaatatcaaatgctgaagaggacatggggaaaagggaactgttgtacactgttggtggtaatggaaattagtacaaccactatggtgaacagtttggaggttcctaaaaaaactaaaaatagagctaccatatgatccagcaatcccactgctaggtatatacccaaaagaaaggcaatcagaacatcaaagaaatatctgcactcccatgtttattgctgcactattcacagtagccaagatttggaagcaacctgtgtccatcaacagatgagtgggtaaagaaaatgtggttcaagggaggtggaggctgcagtgagccaagatcgtgccactgtactccagcctggaagacacagtgagactctgactcaaaaaaaaaaaaaaaaaagaagaagaatatgtggttcatatagacaatggagtattattcatccacaaaaaggaatgagagcctgtcatttgcaacaatatggatggaaatggaaatcatgatgttaagtaaatagccaggcacagaaaaatatcacatgttctcacttatttgtagagctaaaaagtaaaacaattgaaatcacagagatagagagtagaaacatggttacctaaggctgggaaggacagtagtggggcagggagaaagtggggatggttaatagattttaaaaaatagaaagaatgggccaggcaccgtggctcatgcctgtaatcctagcactttgggaggctgaggcgggcggatcacctgaggtcgggagttcacaaccagcctgaccaacatggaaaaatcccatctctactaaaaatacaaaatcagccagacatggtggtgcatgcctataatcccagctactcgggaggctgaggcaggagaattgcttgaacctgggaggcagagatcgcagtaagccatgatcgcgtcattataccccagcctgggcaataagagcaaaactccgtctcaaaaaaaaaaacccagaatgaataagacctagtatttgatagtacaacagggtgactatagtcaataataatgtaattgtacatttaaaaataaccctgtagccataaaaaagaacaagatcatgtcctttgcgggaacaaaagcgggaaccattgatggagccagaggctattatcttccacaaactaatgcaggaacagaaaaccaaataccacatgttctcactcacaagtgagagctaaatgatgagaacttctgaacacaaagaaggaacaacggacactggggtctactttaagggtggagggtgggaggagggagaggagcagaaaaggtaacgattggatactgggcttaattcctgggtgataaaataatctgtacaacaaacccccatgacatgagtttacctatgtaataaaccttcagatgtaccctggaacctaacataaaatttggaaaacaaaaagaaaaacgagaaaataaaaataactaaaagattataattggattgtttattacacaaagaataaatgctcaaggggatggacacctcatttacgatgatgtgattattatgcacttgcatgcctgtatcaaagtatctcatttatcccataaatatatttatctactacgtacccacacagaataaaaatgaaatttaaaaaaaaaagccaagataggccaaaacttggcctcttcagccagttaggcaagtggagaatgtaatggtaaagttcttgaaggaaattaaaagtgctaatcaatgaacacataaatgataagaaagcaaaacagccttattgctgagaaagtgtgagtggtctagataaaagaccaaaccagccataacatttgcataagccaaagtccactccatagcaaggccctaactctcttcaattctatgaagggtgagaagtgaagaagttacagaagaaaagctggaatctagcagagattagttaatgaagtttaaggaaaaaagctgtttatacacatagaagtaaaagatgaagcagcaagtgctgatggggaagctgcagcaagttatccagaagatacactaagatcactcatgaaggtggctactctaaacaacagattttcaatgtagacaaaacagccttctactggaaaaagatgccatctagtattttctaagcaagacagaagtcaatgcctgcttcaaaggacaggctgactctcttcttaggggccaatgtaactagtgactttaagttgaagccaatgctcatggaccattctgaaaatcctagggcccttaagaatcattctaaatctactctacctgtgctcaataaagcctggatgacaggacatgtttacagcacggttaaatgaatattttaagactattgatgagtcccactgctcacaaaaaaaaaaaaaaaaaagattcctttcaaagcaacactgcttattaacgatgcacctagttaccaaagagctctgatggagatgtacaaaaagatgaatgttgttttcatgcctgccatcacaacattcattctgcaacctgtggatcaagaagtaattttgactttcaagtctttttttttttttgagacaaggtctggctctgttgcccaggctggagtgcagtggcgtgatcatggctcactacaacctctgcctctcagactcaagcaatcctcccacctcagcctcccaagtagctgggaatacagtagtgtgccaccacacctggctaattttatatatatatataaacatatatatatattttttttgtagagacaaggttttgctgtgttgcccaggctggtcttgaactgcagtcactgaactgggaaacctaaatgcaaagggaataattgaatcctggggtggcagggaccaagtggcagcactcaatcattaaagcaaggcgagcagaattaccataatgaacagcagagtcaaagccgcaatcagaatagtatgacttgcacacacctattgtgttggctagttgatatggtgttcttagaagtgaaaaaaagaagcctactacattcttacttgatctatataagcagaaaagtgctaggtcaagagaacaaaagtctaccctgaatcatgaagactaatggcccctcaatcactccccagacttgagccagtttacagacccagaatcctttgaatgaggaagatgatgggtccccttgagaggactccagtacaccaccaaaaatttatactattaatctttctcccagccttccccaaaggggcttacagccttttaccagggtaactattcattaggtaaaagaaaacaatcagatcgttcagggactactggatatcggctctgatctgacactaattgcaagagacccaaaatgttaccatagtcccgagtcaaagtagaggtatgtagaggtcaggcgattagtggagttttagctcaagtctttcttactgtgggcccagtgggtccccaagcccgttctgcggttagcataaggtcaccatgaaaatgaagttttttctcaatatggtgaaagatatcaacccttgtctttgatgcatggagccaccatactagcactgaactacttaatttgggctacttacatacttaaattcttgcatatttaggctactatttggggagtctcttatgtgtagctgaatgtaattgcttaatcatataccaataaatcaatgatggtgctctaaaggtcaagagccatcacaaactccaaccacatttaaaatccatggagtttagtcctcacatccagatccattgaatcttataattcctagtattgcctacacatactaactaccttaaatcttgcaaatcgattctgtccaaagctgctttctacctatgtcatagcaccaactattaactccaaaatcctagccttaagtctctcttatttccttttacaagctattctgcttgcctctctggatttctgcaaaagaataatggatttaactgttcctaaatttcagaaaaagtacttcctagaattacaaagaattgtgaagataaaagcaatgatggattccatatagttccatataaaataattacaatatcccttttcattatgttaatacttaaaaaaaactttatttactgtaaagaagataagaccacaggaaaaaatagaagctaaatatagttttcaggtaaagagtgatattgtactctgggtaatattatttttttcttttgcttctacatcccagagcaatacacacctttctggaattattaatcttttgaacctgtattcccttcttttgcttttctagtccttttaacaaccttgcaatgaattcctctattaaagttcctctgtttgaaattactacattgatttgtttttctgactggactctgagcccttaagatacagaaaattgattgatagctgtatttcatttacctttagaaattttcattttatcattggagaaacagcttaattgaaatcacatttccactttttttttttgagacagagtctcgctttgtcaccagactggagtgcagtgcacaatctccgctcactgcaacctccaccttccgtgttcaagcgattctcctgcctcagcctcctgagcaggtgctatgacataggtagaaagcagctttggacagaatcgatttgcaagatttaaggtagttagtatgtgtaggcaatactaggaattgtaagattcaatggatctggatgtgaggactaaactccatggattttaaatgtggttggagtttgtgatggctcttgacctttagagcaccatcattgatttattggtatatgattaagcaattacattcagctacacataagagactccccaaatagcagctgggactacaggtgcacaccaccatggccagctaattttcatattttagtagggatggggtttcatcatgctggccaggatggtctcaatcttttgacctcatggtctgcccctgcctctgcctcccaaagtgctgggattacaggactgagccaccacgcctggcctacatttccagtttaactacaaatcccgcctttaagatttctaaccacctactggcttccaccaaataggcctgatccttctcttcacataagatgaaatgctgctggtgtgaagcttaatcccttttgcatttgcaatctctgtcatcttattttattttttctgagacagggtttcactctgtcacccaggctggagtgcagtggcacaatcagagctcactgtaacctcaaactcctgggctcaagaaatcctcccaagtaggctaggactacaggtatgtgccaccacaccctggcttatttttggtagagacagggtctcactattttgcacaggctggtcttgaactcctggcctcaagcgatcctcctgcttcagcctcccaaagtcctgggattatagatgtgagccaccatgcctagctcctctgtttcttttctacaagtcatggcaaatgatttgctgggcacagtttaggagatctagtcttctatttaacaaggtgaaatttgcagatctaaatagacctcttctctgcacaacctcacatcccacatctagacctcccacatggtctagaccccactgctcacctcctgctgtgcagcccagttcctaaccagaatcaatctggggcctggggtttggggaaccctgctgtagaataatttctatcttcttccagatgccacctcatagtcgaagtagtggcattaccagtagataagacacaaaagcagaacaggcctcttgaatctgcctgcatccataaacagaagaaacctaagattactcagacctctgttctagcttcttgggctataactagatagatgttagctggcccaagtctgctagaagagtattctgagggagataaagtacaaagttccactttagtactcaggttgtacccaggtattcccatgtacagttttcttcccctcagctggttttatactcaataaaattgaaggtttcattctcttctgttctccattatctatttttcaattggttgaagtagaagaagaaataagtgattaaacaccctcatactccaataccatgaagacactttgttggtttgttttagttacataaatgtaagtcatacaaataacgtccccccaccaaaaaggccccttcaaatttaaaaaggtgaacaaaattgttaattaaccacagcatctcagtgttgggtggaacactagagaccaaattcagtctctatactacaaaggagcaaacacacagaaacagaataaaagctataacatatattataattaatataactatagatagttcaaaagagtgaaaataaaagtacttttttcagctgtttatatatttttgtacactgagttcttttcataatgttattgtacctaccatgttatttcaagacaattccattgaacattatttcaaggaattgtttgtgtgtaacaagaaaggtacaagagaagtagatacaacggaaggctgaagaaatcaccaaagacttgatagaaaagataaagcctaatccttaaggattgagtaagtaagaagtagaaataagataaaagccttccaagagaggggaataacatgagcaaaggcatggaggtagaacctaaagaggcagatatgatatgaaatagagtatggtgtaaagaaagatttgtccccaacaccgtctagaatagaactttttgagtgatattttcataaacgctttctgggaagaaattaacattcccggtaaaaagcataatccatttcggataaattctatcaagcttaagcaagctcttctgggaacttatctacgtactcagctgacagctgcaaagtctaaagatctttaacaagttattcttttcttgtttatctaaccactcttgttttcctataaatgtctccaccaagaaaggaatctttgaattggcctggttcattttcatccctggcagcaagtctgaaataaaatttcacatgttctcataactaagtttctaaaacgctttttttaaacaatgaaaagacaattataaacatattcatcaaatcctaaaagaggagcattgggaccacaattctttagtatgagggaatgtaaccagaataaaagaataatgtacttaataagtccagctttttttctcttgcaatgtccaaaaaatattctatgctcttctatttggctccagactattttattatgctcatcaggaaaatgggtagaaaaaggtccagatcaggaaaatggcaagaaaggctaggaagttttacatttaaaaaaaaaaagagagagagagaaagaattctttagccaggtgcggtggtgtgcgcgtgtagtcctggctactcaggaggctgaagtggcaggattgtctgaggccaggagttcgaggctgcagtaagctatgattgtgccactgcactccagcctggatgtcagagcaagactctgcctctacaaattaaattaaattaaaaagaaagagagggacagagagacaatcctagtaaaaaaaaagaattgatccagagaacccaaggaggagaaaaagagctaagaaccaagtggtcttgctttaggatgtgttttgtttaataataaatcagacaatgttctgatgtacagcaggaaaagaacaatttaagatgttttgctgagcattaagaatgtactcttaggctgggcatggtggctaacacctgtaatcccagcactttgggaggctgagatgggtggaccacttgaggtcaagaattcaagaccagcctggccaacatggcgaaaccctgtctctactaaaaatgcacacaaaaaattagccaggtatgttggtgcatgtctgtaatcccagctactcaggaggctgtgccaagagaatggtttgaacccaggaagtggaagctgtagtgagctgagatcgcaccattacactccagcctgggtgactgagcaaaactctgtctcaaaaataaaaaattaaaaataaataaaacaaaacaaacaaacataaataaataagaaatgtattcttaataataatagtaggctcccagccaggtcagctcactcctctcttgggagtgtactcttacttccttaataaaacttttgttacctaagtagttacatagtacaaaaggcaaagacaagcacatcttaaatacatactaaatgtcaagaaaggaagaataactgccctatcatgttaagatggaggagcagagagttgaaatagaaacagacataaagagccaatactttattatgtttcgtatattaactcacagagacctctagaaaatatgcgtaagtcttagacaacaacaatatactctctactagggccagcagtgcatgcctacaatcctggaaggggagactgaggcaggaggatcacttgagtttgagaacagcctgggcaacatagcaagaccctgtctctaaacaaaccaaaaacccaagaaaaatatattctccccaaatagttttaggatagacaacagggattaaattttgtaaaaattaaatcctttctcaatatctttctcgctatcttttaaaatagtgaacaaaattaaatttaactttaaaatataaacaatgtcactgattatcactaaaatacttacgatggtcgatcctcaagaatcaaggcagtggtagaaagcggctcaaattcaaaattcttgcgtcttgaagactgaggtggtggtttacaggtcctccccgttcgtgcttcatattcctagagtaaattaaaacataccttatgcagaaactgctccaacatagtttgtactattaaatctgtatcattaaaaatattatgctataatgagggatacatacaattcaaaaaataatttggtaaaaatatcaagcagacaaaaaataaaagttttttttttggaggtggaggggagctgggagcagtggctcatgcctataattccagcacttgggaggccgaggtggcaggattacttgagctcacgaattcaagaccagcctgggcaagggtcaacacctcacctctactaaaaacaaaacataaaaaaagttgtttttttttttgttttcctgaagcaacctaaactataaatatatattacatacaaagtatcaaaatgtaagagaaggaaagacagaagtacactagattaattaaagttttaggaagacattcttaattgccttctatgatatcagctatccaggccatctttgaataatctacaactagataagcctacttcctaaactttcagttagatcagtgattaaaatgttgagacaagatatagataatgccactgtattgctctgaagatccctctcaagggtgacattcaacctctaatgaaatgatagttttggatttcaatctagtattacaaatagatctacttactctaaatttaaacaacagtttgctaacacatcttattcaaaaatatagccacagactgtcaaacatttcactaaaattaagaaacttactatagtattcttctaattcatccaacctgataattctaattaaaataaattaatttaatatatggtaaacacatttaaatttatccattcaagtattctttcataaatgttcccaaacttctgaaatttatttatagaaatttgccaaagatcaataccaaatttaccagcttgcaagcttcagtacccacattttttcctttctaaaaaatcaagctagcatctgatcatctccaggcactagttatatttttcattacattctcaaatattactcaatgatttcacgaactatgcaagtccactggtggctatagaagacactgatttatatgaagaaaataaaatgcacttaaagtggtcagatatttcactttttagttgcttaactacaattgcctgtaattcttttaatactattgttacatcttttccaactcaaagcctatttctccttactcaattgggcaatcataaaatgagacctgatagttccatacctcttaaaaatttgataatcttttttttttctttttcttcttttttttttttgagatggagttatgctcttgttgcccaggctggagtgcagtggcatggtctcggctcactgcaacctccgcctcccgggttcaagcgattctcccacctcagcctcccgagtagctgggattacaggcatcagccaccacggctggctatttttttttttttgtatttttagtagagacagggtttctccatgttggtcaggctggtttcaaactcctgaacttgtgacccgcccacctgaaactcccaaagtgctaggattacaggcgtgagccaccgtgcccggccttgattatcttcttgaagcttaaccttaattgagatattacttttaaaaaacaacttatttggtcttacaaacttcagcttaccttgtggttccagccactgtttataaagtttcatattcatctttagttctgcatcttcccttccatctactatatctatgctctgcttatctgagagctcccttgcatcaccacattgggtttttagaaacttctcctctatcaaattatttaggattgtgtgcacttatgtttattaactgtcatctcaaagaaccatacagccgttcataatcaaaaacaataatgtcactcatttctttttgtcttttccaattttctttcctaatatctagaatatataatcatgctcaatgtttcttttcttcattacaaactccaatgtaataaatcccttttctgctcatgtttttcttactaaaaattatagaaaaataataaatttgttataatttaaatggtgttttattttcctacaaggtaacctggtttcactgccaaacagaataccatgaatattatccaataaaacattttccatgcaaacaaaggccaagcacatagacagcaaaatcaaactttcaaaccaatatattaataacaactaacattgactgacactgtgtaaccatgcactgttagagccctcccagtggagaaaaactgaggcacaaagatgtatactcatttgctgaaggtcattaccagcaggcagtttggctccatagcctgccttttaacaatctattatcttgctatattaacaggcagtaaagtagctatgtatgacataaaaaaatttttttttgtagagatgggatctccttagggttgccaaggctgttcttgaactcctgggctcaagcaatcctctcgccctgtctcccaaagtgtcaggattatgggtatgggccactgtgcctggctgatgaaaatttaaaagaatgagattcataaaatcattcagtgaaaggctcatcggggtagatcagactgacaatgcctgaatccccaatccacttaaatatcacaaaaggagacccccagacagaatatttcttgtatgatgcaatatgaagtatacactaccattcttgaaatattcttgccaaaagaaaaatcaaagttaaatataattaagcctatagaattgtgttctccaatattgtggccaaagttagtaataaccaaataagctaatacatatttaaatatgcataaaattatcaaggaagtattaagaggttctcctccggagagtgagactagaaatgaagggcttttggttcaccttatgaaaccagtgttgattggctttgtaaacaacaaaaaataaagtatatcttatgagagatcactcatggccatggtggatgatggacaaagatcttactaagaggtgggatcggaactggagcaaaaatgatgggtactgataggcagaaagaattaaaagaacaagtcagcaggagcaaacaaaggcatggatcagggaaacacattaatctcactgaataggaaaaatgatgagaaataagattagaaaggtgtgggttaaattacagggcctttcactggctaaaatatttggacttaatcatgaacaaaatgggaaaccactgaaagtttggataaagccaagtttgatgaaagctgtcctttataaaacgtgaactaagtatacatttaatatataaagcaactcaaaatgaagcagctagaatataatttatgtatctacgagaggaatgagctttttttttttttttttggagatacagagtctcactctattgcccaggctggagtgcagtggcacaatctcagctctctgcaacctccacctccagggttcaagccattctcctgccttggcctcctgagtagctgagattacaggcatgtgccaccatgcccggctaatttttgtatttttcatagagacagggtttcaccatgctggccaggctggcctcgaacccctgacctcagatgatccacccacctcagcctcccaaagtgctgggactgcaggcatgagccactgcacccaacctaggaataagttttgtacagaatcgtcactcaaacatcattcacataagaagttgtattctagcactttccacatacatccttgtcataaaagtgctgtaaatttctagagtaataataataaaaaagctttaaaacattgtatgagctcatctttatcagaaaatagcacagatttccatatcaaaataacttaaatatttgctgaataaattaaacatgccatcctaatgcaatcagaattacaaattatatagcagcactcctggattaaaaaaaaaagtaaaaaaaaaaaaaaaaaaaagaattacaaattgtattagaaataatacggctgggcacagaggttcacgcctataatcccagcactttgggaagccgaggctggcagatcacttgtgcctaggagttcaagaccagcctgggcaacatggtgaaatcctgtctctacaaaaaatacaaaattagccaagtatggtggcatgcgcctctagtcctcagctacttgggaggctgaggtgggagatcacttgagccaggttgtggaggctgcagtgggtcataatcattccactgcactccagcctgggtgacagagtgagaccttctctcaaaaataataataataatcaaatattaacactagtactttcaaaattcatcataagattatatgctatttattaagatgtttttgattatatataacagaaaacccaactcaaacaggtttaggcaaatttatgagctcttaaaactgaatattccatacaatcagttaactttggattctgtttgaccaagaggttcacagcataaacatcaatcagcaactccatttctctactgttctctcagttctcccctcctccacgtgatttgaagacgtaatgagaaatttaagtaagtactgattttcatctacattcctaaaagttaggtatatacaaattggcaaaaaaaccaaaaattcttcagagacatagagtagactcccacttggtgaactgggtaactcacaccaactttcttgctgcaaacaatctctgcagtccctgacaaagggggaacaaacaagatgagcctgaggatcactcaactgttatgcctggaggcaatactgaacatcagggcaggaagggggaccccaaaggaagcttggctgttagtttggacaggccaaagggctagaattttggggatacagtagtagaaaagaaagtgccccatcaggaaagaactccaggtcctgcacagtggctcacacctgtaatcccatcactttgggaagctgaggtgggtggattacttaaggtcaggagttcgagaccagcctggccagcatgctgaaactctgtctctatgaaaaatacaaaaattagctgggcatggtggcatgtgcttgtagtcccaggtacttgggaggttgaggcaggagaatcacttgaacccaggaggcagagggttgcagtgagccgagatcaccccactgcactccagcgtgagtgacagaatgagactccatctcaaaaaaaaaaaaaaaaaaaggaaaaaactccagaaactagcatagcagtattcttgagtcttcagctgaatactgatctacacgtgtacaataaaaccctacaaagctgggcaaagaagaacttttgggaaaagaacaataacctgaggagctacaagcaaaacacttcccagagcttacccaggggtgagaattattcacattatcaccaccagaataaaaagtcatcactgggaatacacaaaacattcaggaaaaacccaaaaggtctctttgttggatgtaagacattgtgaattttagacggctgagggctgaataatacttgattttgttctgtccagaagttaagcttcttgtgcatcagtttgactcctttatggcttatttataaacttttttagttcacatctaacgtaattttttctttggagctaatttatcccataactaagaaattatcaatgaacttactttcttctgcaatgtttaatctgtgattaatgtcacccagtaaaatattcacgtcagatcttgcatattaacaactgtagcactgttatcaatcaacttgagaacagagcaacagaaactatccaaaattaagcaaagaaagggaaaaaaattgaagaaatataagcagagctttagggaacactatgaagcagcctaaattatgtgtaattggagtgttggtacgagggagaacaatatttaagacaataatggctgaaatgttgtcaaactacacccacagacccaagaagttcaataaattctaagcagaatacagataaaaccacaccaaaagacatcataattatttgctaaaatataatggtaagaagaatattttaaaagcagccagaaaaaaagcacttatattgaaaagactgaatgtgaaaacaattacaagacttttcccctaaaattattccagtcaaaagacaatagaaaaatctttaaactgctgaaggaaaaaaaaatggagagggaacatctattaacttagaatcctataccagaggaaatatctttcataagtgaaagcaaaataaaattattttcagacaagcaatagctaagagaatttgttgtcagtagaccagcaatataatttcaaggacattattcaggcagaaagtatgtatcacatgaaaacatgaatatacacaaagagataaaaagcaccaaaaataataaatatagacaaaaagacagttttctcatttcttaaagttagagaatatttggtcatttaatacagaaatatactggtaaatgtaaataagcagtttacagcacaaaagttagaaaggaggtaacagcagtacactgttgtaaggttcttccattatactcaagtgctataaagttatttgaaggtagaccatgataaattaaatatcataaaagccctagtgttgcagtttctcgatgtgtaattagaagacctaagtgttcaggacatgctttcatggggtctgcaaagtcagagctatattcctaagagtgttaatagtttgtcactgcattgacatttgtactaatggtgctcagcaatgctgaataaaactgtaggtagcctggacaatatagtgagacattgtctctacaaaaaataaaaacattagccaagtatggttgtacgcgcatgagagtggggagctatgagctcactgctgcaccccaacctgggcaatagagaccctgtctcaaaaacaaaaactgtcagtgccctatcacaaatcaaagcaatagcactgtgatgactgtattattcaggacatgcattgaaggtttaaaaaaaagagggggagtggccagattcatttaagtatgtctatgacaaaacagtaaaaattattaattgtattaaatatttatatatgagtaaacatcttaacattctgcgtgacaaaaggaaaagtacagggccgggcacagtggctcatgcctgtaatcccagcactttgggaggccaaggcgggcggctcacctgaggtcggaagttcgagaccagcctgaccaaatggagaaactccatctctactaaaaatacaaaaattagccgggcgtggtggtgcatgcctgtaatcccagctactcgggaggctgaggcaggagaatcgcttgaacccaggaggcaaaggttgcagtgagctgagatagcgccaccgcactccagcctgggcaacaacagcgaaactctgtcttaaaaaacaaaaacaaaaacaaaaaaaaactcgactacacacttgtgcaaaggaaaagcacttgtgcaattatttgagttctaaactgaacaaatgtctttttcaagaacactatttttatttaaaagaaaaactgactgcaaactgcagtggcagtcattttctaaaaattagacaaagcgggccctttatctccatgatatttctcccagaaaaccataaacccactcaagtcataaggaaatcatgagagaaacctaaattgaagaccattctagaaaataatagaccagtactcttcaaaagtgtcaagttcattaaaaaaaggaaagatgacaaactgtcaaaggccatagagactaaggaattgtgatagcaaaatataatgtgatattccggattagacactgaaagagaaataggactttaatagaaaaattggtgaaatccaagtgaagtctggagtttaattaatagtaatctaccaaagtcaattttctgagttttgacaaatgtacagggtaatagatgctaacattagaagaaactgaatgagaggtatttatgaattctctgtattgttttttcagtatcacaataataaagttattccaaaatctaaagttattctgtaaatctaaagttattccaaaataaaaagcttattaaaacaaacaaaaaaggatgaagtgtgccagtgattttaaggaaagcaattgaaagtaagtgttgctaataataaaatccagcctttcagtaagaattaaaatgctgtgaacttgtaaatgccactatatatatgtgtgtatgtatatacatatatacatatatatatgttgtcaatagacagcaatataatttcaaggaaattattcaggcagaaagtatgtatcacatgaaaacatgaatatacacaaagaaaatacaccaaaaataataaatatggacaaataaaaaagacagttttctcatttcttaaagttttagagaatatttggtcatttaatacagaaatatactggcaaatgtaaataaggagtttacagcacaaaagttagaaaggaggtaaacagcagtacactgtcgtaaggttcttacatgtaaggttcttacaaaactaagacccaactatatgctatttataagaaacccactttaaatataaagacagatacaagaataaaaggatgaaaacagaaatgtctgcaaaatattaactgcaaacaagctctagtggctaataaagtcagataaaaacttcatatatatgtgtatatatacacatacatgtatatacatacatacgcgtatatacatatatacgcatatatacgtatatatgtatatatgcgtatgtatgtatatacatacatgtatgtgtatatatgtatgtatgcatgtacgtatatatgtatgcgtatacgtatatgtgtatgtatgcgtatatgtatgtatgcgtatatgtatgtatgtatgcgtatacgtatgtatgtatacatatgtatgtatgtatacgtatgtatgtatgtatgtatacgtatacgtatatatgtacacacacacacacacacacacacacatatatatatatatatttttttttttaggcaagagtcttgctctgtcgcccaggctggagtgcagtggcatgatcttggctcactgtaacctccacctcccaggttcaagcgattctcctgcctcagcctcccgagtagctgagactacaggcacgtgccaccatgctcagctaatttttgtatttttagtagagatggcttttcaccatgttagccaggatgagctcagtctcttgacctcgtgatccacctgcctcatcctcccaaagtgctaggattacaggcgtgggccactgcgcccgggcctatgccaccatatatttaacagcttcccagagttagatttttgtgagatcagtggtgataatactgtcgttttttgatattttataatgcaatgctgtaacatttggaagatctacgtatctggtgcaccagtactttccaaatgaccaatgcatgatattataaaaccatgcataaatacacatatccatgcaaagtgcaagaaagaccaatgcatttttctataacagaattatatggtttcagattccacactataacttacctttaagaaacaaccacttgatgaattttggagtggcatcagagaagaatgcccacaattatctgaaaagactattaaaacgttcttctctttactacatacataactgtgagattttcttcatgtacttaaatttactaaaacaatataaagcaaaaaactaagtgcaagagtagatatgagaatccagccttcatttatgccatacattaaagagatctgcaaaaatgtaaaacaatgccactctccccactacttgttttttaatagtcatttttcacaaatatgttgtttttgttaacatataatagctttattcttgtgatatttaaatgattaatacttgaacacttcagttttaactgggggtatagtaataactgataatcccataaacaaaaaccctttgaggtctttattaattaagaatccaaagggaccccgtctctataaaaaaaattttaaaattagccacacatggtggtatgtgcctgtagtcctagctactctggaagctgaggtgggaggatggcttgagcccaggaggcagaggttgcagtgagccaagactgcaccactgcactccagcctgggcaatagagccagactttgtctcaaaaaaagaaaaaagaatccaaaggtatcatgagactaagatgtttgaaaactgttggtcaacagcaaccaccaaaaaagtaaaacaaaggtaaagctaataagctaatagtggtgataaagtgcagtgacaaaaatactcattcaacccaaaagagggcaggagaaaaaaaaagtgaaagaccagaagaaataatttgaaaagaaatagcaagatggtaaatttaaatctgatcatatcaataatgacagtaaatgacatgccatttaaaaaatagagggtatcagattgtatacaaaagcaagacccaactatatgctatttataagaaacccactttaaatataaaggtagatacaagaataaaaggatgaaaacagaaatgtctgcaaaatattaactggaaacaagctctagtggctaataaagtcagataaaaacttcataaaaggaaatcttaccaaagcaaaaaggacatatcattgatgacacagggaccaattcaccaagacaacttcaaaacaaagcttcaaaaaacaggaaacaataattgacagaaatgaaaggagaaataaccaagtacattatggtggagattttatcactcttctctcagttagtggtagaaaaagcagaaaatttaaaaaatataaaaaatttaacactaccatctaacatgacctaaactgatatttacagaatatttcattcaacatctgcaaaatacacactgctctaaagtacacaaggaacgttcagtaatgcccctatatttggggcataaacaagtctcaataaattgaaaaaaactaaaattgcataacatatattgtctgactgttatggtttgaatatttgtctatttgtcccttccaaaactggtgttgaaatttaatccccagtgtgatagtactgggcaggggtgggggagcctttaagaggtaatttggtcaggagggctctgccctcatgaatggattaatctgttcatggattaacatattatcatgagagtgggactggtagctttataagaaaaggaaaagagacctgagctcatatgttcagctcccttgccacatgacgccctgcattgccctgggactctgcagagttccaaccagtaagaggactcttaccagatgaagcccctcgaccttggacttttcatcctctgtaactgtaagaaataaattccctttctttataaatcactcagtttccaatattctgttataagcaacggaaaatggactgagacactgaccatccatattaatcatttatgaaaacatatccgtaaaatcccaagatattttaaaagtaaaataacatacctctacataatcataagtaaaggcagtaacaaaagaaaaggaaaagtatctttcattgattgaaaatgaaaacactgaaatttatggaatgcagctaaagcacagttagaggaaaatttgtagcttaaaatacattaaaaagataaaaggtctaaaatgaatgatccaccttagaaaactagaaaaaaagcaaaatacatccaaagcaagtggatagtaaataataaagaacagaaatcaatgaacagaacacacaaaaaacaagaagtgaaaatcagtgaaacaaaaggtgtttcttttaaaacataataaaattgataaactcctagtaaaactgatgaatgaaaaagagaagataaaaattgccaaaatcaggaatgcaagagagatcatcactatccacatttctatcacatacctagcagacattaaaaagataagaaaatatgaataatttaattgcaataaatccaacaatatagatgacatataaaactctgttgaaagacatgttaccaaaactgactcaagaagaaacagaaaacttgaaaagcccaggctgatgtcaagaaaaacattaaatttataactaaaaatatgctcaacaacaaaaaacttccacacttcacttagatcagtaattctcaactggggttgactttgcccccttaaggacatctgacaatgtctaagacatttcagttgtcacaatgagaagtgaaaggggattactactggaattcctagaggccaggggtactactaaatatcctgtatttcacaggaaagcccctcacaatatttacatttaggtcatgtaaatatgtactatgtaatatttacatgacctaaaatgtcaaaagtgctgaggttgagaaaccttggcttaaattatttcactggtaaattctgtcaaacattcaaggaagaaataacaccaattctacacaaataatttcagaaaatagaaacaatcctcaacttactaaatgatgattgtattatcccaataccagaatctgacaaaagcattaaaagaaaattatagactgacatccctcatgaatatagaagcaaaaatccctaacatagtattagcaaactgacttctggatttccactccagcctgtacacagcttagaaattgccattccaggacaggtgtggtggctcacgcctataatcccaacattttgtgggggtcaaggtgggaggatcttttgaggccaggagttcaagaagttgccactgcatcctaacaagtaaaaacctaagcaaactgaaaaattaataattattcttagattcaccaaagacatgaagccacagagcaaaccactgccccaaaactgcagaaacaaacacataaagaagaatcacaacttagcagagcagaaacccagaagctgaaacctctggcagtgctgcagtaggaaaacataaactgtaattgacaaactgatagaggctgagtgtggacaagtctgagtgttagaactccagggggtaggcagctatttaaaaaaggaaaaaaaattaaaaattaaacaaaactccaggaggacccagttgcatacactttcgtgagttttatttccaggaactctaccaggtcctcagactgagtactgtggggaagaaatccccttgtgctttcagcaggagaggaaaagtaattattttgaaatagtcctttacattctgttcttaacaaggtctgccctcaggagaaacttttttaccagagcctaacctgctctaacctaactaggggaagggaaatacacaactccagctccctctgtccattctgtcctgtcaaagggggaaaaaaaacaaaactgagaagcactatgaagcgtaccattcagaggtacaggttcaccaaaagattaagacccaatcataggactatagaatgcttccccttttcccacaccttaccactaccttactaaagtcctatttaccagttccttttacccaccacatttatatctacctttcagcaaaacttatatggcatactaaatggtaaaaaccacagtctaaagagattaaacaagcattagaaccagagtcagatatgataggaatgttggaattatcaaaccagaattcgttttaaagagaactatgcactaaaggcttcaatggaaaaagtagacaacatgcaagaataatgtaagagatgaaaaatttaagaaataatcaaaaagaaatactaaagattaaaaaaactggaacagaaataaagaattcctttgatgggctgattagtaaattggacatggctgagacagaatctctgaacttgaggatatgacaacagaactttcaaaactgaaaagcaaagagaaaaaagactgggaaaaaaagtacagaatatccaagaacactgggaaaactataacggacaagagagaggggaggaaaagagagacagagagaaggaagaagaaatatctaaagcaatatggactgagaatttcccccaaattaatgtcaacaccaaatcaaagatccaggaagctcagagaacatcaaataggataaacattaaaaaaaaaaaaaactacttctagccatatcatattcaaatttcagaaaataaaatcaaaaaatcttcaaaggcagcagaggtaaaaacatgctacctataggagcaaagatatgaacttatcctcagaaatgcaagtaaagagtggagtgaaatatttaaagtgccaagagaaaaaaaattgcaaacctagaattctgtaccctacaaagttatccttcaaaagtgaaggaaaaaaactttctgggacaattattaaggcatttgtttgccaggagacttgccttgcaaaaaatgttaaaagaatttcttctgaaagaagatatttttcttttttcttttttttgagatggaatcttgttctgtcacccacgctggagtgcagtggcgtgatctcatgatctcagctcacctcaacttccgcctcccaggttcaagcgattctcctgcctcagcatcccaagtagctgggattacaggcatgtgccaccatgcccagctaatttttgtatttttagtagagacagggacttgagagatgacaacgtgctggcagcccttgctcactctcggtgcctcctcagcctctgtgtccgctctggctgcgcttgagaagcccttcagcccactgctgcactgtgggagcccctctctgggcaggctgaggccagagctggctccctctacttgccaggaggtgtggagtgagaggtgcaggcaggaaccgtggctgcgtgcggcactcacgggccagtgcaagttccgggtgggtgcgggctcggcaagccccacacttggagctgctggccggtgccactggccccgggcagtgaggggcttagcacccaggccagcagctgcagagggtgtgccgggtcccccagcactgccagcctgcccgtgccgcactcaaattctcgctgggcctcagccacctccccacggggcagggctcaggacctgcagtctgccatgcccgagctccccccaacccccctggtgggctcctgcgcggcccgagcctccccgacgggcaccgccgcctgctccatggcgcaaggtcccatctaccatccaagggctgaggaatgcgggcgcacagcgcggtactggcgggcagctccacccgcagccccagcacaggatccgctaggcgaagccagctgggctcttgagtcgggtggggacttggagaacttttatgtctagctaaaggtttgtaaatgcaccaatcagcaccctgtgtctagctcagggtttgtaaatgcaccaatcagcaccttgtgtctagttcaaggtttgtaaatgcaccaatcactgctctgtgtctagttaatctagtggggacttggcgaacttttgtgtctagctaaaggattgtaaatgcaccaatcagcactctgtgtctagctcaaggtttgtaaatgcaccaatcagcaccctgtcaaaatggaccaatcagctctctgtaaaatggaccaatcagctctctgtaaaatggaccaatcagctctctgtaaaatggaccaatcagtaggctgcgggtggggccagataaagaaataaaagcaggccacctgagccaacaacgccaacccgcttgggtccccttccacgctgtggaagctttgttttttcactcttcgcaataaatcttgctgctgctcattctttgggtctgcgctgcctttatgagctgtaacactcactgcaaaggtctgcagcttcactcctgaaggcagcaagaccatgaacccatggggagggacgaacaactccagatggaaggtacgaacaactccagatggaaggaacgaacaactccagacgcaccacctttaagagctataacactcaccatgaaggtctacagcttcacccctgaagccagcgagaccgcgaacccaccaaaaggaagaaactcagacacatccaaacatcagaaggagcaaattccggacacaccatctttaagaactgtaacactcaccacgtgggtccgtggcttcattcttgaactcagcgagaccaagaacccaccaattccagacacagtttcaccatgttggtcaggctggtcaagaatttttcttattcttaattgatctaacagaaaaaaagttttcttagtctattttctgttgcttataacagaatacctaaaattcaaaagaatttatttcttacagttacagaggatgagaggaacaaggtcaaggggctacatctaatgagagccctcttgctgatggggacgctctatagaatcctgaggtggtgcagagcatcatgcggtgaggggctaagcatgctagctcagatcttgctttcctcttcttataaagtcactaggcccattcctatgataatccaataatccattaatccattaatggattaatcctataaaatagattaatcctcttaaagaattaatcacctcttaaaggccccctctctcaatattgccacagtggggattgcctttcaccataaattttagaggggataaacaatcaaaccatagcaacagtttactcaaaataataacatcaataatgtgttcaattatgtatgctcatgtgtgcatatgctcatatgtgagtaaaacgaatggcagtaataaaagggatgggcagaaggaattaggaatgttttgttgttataaggtatttgcattacacatgaaactccactttcaggtatagtgttgcctgaaagtggagttggcttagctataaatacatactgcaaactccaggacaaccactaaaaaaagttttaaaaaaagaagtataactgatatgctaagaaatgggagaaaatggaatcatataagatgttcaattaaaactaaagactgaaaagatgtggaagacaaaactggaaacaaattataaaggcaacaactaacaaacagtaacagaaatgagagataataatccaactgtatcaataatcactttaaatatcaatggtctaaatgcaccaattaaaacacagagaggccaagcatggtggctcatgcctgtaatcccagcacttttggaggccatagcaggaggaccatttgaggccaagagtttgaggatgcagtgagctatgattacaccactgcattccagcctaggcaacagagcaagattctgtctcaaaaataaaacaaaacaaacaaacaaatgaagaaacagagactgccaaagtgtattacaaaagaagacccagccatgtgttgcctacaaaaaaacccactttaagttgaacaatgagaacacatggatacagggagaagaacaacacacacaggggcctgtcagggggtggggagacaaggggagggagagcattaggacaaatacctaatgcatgtggggcttaaaacataaatgacaggttgataggtgcagcaaacaaccatggcacatgcatacctacgtaacaaacctgcaaggtcagcacatgtatcctggaacttaaagtaaaattaaattaaattaggttaaaattttaaaaaccccactttaagtataaaggcacatatagattttttaaaaagggatggagaaagatataccatgccaatgctaatcaaagataacaagagtagctatagtaatctcagacagagcagacttcggagcaaggaaagttatcaggaataaagaggggcattacataataaaggggttagtaatccaagaagacacaaaaatccttatcatatatgcaactaaaaacagagtggtcaagatacatgaggcaaaaacggatagaactacaaggagtaatagatgaatctactattacactggaaaactttaatgcctctatcagaaatggacagatccagcagtcagaaaatcagtaaggacatagcttaacaacagtaccatcagtcaactggatgtaattgacatctgtagactaccgcatccaacaacagcagaggaaacattcttctcaagctaacatggaacattcaccaatacagactacattctaggtcataaactacaccttaacaagtttaaaataacagaaatcataaaatgtctgctctcagatctcaattaaattaaactagaaattgacagagatagatagctgaaaaatccccaaatacttggagattaaacaacacacttctaaataacacatgtgtcaaagaagaaatcttaagggtaattttaaaatatttttaactatatgaaaatgaaaatacaacttatgaaaatttgtgagatgcagcaaatacagtattagaggcaaaagtattgctttgaatgaatacatgagaaaagaagaaagatctaaaatcaatcatctaagcttccaccttaagaaacaagaaaaattcaagcaaattaattacaaagtaagcagaaaaaaataaagagcaggaatcaataaaattgaaaacaggaagtcagtagagaaaaatcaacaaaaccaaaagctaacagttctttaaaaagatcaataaaatttataatcctcttgccatgataactaagagaaaacaaaaaagacacaaattactaatatcagaaatgaaagtagagacatcactacagagcccaaggacattaaaaaggataatgaataagtattatgaacaattctttttttttttcttttttgagatggagtcttaagctctgttgtccaggtgccatcctggctcactggaacctctgcttcccgagttcaagcgagtctcctgcctcagtctcccaaggagttgggactacaggcgcatgccaccatgtccagctaatttttttgaaaattaatatttttagtacagctaatatttttagtgcagacaggatttcaccacgtcggccaggctggtctcgaactcccaacctcaagtgatccacctgccttggcctcccaaagtgctgggattacaggcctgagccaccacacctggcttattacgaacaattctatgcccataattttgataacctgaatgaaatgaaccaattccttgaaatatacccaaactaacataagaagaaactgaatcaataattaataatcttccaaaacagaaagcacagacccagatgggttcactgatgaattctaccaaacatttaaggaagaaattgtatcaattatctataatctcttccacaagacagatggagaggaaatacttcctcactcattatctgaagccagcattactctaataccaaaactagacaaaggcattactaaaaaagaaacgtacagaccaatatctcttataaacataaatgcaaaaattcctcaagaaaatattagcaaatctaatccaacaatgtataaaaagaattctataccatgaccaagtgggatttatcctaggtatgcacaactggctcaatgtttaaaaaaaaaaaatcaattaatttaatcaattgcatcaagaggctaaagaacaaaaatcatatgataaaacatcaatagatgttggaaaagcatttgacaacatccaacaccattcatgagaaaacctctcagtaaactaggaatagaggggaacttcctcaacttgataaagaacatctacaaaaaacccatagctaacatcatacttaatggtgagaaactagaagctgtctctctaaggtcaggaacaaggcgaggatatccccgctcaccactgcttctcaacattgttctggaagtcctagttaatgcaatagaaaaaggaaataaaagttacactaattgggaaagaagaaataaaattgtctttgtttacagatgacatgattgtctatggagaaagtccaaaaaaatcaacagaaaaacttctggaactaataagcaataacagcaagtttacaagacagaaggctaatgtacaaaagtcaatcactttcttacaatataacagcaatgaacaagtaaaatttaaaatgtaaaacacattaccataaaaatgaaatacttaggtataagtgtaacaaaacatatgcaagatccgtatgaggaaaagtacaaaactctaatgaaagataacaaagaagaacaaaacaaatgaagagatattccatgtttatgattaagaagactcgccgggcgcagtggctcacgcctgtaatctcagcactttgggaggccgaggcgggtggataacctgaggtcaggagttcaagaccagcctgacaaacatggagaaaccctgtctctactaaaaatagaaaattagcccggcatggtggcacatgcctataatcccagctactcaggaggctgaggcaggagaatcgctcgaacctgggaggtggaggttgtggtggcgccactgcactccagcctgggcaacaagagcaaaactctgtctcaaaagaaaagaagactcaatgtcatttagatgtcagcttttctcaacttgatctatagattcaacacaatcccaatcaaaatctcagcaaattattttgggaatgataaactgagtctaaagttacatggagagacaaaagacccagaatagccaattcaatattgaagaaagacaaagtcagagggttgacactactcgaattcaagacttaccagaaggctacaataatcaagacagtgtggcattggtgaaagaacagacaaatagatcaatggaacagaacagagatcccagaaataagcccacataaatatagtcaactgatctttgacaaaggagcaaaggcaatacaatggagcaaagataggcttttcaacaaatggtactggaacaactggacatcgacatgaaaaaaaaatcaatctacatacagaccttacatccatcacaaaaattaactcaaaatggtttacagacctaaatgtaaagtacaaaactatataactcctagaagataacacagaaaatttagatggccttgagtatggtgatgactttttagatcaacactaaaggcatgatctacaaaaaaataaaaagtaaaatacagtagtccccccttatccttgggaaatatgttctaagatccccagtggatgcctgatactgaaccctctatgtgcttttttcctacacatatgataatgttttataaactttataaatttataaattagacacagtaagacattaacaataataaaatagagcaattataacaaaattctataataaaagttatatgaatgtgttctctcacacactcacatatgcacacacacagacatacatgcacacaaaatatttttattttttatttttattttaatattttcagactgcagctgaccatggataaccaaaactgtggaaagtgaaactgtgataaggggagactactataattgatcagctggagttcactgaaatttaaaacttctgctctgtgaaaagacaagccatagaaagaaggtatttgccaaaggcatgcctgacaaaggactgttatccaaaatatacaaagaagtcttaaaactcaacaataagaaattgaacaatctgattttaacatgagcaaaagacctgtatatcatcagagaagatatacagatggcaagtaagcatgtgaagagatgttcaacatcatatgtcattagggaactgcaaattaagacaatgagacaccaccacacagctatgagaatggccaaaattcaaaacactgacagcaccaaatactggagaaaatgtggcacaagaggaactctcattcaatgctgctggaaatgcacaatggtacaaccactttggaagatatcttgctaccttcctgcaaaactaaacatattcttatgatccagtaatcacttcctttggtatttaccaaaatgaactgaaaacataaaaccacacaaaaaattgcacgcagaagtctagagaagccttattaacaacagccaaaacttggaagcaactaagacgtccttcagtaggtgaatgggtaaataaactgtggtgttcccagacaatagaatattattcagcactaaaaagaaatgagctatcaagccatggaaaggcatggaagaaatataaatgtatattactaagtgaaagaaaccaacctgaaacagctaagtactgtctggttccaattacataatagtctggaaaaggcaaaactatggagacaagaaaaagatctgtggtttccaggggattggaggagggaagaatgaatacacacagcacaatttttagtgtagtgaaactatgctgtgtaatactacaatggtagatacacgtcattatacatttgtccaaagccataaaatgtacaacactgggaatgaatgatactgtaaactatggactttgagtgactgtgtgtcaatgtaagttcattggttgtaaaaaatgatccactgtggtgcaggatgctgacagtgaaggaggttgtgtgtatgtggggacaggagttatatggaactctctgtactttctcctcaaatctgctatgaacctacaactgccatagtttttacatttaaatacatatatttaaatatatatgaatttaaatacatatatttaaatatatatgcatttaaatacatatatttaaatatatatatgcagatctaatccagaaatatgcaaggtgaataataactgtgactgatcatagtttattcctggaatgcaaagttggtttaacaaccacaaactaacttatacaacttaataatttaaaaaaatgatcaaaagagttggcacttgagttttgcctcacatgaatggaccaaaagctacacatataatgcccaagaaacattcatcaaatctctgaaggatgacatcatgttagccttcaaactgtcttccatacatgatgtctcaaatattatatgttttcacatccagtactcaagcaaaggtaactgggcacacaaagagataagatatcacctgttagcaaaaactagcagaaataatatttgatataagcagacctataggagttccagatgctggaatttccagacatatgaaacagctttacttactatattcaaggagataaaggccaagcttgaaatttcagcagggaacagtaaactgtaaaaagtgatacagcagatttgaaaaagaaccagctaggaacacaagaattaaaaacacacaaaattgacattaagaactcaatgtatggagccaatgtattcttaacacattctctaggtagttctaatcatccaatgtgtttgcaaatcagaatagattattatttaaaaaatcttaataaacttgtcctcaaacccactgttttttataacctttttaagattttttgtttaatttacatataataattttacatacttatgggatacatagtgatgttttgatacatataatgtattgtgatcagaccagggtaattaccatagccatcatctcaaacatgtatcatttctttgtgttgggaatattcaatatcctccttcttgctatttaaaactgtatattattggtaactatggtcattcaacagtggtatgaaacactagaacttattccttctatctagctataattttttatcctttaacaaatctctccctaacatgcactccccaccaccaccttcctcctaccctttccagcctttagtatcctctgttctattttttactcctatgagatcaactttcttttttgggtcctacatgtaagtgagaacttgtggtgtttaactttccatttctggcttatttcacttaacataatgtcctccagttccactcatgttgccacaaatgacaagatttcattcttttttatggctgaatagtatatgcttgtgtatatataccatattttctttacccattcatctgttgttgggatacctaggctgattccatatcttggctattgtgaatagttctgcaataaacatggggttgcatatgtctccttgatatactgatttccttttgtatggataaatgtccagtagcgggattgctcgatcgttactgttttctaattcagctcctataatccctccagaattatttttctaatacataaatttgatatctcagtacctcatttaaaagtattttagataaaacccaattctctagcctcgtggctaatgagccttcaccatctaccctgtatctttgatatactgtcctattagctaaacagatcctattcattcctgtttgctttttcaatttcctctatctagaatggctttccccatcttgtctgcctgcttaattcctactaatacacttaggaacacaatttgcatgtcatctctgagaaaaataaatcactctttcaactgtactctcataccctgtcacaactccactaaagcacttaaaacacaatattatagttacatatgaaattctcttctaccccttgtcccctgcagttatactgaaataactcaaaggctaggatgtagatatagatatagatatatgcaccaagaacctaaattatacctattgcattatacatagtattttttgaataaagaattcatggaaataagccagaaaatcttaagaaatctaagatcaattcaagaattctgtccttcaagttctgctatagaaaaagcctagagtttgctaatatcaggtcacacattgaattggcagcagaatggtattctaccacactttgatgccttgcgttttgtagcgaaagcgatttaccaaagaagtgtaccaggatggaaatatgtgaaaagatcagactggattcaaagggagggtggcaagaatctttgaatagctgcctaaataaataaaatatggggactgacaagaagaaagaacagtagcatagaagcttctccttcaaagacaaggagagagccaaaattgcctgatatataccctgatatatccattaactgacttgactttgagtttcaatggacagtaggaacactccccttaaaggggttagtgttaaaccacattagtgagtaaatccttctatttctatatgctgtgaacaatttatagagagccagaataatgtttcagaagcagaaaaactccccacctctactatctcaagaccatgtctgcccaagatagagtctcttacacaacttgatctaagagctgaggaaaccattatgcttgggatagacagggtttagctgattatgatgtctttatagattataaattttattccagatctatgaattaggagacaaaaaacccatcctatatttcaagctcaattgcagtctcggggcaaagcatttcatcactttctggcatataagagtaccgtagtaaacttcatttttgcaaagttaccagcacaatcttgtttgtttagtctgaagcctgctataatatacaagtctgagataaagacaggatgaatacaacttttaatataatgttgataagcaaaacagtattcctgtaatcaaatatagatattcagagtattttcaaacataaccctttccaagtctctgtttctgataaaatgaaaaaacgtcccctcaaattctaccgtttaatttgtgaaaacttatctttattcttttaattttctttaataatttaggcttctctcttgaggatcatacttctcccttctcccagaagcataggcccagaaatattactagtacctctccaatctttagaccacacaaattattttttatgaaatccatttatacacagaaatgcataataatttatcaaccatcaataaagaacacacacgcaactagaagtgtagttattcactaccttttcaaggtgataacagatgaggtaaataaaggtgaaaacaaaacatgcaagagtgtaacaattttttaaacttttcgggccaggcatggtggcacatgcctgtaatcccaacactttgggaggcctaggcaggaggataacttaagcccaggagttcaagaccagcctgggaaacacagtgagaccctgtctctactaaaaatataaaaaaattagccaggcatggtggcatgcacctgtagtctcagctaccagggaggctaaggtgggaggatcgtttgaacccaggaggtcaaggttgcagtgagccatgattgtgccactgcattctagcctgggcaacagagtgagatcctgtctcaaaaacaaaatttttaaagaataacttctgaacacagtccagtccccctacaatttaacatcagtgaaataattgttttgtttttgcagtaatcaaattttacagcaagaatatctatatttaagcataattaaaaccaataaacttttcaaatactctattacacataccaataaaatcagaaaccagaaaattaagccccaacatgttctaagtgttatgtatttaacatttaactactgctcacaaaacacatgtatgctagtcctttccataatgttgttcctgcagtaaaaaatttcaaaagcaaagccttaactgaggaaagtgatctattctacttttagacaatttgaaactctctgattaagaaatcagtatcttacaacttttttccttgcctgtcaaaatttatgtgaaactgattcaaccactcaacttaaactttaccagaaaatggcatgtgtattgatgaaaaacttgatcatctaagcactacaatttcgttttcacattaaagatgccaatataaaagcagtgcctagcaaaaaaaggtaagtttcactgagagattatcagtttgacataaatatgcataaatagtgcatattcaatctagtatgcaattgtatcataattacatataacatggttcatttgaaatcattctcacttgcagtttcgagttcctaagacaaaccatgtagctattccaactttacctactaatttagaaaaaaaaacaaaaaactcaggtcaactgaactacgatataactgaaatactatttataattaacagattcaatttttaacacggctcaccaactggttcaaaaggccacaagcggaatttcacatctgcaagagaacacatgtgataatcctcaaaaagtaatactaggaatgttcttgtgattttggaattgattatcaagttaacttcagtcagtttgattttgctataatcctaaaacgttttttatgtttctttactgttaacatggaaagcactaaaattgattagacttgtaataaaagttactgcaggaataaaaagttttaaaatatttaacagattctttcacttatgaacccaaatatctctgaaaagatacaggtacaaaacatgtaaagttaaattgtatatagatgtgtgtgtgtgtatatatatacacatctatataattaaatatggtgacatttcattcttgaaatagaaaaaaacatataattccacatatgcaaaatatatacatgtaaaaataattacgtgttttttccacacaaaaaaatgaattttaaaaggcctaaaaatgtgaaaggaaagtgaactgagatatatcattctatgttttatattttataaagagaatataatcatgtgttatttgtgtcactaataatacataaaaaaggtttttttttttttttttttgaaacagctcaggctagagtgcagtggcacgacctcggctcactgcaacctctacctcccaggttcaagtgattcttctgcctcagcctcccaagtagatgagattacaggtaagcaccactatggccattaattcttttgtgtttttagtagaaatgtggttggccaggctagtctggaactcctgacctcaagtgatccacctgcctcagcctcccaaagtgctgggattgtagatgtgagccaccgcacccagcaaaaactttgtaaattaaatcttttcttctttacttagtgtgtaatcttacagatgtctttccattaaagaaatgtttggtttaataacatatttaaaaatatggcaactctgcaggacacagtggtgtgcgcctgtagtgccctgtactcaggaggctaagacgggaagattgcttgagcccaggagtttgaggccagcctgggcaacatagtgagccccacattccaaaaaaaaattttttttcaaaaaatgttttaaaagaatcaacaacttctttctgaagacctgctttaaaaagttattagccaatgaaatactactactctaatctcctaataaatcttactgctttaccattcaaaaagcaagtgaggcatcatttctccaagcagtttttcacacctaaattaccagctacctcttcatttcctaaagccttaacagcttaagaacctatcccaaaacatgacagaagtgtcctaacattcttcatggctttactgatactatattcactttcggtttctgattccaaacgtaataacatctatctgaaagcatacatggtaaaggaactcagatacagttttatattcataatcttctagagaattcaaaaatcagtgctatgaaaaaatgtttctaagttaaaacagagacataaaattgtaaatttaccattactataaaaagaaaatcatgcccactttgaaaaatgagaattgcagggaagaggacagcaaaattagacaaatagggagtagaggacacacattgaagcagagatagtagaaagcaagaggtagaaacatgttccatcacatggtaaaagtaatacttttttttttttttgagacagttttaatcttgtcacccaggctggagtgcaagggcacgaccttggctcactacgacctctgcctcccaggctcaagtgattctcctgcctcagccttccgagcagctggaattataggcacctgccaccacacctagctaatttttgtatttttagtagagaccaggtttcaccatgttggccagacgggtctcgaactcctgacctcaggtgacacaccagcctcagcctcccaaagtgctagaattaaaggtgtgagccaccgcacccagctgatacatattttgaagatggaaaaaggtcagaagaaaaatgacttgactatacataatgcctcccagagaacaaacataaccacaaaaagggcactaaaacatatactaatagctgtgacatagctggaaagttcgaaaactaaaataagtggcgcagagaaataatcgtcagttaaaggatcagagaaggggccgcagaggcagaggcagcaactacatttcaactctaccccttcttctcaaatgaaaaagagctgttcttttcctgaccactcatgaagttctattgctgttgttgctgttttttgagacgtattctcgctcttttgccaggctggagtgcagtggcacaacgtcggctcactgcaacctccgcctcccgggttcaagtgactctcctgcctcagcctcccaagtagctgggactacaggcacgtgctaccacgcccagctaatttttatatttttagtagagacggggtttcaccatgttggtcaggatggtctcaatctcctgacctcgtgatctgcccgccacagcctcccaaagtgctgggattacaggcttgagccaccgctcccggcccactcatcaagtttttataccacatatataaaaaagggaatgtgaggggccgggcgcggtggctcacgcctgtaatcccagcactttgggaggctgaggcgggcggatcacgaggtcaggagattgagaccatcctggctaacacggtgaaaccccgtctctactaaaaatacaaaaaaattagccaggcgtggcggcgggcgcctgtagtcccagctacttgggaggctgaggcaggagaacggcgtgaactcgggtggcggagattgcagtgagccgagatcgtgccactgcactgcagcctgggcgacagagcaagactccgtctcaaaaaaaaaaaaaaaagagaatgtgaggtcttggctttccgaaatgaaaatagcagattaaaggtatacagcgtatcagcaaagataattatccaaccagtaatttattcagagacttatggtaagaaaatatcatagaacattagtttatataaagatataaaaatgtatgtgcatgcatatttaaactaccataaaaatcaaaaatacctgtataaaccttcagtagcaagaccaccgttttgcctctagagggcgaacttggtcttctgaaacattctagacgagagacgttactttcagactttaccaaaagaaaaaaaaaggagctaaaacttaagatgtcacaatagcagaggttcccaacctttcttggtcaatgcctttagtgtctctgatttttttcacagtaactcttaagccaaaagaaatacctaatgattctgtttaataagtagctatgtccaaacaatttaataaggatatatttcctaacacttagtaactgctaaaaaaaaaaaatacacataaattgaaaaaagaaatatgttttctttcattctttttttttttttttcttgagatggagtcttgctctgtcacccaggctgaagtgcagtggcatgatcttggctcactgcaacctccaccttccaggttcaagcgattctcctgtctcatcccccaagtagctgggactataagcatgcaccaccatgcctggctaattttttgtatttttggtagagacagggtttcaccatgttggccaagctgctcttgaactcctgacctcaagtgatttgcctgcttctgccttccaaagttctgggattacaggcgtgagccactatactcggcctcattcttaaataaccgcaattaattaccaatttgggcatgtgtggctttgtgcattgtatacaatttctcaaaccttaaaatcagattagacataaccctcatttccagtcccacgctgacttttttacagtatctggtttttatcacagcaacctcagaaaaaacagattcacaaagatatgatgccacagaaaagtatgtagtagcacttaatgttggaactgtgtactgcttctaattaccagtctccaccatatccaactgatgtggaatatcactgtttgcctcaaaaaatttaaatatcccacagtaccccagtgtgttaagtgcagcacaccagagtgtctgagcacatggcttggggatcacagcacacagttttaagtaccaatagataaactattcactattttcatcacttgtaaagaaaattaactacaagccaggtgtggtggcacatacctgtagtcccagcttctcaggaagctgaggcaggagcatcatcatttaagcccaggagtttgaagacagcctgggcaacatagcaataccaagtctcttgaaaaaagaaattaagttagtttacagggagaggaggaggcacatggtctaactactgactagctacatagttcaggcaaatccttcaaaagggaaagggaggggctgcttagaaagacggcaatctcagcaacttctgtttgtcttatgcttctctcagggacaaacatgcagtcctctagtgccgtgcatgtacattctatgggggtgaacatcttggttctggttaaacagctagtgcttttgacagctgtgccaggaagggttaggaccaactacaaaagaatatgggttctaaaagcatagtgtgtgtccctaactttgtttttcctgaggaaaaaaataaaccttttattcaaatgcaaaaagaagaaaaaaagaattaactacaataatgtttttaaagatctaaaattattttctcatattacttggaaaaccagtttttcttctgagcaataaaaggaacactattaaatctttaaaggaagatatcttttccaatttgaatgatgattattgccttcatgtgattgtttttataaatgctagctgtgttaaatttggtaaactacaattgggaaggataaaaataggaaatgtactatatgtcttcttctgagcaataacttctctgaactttaaaacactgcagattgatccagtctcactgctttccattctcacttatctagtactgaagagccaaagttcagaagtcaaataagatcagaaagtcttaagaactcaagaatacagatgttaacagagatatcagaagaaatagcttctaaattactagaaacagattgtgtaccaactcttctcatttacaaagtccttggtttagagaggacaccagaaaagtgacaaaggaaggagttcaacctcataatctactcagtttttgctttttaatatttcatcagttcacaactaccaatattcagaacatctgtgccactgacaaatgctaccaacttcaactggaagtcaaacagtatgtggtgagagtgattagctaagtttttaaaaaatctattcaaggaataactggttaaaaaaaaaagtctacgttctatttgaagaattttcacaattataaaagataacagaaaatatatgacctgtttttctagaaaatttagcaggtccctataaatacttataatcccaaaagtctgtatctagaaaaataagaataaaaatagaatatggttagtttaaaaaaaaaaaaaaaaagaagaagaagaagaagaatgcttgaaaagctagggtaaactacatggctatgtcagtacttacctgctgaatgattttggatgttttctgaagattctctctaggagggactttaccaaataatttccaaccaggagcactatggacaactgatttgagttcctttgtcctttttggaaaaaggtttctgaaacacagaaaagttacatgaattgtgttttttgtaaccagagagctatttaacagtaattttataataagtttgttcccaaggcaaaaacaaaaatacttttaaataaaactatttctactacttataccactattacttagaataataaggctcaattaagaatatgtagcttaatacctaatgcatgcagggattaaaacctagataacaggttgataggggcagcaaaccaccatggcacacgtatacctgtgtaacaaacctgcacattctgcacctgtgtcccagaacttaaagtaaaatacagactatctggcttatatagaggtattagaagaatcatcaacagaaataataaaaagataaacaaattggaaggaaaatgatagccataaataagatgcaaacatttgtctaaatcagctacaaagtatactagaattgactgtacatgtacttaacaataagagccaaaattctgaaaacaaaaacatttaaaagaatctatataacagttaaaggattaagtaatacaatatttggataaatattatttacagtaataatttgttatttataataaaattatatctactaatcccctattgctataatatatatacataacctgtctttcctaggccagctatgtacaagaaagcttactacaaaagagtcaatatataaccaaggaagaaagtatctctcactgaaaaatctagaaaaaaaaaaacaaaacccaggacaggtgcgatggctcacacctgtaatcccagcactttgggaggttgaggcgggcggatcacgaggtcagcagctcaagactagcccgaccaacatggtgaaaccctgtctctactaaaaatacaaaaattagccaagcgtggtggtgggcacctgtaattccagctactcgggaagctgaggcaggagaatcgcttgaaccctagaggcggaggttgcagtgagccgagaccgcctcattgcactccgcgtcattgtgcaccctgcacaagtattaaggattttacctattatctccatgccctaaccaaccaaattaagtacctatttttttatgtaagcagggatgatactcaacatatgtacccatcaaaacaacatgaccagggcccaatgaaccaattaggaaggtactgatgaattcaactcaatataaaccctttgcataagctataagtgaacagtaagaaaattcttaattcacacatatgattaattacaaacagttccaaattgaagtcccaaataattagatttatctatactcaaaatgccgtatcaatatatcttaaaagtgcagattagtgataatagaaaataagtttttaatgaaaaatgttaagggactcctacaaaagaatgcaggctaatcaataataaagaaaagaaatggccaggcatagtggctcatgcctgtaatcccaacactgggaggccaaagcaaaaggatcacttgagcccaggagtttgagaacagcctgggcaatgtagtgagaccctgtttctacaaaaaataaaaattaaaaaaaatagccaggcatggtggtgcacaccttgtagtccctgctacttgggaggctagggtgggacaatcacttgggcccaggagttaaggatgcagtgagctatgatactgccactatactgcagcctgggcaacagagcaagaccctgcctccaaaaaaaaaaagaaaggaaaaggaaataaacactcttatttcctcaggtgtataacagaaataaacatatgacactagagtaatttctactttaagatactctggaggtttcacctcagagaccatgtacagtgacttaattctctacttcataagatcactaaataggtgaacgttttcaataatgaatatgctgaggactaggaatacttctaagaaaaaaatttgaagcctcaaaggatggtctattaatttaaacaatgtttgatacgttgtgtaccacttatcaagaaaacactttgtagctgatttaaacaaatgtctacatcttatttatggctatcattttccttccaatttgtttatctttttattatttctgttgatgattcttctaatacctcttaactccaaattcacctttatgctctaagataacagaaaaaattcctttaatcatttctcctttaaaacaaacatgaaattattaagctttctgggtagagggcaccaaagggacactgaaggagaaaggggctctcctgtggtttccagctgctgcagagtggatcgggtagaagtgtgaggacatccagtaaaattctgcttagctcgatgcccagactgcagcccctcagcaaacctgcagccttgctgaacctgcagcctcaacctggagatggcgttcctgcagcctgctcaacaaaaaaattgactccaccaaaggcttcctgccagcaacagtgtgccaatttcctctgcaagccccacacaggccagacagttctcatcaagtcatattccctctacaattcctacgtgacctgcctgcaccctaaaggtttcctatctacccacacaaataaacacaagaaaaaatctttgtcaccatggtttaagaaaataattattggatatgacacaaaaacatgatctacaaaagaaaaagttgatgaactgggcttaactaaatttaaaacatttgaacttcaaaagacatcatggatgcaaaatgacagaatagaaagatctaggggtcagtctccccaccaaagtaaaagttgagctagaaagagtaactggagcggggcatggtggctcacatctgtaatcctagcactttgggaggctgaggcgggtggatcacctgaggtcaggagttcgagaccagcctgggcaacatggcgaaaccctgtctccactaaaaatacaaaaattagccaggcatggtggcgcaaacctgtaatcccagctactcaggaggctgagacaggtgaattgcttgaacccaggaggcggaggttgcagtgagctgagatcgcaccactgtactccagcctgggagacagagcaagactctgtctcaaaaaaagtaagagttaaaaaaaaaaactaagagtaactggaatcaagtactttagtagaactctaggaactgaccaaacccttttaacaaccaggggagtgcttgatgaaggaagaggctaccgatctttcataagtatgaataagcagcatgcataaaccaattaccttcccctattcctcacaaccaccaccaccacacccaccacctcttgtggcagtggggatagcagcccatgttcctggagttgctaaccggtgccaggagggacagtagggatcatgtccttcaaaatttagggttgtacattttggttggtctggccctaagggagtgatgcaggcacatgcatcagtttcactactctccacagcagtggctttcactgtaagtattattagaacaataaaaaaggtaaaacctttttgatctccttttttggagccagatatctaagaaaatctttgtcaggtcaccagctagccacagagacaacagaacaaaaacttgtgaccatacacaatatggaatacatactttgtgaaaatagcttgtaaagtcacaaacaggtggcttcagccctcaacaagcaaaaaacagcaatcactgaggagtgggagaaacagatttatagttaccatactataatactcagagtatccagttgtcaacaacaaaaaattacaaaacataccaagaaacgggaaagtatggcccattccctagaaaaaggaatttgacaaaaatcttccctgaggaagcccaaagtaattactagtcaaagacattaagtcaatttcataaaaaaaaaaaaaaaaaaaaaaaaaaagctccaggagattgaaaaagaaaaaaacccatggacaaagaacgaaaggtaataaaggaggataaagggggaaaatgtatgaacaaaatgagaataccagtaaaggcagaaattataataagcaacacaacaaattctggagctgaaaaacaactaaaataaaaaattcaccagatgtactcaacagcaaatttgagcaggcagaagaaagagctggcaaatatgatgataagaaaattgaaactgtccactctcagtagtagaaagaaaaaagaatgaagaaaaaggaacagagcctgaggggcctgtgagacattactaagtgtaccaactacgtaccataaaagaccaaggagaagggaaagacaaagaggcagaaaaaatacgtgaagaaataactcactttgggaggccaaggcaagtggatcacaaagtcaggaaatcgagaccttcctggctaacatggtgaaaccccatctctactaaaaatacaaaaaattagccaggcatggtggcgggcgcctgtagtctcagctactccggagggctgaggcagaagaatggtgtgaacccaggaggcggagctcgcagtgagccaagattgtaccactgcactccagcctgggtgacacagcgagactctgtctcaaaaaaaaaaagaaaataaccaaaaacttcccaaatctgaggaaagacataatctacacatccaagaaactcaacaactttaagcagaataaactcaaggaggttcacactgagatacattatagtcaaactgctgaaactcaaagacaattttgaaaacaataagtgagaggtaccatcaaaaccagagatcctcaataagattaacagcttatttctcttcagaaaccatggaggccagaagtaagattacatatttaaaggtcagaaaggaaaaaaaaaaattgtccaccaaaaattccatatccaacaaaactatccttcaagaatgaaggagaggccgggcatgatggctcatgcctgtaatcccagcactttgggaggccaaggcaggtagatcacgaggtcaagagatagagaccatcctggccaacatggtgaaatcccgtctctactaaaaatacaaaaattagctgtgcgtggtggtgcgcgcctgtagtcccagctactcgggaggctaaaaagcattaaagcattaaaaaaaaaaaagatttttttctttttttaaaaaaagcaattttgactttgtatcatcaatgacagctggaaattttttaaaatctaaagagatataatagcaagaaaatacaaggtatgtgagaagaaatctagccaaagttttataaaaatttatagagagaatgaaatgatacattattgaaccacattaaagaaaacctcattaaatagaaagatagttcacatttatagaaaggaaaacactatcataaaaatatcaattctccccaaacttatctatcaatttcatccaattcccatcagaaacccaacaagattttttaggaacttgaaggaaactcaaaaatttatgttaaagaataaaggacctgggcgggcacagtggttcacacctgtaatcccagcactttgggaggctgaggcaggtggatcatgaggtcaagagatcgagaccatcatggccaacatggtgaaaccccatctctactaaaaatacaaaaattagctgggcgtggtggcgcgcgcctgtagtcacagctacttgggaggctgaggcaggagaatcaactgaacccaggaggcggaggtgcagtgagctgagattgcatcactgcactccagctagcaaaaaagtgagactccatctcaaaaaaaaaaaaggaataaaggacccaaaataagatattttcaagaagaaaaaaggcaaggctgagttgccctaacagatatccaaatttaccataacattacagtttttaacaacatatggtattgacccagggataaagaaattaatcaatggagaaagaataaacaactcagaaacatacccaagcataaatggaaacacaggtggcactgcagatcaacgaggaaagattgtgtaataaatagtatcgggacctccggctagcaatgtgaaagaaaataaattggattcctaccacataccacagtcagttcccaatgtatcaaacagttatacacgaaaggcaaacttttgaaagctttagaaagaaacacaggagaatttttcttctaatctcacagggaaaaatctaaaaatcagtcccaaaagcattaatttttaaaacttgataaaatcaccagcataaaaagtaatgagttctgttcaaagagcactataaacaaagtaaaaagacataaatttagaggataaattccaacacacataaatgacaaaaaattagcacacagaaaatacaaagaactccactaaccactttcataaaagataatctaataaaaaatagataaaaggtattgcagaaagagggaaaacaaatggcaaatgagatctatcacacaatatttagcctcattagtaataagggagctcacaaactaaaaacagagtaacatttgtaatgtattgaccactgtatataaaatcttagcaaaacctaagaaacctgataataccaagtttagaaggggaagaacactgttagaaatttacatgatataaatttgttttgatatttacatgatataaatacagttgtttctagctcataaagttgaacagctgcataccctaccatctagcaattagacttctagccacgaatcctaagcaaagtcctggacatgtacatttggaatacatatataacaacattcaggacaacactgttcaaaagagcaaaaacctactcaaaatccaaaaatccactgacagaagaatagaaaattctaattgtggtatatttgcaaatgtaatattattcctccgtgaaaagcaacaaaagctaattcatcaccatgaatgaaacttgaaaaaacaatgttcagtcctatgatctgaatgtgttccccaaaattcatctgttggaaacttaatcctcaatgcaacagtatttggaggtggggcctaatgggaggtatttaggtcataagggttccactctcagaatggatcaatgacaaaataaaaagagctcgacctctcaggctcaaacagtcctcttgcctcagcctcctgagtagctgggaccacaggcacacaccacaacacccagctaatattttaaatgttttgtagagacgaggtctcactatgtttcccaggctggtctcgaactcctgagctcaagtaatcttcccgcctcggcctcccaaaggctgggattacaggtgtgaaccattgcatccagccccaaaatactagtttttattacatcatgtaatcctaatgtcccagtcaggactccctagtaactggagagccctaactaaaatggttaaaagattttctttttcttttttttttttttttaaatggagtcttgctgtgtcgtccaggctggagtgcagcagcacagtcttggctcactgcaacctccatctcccgggttcaagcaattctcctgcctcagccccctgagtagctgggattacaggcgcacaccaccacgcctggctaatttttgtatttttagtagagacagggtttcaccatgttggtcaggctggtctcgaactcctgacctcaagtgatccacctgcctcggcctcccaaagtgctgggattacaggcgtgagccactgtacctggccaattttcatatttttaatccatagctgaggagctatcaatttatcctctgcctacactgcattgggcatcatcttctgccacaaagcttaggtacacttacttgaaccaaaatggataaacatttcagacttcaagtacccttcttagggtcaattcacatttatatacaaatctgtctcaatcatactgaggtagttactgggtcagaaaccatactaacaataagcccttggggaaaaaaatttacaatgaacaaattttattgttttttttacagctattatcaactctaatcactgaccagactgcaagaacaggtaggcagttctcatgaggagaaaaaaaaaagcattccattctttatattagaaatgcagagttacatgtataaattattaaagcagagacaccataaaatagaagggcttaagcatattttttaacttagtgaagcatagcttcaaataatgtgacctggctgagaaaacagacatagcagcagacggagaaaaccacaaatataagatgaagttataccaaaggaaagtaataactacagatcagaaaattcttcatgtgcagaattctataaagggccttgggggtatttatgtctctatagctttacctacaattagatattgtaatccttaccaaacatattctcacatgaaaaactagaggctacacatattaatattgtctatcagatctctataagttacagaattttttaaaatcacacctaaaatgctaaatatacataaatctttgattagggactgttaaaaattatcttgcattagccaggtgcagtgactcatgcctgtaatcccagcactttggaaggctgaggtgggtggatcacctgcagtcaggagttcgagaacagcctggccaacatggcgaaatcctgtctctactaaaaatacaaaaattagcctggtgtggtggcacgcacctgtaatcccagctcctcgggaggctggggcaggagaatcgcttgaacccaggagggtttccgagacgaagtcttgctctcttgcccaggctggagtggcacaatattggctcactgcaacctccacctcccgggttcaagcggttctcctgcctcagcctcccaagtagctgggactatgggtgcacaccaccatccatggctagtttttgtatttttagtaaagacagggttttaccatgtcggccaggctggtcttgaactcctgacctcaggtgatccacccgtctcagcctcccaaagtgctgggattacaggcatgagctaccacacccagctacttataaggatattttggacttccaaaattaactccaagaaatactaacttcttaaatcaaataacagtaagtctttcagtggatgtggtttttgtagaatcttgctatgatcagcacagatgaaaaggaaaaaaaaaaacctccaaaataaaaaagcctggttctaattatatattatagtcctgacaatacaataagttcagaatgaagtttaaattcttgttaaatcataaaaaaacaagccaaagccaaataacttaaatttatgcatccaggaaacattggttactacaagaaatttccataaaagaaatatgagcccacaggtatccagttgctaagaaaggccatcagatattgttccacattaatttcttatgccactaggaaattttggattgggttttcaggttattccctgccacaaacactatttataacataatacagcaaaatggcatatacctgcaatgaaaagtaattttaaaatatcattacaaatattgtatatggaattgtgttaaaacattacagatttaacaggcttcactggtcagcctaggaaaataatcactactttattaaatcttaagggggaaaacccagtgaaaaggtacataaataggccaaaaatgtgtcatcttttgacgccccatcccttgtctcgcgatctactgttagtaagcctgaaaagctgatgtctcaatggagataaatgtgagaccacattcctccgtatcaccttttcaaatgaaagacagaccgacagacagacacacacactcactctctctctcttccctttctcccaccccccaaaatattaaaatttcttaaatataaatcaacactaaaggcttcttagcaaaacaaaccagatgtgttcaagcacacccacacaaaagatagaacaattctttcaggattccagaggtagtgtctgactatatgaatgacatctgtagggcacttttggggaaggggtcactcttgtgctatgttgttcgtgttgaagggaggggaagcagaaaggaacattcctagcttctctctgcccccttattcatccccacctgagggaccaaattttggcagcagacactgctgctgaagatagtctgttctgctctcctgttaggaggccaagttacctctgtacctctctgctccccatccccacaggaaagacctgctgtgttaatgttttgctgagtaaatttaacacaagtgaaatattaaggaggccaactgtagtcacacaacaaacccacatcttttgatccacaatgtatctgtattaagacatattttgaagtaccatttgttttcctatcttttctctattgagcccaaacttgaatgggttgctaaaggtgttacctattaggccttcccaaaccccaagtatttataaattgaaaagtaccttattgcttcaggtatggtagaaatattaagaacaactatgtgttttcaaattattttctttcttttctttttttttttttttaagagtcttgctctatcacccaggctggagtgcaatggtgcaatcttggctcactgcaaactccacctcctgggttcaagcgattctcgtgccttagtctcccaagtagctgggattacaggtgcgtgccaccacactcagctaatttttgtatttttagtagagacacggtttctccatgttggccaggctggtctcgaactcctgacctcaagagatccaaccacctcggcatcccaaagtgctgggattacaggagtgagccgccacacccagccttcaaattgttttctttcttcattctgtgatacatcttgttagcacataacagggaatggtagtgttaatccatctttccccctttaaattcatcctccaccccaatcaacactatataaataccatgttcatgtacacgcccatctatacacacacagacacaaacacaccatcttccattctctctactaatttgtgtccaatctttttagcaaaaaggagttgagcaataagttgccccagttaggaaatagcatcaactgagaaatagcagtctaatggtttcttcattgttgaaaacatatagttgaaaaagaaaagaggcacactaagaaaaggctaatgtggggattagaagagaaaagaggggaaaaggcctactaatacaaccatttccctgccttctcccttagtggcttttataatacaggttgggtaaatgactctagcttattaatacatgttaacatttgcttcacatatctgtgtgcttgtattctcctaaaatttcttcatttcttttatcacacacaaaaaaagctacataggacctaagagtcagaccatttgcctaccataccttatcaaaggctaaagctcactaaaaaggggcaaaatttattgatatcatgcaaattctccactaatgcttttttaaataacagaatgtagagtgcttggatctttaagaattggcaaacccacttacgtatctgagataaaggaatgtaaatcccatagtttctcaaactgtggaatttgacactatagaaaattgtgactacctaatcctgaatcttcttactgccaacagtaatgtgagctccagccctccaaaaagtaattaattttgcttaacatttacatcaatttgactattttaaccttttagactcattggataaattctaataatcatttcaatagacttgtatattaaaaggggattcaacactgggcacacacatgtagtcttggctactcaggcggctgaaggaggactgcttgagccctggagttcgaggccagactggacaacatagcaagacaccatctatttttttagaaattggggtggggggatagaatacttttcggctgggtgcggtgactcacacctgtaataccagcactttgagaggccaaggcaggtgggtatcttgcgtccaagagttcgagaccggcctgggcaacatggcaaaaccccatctctacaaacaaaatgcaaaaattaggcaggcgtggtggcacgcacctgaagccccagctacttggcaggctgaagcgggaggatcacttgagcccaggaggtcaaggctgcagtaacacaagatcgtaccactgcactctagcctgagtgacagagcaagaacctgtctcaaaaaaaaaagtggaggggatagaatcaattgaaagagtaaaatcagttttaaaaattagaaatcataacagaggggaagttggatggctgaaaacataaaaacttcctggactttaatttccccaaagaataaaaagccataaagaaaacattatctagtgaccatggaatgccacagctgactacataattaattcaaagaagtataactactgtctctaaactcagtactttggttacccttgagtattctggattaaagatctggcacaaagattactaacattctttacaagcctcaatcatttttcacttggaaaaaactttcagctgactatatgcaaaaaaagtagggttttttgccagataacttaggcttttttaattccaagaattttctttttcaagctgtttttggatcttgtctttgttattacaaatcctaaaaattaaaaaaaaagtagagaatttttattcaataaacattacttaactaaccagatattttctgagatcagagctatcaaaaagggaaattcaacatcacccactctgtcaaaacaagagaaattacaaggctgaaaggctacaatttttcaagtaataaataatattttagagcttctagggaccttagaaaatatccgtaacattggagagtgttcagagaaaaagaaaattaaaaattaaattaaaaaaaaaaaagactatccaggtcagagttctttattaagagtcaatcaacctgctgagcatgatgactcacgtctgtaatgccagcactttgagagtccaaggcgggaggatcacttgcatctaggagttcaagaccagtctgggcaacatagcgaaaccccgtctctacaaaaaaaaatcagccaggcatggtggcatgcatctgtagtcccagctactcagaaggctgaagcgggaggatcacgtaagcctgcgaagtcaaggctgtagtgagcctgatggcaccactgcactccagcctgggcaacagtgagatttttgtctcaaaaaaaagtcaatgaacctacacaaatgggccacaggttgtctacaagcattctcaaattgtgtgcacaatccagtaatgaggtcaggtaagaaaaaaatattgtctgcacaattttaagtaaatgatgtacttacaggccaggcatggtggcttacacctgtaattccagcactttgggaggctgaatgaagcaggtggatcacttgacctcaggaactggagattaccctgtctaacatggcaaaaccccatttccacaaaaagtataaaaattagccaggcatggtggcatgcgtctatagtcccagttactcgagaggttgaggtgggaggctcacttgagcccaggaggttgaggatgcagcaagctgtgattgtgccactgcactccagcctgggaaacacagtgagaccctgtcttaaaaaaaaaaaaaaaaaaaaaaagaagttccaaacatttctcttggccagctttcatcaaattctcctaggattcaatacaccaacctaccacttccaagacagactgatgaccccacagagtctttgccaaggtcacactactaagtgtttgaaacaggtctctcttgcatagttgcttttctttttaatcacattcatattgttcatgtcctccatacaacaatcaagatgtaagagcttcacaactaatccctaatcttttccatcctacacattgccaaaatgccttcattttaaacaattcaaatatacaaatttattttcttatccttccagaatacagtccaagtgtactcatgttagcaagtcaccttatgtcttatttcttatggtaaataaattacaggcaatgccttactgatagaggtcttctttcttttctttccttttttttttttttttttttttttgtgagacagggtctcactttgtcacccaggctggagtgcaatggcacaatcttgactcactgcaacctccgcctcccaggtacaagcaattctcctgcctcagcctcctaagtagctggaattacaggcatgcaccaccacacccggctaatttttgtatttttattggagacagggtttcgccatgttggccaggctagtctcaaactcctggccttaagtgatccacctgcctcggcctcccaaagtgctgggattacagatgtgagacaccatgcccagctgagatctttttcttcttttgcagcaggagagaacaaaatagaatacatttaatgataaaagaaaaaagtaattataaaaagtcttgcttttgagctgcatacttattacatcatgcatgacatgttttataaataaagtctctgttgctttaggaccaatggtagtatctaagatattcaaagggaagttagaaaccaccagaagaaaagaggaaggatatagaaaagaacttttaggataagcacacaagcggtaataaggaaaaacatcagcagaacatgggcaaaatatttgtcaccagaaggtaagataccttttaacataggagaaaggtgggaaagacaggcaagatgactgatgaggaatgataaatgaaactaaccatatgtgtaaatacctttccatttatgcctattgtataaatacaacagaaactaacagtgtttttgtttacagtaagagtaaaataccttcatatgtatttcatctttataataggtacagggtttcttttggggatgacagaaatgttctaaaattgattagggtgatagttgcacaactctgtgaatgtgctgaaaactatcaaattgtacactttaaaggggcaagttgtgtggtattttaattatgtctcaataacactgttaaaatatttaaataaaaaaaatcaggccacctgtggtggctcacacctgtaatcccagcactttgcaaggccgaagtgggtggatcaagaggtcaggagttcaaggtcagcctggccaagatggtgaaactctgtctctactaaaaatacaaaaaattagccgggtgtggtggcgagcgcctgtaatcccagctactcgggaggctgaggcagagaattgcttgaacctgggaggcagaggttgcagtgagccgagatcgttaccactgcactccagcctgggtgacaaagtgagactgtgtctcaaaaaaatatacaaaaataaaaataaaatctgacaatatgtaaaaggaaaaacaacaagaccaagtggggtttatcctgggaatacaaggctcattcaacacttgaaagtcattgatgaatccaattttattcacagtctaaatgagaaaaacccacacaattacatcaatggacacagaaaagtcatttggcaatactaataaaataaaaaatccaaagaaaactatgaataaaagggaagttcattagcttaattaaaggcatctaccaaaacataaagataaaaaataattttaaaaaccctacagctaacatcatacttaatgatggtgaaacattaaatgtttcccctgagaatggaaaccagataatgatgtccacttttgccattccctttcaaaatcatactgaaagccctagccaatgcaataagacaagaaaaattaagttaaaagtctcaaagagtagaaaggaaaaaataaaatgttctcttatttgcagacagcatgactgtctacagtcacctcatagaatctacaaaaaagttcctagtaagttaagcaggattacaagataaaaggcaagcacacaaaaatcaatcatatttctctgaattagtaatgaatagttagaaagtgaaatttttaagaagtatcatttataataacacaaaaaactaaatatttaattataaatttaacaaaatattacaggatgtgtatgctgaaaatgtcaaaacattgatgaaggaaataaaaaatgacccaaataaatggctagatatactgtgctgaagaactgaaagattcaacatcataaagatgtcaatgctccctaagttaattaacaagaattatctgtaaataaaaacaagttgattctaaaatcaatatggaaagccaaaggaaataaaatagccaaagcaattttgcaaatttaattagctgtcttctgcattaaaatgtgagctcttactagttggttgagttgtagaacaaaaaaaaacgtgagttctatgatgtctccactgcattacagtgtgagctccaaatttattattgtaacttcagtgctgcgacttcacacaacaaatgaaagtcagctaatttcagagaaattaattgaacatgatacatgtaaccttcacaatgccctgcactcactgaatattttcttttttaaactgacatagaacaaaattgaccatttttcttttggtgtatagttctacaagttttatcacatgtatagatttgtgtaactactatcacaattgaagtatagaacactcccaattcaggtatagaacacttccatcacgccaaaaaaactccctcattttgcatccactgaagtacagagaaagcaaacaaaaaactccccatgctatctctttacagtcacaccctctactaaccccggaaatgaacttgaagatggacttgcaaaccagaggtagtgccagaggagtaattcttgcttgccccatgcagtgattccctataattttatgttgccttggcatcagtttttaaatataagtttaactttctcatactagaagcagggctcagtcatccttgacagtttccagttctacaccttttcccatttcctcaaggtggacctcctgttgatcacctccctatgggacagctgaatacaacctacttacctggccccattgactgccaaaccctgcgtgaattgtgcagacatgccacagtgaccttctagaactcttaccagtttactttaaacccattaattagaattcccccacaggaaatctgcttcgatatgccctggatgccaataaaagctttggcccatgggtcccctctatccttcccagcactgacccatctccatgtggccttcagacatgccaggtactcccagggcctgtaatgaaatccttattccattttgtgtctctttctgttgctgaagggctattctttattttcaaagaatttaaaacactccatctcatgctccctgagctagtatcacagcacagtgtttcaatttatgtttccatcactggtttcaacagaaaggccttattctagctccttctttcgttggaatataggtggtgctcaaatatgcttactgaatgaacgaggggagaatttagacaaacacaggagagaggaagaaaatgacagataagccattacaactagaaaacactaccaagtataagcagaaaataacagaatatttcacttccttgtccccaaatcctcagtaactccctactatttatggaagagttttaattatttaccctagcattaaaagctctccacaatggggacacaaattatctttacaatattatttcctactactctctttctacaactaggaaaaatatacagttgtcctttggtatctgtgggggactgattccaggacttccctcagataccaaagttctcagatgttcaagtcccttatataaactggtgcactatttgcatataacctatacacatcttcttgtatactttaaatcatcttagattaattataatacctaatgcaatgtaaatgctatgtaaatagttatattttttagggaataacaagaaaaaagtctgttcatgttcagtacagactaaatattttttctggacatttatgatcctaggttggttgaatccatagatgtggaacccacagacagaaagggtcatctgactgtatgtggttttggcatgcctacaacctactcccactctgccattccttctctgaaacagtagcccagagtggctatttttgtagtttatgatccgggccctcagtcagagctgatttaactgtaccactgataaaacagagaaaaattcatacacaggctaagacaagcagaccccccaagttttttaatagaagccttagagattgagaaagttaaaaaatggtgaatgaggccaggcacagtggctcacacctgtaatcccagcactttgggaggctgaggcaggcagaccacctgaggtcaggagttcgagaccagcctggccaacatggcgaaaccccatctctactaaaagtaaaaaaattagccgggcgtggtagcgggcacctgtaatcccagctactcaggaggctgaggcaggagaatcacttgaacctgggaggcggaggttgcagtgagccaagatcgtgccactgcactccagcctgggcaacaagagtgagactccatctcaaaaaaaaaaaaaaaaaaaaaagatggtgaatgcttgaactgataattcgtgtagagctggtacagcttcacagagcctttgtaggtagaaagcatgcattgaacaatcaggaggcagaaaagagctgaaaaaccaagcatctcttggaaggcagaaaaaccactgttcctggcactctgtgatccaggtatagtttattttcttattttacttattttctttttttgctttatctttttctctctgcttctctttctttctttcaagacagggcctcattctgtcacccaggctagagtgcactggcgtgatcatggctcactgcagcatcaaactgctgagctcaaatgatcctcctgcctcagactcctgtgtagctggggctacaggcttgagccacagtgcccagcctagtttattttttatcttcaaaatgcccacaagatgcctattatatgctaacaataaattctactttatttaaggtagcttagccaggtgtggtggctcacacctgtaatcccaacaacttgggaggctgagacaggaggattgcttgaggccaggagttcaaaaccagccaggacaacatactgaaacacccatctctaaaaaaaacagcaaagaaaatagccaagcacggtacctgtagtccccactactcaaaaggctaaggcaagaagactgcttgagcgcaggagtttgaggttgcagtgagctatggtcacgccactgcactccagcctggctatggagcaagactctatctcttaaaaattaataaacaaactgtttcctgataggagtccagaaaaagaagaaaaaataaataaggtagcttaagtaggcttctgttccttaaaactacatgaacccagccgggcgtggtggctcacgcctgtaattccagcactttaggaggctgaggcaggcagatcacgaggtcaggagattgagaccatcctggccaacatggtgaaaccctgtctctactaaaaatacaaaaattggctgggtgtggtggcacacacctgtagtctcagctacttgggaggctgaggcacgagaattgcttgaacccgggaggcggaggttgcagttagctgagatcgcgacactgcattccagcctggtgacacagcgagactctgactcaaaaaaaaaaaaaaaaaaaaaaactacatgaaccctaagatatcagctaaactctgtactcttcaatacattctatactttcctgcctgtgctacagatagctaaatacacatcttatttcccctattaaaatacaaactaaactggttacacaaacttagaactgtatatacataaaatttaaaacgttgtctacttttgtgcatcaaatggtactaccaagaaggtttaatgacacccataggagaaaataattgcaaatcatttatctgataagggtctagaatccaaaataggtaaagaactcaaataatttaacaacaaaaacacacacagcccaattaatattaggcaaaggatttgaataaacatttttgcaaagatggtatacaaatgggcaacaacaacatgaataaatgctcagcatcattagttgttagaaaatgcaaaccaaaatcacaaagaaatactattacaaacccattaggatggctgtaatttttttttctgaaagaaaataacaagaacatagagaaactggaaccctcattcattgctagtgggaatgtaaaatgctgcagcttttagaaaacagtttggcagttcctcaatgagttaaacacagaattatcctataacccaacaatttcactaatgggcataatatccaaaagaattaaaaaccagtgctcagggaatatgccaaaaggaactacactctcatgttcaaatgcagcattattcacaatggtcaagatatggaaacaacccaagtgtccatcaatggatgaatgcattttaaaatgcatatgtacacgatggaatatattcagcatttttaaattaggaaattctgtcatttgtgacaacatggatgaacagagagaacattatgttaagtgaaattagccatgcacagacagacaaataccacatgatctcacttatatttggaatctaaaaaagtcagactaatagcagtagagagtagaatagtggttaccagaggccagggggtggtcacagggggaaccaggtggaggtgggtggaggagagtgaaagggaaaaggggaaatattggtcaatgggtacaaaatgggtttcagttagataggaggaataagttttggtgttctactgcatagcacagtgactatagttaataataatatatatttcaaaacagctaaaagagggttttctaatgttctcaggacaaatcaatgatacatgtttgagtttatgatatgctaattagactgatttgattattccacaatgcatacatgtatcaaaacttcacattgtgccccataaatatacattcgtcaattaaaaataaaacttgaaagaaaaaagtgttcaaacaaaaacttgtacacaaatgatactagcagcactatccataacaaccaaaagacggaaaccacccaaatgtccaccagtggataaatggatgaacaaaacggtatatccaagcaatggactattacgcaaccataaaaagtaatgctgtactgaggcatgctacaatataaatgaaccttaaaaacatgcaaagtgaaagaagccagacataaacggtgacaaactatatgactccctttatatgaaatatccagactgagcaaatgcacagagaccaaaaacagattgctgggttggagacaaggcaggatggaagtgactgcttagtgagtacagagcttctttttggggtaatgaaatgttctagaattagatagtggtgctagctgtacaacatggtgaatgtactgaatgtcactaatggtaaattttatgtcatatgcatgtcttagctcacgttgctataacaaaatatcatcgacttggtagcttgaacaacagacatttgtatctcaacgttctggagatggagaagtctaagatcaaggtcccagcaaatttggtgtctggtgaggagtctcttctgttttcagacagctacctttctgctgtgtgctcatatagcagcagggcagaaaaagggaagcaagctctccagggcctcttcttataagggtgttaatcccatcattagagtcccaccctgatgaactcatttaaacctaattacctcaaagataccacctccaaatatcattactggggattaggccttcagcacatgaattttggagggacacaaacattcggtccacagcaatatattccactgcgataaaaaaatttaacagatttataaaactgaacttctagttatcagttcttaaaatatggttgccagcattcatcaacagattaactgcttgcttctttcagtaggagtaagtatcccaaaccaaaagccatatctaaaccacacattttggtaaaataaaaactacttagaggagattcacttttttctttgtggctctgtttggtattaaatgtattaaatagaaaactaaattacactggttaaggctttttaaacaaaatacaaaaatgactgttcctatcaaaagctgtttattctatatgagctgcttctaagtttgtcttttttttccctgagacagagtcttgctctgtcgcccaggctagagtgcagtggcgcaatctcggctcactgcaacttctgcctcccggattcatggaattctcctgcctcagtctcccgagaagctgggattacaggcgccaccacgtccagctaatttttctatttttagtagagacggggtttcaccatgttggccaggctggtctggaactcctgacctcatgatccacccacctgggcttcccaaagtggtaagattacaggcgtaagccaccgcacccggccttttaagttttattgaatctaaaatgcaggttaatgttaaaaacttcacgatgataaacaaatgttatttagtatggaatcatactaaataacctatatacttaatatactttaatatacattaaataacccgtatatgtaacacatttaatagtaaatgtacaaatccttaagaataaataaaagatgtatgtgtttgctatcaaaaaaatggctgggaggccaggcgcggtgactcacgcctgtaatcccagcacttcgggaggccgaggccggtggatcacgaggtcaggagatcaagactattctcgccaacatggtgaaaccccatctctactaaaaatacaaaaaatagctgggcgtggtggcgtgcacctgtagtcccagctactcgggaggctgaggcaggagaatcacttgaaccaaggaggtggatgttgcagtgagccgagatcgcgccactgcactccagtctgggcaacagagcgagactctgcctcgaaaaaaaaagaaaaaaaaaaggctgggcacagtggctcagcctctaatcccagcactttgggaggctgatgcgggtggatcacttgaggtcaggcgttcaagaccagcctgaccaacatggcgaaacctcacctctactagaaataccaaaagttagcctggcacagtggcatgtgactgtaatcccagctactcgggaggctgaggcaggagaatcacttgaacccgggaggcagaggttgcagtgagccgagactgcaccagtgcattccagtctgggtgacagagtgagactgtctcaaaaataatataataataataataataataataatagaccaaagtataaaagattgaaggcgaaaaacagacatatctagttctacagaaattgagaataatctgttaggctgataagaaaacctaaagaaggtattttcttcaaaactagcaatagcattaaggcaatagttataaaacaaaattcagcactttctttatattacaacatttcagttacagatgctgtaatctggattttcttaaaagctgcgcagctgccacaagtattttaccaaaatctatatgtttaggtagttactcctttaaacatggactgttttgccagcacatgggtaactaaagattgttgggctttgtgagaattaatagagctagatttacttggagataaccaaattcaagcgtggcagggcccaagtttctggttttattatccttcaatttaatctatatctctacacagaggtaaaaaaatgaacaagaacatggtctctgtctctggaggctttgccatttagtagaagagacatacatgggccgggcgcggtggctcacgtctgtaatctccgcactttgggagaccgaggtgggcggatcacgaggtcaggagatcaagaccatcctggctaacacggtgaaaccccacctctactaaaaactcaaaaaaaaataattaggcagccgtggtggcgggcgcctgtagtccagctactcgggaggcgtgaggcaggagaatggcgtgaacccgggaggtggagcttgcagtgagccaagactgcgccactgcactccagcctgggcgacagagcgagactccgtagcaaaaaaaaaaaaaaaagaagaagagacacatatacatagaggtaattatggaagtctcaattttttttaatctctttcaatcctcaaaaatggctgataagtatactgtcccagtccacttttataaagcaatgtacagaacttttacactagatgtgaaaccttgattttgcaacaattttacacctccagggtttttcctgaggttgtttcctttctgatccgcaacatcaaaacatgtagccaaatagctattctggctcttttcccatcctcattaaattccttacaaaatatggtaagcataatttttcacatgactctattttcatatcatctcaattccttcaaaaacaaaaatccagttcaaagtttattttccttaaagcttcacaaaaaggctactggtatgtctcactcaacttattaaccaccccttcttgcagagattgaaagatttatctagttatttactttttttctctaatccaatattactggtttaaaaaatgttatttacatcaactatctgtatatcacattgtgaaaaggagactgacaaacacccataaactaccataactatctccatgctccagtttctcaagttgcaaatcatctgccacaccgctatgcaagtcaccgttccgaaatgtagttctaagtatgtctccattgtttaaaaaacccacaaatgttccctgtactgccacctctcactgaatcagttcaaattacttagttctgtcagacaaatttagctcccccataatttagacccaacctttttgcctcagtttttgacacatacctcatgcaccctagaggcaatcatccagatgagaatctgcagtcccaaaaagtgctgagctattttatatataattctatatatatgttatttttacttgtcctgtcatcacactcattctaacccaaaccctcttctttagtaaaatactaagctttcatgtttcatctactgtaaagttcctaacttcctgtctcaaagttaatcaccccttcctcagtactgatgcatcctcatatcctcttttataacacttatcaggtaatattgtaaacattgatattataggactcccttatctgaaactttttaaataaaatgttctgtttacctaatatcctatgtgcctagtatacatagaggactcacaataatttgctgaatgaataaatagtaagaaaattccaaactaattaataagaactaaaaagggttctgtagcaatcttaaatgtctgaagggtaatcatgtaaatgaattgaattgtattttgtggctctaggggggaaattgggactatgaacattacaatgaactacactgtacttcaacatagaaccttctaacaactaataccctcaataggctctgttgagaaaaccaagctccaaattagtaaaagaattcaagcaagactaaataacatctatcagatgtctaaaccttctgagaataaaaagcacacacttagctgtatggtagttgctggtgctttgctttgttgacattttgctcatgtctgacgtagaagtacatcctgaactgatgatatgcatgatagaacctttcttccagtagcacaggtgaaacccagatcctgaccaaggtaattgtattttttttccctacatagtgttatgtttctattaaatggacaactaaatcaaaagtttatgttccagtggtgttgtggaagagcaatacaatcttatctactcattaaaataagtggctagttattattttactcaagaaaattttatagtggttatctcctaaaattttcccttcatgcagtatagttctcagctgtgttatttgtacacccagttttgaaagtaaatccttattctagtatttttgacagtattactgtgcttctgggagtatattacaaagatgggcattatcctccagttatttgttcaattagtgtgctagttaccttatatgataattacctatcaaaagttttattagtcttttttttgagacagtctcgctctgtcgcccaggctggagtgcccaggctggagtgcagtggtgccatctcagctcactgcaagctccacctcctgggttcacaccattctcctgcctcagcctcccgagtagctgggactacaggcacccgccaccatgcccagctagtttttttgtatttttactagagacggggtttcaccgtgttagccaggatggtctcgatctcctgacctcgtgatccgcctgcctcggcctcccaaagtgctgggattgcaggcatgagccaccgggcctggctagttttattagtctttaactcaaaaattttggtgaccaaaacagaattctgaaccacaagtcctttgttttctaaataacattcaaggattaccaatctctataactctgggtagtaccaataacgttaaaaagtcaatgaggggttgggggagttaaggcttatgtaagtacaaaaaagcaacttaaatgttatcactcttcaaaaatacagaaactacttattcagttgggatgttttccttatttaaaacttcaataacttactttagaacttaaatttctatgtactatatcttcctggtaatgaaccatgaattttttccatgtgggtaagagggactttaattccatttgctagatttaccctggtacttgtaggaaaaattttcctttccttttagcactggaactcaaataagaatacagtgtgtacaactgtatattgcatttattttaccttttgataaatgtacattttagtacctgaaactatcatactaacaacctaaacttttagagcctaaattaaactttatatgtacaacctgttattaaaaaatagttcagtttgcctgtaatcccagcactttgggaggccgcagtgggcggatcacttcaggtcaggagttcgagaccgccctggccaacatggtgaagccccatctctactaaaaatacaaaaaattagctgggcgtgaggtgcacgcctgtaatcccagctactccagaggctgagatgggagaatcgctggaacctgggaagcggaggtggcagagagccgagatcgcaccactgtactccagaccgagagacagagcgagactccgtctcaaaaaaaaaaaaaaaaagtttcacagtatggcctattgagaagccactgggagacagggacgttagggaagttaaggagagatatacaagatactttaaagacacaagtggctagaaacatccacaaaggcactgaggtatgccaagtagaaaaattagaaaaatatggaaataatctgtggtaatactctgaaaccaacaggcctaagaactaactacatggctaacttctacctaacatttattctctccagcaatttctctctctacgaatatcttcaaactcattctctaatagtttctcgtactatacttccttccaaactctcaaattttctttatcatcttcttaccaccttaacaagaataacgtggaaacaatgtattatctttaccatactttcttccaaaccctcaaatcttctttatcatcttcttaccaccttaacaagaataacgtggaaacaatgtattatctttagctttattttatattccttctcctgcttttcaaaagcaaataatgtgaacattttatgtttttctaaaaaaaaagtaaactattatagtatttgaatgaatttttcctgagacaacaacaaaagaagtatttgccctacttgactaaaagatggctacgaacagtctagatgaaaaccagatttggaaattctaaataatgcctaacgtatgatgggtagttgtacattacagtacttgggaaaatatgagaaaacagcacataatttgatttcaaaattattatgttcagttccaaatttaaaatgttttaatctatgtggggttagagacaagcagatggaaatattttttaacaaaaaaagtatctaacataaaattcaaattaaaaaaaaaaaacctgaaaagccaaattcaaagatgagttaaacaccttatcaagttcactctcaaactagctctaagtaagaagcatgacttgtagcttgatttcctaaggtaaacttctcttaattgcaggaaagagcatgctgaaaacccagacagtcacatgggtttccctctctttcttattttggccacagaaataagaagcataagaaaggctgaagcagcaaatgttggaggggagaaaaccatgtgcagtgtgcaggatttcttcttaaaggcacggaaaagaattacaaatagcagcagaaggaaggaaaaataacacttttttcataggctataagaaaggtaaaggtatgccaacaaactgagtagacctgaggaaaatcttacaagttaaagcttttcacaagacaggcaagcatggctatctaaacagcataaaatgaaaataaaagatttttcccattaataaaaaggaagccaagaatgaatttgtccgaaataatttctcatccaagtaaaggctagcaaagtacttaaagatttgtattttgaatctgttctctattatacacctctgtttatactcatcaattacatagtacctgaatatgacccaattttaaatcagtaaagcaatgtgagctataaaggtgtgttgtactttcagtcactacctgaggagacctgcctattaaccagcccagtatttcagtggttatagtcggggaatcgcctgcatcagaatcacctgggggtctttttaaaaagttggattcctggtggaccccacccaggatctacttgggtctcaaggaatctgcattcttaacaaccctcccccttccaagtaattttaaacactaaatttaagaatcactgtagtagggtccaagcaactatcagccataactatctgaagataactcatagtgtagctaacagagttcctagggagaaaaaagctgtctcaaaaaggacacactttgcctttctgcatacatttagagatggataacagatgtatcgtctcaaaatctccaaatgtttccactctttcccaaaaccttcctaccacaacatactaagtatgaaatgcatgagtaagccaagttaaacatttcatggacttaaactaaaaaattggctttgcctgtctataaaagttccttaagacaataaaagatacaaatattttaatctttctcagcattcctttcggttccttctcagatttgctttttagtcaaagcttcaagacttcgggaaatgtcatatcactacatcagaatctattttaacatccatccaatcccatgtataaattatgtttaaaaatcttcttctgcacaaattgtgtaacgtttccccagacaggacacaaaaattcatccagtatcttcctttcttcaaatcagtggatttcagtggtgaagctgaggaaggtgttatagtagtcttgctactgtctgaataataacatttgaatcttcactatatgccacatagttaaaacaaagaatgtaaaatattatttaaccctcatggcaatcccatgaattaggcattattattatccccattttatggatgagttgcctaagatccagagaagtccagaattaaagagctagtaagctaattcaaacccaagcagcctaactttagaaccagcatttttaagcaccataccatcctgtaatttgaagatgccacctaggattaagcaattcactaaaacctagttgacaatctgaatcaactgtgagcaattttctctttttttttggagacagtctcactctgccatccaggcaggaaggcagtggtgtgaccatagctcactgcagccccgacctcgctggctcaagtgatcctcccacttcagcctcccgagtaactgtggctacaggtgcacacaaccatgcccagctagtttttttattttttgaagagacagcctctcactatgttgcctaggcagccttgaactccttggctgaagcagtccccccaccttgggctccgaatgcaggcatgagccactgggcccaaccacgcaactttctaaaaatgcaaattcaccagccaaataataggtctcctgaatctgactaggcggaggctgtgaattagagaatctaattttttaaatgtgtttttaggtgatttttaaatttttttaaataaaatgagatggggtcttgctatgctgcccaggctggaactcctggcctcaagcaaatctcctgcctcagcttcccaacgtgctgggattgcaggcatgagccactatatctgggtgctttcaggtgattttgaatataccaaaagctacaaacaactgcactagttcatcaaagtgctacagtggcaaccttcatgaaataactcatggtctggaagttaaaggcttaaattccagttaattgattaactaaaatgtacttattaccccattctctctctcactactcctccccacctcaaagaaataagaaaaaatagatctagaatttgctacagaaaagaaagaagagctgatgcactgtgccatcttcacatgaaaaactaaacaaagatcactgatatttctatcatgattaccctaaggcagagttagacctttgctaaaagaaacattaaaggtggaatttagagttgaaaggaatagtcctatctctggcatgcctctcattttacagagggaaaaaaaaattctgttttttttcagctttctctttaactcagttcacatttgtagtatttaaccagtaaatatttgtggtccactactgtgtgtgcaacagaattgtgtattataataccatgatattagaactgaagggactctgaatctcccaatttcatagataaggaaaccgaagtccagaaatttagtgatttgtccaaggtaacagaattatttaatggcagaagttgttacctaggacaaaaaccaagttacttatctctcaggcattgtattttcactacaccaaaagctaagtttttgctcttaaatttataattcatagaaatcagtgtattagcttcaagccctaggaacagatctacagtctagttgtaattcttacattaattagctatctgactttggacaaataactgtaaaataaaaataaaccctacccttcctaggtcacagtaatatgtcaagaacaacaaccaaaaaaaaactgtggctgggcacgatggctcacacctgcaatcccagcactttgggaggcagaggtgagcagatcacctgagctcaggagttcgacaccagcctgggcaacatggtgagacctcatctctgaaacaaaagaaaagaaaaaaaacacatatgaaaataattttagaaaactgtgaaattatgtagaactaagatacactttcatattttttcccagaggcaaacaggtactggtttttaaatcttgtaaatactgcccctaaatagtgtgcagtgaaaagctttgaatatcattgttctaggttaaacaatgagttaccatgcataactcatttccaatattaaattaataccatcttgttagatcatatctagcaaataaaagattatttatctgtcaacagcatcattggctttccatggagtattaaggcatgaataaggtgatcatagaagttccttccacttaaaagatctaaaaacttaaaagtaaaaactttcacttaaaagtaacacaaccactccccaaataaaaaccttttagtcaaaatctctataatgaataaaatgtgaagtttaattaataacattgtacaaatgttagttccttagttgtgacaaatgtaccataaatataaggtgatgttaaccaaaggggaactgggggaggggtgtggaaactcttggtattacctttgcaacttttctacaaatctaaaactatttaaaaataaaagattttaaaaattaaaaattaatctctatggccattttggataatgtagagatttctatcaaacaagtaactccaagttagtattataataatagtctgctttgcttacaagtgtgtagtaaaaaatgttaatttggccagatgcgtagctcatgcctataatcctagcactttaaaaggccaaagcgggcagatcacttgagcccaggagtttgagaccaatctgagaaacatggcaaaaccctgtctctataaaaaatacaaaacaaaattagcaggtcgtagtggtgcatgcctgtagtctcagctacttgggaggctgagctgaaaggatcaattgagcccaggagtctgaggctgcagtgagccgtgccaccgcattccaagcctggatgacagaatgagatcctgtctcaaaaaaaaaaaaaaaaaaaagttaatttaatttagcacttcaaagtaatatgtttgagtgcttaaattatcttacttccacaaaaatcagagtttctgaatacgttctacctaatttgtattcaggttatcacatctctaatctgccagctgaatgaaagccacaaattcctaagttgaagtcctgaaccaatgctggatttccggtgctttagtgtaggtccctagagtgttgttttttggggggtttttaaaagaaaatacgggatctgaggtaggggaaggagtgacacacagggaaaagatataaaaggctcttgagctagctccccaatttaacataatggtagcttcacaacattctaaaatcctaatagacttttgtgtttattctagagcaattaattacgtattattttcagttttcctaaaattttaaacattaattatagtagcacagttgatcctgaacaaaacaggtttgaattcaatagattcttccttcattctccttgtaaataattatatcagagtattaaaaagctgcccactttggggagcttttaaaatcttttaaaacatcagaagtttcatattttgccttttctttagtgatttgagaaaggaattttttttgagaaactcactttgaaactgtcgttttttattttagttgactggtggaggcactatggaacaagtaagggagacttataggacagagatgtttatgatggctcagtcagatggatgaattatgattttgtcaactagcacaaattctaggtggaaaaaaggacgtggctgactttgttgtttctgagaaccttaaattaagaaaaaactatacctataggaatttagatttttccatgtcatatttaataaaaacaaaaaaacttcattggttttcatattagggagaatggagactatctagatgtaaaaagaaatcactaaaagagcctttagtttttcctactcaacccaaccattgtaaaaagagctctgtgaaaatagcttttgccacaatatttaggaagtttcagaagtcaacaactacagagaaagccacatggatctgtatgtttcaaaatctataaagtcaattttcttttcagataaagggaaaaaaatctccaattattccttccctaccttagcaatgccctttattcaccaaattcatataaagacttgggaaaaaaaatcagcactaccaggaaacacagataagtgtctatgtttttaaaaacagtaactatgccaatgcaatcctaacaagcttcaaaactattaaatggcctaaaaacaaacaaacagaaaactatgaaagagtctatctatgtaaaaaataaaccattctacttagaaaacaagacatgaatttacttgaagaacccacaaaaacggtttagaactttttttaagagacatggtctcactctgtcacccaggctagagtgcagtgactcaatcatggctcactgcagccttgaactcttggactcaggcaatcctcctgtttcagcctccagagtagctgggactacaggcatacgctaccatgcccagcttagaactattttttaaaaagagtaacaaatggatctttggggaattaaggcaagcttggaaacacaaaagacttcaaaaaagctttcactcctccttactgctgagtggtacccatctagcatttcaacttttttttttttttgagacggaatctgtcacccaggctggagtgcagtgccacgatctcagctcactgcaacctccccccagggttctagcaattctcctacctcagcctccttagtagctgggattacaggcacccaccaccacgcccagctaatttttttgtatttgtagtagagacagggtttcgccacattggccaggctggtctcgaactcttgacctcaggtgatccacccgcctcagcctcccaaagtgttgggattacaggcgtgagccactgcgcccagctgcatttcaatttttatagacaggaaagggtcaaggatctgagggaatgttacttttagggctctgacagccaagtcaccataaacacagaaaggtgtccatgtgaagctgaagcaagcccccagtagggactgaaatagaactcacctcatgtggaagggaaggaaagtgggagatgaccactaaggccctccaaatgaaagcagtcatattctaaatgaattcctgtttttcctatatatctaccaaaatgatgtgtcttaacataatactatgtagtaatagatacattgtgtaaaatgctcccccctctttacttaagtaaacataaaactgttttttttttaaggtttctcgtatagatttttgcctaattaagggaaagagaagaacgaagtgggaagggaagaagaaggaaagcatggaggataaataggtgggagagaaaagagccataaagtgaacaaaggttgtagactgaacataaacatggattgggaaatcaggaatcctggtttcaaatcccagcatgccactagctaactaaattaccttctttagacaatgagattcctcatctaaaaaaatgaagtgggagtaagggttgcacccaagaacaagattccatcccaaacaagccacttccaaagagagccctcacctggagcttcagagttgagaatagcaactatgcatttaggggtagggttggatctcttgggttgtgttgtgagacaggggtaatttctgattattttcactgaggatggagattctgctcaaaattacactacctagctagagcacagtaaaagggaatccatgaaagctacctattcaacccaatctgaatggtgttcttcataccagtggctaggtattatagattcagagatgaatgtcacagttcctgcctttaaggtgttcagaattcatttaagaaaaactgtgcctctctgactctgccctttctttcccaagaatgtcatataaaggaagcactgactcctagagtcttgacattcagacctctatcaggaaaaatgaggcttagagaaattaactttagggcacctgttttctgacttcaaatccagtgctctgacacatatgaataatgtggccatatgaatgtcatctagctatattaagttctattagtctataagtaaaaaaaatttacaaattaaatcaaaattcctgcctacttaaaacacatgggaaatgaaagaaaaaataaaattcctgcctactgttaataatatgaaagcctcctataaataacattgttggctggggcagtggttcacacctgtaatcccagcactttgagaggctgaggcgggtggatcacctgaggtcaggagttcaagaccagcctggccaacatggtgaaacctggtctctaccaaaaatacaaaaattagccaggcgtggtggcgggtgcctgtaatcccagctacttgggaggctgaggcaggagaatcacttgaacccaggggggcagaggttgcagtgagccaagatggcaccacttcactccagcctgggcaaaagagggaaactccatctcaaaaaaaaaaaaaaatgttcagaaattgcaatgtatatatatgcatctgtcttcaaacttaatccccattagcctgcaccccacctgcaggtaagggacagttttctaaatcatctctattcacaatgcatggcagagagcaagaactcaagagtatactagttgaatttgttatctccaaagcccctcccagatctaaaattgcctgacatctgacctcaaaacatgaccaagatagatatgaccaacaaacacccaaaggccacacagtgtcacaaatttataaacctaactcaccttgagatcttttagaatactgccagtacaagctttaaatatatttttgcaactatattacaaatacagatgtcattactacatatattgtcctgagtaacaaaaaattaggattttccacttttgatttaagaaactttatatttgtaaatttatacaagcaaaaaaataaggataaactagaaagaggaataagaaatatcaattataatcagaaaattgtgcctttatgtctacaatatgtacgctaattgtataacctgctaaaacttgagctaagaatttgcttctttcacttctggttatagtcaagatccccgaaaaggtagaaaaacaaagtagggagaactctgtaaaggaaagttttacaagttgggaatattttcctatttgcctggggacttaagaaaaaagaagaagaagaagaagaaaaaggcgtgtcaaaatctaactcaaggaaaactgcctttttttttttttttttgagagaagtctagctcttattccccaggtttcagtgcaatggctcgatctcagctcacagcaacctccgccttctgggttcaaacgattctcttgcctctgcctcccaagtagctgggattaagtcgcctgccaacatgcccggctaatttttgtatattttagtagagacggggtttcaccatgttggccaggctggtctcgaactctgacctcaggtgatccacccacctcggcctcccaaagtgctgggattacaggactgctcttacagtaaggtgtattaagtattttctgactactcttatttatccctattaaatcaacaaacctccatcctgaaatctgcgaagtccagcaccataatttaatttctttcttttctttttttttttttttgaaagacggagtttcgctcttgtcccccaggctggagtgcaatggcacgatctaggttcactgcaacctctacctcccaggttcaagtgattctcctgcctcagcatcccgagtagctgggattacaagcacctgccaccacgcctggctaatttttgtatttttagtagaaaccgggtttcaccacattggccaggctggtctcgaacccctgacctcaaatagtccgcccgcctcagcctcccaaagtgctggaattacaggcgtgagccaccgcgcccggcccataatttaatttcaagaatatcctgtcaaatcacaaatacaataccattttttaaaaaaactaaagttattggggaaaaaaaggagaggcttatctgggagattagaaaaaaggctttccttagtaaaagccctactttggcttaaaaagttgggataaaattctaaacaccaaactgcattttaataaagaccactgaaacaaacgattaaacactatgaagcacaaccacttctaatttcaagaattcccaaaccacttgaatggatttagacgctatgcaagcacagcaaataaacagctctacaaaatgacttccttctctctttcacaaccacacccgtacacacataccgcctcccctcaccacccccccaacaacctaaatgtttgtagtaaaatttttaaaaattggagacggagatggttatctgcttttccagaaaaggcaactgcatatgtggcactagacagctggcccaacctgactgctcagaagccaggtatgaatggcaggtacagcctcccgcggacaaggcaacagaaagactcgctgtccacagagctcacaacttctcctatagaaacacaaagccgacccagttcctcttcctccagtgacaaatcaaagctaagtcctgacgcgtgtggggctggcacggaagcggccgaccaagctctccgctccggctccggctccggctccgactcccaccaagaccccggctccggccccggccccggacccgccccgagtcccatgcagcctgcgctgtacctggtgaagaagtccgcgaagccgccactccgtcgagcccgggccgaagcccccgcaggaccctgctccgcggcgggcaagggcaccggcggccccgccgggggcaggtgatcgcgggcgctctgaccgcggctcacctggaacgtgttgcgagagttgaagtgaatgtcagaaaagcccaggcgcggctccgcacccccattagtcctctcggccgaggtggcagggggcgcgccctcctcgggacccccggcgccgactccccgctgctctgagtcctcgctactgctgcagctgctggcggggctgtcccccgagtcgctgcccgcgccctcgggctcctgggcgtccgcggccaccaggcagcagctccgcagcgggtcctcaagcggagaggcccaatcggacgggcttcccgcgccgtccgcgtcctcgtcgccaggcccctccaggcgaaggcggccgtaggggcggcggcggcgcgactcccggccgccggcgcgcgccagcccgcgagcctcttccagatcgcgacagtcccggcccggcagaaaacccgagtcgccgttggtcatgccttcgtgccgcggcgcgcggccatcagccacctccgcgccgcggtgtttggagcccgagcccagcaggcaggcgtccgatcgtggggctgccgagggcggcggggcgccggcctggccagcggggagcggacagtagcagagccccggctccagctgctccccggccgccgcgaggtaacgctgaaggagctgccgaggcggcgtctcctcctcctcgtcagcctcctcctcctcgtcagcctcctccggcggctccacagcgccgacgcctccgccaaagccgcccgtggcccggattaccttcctgtcctggcccacggggtccggcgcaggcaccgggagcaacttggggtttcttcccgagcaggctccggcatcctccggacccaccatctgggggtgggtggcggccgccccaggaggcaaagaaggactacaggcgcaggcttggccagagaacagctctgggtgctggggccgcggcgacagccgccgcaacgttcccagacccacccctcccacccgctgggtcggacagttgcttgagggcgggcacgcgccaggactcgcgcacgcgcaaaagtcggaccggtcaagccccgacctggagattccccgaaccatagagacggtagctagagagacgcaggctgccaatctaggatccgccatctggatggtggaagctggttggcccgctctaagcgtgacagttcttaccgaagcgcgggtattgctcgcttagcaaaaattcacttgatgtatttcatttatggtagtaaaatactcccatatttgggaggtgttagcgtgggtaagtccttccagctctaattggtcaccagtcgactttacgatttttacatccttctccggcatcattgccacagttcagggcttcatcacttcatccaggagggtcaacaccctcccttcttcacttcatctaacacaaaagaaagatatcctaagttatcttgctcacctagcaccatgtttcatcacagtcctctgtttaaaagattatcaccggccgggcgcggtggctcacgcctgtaatcccagcactttgggaggccgaggcgggtggatcacaaggtcaggagatggagaccatcctggctaacacggtgaaaccctgtctctactaaaaatacaaaaaaattagctgggcatggtggcgggcgcttgtagtcccagctactcgggaggctgaggcaggagaatggcgtgaacccgggaggcggagcttgcagtgaaccgagatcgcgccactgcactccagcctgggcgacagagcgagactccgtctcaaacaagaaaaaaagattatcacctaaggagggagaggaagtggtcaggcagagaggagctattgaaataattccagcactctgcgatagtggattaaaatgggatgattgaccattgagtggaaatgaagtatatttaaagtaaaagacgaaagacttgataactgatcagaagtgacagaagagagagtaaccaatgattactacaaagatatgagactgaaactgatatggtttgaagaaatagaaaagtggataggaaaaaaacgattaataggggaaatacatctggtaaagtaaacgactgaaaatatccagcatatagagttctaaaacttgagttggctgggcgcagtggctcacgcctataatcccaacacgttgggaggccgaggcaggtggatcacctgaggtcaggagttcgagaccagcctggccaacatggtgaaacccagtccctactaaaaatacgaaaaattagctgggcatggtggtgggcacctgtaatcccagctacttgggaggctgaggcaggagaatcgcttgaacccgagaggctgaagttgcaatgagcccagatcgtaccactgcactccagcctgggcaacaagagggaaactgtttcaaataaataaataataaaacttgggttagggtttaggttcagagacacagattaggcgtcatctgtataatgcaagtaggtggatgaatcatgagtaacattacctaggaagaaagaataatgataagggtcgggcacagacccaaatgtttcattatttcaggacaaaaaagttgtattgcaagaaattgaagaggcatcagttgtggataaaacgaagcagaaaatatagaccactcattctataaaagtatatagaatatagaccactcattcattctaaaagtatgttagtgaatgcaagaacagaaaatagaagtcgtagaggagacattattgtcaagcatttaaaatttatttcatataaaaatacctatacatacagatataagagggaatataacctttatataataaaatgtcaataaaatgggcatgcatgtacctaacactcaatttaaaaaaacatcaagaggccaggcgtggtggctcacatctgtaatcccagcactttgggagccagaggcaggcagatcacttgaggtcaggagttcaagaccagcctggccaatatagtgaaatcccatctctactaaaaataaaagcataaaataaaataaaattagccgggcgtggtggtgggcgcctgtaatcccagctactcaggaggctgaggcaggagaatcgcttgaacccaggaggcgaagtttgcagtgagccaggatcgcaccactgcactccagcctgggcgacagagggagactctgtctcaacaaaataaaaacatcaagtgtcttcgaaaataagcgttattgaaggccctaggaaaggactaagtggcaaaggcatagtcagcaatgcatttattatcaaggtatttcagaaggaaaaaatgactttcaggacacgagtggaaaaaatataaaaagagagaaaatatttgcaaattgtatatctggtaagagtgcagtatccagaataaataaagaacttgtataaatcaacaactgaaaaacaacccaactaaaaaaatgggcaagggacttgaatatacatttctcctaagaaacatatgttaatggaatattaataagcatatgaagtgatgctcaacatcattagtcattaaggaaatgcaaatcaaaactacaatgagatagcacttcacactcaccaggatgtctataatcaaaaaaatagaaaacaaatgttgaaaagaatgtggaaaaactagaaccttcatacatttctggtagaaatgtaaaatggtgcagcttccatgaaaaacagtttggtagttcctcaataagttaaacatggaattacttataagccagcaattttactcctaggtgtatacccaaaagaattgaaaacaggtgttcaaacaaaaatgttttacgtgggttgggcacagtggctcatgcctgtaatcccagcactttggaaggccgaggcaggtggatcacctgagatcaggagttcaacaccatcgtggccaacatggtgaaacccgatctctactaaaaaaatacaaaggccgggcgtagtgtctcacgcctgtaatcccagcactttgggaggccgaggagggtggatcacgaggtcaggagatcgagaccatcctggctaacacggtgaaaccccatctctactaaaaatacaaaaaattagccgggtgtcgtggcgggcacctgtagtcccagctactcaggaggctgaggcaggagaatggcgtgaactggggaggcagagcttgcagtgagccgagatcgcactactgcactccagcctgggtgacagagcaagactccgtctcgaggaaaaaaaaaaaatagcctggctcagtggtgcccgtgcctttaatcccagctacttgggaggctgaggcagggagaatcgcttgaacctgggaggtggagcttgcagtgagctgagatcacaccactgcacgccagcctgggcgacagagcaagactgcgtctcaaaaaaaaaaaaaatgttttacatgaatgttcacagcagcattaccaataataaccaaaaggtggaaacaacccaaatgtccatcatcaggggaactgataaacaaaatatggtatatccatgcaaccaaatattactcagacgtgaaaaagaaaagaaatactgattcatgctacaaggtggatgaatgtgaaaagcactgtggtggtgtgtacctggatagtcccagctactcgggaggctgaggtgggaggatctcttgatccgagaagttcaagatcatagtgaactatgattatgcctgtgaatagctgctgcattccaatctgggcaacatggcaagaccccatctcttaaaaaaaaatagataacatataattccattcctatgaaatatccagaatagataaatccatagagacagaaagcagattggtgattatcaatgactgagggaaaagacaaatagagagtgactatctaatggatataaaggtttttgggagtataaaatgaattgaatgaaaatgaggtgaacaggcacgtattttgaaactagatagaggtgatagttgttcaactctgtgaatgtactaaatgccattgaattgtacactttaaaatcgttaattttatattaggcaaatttcacctcaagtgtaaaaaagcaatatagaagatgtctggacaatttttatttttatgtacacatattttgatactagctggacaaggtggcacgttcctgtaatcccagctactcaggaggctgagaggcacaagaaccacttgaacctgggaggtggaggctgcagtgagctgagatcatgaataagttaggaaatgtttgacagcagaaagaaaattgcaagataaattctttaggcaaacgacaaaggttgaaaagataaaagattgagattagactcctgcagctaccctcatttttaccatcgtattacaatccttatgtccagacatctcgtatattgtttttttacacgaggtgaaatttgcataatataaaattaaccattttaaagtgtacaattcaatggcatttagtacattctgttttgtaaagcagtggaatgtacaatttttataagactatgcgaattggtttgctactgaaatcttcaacttctgtaaatagtttaaattccatgcgtgcctggtaaaaccccagctggtaagagagggtgactagactaaggttgcagattatagttagataacaagtactgaaaggatgcctactgcagattaactcagcagggtgagatatgtgtgggaaatgaatgatagtaagatcacgaggcagctgctgtttggtaagccatagtgggactgccacaaaccaagagacagatgaatggttaaaaatgcacactgatgcggccggatgcggtggctcatgcctgaaatcccagcactttgggaggccaaggcaggtggatcacaaggtcaagagatcaagaccatcctggccaacgtggtgaaacccccatctctactgaaaatacagaaaaatagctgggcgtgctggtgcatgcctgtagacccagctactcgggaggctgaggcaggaaaatcgattgaacccaggaggtggaggttgcggtgagccgagatcgcgccactgcactccagcctggcgacagagagagactccgtctcaaaaaaaaaaaaaaaaatgctgatagcaaaaagtttaagagttaaaaactagaaatcacctaaataatcaataatatgaaaccgtaggaaaaactaggtatatcgatgaaacattatgaatacaattaaaatgacagaatgcagaaatatggagatgttttacaaaataataataaaaagtagagatacacaattgcataccataattacaatgatgtatgaaactgcatatctagcttgataaagataaaaaaaagatagacaggaaaagaaaatgatggattttatatttacacttttcctttcataatttaaatttttaaaaaaattgttttcactttagagactgagttttgttatgttacccaggttggtctgaactcctgggctcaagcaagcattctggctcagcctcccaaatagttggaattaacaggcaggcataactgcacctggcttgtccttttgtgacattttaaaaattgatggttgggccagatgctgtggctcacgcctgtaatcccagcactttgggaggctgaggcgggcggatcgcctgaggtcaggagttcgagactagcctgaccaatatgatgaaaccccatctctacaaaaaatacaaaacttagcgtgagccactatgtccagctgtttttttttttttttaagcctagtctaatggtatgatctctaaagttatgagaaacctgtattgaagagtacttatcagaatcttttccatgacttttcttgaagaagaagcaaattttagactgtagctatctacttttgagcaagcaaattttgttattactgtggcatacaacaatttagagctaggtgtggtggctgacacctgtaatcccagcaactcaggatattgaggcaagaggatcgcataaggccaggagttcaagaccagcttgggtaacatagtgagacactttctctacaaaaaattaaaaaaaaaaaatcttagccaggcatggtggtgcatacctgtagtcccagctactcaggaggctaaggcaggaggatccttgagcccagtagttccaggctgctgtaaaccatgatcatgccactgcaccccagcttggatgataggtcaagaccccaactctaataataataaaaaaattataatcatcataattgataacatattccaagacacttcagaattttaggaatctcatacaattttggaacacatattaataacatattaataaaaatataactcaaagaaagttaaaaactttttcttatttgacaatgcttttcatatgattttaacatactgatggcagtggccactccaaacaacctgccactgccatcatgccggctgcagcagggaggctcagccagggctgcatgctccatggagcccacaggagttggggacaagtgggagccccaccccttctgagctggggtgggagcagctccctgggtgcccgctgcagccaccaaaaccgctgctgcagacccagcctcctgctccacaactcaagttatggctgcagatcagagcctctctgtgctcttggccaggagcaggcaagaaccctgccctacccagcagagctgcagccacccaaaccacagctgcagactcaggcatccctccactcttgggagcatgagaaggtccccccatcctcccagactccaaagtgcctgctcccagagcgcactaggagcaaagtggggcagagcctgggtgccatgaacagcagcaggaggcagacagattttctgagcagaaatgggggaagggtcctggtgtggccccaccttaaggcaagggagggcctgaaggctgggggctgggctgctagtcccacggacacgagcaggaacttgtggtgctttttcccggccttcccatggccacccatggaccaattggtgagcacttcctcccctctgaggcccataaaagcccccgactcggctgggcacagtggctcacacctgtaatcccagcattttgggaggccaggacgggccaatcatgaggtcaggagttcgagaccagcctggccaatgtggtgaaaccctgtctctactgaaaatacaaaaattagctgggcacagtggcatgtgcctgtagtcccagctgctcaggaggctgaggcagaagaatcacttgaacctgagaggcggaggttgcattgagccaagatcgtgccactgcactccagcctgggcgacagagttagactccatctcaaaaaaaaaaaaaagcccccagctcggccagagctgagcaggtcacaagatgaccagcttcagagaggacttatcctcttggaacgacctgcctgcagagaggagccaccctctctaggacgcctctttgctgagagctgcagagatgacagggcgacctgctggcagagagaagacacccactgcagggcctcctctctgctgagagctgaacactcaatgggacgacccatctacagagaggggcaacccactgtgggtctcttccgagctgttctaacactccaaataaagcttctcttcatcgtgttcacccttcacttgtctgcatacctcattcttcctgcacacaagacaagaacttgggcaaaggtgccaccagccacagaggtttccagccagagaagagacaccccaaatatcccgtaacaataccaaataagtcaaataagtctctcttggacttccagggtccctaatatctaaaaatatctaatctgaggtcaaaaagacctaatttagaattagaaatttcattttgaaaagtttgttaaataacaaaggtctaaaacacttcatatcacaaaaataggatcacagatcactgtgaaaagaaatcattcatttatccaaagtgatcattcaaagattctaaaaagcaaaatcctttttctgtgttagagaaaagactcagttttctaaacaataaaaaggtctaataaagactgcatgagacaggctgcacgcggtgactcacgcctgtaatcttagcactttgggaggccaaggtgggcagatcacctgaggttgagagtttgagaccagccttaccaacatggagaaaatccgtctctactaaaaatacaaaaaaattagtcaggcatggtggcgcatgcctgtaatcccagctattcaggaggctgaggcaggagaatcgcttgaacacaggaggcagaggttgcagtgagccaagatcacgccattgcactccagcctgggcaacaaaagtgaaactccatctcaaaataaaagaaaaagaaaaaagactgcatgagacaaactgaatctatcttttcctctcccccctcttttttttgtagtttactcaaatgttgaataaaaatattttactatctcttactaatattacatcaaaatcttttttttgtttttgttgttttttgttttttgaggcagggtctcactctgtcacctaggctacagtgcagtggcacaatctcagcccactacagccttgacctcccagactcaggcaatcctcccacctcagcctcctaagtaactgggactacaggcatgtgccaccatgcctgattaatttttatgttttttttttttgtagagatgggattttgccatgctgccaaagctggtctcaaactcctgaactcaagaaatcctcctgcgtcagccttccaaagtgctgggattacagatgtgagccactgtggccagccacaaatttcatttaaaagagaaaaccaaattttatctttgtatcagtgtattattactgttaaagtaaattttaataaaatcttttttttttttaacatagagtcttgctccattgccatgctagagtgcaatggcatgattacagttcatggcagcctcaacctcccaggctcaagtgatcctcccacctcagcctcctgggaccacagatgtgctgggaccacagatatgtgccactacacctggctaattttttcacttttttgtagagatagggtctcactatgttgcccaggctaatatcaaactcctgtgttcaaaagatcctgtcacttcagcctcccaaagtgctaggcatgacaccactcctggcctaataaatgtgaacagatttatctactcttaatcagttttgaccacacaaaataagatttttataaacctttataatctcttataattcaaaaaagatgtcccaactttttatatctactttcattattatttaaatttcaaacaactttttaaacttctaaaatagaaaaaattactttttctttaacagaaactatacttttatatctttataagctcacagacaaattaagtatatatttaaaacatcatagaggcaacagttttatcttcttaaaacatctagtagagacagcactgacttatcaatagacccagaaaaaatgtttaaattttgaagatgtttttattttactttattaggaattttaaaattagccatatttactaaagagtattgaattcatgttaacttgaatagcacttggacttatttaatttatgaatatttatttataagccaatttgatattatacaaacagacatatatacatgtacacatgtacacaaatatatagatagacacaaataaagactttatagctttaattttttaattttagccatgagacaggtaaagctcactagtttaaaaggacagttggattcaaactgtgcttttgtaaatagaaaaggtcttgctaaagacgtcactgagttttagagaaaatggggtagcaaatttacatctcaaagtacagatgtaacaggacaagctgcagacaaaacccctcagacaccaagttaaagaaggaagggctttattcagccgggagcttcggcaagactcacgtctccaacaaccgagctccctgggtgagcaattcctgtcccttttaagggctcacaactttaagggggtccgcgtgagagggtcgtgattgattgagcaagcagggggtacatgactgggggctgcatgcacctgtaattagaatggaacagaataggatagggattttcacagtgcttttcttacaatgtctgcaatctatagataacataaccgtttaggtcaggggtcaatctttaactaccaggcccagggtgtggcgccgggctgtctgcttgtggatttcatttctgccttttagtttttacttctttctttggaggctgaaattgggcatgagacgatatgaggggtggtctcctcccttattcccctcctttgagaatctcactcaatagtgggagttcttactttccttctcactacccatgtcttcttgcaagacagatcgatggtgattcatatagtacacttgtgctgaagcattttggtgaactaaggtagcgttgaagctttttatcatttgaagaagtacaggtagcaaacaagggagcagtaagcaggttcctattactattataactcctattataagagttttaaatctttttagcactgggaaccattttccaaacatggccccaggatccatgccacacttgcacgggcacatgtgccagttttgtcatatttctaaccatgtcttcaactacttgcccttgatcatctatgtgtagacagcaatttgtaaggtcaaattttctacagacctctccttcagctgctagcaagtagttgagagccaatctattttgatagatagtatttctcatctgagtttcttgccaggccagaatagtcaaggctccgcctgtcttattagtgattatttctgagacagcttgtaaccgttatgatttggttgagcatgtaaatgggggttgggtatccccacaagctgtcttgtgcccaagtaccaggcccataatattgtatgattctctcagggggccattcatcatctttttaattttctatagctatgcttctctttttgtgggaggcacagagagggaagcccaggaattagcctgtctttatgggcagtaggaagaaggatggtttaaaagtgccaataacacaactacctgcccactggtcgggtaatttggtgtaagctctatgtccacatatccagtataatccagagggggctgtctagtcccagtgggactccgggtgggttcacacagtttgcaactttgggaatttgctaaatggatttttcttagtgtaatttgaactccactaggtggctgtttttgtagtattttgcccaagacagctgagtcttcccacaagaagggtaaagtccttcctcactcttgctatacagtattgtctaatgattgaggcttttaggacccagaagttattagggtgattcttttgagccgggaattcattgggaactgggtctataggtattaactcttgggcttcccatggccattgatctcccattacagttcctccacatacataacatgaagtgacattgagagactgggccacatgctcagctaattgcaaaaacaaatttcttgtttttcctggaatttctggtactggcacattcagtttatcacagaaggtttgaaatactggctcaggagagcgtttataaacttctcctcaaaccatgatacttactcgatgatccagtccagccctattgattcccagggttacacgctcccctttttttcagcgaggatcaaggagattggttattactagttctaaggggttacactgaccactggtacaggaagggccacttttccctttctgaaggtggacagaatacattttattttttatccaagtagcctgaatgacacaagaccagtatccacattcatttccacacagttctaattcatgacaaatgtacttattttctgccatatagcctctttcctaattaaaagaaccacatcctattcctaacttattattattaatgatagcacaggcatcaaacttcaaggtgatttgtttgggcacccctttttcttttgttttggctaacactttactcgtatcatttataagccaccaccagtcctcagtccttaatcttatttcaaaaactgtggtcatgggaggctcagatgggtcataacacacatcaggttggtcatttcctgggctacatacttcgcatagaatagcattatacaaacaagtttttttttggagtcctggtacaatcataataatcataaaataataggactgtagcaactttttgtcctatctcagtgacttgatgtatacactggaaacagtcctcagtctgaggaaggtcagttaaagtacttactgtacaagtccaaattttaaggaaaataagtcctgcgatgagttttctcatgcttcggccatgcatggacccagtcagcttctgggtgtgactggagcagggcttgtcatcttcttcacagtcactttgcaggggttgacaaagctgctcccgtccatgtaccgctcacagtctactgatgttcaaggatggtttcagaggttgggcctgctagaataaactgagtccaacatctctacccagttatgttcaactgggctctctgataccgggagcaaggtggtagggtttagggtgttgtaaacttcaatggttatgtggagatttccacagagcaagctttggtacttggttaatctagcatttgttaaccaatgatgtcctttggtagtcatcaaagttactacagcatgggggggcctttatagtcaggttttgcccaagggttagtttttctgcttcttgtgctaacagggccgttgctgccaaggccctttgacctgggggccagcctttggaaaccccgtctagttgttttgagcgataggacactggccttggccagggccccacagtctgggttaaaactccaactgccattttttcctctttctgacacatagggtataaagagttttgtcaggtcaggtagccccagggctggggccgacatgagtttttcttttaacttatgaaaagctcattgctattggttgtaatagatgtagtttatccaatttacatttttattaactgttacctaccaaaatattgactcaaatcctgcagctatttgatttcaagctttaaattgatctggtggtcatcctgggactccagttgcatctaaatggacgtgagagtcgaaagacccataaggggcttttctcgctttacaatgtcttatttttcctccctctggttgatgaaatgccagggtgaaagggatagccaattggactaaaatacaagtgccattccagttattcagcagagtgccagtaaaggtctaccacgataccaccacacatccgctcggggatgaacaagggctgactgattgataagctcttgaaaatttttaagctcactgcatcccttcaggtctcctaggaatgctaagtttcctctctgtcgtgagagacacgaagtgaacttagtgttgggaaacggaggctggatggccctcgggggctgacccacagggtgccgaactttgggatatagcagagagagcttggcacaacttattactccaggctgtagaatcctggaaaagagctaccatgcagcccacgcctggttgactggaggaccaccttagtggaaagggtacaatctgggcatctggtctgccatgtccacaagcataacaattgcttttgtttagtgttcagatggaatatttgatccattccaaccaggcatttgcatcttggtatgctgtcttaattgccaaagtttgttttaagtctttaacttctatgatcctctagtaaaataaatgtatgattttgggaaattacaaaaacctgttggggctgtccatccttgctctttagtggtccacagaatgttggaccaactacagcataaaagctctacactggggagcaagactcctggttgacactggagactttatcgaaatttccccggattaaatggtcctaatttactaatgcccagtctgaggagagtcaggagggacagaggtacttttctgaagtagagagctgtctttgacttcgcaagtccccacagggtataacaaggcaagcattaaatgcaatactttgaggcgaaattgacttggttatgttaataaccagatggtcagcaatagagcgaggaaagaagaaagagtaatagaatagatgaaagagttaaatttttcttagctttagtttggtagggttttcccctgggactgtggcccatgactctggagagggtggcgctttgactcgggtgtgatgagtccatcccttttctgctgtatgaacagcagtctcagtggttagcagcacaaggtaggatccttcctaggctggctcgagtttttcttctttccaccctttgataagaaggtgatcttcaggctggtgctggtttactggaaattctaggggtggtacctgtgctaaaagacttttaattttgagggaaaagaaagtggaagataaaccaagtgtataatttttaagaaattgactttttgttttaaatgtggggacatcaacagtggactttatagtctttggtgccttcttactgagaaatttcctttagcatctatttttattagtttttagaccaaagaaagccaaataccattttatatttaataatgctcttgtatgatttttataccagataagctaaatttcacctttatattagtgtgctattaatattaaacttagtttctttttcttttttttgttgggacagggtctcactctgtcactcaggctggagtgcagtggcctatcttggctcactgcaagctctgcctcctgggttcaagccattttcctgcctcagcctcccgagtagctgggactacaggtacctgccaccacgcccagctatttttttgtatttttagtagagacggggtttcactgtgttagccaggttggtctcaatctcctgacctcatgatccgcccgcctcggcctcccaaggtgctgtgattacaggtgtgagccaccgcgcccagcctaaacttagttttaataaaactttgtatacatatttattcaatttttatgttgggccataaggcaagatttttatagactctttttaactttttataatctttgttgaagagcaggttagtgctttaagaaaaacccattgtgtttttactttaatgtccagtttacagaaaaactggatgatactcctttaactttagctaatatgtttacacacagaattttttttatgattaatgttttaaaacttgcttaaacctccaaaacaaattttttaatcttttaatgtagataaaaatttacattcttatgccttcttataatccttttaccaaaggtatattttactttccttatagccttgcacataatctgctttttttttcaatagttttacattcaggaggcctagttactttcaaattatacaacatttcttgcataaattattttttataacatttttctctttcacgactttcgcagacaattcttcaacatgcctcaactttctgacttattacaaacatttttttctttaaacaaccagttaatttatttcggaacaagaatttaccatataacactctttttacataaattctgcccctcctttttttcctttttttttttcaaagatgataaccattcttttccaaagtgaacttcttttatgtctgtggactagacagtctaaggtcacaagattagaagttactataatacatgttacactgttaacttttagcaaactttacttttgttgaaaaccttgtaagtttgggattttaattatcctttgctattaataagaccttgttttgtccaaattaatttagaattggtatagatggctttttttttttccttcaattacctgggaggaaccatcaatcttcctgtcctgaagggagttcctcctaggcctggtcggaccttctgtggtaattaagatttagatcccctgttgggaaacctgctgggttaagggaattttcagtggttaatgttaaatcatccttcttttttttcttaggatacttctgaactggtgaggtgtgctcacaatcaggtttcctctaaaagctatttttttacttttttctgttagcaaagcagttgccactacagattgaatgcattcgggccatctgtgggttactgggttaaggatttttgataggaaggcctcggtgctttcagatatgcccttgtttacactgacaacaaaatggtattggagtgttatagggttatggagaataccttcaattatcaattataggttttaaatttaccttggcttttaaaggaatagggtacacagtttttttcttaactacttgtatgtctatttctttctctttctttctttctttttcctgctttgtttttccttctttctttcgctttgattttctgtctttttttctctttgactttccttttgcctctgtctctttctctctctctgcctctctctttctatctctgtctcgctctcactctctctctttccttgactccctctttgtctctctgtctcttcctctttctctctctgctggtctttccttgcctctgccagccacttatgctgctgttctctcaaccgctgggggggtgggggttgtctaaaaccagctgtaaccaagtgtctatgtacgggaactggtctgagtgccctggcttacaggttaccttgtgccatacctttgaaacaagggacctgtccagccttccttctgatggccaacacacctctaatgctggccagtctatcttacacaaagttttaagttttcctggtgccataatactccatagtctcccttaaatcctttcttgaaatttttcaacagagttcctagtggggtgggcttactttgtgcctgacccatgcttcttcaagagaaaacaccacgctcacaccacacgcacaccacaatacaaagaacgggtaaaaagggcacacacacacacttttatagtttacaccaaaccagaatcaaaaccaaaatcagagtatcaagaaatccaagccaggtcgaaaccaaaacgaaagtatcaagcaatccaagtcaagtcaaaaacaaaaaccaaagtgccggtataggcacaccgtgggtgttcaggccacactgccactcaaatggaatgggcaagttccaaagactagtcttagcaagtttcagatgtctggactccaagtgccagttccttcccggtgttcagccactgtgttaatcctctgtgggggcctgcatgcgctgctctggcaaggcattccaccggggcaattgcctacccaggagcgctctcaggatctgcgttgctcaagctggctggagtcccccgcagggatgttccacagggcaagcctaagccacctaaggggctgcctcaaccgtccattaatcacctcgcttcccggtcagggaaccaagaaatgcagcaggacaagccgcagacaaaacccctcagataccaagttaaagaaggaagggctttattcagccaggagcttcagcaagactcacgtctccaacaactgagctccccaggtgagcaattcctgtcccttttaaaggctcacaactctaaaggggtccgcatgagagggtcgtgattgattgagcaagcagggggtacatgactgggggctgcatgcacctgtaattagaatggaacagaacaggacaggaattttcacagtgcttttctatacaatatctgtaatctatagataacataaccgattaggtcaggggttgatctttaactaccaggcccagggtgtggcgccaggctgtctgcttgtggatttcatttctgccttttagtttttacttcttctttctttggaggcagaaattgggcattagacaatatgaggggtggtctcctcccttacagagagaatttaagctttttaggaagaagtttgggtgtgtaagttagaagaagattaaaaatgaacatcaaggtaacacaaaatcacaggaatttaccttaggattttataaggagaccaattttatttagataggtggcttttaatttaatatttgttttttaactggaccattgtgctcaggatggagcccattaatgaataagactagcgaagtatttgtagttcgtggggcctaatagtttaaataagtgaaaaacaggcacagttggaaggacaagtatttaaatttttaagaattaaaaattgggctgggcgtggtggctcatgcctgtagtcccagcactttgggaggccaaggtgggtggatcatgaggtcaggagatcgagaccgtcctcgttaacacagtgaaaccccatctctatttaaaaaatacaaaaaattagccagttgtggtggcacgcgcctgtagtcccaagctacttgggaggctgagacagaagaatcgcttgaacctgggaggtggaggtttcagtgagctgagatcacgccactgcactccagcctgggcaacagagtgagactccatctcaaaaataaataaataaataaaagaattaaaaacttactttttcactgaatcctgggtcctccaaaagagggaaatgccacggaacctggctgtgcaatgcttttacagtgtgcttggttacgacatttttctaagtgtttaagccacatcctttttatcttaacatgcaaagatgtgaatagccccctgtagtattactcattcactgtaactgctgtcagtcacctctaagactgtagctctttccagtgtcctgccagccatctcacacacaaaggtcaagttctctctggcagggtaaaataatttctggtatcccagaagagtgaaagaaacaggtaatgtaatgttaaaaaaaaaaaaaaaaagctgggcgcagtggcccacgcctgtaatcccagcactttgggaggcggaggcaggtggatcacctgagcctgggaggcagaggttgcaatgagccgagatcacaccactgcactccagtctagcgacagagtgagaccctgtctcaaaaaaaaaaaaaaaaagccgagctttaaacctgagaagaatctgttcatgactcttgaaactccataaggaaaacagaggacccccccaaaagtgggagtggttcctttttctctgttccttaaggtgtctgagctattagaggccccctctagagtcttttatgtgatactgaagacagcaaagagaaagaaagaatagggaggaggagaagtaaatggaagtgaaaagagataccaagcacatactgttttttttttttttctttaaagagggtttctgtcaactgaaaagaaagcaccaaaaacaagatcctaaaagagaaaaagcagaaagtccttttatgtacatctctctctctatatatatatgcgtgtgtgtgtgtatatatatacacatatatatgtactctcacaaacatatatatggcttgaatatcagcttttaattaagctgacttctaaccatagagctcttttttcaaaaacctttaaaaatctcattattagattttagctgggacaaatagctaatatttatggcttttgaattgttttattccaaatataccctccccaatgcctcacaagatccagaaccatccaaaagacagctcaaagaaagaaaaattttgctagctgaaaatagggtataacccacatttctatattctctggggtcccagcttctcagctgatcatttacacacaaaggcccaaaagcctcatgtgcctcctatagacagaagttgacaggaaatcataagctgtccatggaaggaacaaggatcattaataaatgggttcctcaaaaagtcaaaattcacacaaatttcaaaccaaaagagactgattccctgactaggaattaaacctaggccatggcagtgaacctgtggaattttaactattagactacaaggcggagcagccctgccattgttaatcccacaagagatcacaagcaggcagtctgagtgtacaaaggattctagctttgttttaggtcagacctttgctctttaattttgtcaagataatttctttttctttttctttttcttcttcttctttttttttttttttaagacagagtctggttctgttgcctaggctggagggcagtggcacgattttggctcactacaacctccgcctcccaggttctagagattctccttcctcagcctcctgagtagctgggcttacaggcacccaccacaactcctgggtaatttttgtattttcagtagagacagggtttcaccatgttggccaggctggtcttgaactcctgacctcaagcaatccaccggccttggcctcccaaaatgctgagattataggcatgagccaccacacccggcctgtctagagaatttcttctccttcttcttgttcttcttgttcttcttctaattcttctaattcttcttctttttttttttttttttttgagacagaatctctatctgtcgcccaggctggagtgcagtggcatgatctcggctcactacaacctccacttctcgggttcaagccattcttctgcctcagcctcccaagtagctgggactgcagtcgcctgccaccacacctggttaatttttgtatttttttagtagagacgaggtttcacatgttggtcaggctggtcttgaactcctgacctgaggtgatccatctgccccggcctcccaaagtgctggaattacaggtgtgagccactgtgcccagccctgcctagagaatttctaaggctagccatgatactattttgagtctcttttttaaaaacttaatctttctttacatacaaataaagtaattgtttagaataagagatctctaaacttccttttttaaaatttaggagtctttctaatttaaaggacccattttttggccactgactaatttctttctctttttttctttcttttttttttctttgagacagagtctcactctgttgcccaggctggagtgcagtggcacgatctcagctcactgcaacctccgcctcccaggtccaagtgattatcatgcctcagcctccaaagtagctgagattacaagcatgcaccaccacaccctgttagttggtatatttttagtagagacggggtttcaccatgttggccaagctggtctcaaactcctgacctcaagtgattcgcccatctgggcctcccaaagtgctgcaattacaggcgtgagtcaccacgcccagcctgattaatgtctaatgttgtattcattccaatagtgactcagtccaatagcctttttgtggaaggtgaggaaacaagtccgaagatccccgacaaaaaattcactcccgggaataggctaagatagacaaactctcctaagagcttgacacatttggaacaaaaaatcttgagttcccagccattttcaggctggtcacctgatgtcctctgaaaatcacattcccaggatggtggagatcaagagagaatacttgctcacaagtcaaaccctcaaggatataaaataagacaagcagaaacctcatctggtacccttttttataaaagaacaacacagaaagacaaatacaaagggggaaaaaacaaacaaacaaacaatttctatgaggaaagggatcaaacaatatgaatattcataacaaaagaccaaaaaatataccacagtcactacacccaagactggtcacacaaatccttttctcctattcatcaaaattttgcagaggaaaaagagaacagtgattttcaccatctactcaacccagtttccacagagaggcctggagcctgactggcgagaaattcttaccctttgttctggcttgtcaagtcctgggttcccttcactgtggcttctggaagaacagatccgctttggtgatcccgctcacagcaccaaactttagggaccaaggtaaaacttttcctttgcctcctgaagtttcactgaaaaatcaacccacaaaaggcaggttaactggagaaaaggcatataaattttattaacatgtacacagggaaaaacacacacagagtgattatccatcccccaatggagtttagaagcttatatatcatcttgaggttatggaaggaatgggggcttggatcctggcaaaacaggttatggtagcagggacataaggaaatacctaaagacaatgtacttctgtttctcctcatactttttatgcttgaaacatttatccctatgatgtttgccaaatggcatctatatccatcatttgttctacatttaattggaattctaaggtaagaaagagatttcctttctcctctgtttatttattcgattatttatttatatcagcacagactaatagattatcgttttattctacctgcttaaaatacagtactaaactgtcccatatttggtcattgagagcccctaaagttcgttcctatgtcttttttgacagatactctttttttttttttttttttttggaacagggtcttattctcgcccaggctggtgtccaatggtgcaaacatggcacactgcagcctcgaactcctggacttaagcaatcctcctgtctcagccttccaagtagttgggacctcaggtgcttgccaccatgcctggctaatttttttatttttatttttgtagagatggggtctcactttgtctcccagctggtcttgaactcctgggctcaagcaatcctcctgcctcggcctcccaaagtgctggaattataggaaggagccactgcacctagcctctcatctttttttttttttctaaaggaactttctactttctggcaccacaagatattccagctgctttctgtattttccctgcgtcagccttggaaagagccatttttccaaaaagtcctgattccttctatagaaaaatggcatttatacattcagatttgggagccaggtacagtggcatatgcctgcagtctcagctacttgagaggctgaaacaggaggatcacttcagcccaggagctcaaggtcaacctgggacacatagcaagatgtcatctctaaaaaaataaaataaaataatgattaaaaaaaatctgggcgctaagtatgctcattgatactggagtctcattgcttctaggccctctcagcagatagaggtaagagatatatgtaggcccggcacggtggctcatgcctgtaatcccagcacttttggaggctgaagtgggcagatcgcttgaggtcaaaagttcgagaccagcctggccaacatggtgaaaccctgtctctgttaaaaatacacacaaaaaaaatttagctgggcatggtgttgtgtgcctatagtctccgctacttgagaggctgaggcagcagaatcccttgaacccaggaggcagaggctgcagtgagctgagatcgtgacactgtactccagcatgggcaatagagcgagactccatctcaaaaaataaaaagagagagatgtggagatatgtacacagacacataaccacacacatttacatctatttctgtatccatatgtttttctgtatgtctgcgttttgtgtgtgtgtgcgtagacagagaaagagagattatactgataggtcccatttcaatctaataccatggagttctagccttctccccttccttgtctctaactcctttcttaaatatacattttaaaggctttagttttttacaatgctgtttctcagtgtgaattaaaggcttctgatacacactgtcaaattgcttttcagaaagattgtgtgttccctccctgcactgtaagaaagtgcccatcttcctgaatcctcaccaaagatagattatatcactttaaaaaacttcccaactttataaagggacttctctttttaaattacttcttttttttaactacaaatgaagctgaacctcctccctaccctgacattacttagccatttatatttcttctttcaagactaagtaaaatttgtgttcggtccaactcgcttccagttcaccttagtgactagaaaatcctaagaagtgtttgaaaattgaaaggtgatcttggataagcgcacaaattatgtgctaaaatataatcttaaagtactttagatgtttagcaaaaggcaacagaaacttccattagaagacagtgattactttttattttattttatttttattttttttgagatggagtctcgctctgtcacccaggctggagtgcagtggcataatctttgctcactccacctcccaggttcaagcaattctcctgacttagcctcccaagcagctgggattacaggcatgccccaccacgcccagctaatttttgtatttttagtagagacagggtttcgccttgcctgtaataatggtggctcacgcctgtaatcccagcactttgggaggtcgaagcaggagggttgcttgagcccaggagttagagaccagctttggcaacacagcaaaacctagtctctactaaaaataattttaaaaaattagccaagcatggtggtgcaccctatagtcccagctacttaggaggctggggtaggaggattgctagaatccaggagttcaaggctgcagtgagccatgatcatatcacttcactccaacttgggtgatagagcgagaccctgcctctaaaacaaacaaagaaataaacaataacaggacccagcttatcttcacgtgtacaggatgagaggaggctagaaattgtcccactgccaaccccgagatgaatgcatatttgacttcttcctctactctacgtttactttatcttacataaactgcagatttactgagcatgagacaaacacagaattggctgttcctccacatacatacaacatgtggattcagtgagaaataatcaaagccttaaaagactgtaaccacttacctaattttttcctactctccccttttgttttgtttcctccttccccatccagcctgctttctcctctttaaaaactgaacccctcaaaaccctttttggaaaaagtgcgagccacagattctactgtggggttttttttttcccagacactttctcaaccttgacaaaacaaacctctaaactgatggagacctatcccagatactctttttggtttataagacccagttggcatgatttagtcaagggcatgcatcaactatcacccagcagttgtgctcctggttatacccttcaaggaattttctcacaggtccccatgaggacatgttggaggatgttcattaaagtgtgtgagtgaagtccttgttgtgtgaggtgaaaaggaattggagacaatccaaaactggagtaaatatgtactaagtggcagatgaaccaccctggagcactatgcagcaattagaaacaacagattagatatacaaagagcagcttggacgaatattaaaaccgtagtgccaagtgaaaaaagaaatgaaactaataaaacaatatcatagacataaattaataatatataaacaaaacagtcatttttttacaataacatgtttcaaaatgtatattaaacgcattaaaatggttgcctatgaaagagaggagaatggaattgctgaaaggagacaaaactgaatatacagataaatttcaaaaagcaaaagagaatctttgcattgatgataatgtgtcagaaactgagaaagttgttaactctctgaattcaaggtgaaaggagaaataaaggaaggaaggaagaaaggaaggaaggaaagaaggaagggaggaaagaaggaagggaagagggagaaagaaagcaggaagcaaaccctgagctgtgctccttttaataaagctgtgcttcctttaatcacagggctttgaacacgctgtttcatctactagaaatttctaatcaccaccacacacacacacacacacacacacacacacacacacactgttgactcctatttttctcaatctcagttcaatcattattttttctggaaaagcctactgtaacctccttgaccaggccatttttccttattataatgtgccataacaatatatactgtcttttttggacattaattacaactgaaactttaaaaaatgttacatctattgatgtggttctctgatttatatctgcttcccactaacagaccataagctcagcaaaagcaggaatggctcttttctttttccagaccctgatagagtggctgacatagagtaagtggtcaattcataattgttgcataaatgattccataaaagtataaatgaatgaactgagaagggtaaacataggaaaatggagtggtgttgcacagagaatgggggtaggggtgtgagttgaactgtttctccaccacaagatataaggcttgtggtgctggacctggccaggttatagcagccaagaatgttccataaaaatatattatcaactccaacctgatagttgaccttgccatggaagacctcattggatccttggtagatcagaccataactggcactcttaaaaactcttcctatctgcctgtagttccgtctactcaggaggctgaggtgaaaggattgcttgagccccagaggttgagactgcagtgagctaggatggtgccactgcactccagcctgggtgacatagcaagaccctgtctcaaaaaataaaaaataaaaaatgaaaaaataatttaaaaaaacctcttcccatcaaaaagtatcaggaatgaaactctaagatatattcctaccagttcaagaagttcctgtacaagccatcagtctagcagactagtcaccaacacaaaagagggcacaaaatgtctctatatcaatgtttttcacactatgcgtgtgatccattagtgagtcatgaaatcaattccatgagtcacaatgaacattaaaaaacaataaaacaaaataatttttagaaaagataggaaaagaaattcaagatggaagggctgtgcaaatagcctcacagtagttcttgaaattattagccagaaagaagaggaaaatgattctcaggtttaccgcaccttttgtgtgccaggtactttgcatacattatctctactcactggtagcattgttgtccgcatatttatttatttaaagatggagttttgctcttgctgcccaggctggagtgcagtggtgcaatcttggctcactgcaacctctacctcctgggttcaggcgattctcctgcctcagcctcctgagtagctgggattacaggtgtgagccaccgtgcctggccattgccccatctttaaaatgagtagaagctgagtcttcatccatgctttttgtcagaaaccatttaggatgcagacattgagaaaagtagaaaagggggaaaattcaccaggagtgctaagtaggagggaaaggaaagaagagagagaaaaccagagtttagcagaatgcaggaggatactggctaaactaaaaagggagatgactatgaaaacagtacttctttttttttctttgagacagagtcttgctctgtcacccaggctttagtgcagtagcacaatcttggctcactgaaacctcctcctcccgacttcaagcaattcttgtgcctcagccacttgagtagctgggattacaggcatacaccacaacgccaagcttatttatttatttatttattttgagatggagtctcactctgtcatccagactggagtgcaatgacatgatcttggctcactgcaacctccacctcccaggttcaagagattctcctacctcagcctcctgagtagctgggatcacaggtgcgtgccaccacgccccggctactttttgtatttttagtagagacagggtttcaccatgttggtcaggctggtctcgaactcctgacctcgtgatccgcctgcctcagcctcccaaagtgctgggattacaggcttgagccactgcgcccggccatttctttatttttagtagagacagggtttctctatgttggccgggctggtctcaaactcctgacctcaagtgatccgtccctctcagcctcccaaagtcctgagattacaggtgtgagccaccacgcctggccttgaaaatagtacttttgacctaaagctaaaagtaaatctacaggaaacaactcacccgtagaatggagagtaagaataggctggaccaataatacatactgtcatcctgagatttaaactctagatgtgtgggtctcacactcaactgcccttagggactaaaaaggcagatagatattagagaatagaaagtagcagggcctatggggaactacagagtgcatactgagcatatgctccaaccaaaggcattcaaaaatcagttaaaaaatctctctctctctctctctctctctctctctctcacacacacacacacacacacacacagagttttaaccaaataaacaatttcactgacagagtttagtccatggtcctccagtttgtgcttccgtgactgcattaaactctagagaaaagagctgaccgtgtcaaagaaataggtaacagaaaacacccagaacaatcatagtccttgaaatctgcaacaatctaacaggggtacatgggtctgtacttcggattcatcttaaatcattagttaaattcagttaaacaaaacagtaaatatttattgattcttcttaggtacaaagtactaacctaggtatgggggttataaaatagagtaagtcactatctctatactttggtatttagttctcagttcgggtcctatgaagttttatgaatgggcagtcatagagggtacaaaataatcttcctccactttgggaagccaaggcgggcggatcacgagctcaggagatcaagaccatcctggctaacatggtgaaaccccgtctctaataaaaaaatacaaaaaaaattagctgggcgtggtggcgggtgcctgtggtcccagctactccggaggctgaggcaggagaatggtgtgaacccagggggcggagcttgcagtgagctgagatggcaccactgtgcttcagcctgggcgacagagcaagactctgtctcaaataataataaaataataataataataataataataacctttctcttctgctccacagaaaacgagttccttatgttgtacatgatttaaatctcatcttcatgatcctttggctttaaacctgttatagcattgtaatgttcctttttttttatttttttttgagacagagtcttgcttttgttacccaggttggaatgcaatggcactatcttggcttactgcaacctccgcctcccaagttcaaaacattctcccgcctcagcctcccgagtagctgggattacaggcatcctccaccatacctggctaatttttgtatttttagtagagacggggtttcaccatcttgtcaaggctggtctcaaactcttgaccttgtgatccacccacctcggcctcccaaagtgctgggattataggtgtgagccagcgcacccgactgtaatgtcatgtattctaaaactggctctcttgtctacctacataaaaactatttatctagtgataggaaaatatttttaaattccagtgcctacccagtcccaatatagatattgaaccccattctggtggttttaaaatatgtccacagttctttgatactcttcccttcaagaggtgaagcccaattcccctacaatcgagtgtggtttagattaagtgacttacttatgacaaacagaatagcagatgactttcaagactaggtcttaaaaggtattagagctttcctcttgctctctcttggataacatgctctagggaaagcctgctgctttgtcatgaggacacccaattagtcctatggagaggttcacatagtgagaaaccgaagctttttttccaatagacatatgaatgaaccatcttagaagttaatccttgagcctcagtaaagtcttcagatgactgcagccttgaccaacatctagattgtaaaacatccagaaccaaaacaaacctgctaagccattcctaaaatccagatccacagaaaaagtctgaaataatgtttattattgttttaagttgccaagttttagggcaacttcttaaagagcaatagatagcttatgtacctactagaactgacatgctaaaccatattgttttgaagcctatctttttcacttccttcctttcctccacttcccattttttgccccctccagaaactggcaattccctttcttcttccctggatgttaaaaagtcctaactaggatatttaaaagtctttttccccctaatgggctcaagaaagagattctttaggggcagatcctcatcttcttcttctttttttttttgagacggagtctggagtctcgctctgtcgcccaggctggagtgcagtggtgcgatctcggctcactgcaaactccgcctcccgggttcgcaccattctcctgcctcagcctcctgagtagctgggactacaggcgcccgtcaccacacctggctaattttttgtatttttaatagagacggtgtcaccgtgttagccaggatggtctcgatctcctgaccttgtgatcctccccctctggcctcccaaagtgctaggattacaggtgtgagcctccgcgcccggcccccttatcttctttttagtgtgacagatgctggagtagatatctggatcagttagacttctcatcagtctcatggatatccactgattttacttacctatgcatttattcgcccaagtgaattttaagtaagatcagcagtagcagcttggaaaatgaaggaaagaaatcagaagcataaatgccacccaaccaggtctttggagtatatgcacaagtatttccaaatttgtaaccaaaggcaggcaggacttgaacttcggtgataggtggagtacagagtttttgtttgtttgtttgtttgtttgatattgggtcttgctctggtgcctaggctggagtatagtggcacaatattggctcactgcaaactttgcctcccgggttcaagtgattctcctgcctcagccatctgagtagctgggattataggtgtacaccatcatgcctggctaatttttgcgtttttagtagagatggggtttctccatgctggccaggctggtcttgaactcctgacctcaggtgatccacttcccttggcctcccaaagtgctgggattataggtatgagccactgagcctggcttggagcacagagtattattaataaaataagtaggtaaacaattagcggggtatggtggtgtgcacccatggtcccaggtactctggaggctgaagtaagaggatcacttgagcccaggaggtcaaggctgcagtgaatcatgattgagctgccgcactccagcctgggcaacagagtaagagcttgtctcaaaataaaaataataaataatagtaaatttaaaaaataaaataagtaggactggcattgtgggaggtgtgaggatgatatacatgataccttagatgttagtttatttgatagtttccttcccattcagctatacttcccagcagctttggaatagagacctagagacaatacatccttgttttacagaacgttctttcacagcgagctcctagcagagtctggtacagagtggagggtgaaaaactattgctgctcaaaggactatcagaaactgtgcatgactttgtgcatggcatccacttttccttccctagggattttgaaagacaatgaataaataaagaatggctttgaacaatcaatgtaagtaaagaaacaggaaatgtcatttcttagcttaatttatcaacaaacatcttaaataaaaaagaacatgtatcacaaccctaggaaaatccctctaaaatttttccctgaccataatattgcagattaggaaaacagcttaaggcatttgatcccttttgttggaaaactattcccactagcaggactggcatcttgttatgtttcccatctggtgtaaacacaaacttggccacactgtaatatctaatcctgtaattcattaattaaataaaaacaaattaaacacagctaatatttatatcataagattattgaggattcaatgaaataattcatatctagggaaacataaaaattacctaaataagtggtacgctggggtcctctgaatttgatcttgagttgaatcgtgtcccccctccaaaaaaaaaaagatatgttgaaatcctaatccttggtaactatgaacatcatcttatttggaaaggtctttgcagatgtaataaagttaacatgaggtcattagggtgggcccttaatccaatatgactagtatccttataagaggggaagacagacatgtgaagacagagggacacatggagaataatatgtaaagatgggggcagagattggattgatgcatctacaagccaaagattgccaaggattgccagctgtcaccagaatccaggacagaggcatggaacagattcttcctcagagccctaaacataaacaaacaatgccaacatcttgattttagacaccttgcctccagagctgtgagataatacattttggttgttttaacccacccaatttttggttcttttttacggcagcccaaggaaacagatacataaggacttgagtgcaagtggtttattttgaaggtgagtccaggaaccatttctagcagggtggggttgtgaggcagggaagcaaaggacactaatagtgtgtgctgatgagtaggatatctctgcaggtggaactcaatctttgggagacaaagtggaagatgtcttagagcaggggtccccaaccctgggaccacagacctgtaccagtccgcggcctgttaggaactgggctgtacagcaggaggtgagcggcaggtgagtgacattactgcctgagctccgcctcctgtcagatcggtggaggcattagattctcataggagcttgaacccaactgtgaactgcacatttgagggatctaggtgggacgctccttatgagaatctaactaatgcctgatgatctgaagtggaacagtttcttcctgaaaccatcccccaccctgatctgtggaaaaattatcttcctcaaaacccgtccctgatgccaaaaaggctggggagcgctgccttagaggtgttctacctctgaggattaaggacattggtatgtttttgttatattttattggtatattagctttctatggctgctgtaacaaatcatcacaaatttggtggcttaaaacacagaaatttattctctcacagttctagaggctgcaagtctgaacttaatatcactggactgagctctaggggagagtttgttctttatctcttcccctttctggtggctgctagaattccttgacttgtctacatcactccaatctctgcctattgtagtcacattaccttcttgtctgtctgtgtgaaatctcctgtctcttaaatggattcatgtgattgcccacttgcataatcatttcatctcaaaatctttaacttaatcacaactttgcctgtataagttaatattcatgtttccagggacttagccttcatatatttggaagtcatgtttcagcctaccacaattgctatagttatccttcaattaccatttgttgttgattgaggatgcttccagtggaaaaatctgtggcacttcagacctgccctacaggggtccagaaaaagtccttaagtgaaaatttgcaagtgctcagaggactttttcagcatgtatggaacacgaagtactgaggatatgtagacgagacaccaacaacatttgtgtagggcccccaggagacctcccgcacagccccttgcggctttctttctgtgtcctgaataaaaaattagagtgccttgactgctctgtgacctagccatctgcaggttcatcccagcaggcttcaacacaaactggggctttgaacagtcccaggcactggtaaaagtatctaagttgttgcccaaaacactgaaagtactggctcaggccctgagtcacataccttaaaccctcatataaactccgtaccctgaccccctcactgtggacatacctaggtccacaccccttttctctcactgtccatcatgaggattgccacagcactctgtaggtaagttctcctaacaattgttttgggttgatcaccccggcatttaatgcttctttcggccaggcacagtggcttacgcctgtaatcccagcactttgggaggccgaggcgggcggatcacctgaggttgggagttcgagaccagcctgaccaacatggagaaaccttgtctctactaaaaatacaaaattagccgggcatgttggcacatgcctgtaatcccagctactcaggaggctgaggcaggagaagcacttgaacccgggaggcggaggttgaggtgagctgagatcgtgccattgcgctccagcctgggccacaagagtgaactctgtctcaaaaaaaaaaaaaaaaaaaaatgcttctttctatggcatcccaactgggggccttttctcaagacagtttgggacacaccgttgtgggaacttccctgtcgctgcttttgtttgtttttgagatggagtcttgctctgttgcccaggctggagtgcagtggtgagatcataactcactgaagccactaattcctggcctaccactgcttttggggtgattcaagctgtgggttcagcaggacaaaaaatctgctacatcattattctaatgtttgctattattttggtttttggttaatacttttaatttaataattaattataattattagctatcttaacctaattttctgatgcaccacaatataaattatttgtactacctgagtgaccttgcttagaacaaattataccatctatttaaactttgtcctttctcctgttctcatttaggtatacattgctctatgacttcctctaaagcagcttgtctttattttttagcacctatgtgatcttttctattattctctatttggtaattcataattatcattctcaactacacacaaacacacacacacacacacacacaatttctcaacaatattttaacattttcaaaggtagagaccatgatatacgtattttcaaatcctttctttttttttttttttgcgatagcctcactctgtcgcccaggctggagtgcagtggcaccctcatagctcactgtagccttgaacacgtggcctcaaataatcctcctgcctcagcctcccaaagtgctgggattacaggcaggagccacaatgcctggacagtaatatctaaatattacttaaatattacagttatgtttttttagctctctgatagtgagttgtttttttttccccttggctgtagcactatctcaaaggtctgaacagagattctagactccttccctcccctggattttattttactttagtttagttttgtttttgtttcccctgaattttaggaagggaaacagaaagaggcctaggcagagccaagcacttcgacataagggaggactgtatattgtacaattccaggggcgtcattcacagtttatttgtaaagatagcaaactttttttttttgatctatgacagtgaagtgtcttaaggacatggaagctttttctaatttccacaggtcccctttgggtgagctgtagggcaacctgcctgcctcttttatgtctaagatgattgacagtgataacatccaattacgatgtttattttctaatttgtgatactgaagtgtgggctttttctatcgccaaacacttactacaaagtgacaaacattcatatagtcccttattataacttatgtaaattatcttgtggtactggaaaaaaagaagccttgtttattattccatgtccacttagtgacagttttcaaaactgtttgtttatagaaaatggattaattataatacggtaaatggccaagaaagcccttgcttgttgacaaagatctctggagtatttgggattctagctgtgggtaaaagaaagaaatagggaatgttacaagaggtacaagtgaaaaaaaatagttcttttgaacatggtaatgtgaagtcccatggttaggaggtagagctgtccaggaggcagatggctataagaatgaagcttggggaagaagtataggctggacaaaatctctttgtaataggtagatggatgaaatcacgctggaaaagcaagtagagcaagaagagtggtagacaagtgggccaagagtagaaccctgagagtcacctacattgaagaagcctaaggaggaagaaatggaggtaggaggagaacctggggaacaggctattaggaaagccaagggaatcaacattctaatgtgtgaagggagatacgcgtagcatcaaaggcagcagagagatctagtgaggttaaatgagaaagaagtaatgtaattccgtacacaattagaaaaaactcacaacactttggaggttcttggtgaccttaattagatcagtttcagcggaatgttatgggcaaagccacgtaagttcttaacagacttcctgaaagtgctaacaggaatctccaggtacaatccctgtgatactagtttgggaaagcccagtgacccttatcagctcaagtgtccaggaaagctctaagggatctaagaggatctggagtccaaatggggcttggcagtggattgagtgaagaagagatgacacaaaggtggacacacagaattaagaaaccagcaagattaaatggaattaaaaggaatcatataaacttccatttttgagtattttcgaacaacaggctgctcgaattcaagatgggagagatttagcttggcaacaattgctttaaaatgatccagagattttagttgattgtaaacttaaaatgggccaagagtatgacacagttcttaaaaaagctagcacatgctgggcatggtggctcatgcctgtaatcccagcactttgggaggttgaggtgggaggactgcttgagcccaggagtttgagaccagcctaggcagtatagcaagaccaaatctctgcaaataatataaattagccgggcatggtggtgcgtgcctgtagtttcagctacccaggaagctgaggtggaggatcccttgagcctgggaggttgaggctgcagtgagctgagagctgccactgcactccagcctgggcaacagagaaaaaaaataaaaaaaggcaatctttatattaaaaaagaaaatactagcacaggattgggctatgacaatagagaagagaaagtggagacgctaaaagaatacttttttctggaagtagggacaagtaggaaaagaggcacataaaagagcaattaaagggagataagtttattagaacaaatcttaaaaatggaagagatttgaatatgtttataagctgaggggaaggatctattagagagggaaagaacacaggaaagaagggataattaatgatacaagaatctgatgaagctgggaggagttggttttgaactggaatggggatgcctcatccttggagagactggaaggaaggctaaaaggatgggagtgactgtagatatgttgatatgcttgggagggaattcaggcacttgggaagagcacaggctgatgttttccacttgtttgatgaagtaatactccagcgggacaggctctgctgtttctgacactgtgtggaaggagacagagcaaggaagaagttggaagggaggttgaaagaagagtgccagatggacctcttggtctttgtggtgggatcaggaaattggtacttttttccctcagtctctctaagagcaacactattcaaggggctcagaaccctttgagccgcactactgggttttcccacctgctcaggactgcgaggccagactctgtgtcagggccatgctcaaaaatcatagactcaaaaaaacccacaaaaaacttgaagtggaatgcttaaatttattgagaaaaaaaagtctttgagagacaagcactttgatactcttattcttgcaatccataaaacttcctgtaaaaatgaacgactttaggcggggcgcggtggctcatgcctgttatcccagcactttgggaggccaaggtgggcgaatcacgaggtcaggagatcgagaccatcctggctaacacggtgaaaccccgtctctactaaaaatacaaaaaaaattagctgggcgtggtggcgggcgcctgtagttccagttactcgggaggctgaggcaggagaatggcgtgaacccagaaggcagagcttgcaatgagcccagattgcgccactgcactccagcctgggcgccagagcaagactccgtctcaaaaaacaaaaacaaaaaacgactttggtgaaattactaagcagacagaatttacccaaagttgtaagatactgaaatgcagatacagttttttatttttatttttattttttagacagtcttgctctgtcacccaggctggagtgcagtggtgtgatctcgactcactgcaacctctgcctcctgggttcaagcgattctcctgcctcagcctcccgagtagctaggattacaggcgcacgccaccatgtctggctgatttttgtatttttagtagagacagggtttcaccatgttggccaggctggtctcgaactcctggaactcaggtgatccacccgcctctgcctccctaagtgctgggattacaagcgtgaaccaccgcacccagccatggatacagttctttatcagctaatggttaaaaattaaagcaaaaaaaaaatgcaaaataaaacactaagaatcacagacttttaagtgaccaaggctgatgagaaatcattcgccatgctacaaacacggccagaatgtccgtcgaggggcaggcattacacacaaaaaataagcttctttctgccctcaggactgtatggaggaaaaagactacgaaaatcagtatctataacagcatgagataagcaacgtgaggagaggcacaaaatgcaatgaggtgaccgaaaaaaccaagtcctctcattctgagaggaggagcccgatttccccaaggttttaaaagaaataaatagggcgagagtcaaagaatcatactcagataaccttgcaaaatgcgcccctcccgcccggcttcccgcctttggcaccgacgccctcggggcttccctcgtgccagtccgcgcgcgcacgccggggggcaaccggtccagggccgcgagacagtcaccgcgagagggcgcgagcccgaacctgtctacggaagtcccgccctcacttccggcggcggaggattgggagggactgaaggccgtttccggctctggtagtgtagggacttcggcacgtgtgtcattccccgggatttctgtagtaaccctgcttctggtgaacttgtctggccggcattcatttaaggcctaaggatgaaggcggtaagtgtcctcaaaagcccggtcgccgcggcctagggccccttcgggtgatagagtcactgcctgagttagcttttaggcaggttttcacccgtgtctagggggcggtggtttagactgggggctttccattccttacaccgagctcatccttggttacccactgtgtgcgcgcaccacttcagagtatcacgaagagacaggcacggagttttgcatgcgtgggatttcatactttgaaggaatttttcaagaccgtctttcgaactcgtttttcacaaatgagaagcagggtcctaccctcagcgagtttataatgtgagtcacggtacccatgaagggtaaagagatagaaaagcaagtgatttgtcctggttctcccagaaaataagaggtagtcctggggttcaggactaactttgggatttctgaatgagtcaccagcaagagaagtggaatccaaagatccgaattcagttttgccctccttagtttatgggtcttttggcagcttcatcagtaatgtgaggataacagcagtcagtactcaactaggctgttagaggtgatttgttggagcactttgtaagtaataaaatcgtagataaatgtaagttttattaaagacagccagcattttgctttgaatgtgttaaactacaggtgtgttaaactagccttgaatagccacttaccactactagatcagtggttcttaacctgtttggggatcgtagaaccctttgaattgctgtgaattgggattgaataactgatgctgtagcgctcttctgtaggattaaagccatcgtttggttttagcttttatatgcaagtctgtggctgtgggacattgaaattgtggaattggtctaatgaaatttgtaatcagttctctttaacctgatttaaaaaataagtttctgggtatgcagtattctttctgttattttctagagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaattgtgaaaacatcatgtgctctggtttccattgatttattctgaagtgttcttcatggaaataactttgctttctagtaatcgcttttcttgttctcagatcttcctagagtgggtaaggatagtagtcctataggactgctataaagcatatatgctttatcacagtcagtatgagaaaacatttcaatacagtattcattcaagcttctgcttttagtttgtctggaaggcagatctgaagatgcactacttgggaaaacaaactgaaagtactccgttacataaatattgggcagtgtgccagtgctgccactttgccattcaccagcagttaggtaaggtaagaacattgcttgtctctggttcattcttcacagtattgccaaggtacacttctaaacttctgactttcttttcatgtggaaacttggggtgaaattgagttgtaattgtcatggttattttgtaaaactatctaaaaattattaagtactcaaaacttgtaaggaatatgactattttgagtcaggctagttctacaactttgctggtacttttagggtattcttatttgactatatcagattattagacaactattcagtcttctcaggtccattttttaaaaattattattattattttaaatagacagggtcttgttctgtcacccaggctggagtgcagtgtgcaaaaatagcccactacagccttgacctcctgggctcaggcagtcctcctgcttcagcctccaaaagtgctggaattgcaagggtgagccacagcacccagctaaagttttttttttttctaattttgtgggtacatagtaggtgtatatatttatgggatacatgaggtactttgatacaggcatacaatgcataataatcacatcagagtaaatgtggtatccatcacctcaagcatttatctttgtgttacgaacaatccagttatacttttttagttattttaaaacataaaataaattattgttgactatagtcatcctatctatcaaatactagatctttttctaagtgtatttttgtacccattaaccatccctactcctatctcctccaactgcctttcccagccagtggtaaccatcattctactctcttcatgagttcagttgttttaatttttagctaccacaaataagtgagaacatgtgaaatttgtctttctgtgcctagcttgtttaacttagcataatggcctttagtttcatccatgttgttgcacacaggatctcattcttttttgtggctgaataatactacattgtgtacatgtaccatattttcttttattattattattattattttttttgagatggagtctctctctgttgccaggctggagtgcagtggcacgatcccggctcactgcaacccccgactccccagttcaagtgattctcctgccttagcctcccgagtagctaggattacaggcgcacaccaccacatctggctgatttttgtgtttttagtagagccggggtttcaccatgttggctgggatggtcttgatctcctgatctcgtgatctgcccgccttggcctcccaaagtgctgggattacaggcgtgagccaccgcgcctggccccgtattttctttatccattcatctgtttatgaacacttaggttgtttccaaatcttggctcttgtggatagtgctgaatgaacatgggagtgcagatatctgttcggtatactgatttcttttttttggattcatgcctggcagtgggtgggattgatggattatatagtagttccatttttagttttagttttttgaggaacttccaaacttttctccatagtggttgtgctaatttacattcccaccaagagtgtatgagagttcccttttctctacatccttgccagcattgttactgcctgtcttttggataaaagcctttttaactaggatgagatgatatctcattgtaattttgatttacatttccctgatgatcaatgatgttgagcaccttttcatatacctgtttgccatttgtatgtcttcttttgagaaatgtctattcatatcttttgcccattttttaatgggattattaaatttagaaggctcatttaaagtagataggagtgccattctgtgcagtgtgtacatttatatagcaagatttactagggtctttttttgtttttttttttgagacggagtttcacacttgttgcccaggctggagttcagtggcgatttctgctctgctcattgcaatctctgctctgctcattgcaatctctgcctacgggattcaagtgattctcctgcctcagcttcccaagtagctaggattacaggcatgtgccaccacgcctcactaattttttgtatttttcgtagagatggggtttcaccatgttggccaggctggttttgaactccttgcctcaagcaatccacccgtctcggcctcccaaagtgctaagattacaggtgtgagccaccgcgctcagccaagatttacgagttttaatgggtcaggaagaattgtaagttctactaggaaagatgctaagattgttttattcatagttgaatcctcagcacttcaaatagtgcctggcacttagttgactttttttttttttaaataaaaagaggagatggagaaagagagcaagacgcagacagtgagcagaaagagaagttagaatgatctgttgttgggattttgttagatgtgagtgcctgaagtgttgaaagaaaaatagttgaggatattggcaagagtgtggttgaagtgataatcttgcagtctaagtgagggagtgaagacagaacacacaggtagatagaaagtggagtggtcagtggattgaaaggttacataattggttaaggaagaagtgctgtggaagtaactgaatgggagctggaaggataaaagcttgtggtcagagagaggggtgagcactagggtttggaatgtggccattagagaggctggctgaaatggaatacgaagtgaaagtaattggagatgagaaggagctgaggggctaagtcattggtttccaaacgtcctgaaaggcatttcagagtatgtggagacatttagtttttggttgttacaataacctgggaatgctattggcatttagattgcaggagtcagagatgctagcatttttccagactcagaacatcccagtacgacaaagaattgtttgcctagcatatcagtagttcttccatttagaagcactgggctcagctgtgagccatggcccactccctgtaatcccagcattttgggaggctggagtgggaggattgcttcagaaagcgtaagcttttcctgtttaaacccaaaatgcagagagttctacatctctgatacttgtttctaatttttctttgtgtgtgtgtgtgtgtggtacaggtaaaaggattgagagggaagaagaggaagaagaagaagcccttcctttagatatgatggatgaagatgacttacagttaatgaaggatttaggacaaagagtatcttttctaacaagagatctttcttctaggtaatacttcatttgggttataatcattcatatccatttagtgttaaaaacttggttctgaatttcacttaggtggttcaaggtgttcacctttgagcacaatgtttacaaagaataaagtattatttagcttatttcctaaataaaggaggttcatgtataagataagctgatttcatttaatgtacatctttcttttgagtctgaatagtcaagtagagtgaatgggggaagaatgctgttctcactttgaggtagtggcagaacagttctgagttcctacggctatgatttcacttaatcctcattaccctgctggtaggtcttattcccatttccagagaggaaactgatggttccctgcagtcacaagtatctggaatttaaagttggaccttttaaactccaaagtctatgctatactctaaagattttgggaaagtaagagtcacacttggttttatgaactgttcttcataaagaatctgctgtaactttcacctttattttgcatctagagggaaaactggatgtagccaaagtttgagtttgtatggtaggttgtttacccatttcttttattcatttgctgtttgagtgcctgctatgtgccagacactagcctaagtgctactatccatatacctattgaaagttggctggtggtttttctgtacttttgaaatgataggtctctagataactttttagatctattaagactgaaaattgatctttttttcccctgcagtgagcctgttcatgcgaagaaacggaagcatgaacgcattatagataaatatgaaaaaataccaagaactctgcaaactgcaccagagaaggaactgattcatttacttcctatcaaagataaaagtggtataatcccacagactagggagaagccaggtgagtctaataaactggtaatattagttgaacttttacccccttactgatatcatgtttttttttcactcaaaatttaattttactttgattttacccatatctagaaaatattcaattagtcttatagcaagcttgatgatttgggccagaattatagattatctcaggtaccaatttgtactgtgaggacaactgaagctacaaggttcaggtgattttcttttcactaaattttgttgtttctaaaattagagcatattaactgttcttgattagctttcttttttaatgtatcttcttttgtatgtgaaataaaacagaaaagttcagatatcaaagatgtgaagttacatggtttataacaaagcgcatacctataaaactactattcagacaaggaaaaaaaactactgctagcttccagaatcctcccttgtgctcacctcaatcactaattgtgctcttcccataaaagtaactgctatcctgagttttatcgtaatcacctcctagcatttctttacagtttttaccacttaagtatatatcacagttttaatacatatgttttccatatagttactgatagtaacaaagatgaagaggatcaagaagaagagagggaacttgaggaaggtaatatgtctttacagttactaaattgttaattgagaatttttttgcataatagtaaatgtgagttaattttagatgaaatctggaaggtacattttggagtactgctcatttcaaggtcactttgaacatttttccacatttgaaagcttcatcttgtggaattattaatagattctttatttttttgattatggaaaaatttacacaatcatatttgtaatatctaggcatacaagaagtgtgtcttgttaattattactgttctgaattccttttaattgtaagagaaagactacttacaaataactgttaactttttagctttaaattacaaaagcgattctgtagtatgaagtcattttggtttgtttctagcacaattatacttgcatatgtttcatataattgaatgtcagtttctattacctaggaccatttaatcaaagttgaactgaaataatgcattttattgtttgaaattatattagtttggaatttgtgacagaacaatctagttaaattttactttcgcttagcagacctcattaatagcaaaaatgaattacaggtcaactgtttaactgttttcagtcacccatcataaaaccattacagattatgctagtgttgattaaatctagttccctatgaatttcctaaggtggacatgtttttctgtagcccaaaactatgaagtattagtttgtataaagtaatatatagtgttaaaaacaaaggagaatattctgtacttaaaaaaaaactaaataggattatcctatttgttaattaatatgaattattttgggcttattatcatagaagctaagaatatgagctctaggctggttgcactggctcatgcctgtaatcccagcactttgggatgctgaggtgggaggatcacttgagcccaggagtttgagaccagtctgggccacatggtgaaaccccgtctctacaaaaaacacaaaaattagctgggtattgtggctcacctatggtctcagctactggggaggctgaggtgggaggatcaattgaacctgggaggtggaggctgtagtaagctgtgatagtgccactgtactccagcctaggtgaccaagtgagaccctgtctcaaaaaaaaaaaaaaaaagttctagaatcagactgcctgagtttgaatcctattttcctttggtttatgagcttgaatcctattttcctttggtttatgagcttagccaagttattttctcttcctttgcttcagttttcttatctataaaatgggtccaatgatagtacctgtattgttgaggagatgatgtgtagtagtaaatacaaaattcttagctgttgtcattattattattactgtaaaaatattttattaagattcttggatacttgtaagcagaggaatatgtaagggaacatctaatctgttttagagatcattgaagatcctattcaagagctgaccatagaagaacatttgattgagagaaagaagaaattacaggagaagaagatgcatattgcagccttggcatctgccatattatcagatccagaaaataatgtaggtagtattaatttctttaggctctttgtattaggtatggtgtaaatgcctaattgttaagattcccttgttacctataagcatacactaaaaggaaaagcattaactaaacatagtagctgggttagagtaagagagtagacagaatcttagcttaatgctatgtctgaacttaatttcttttgtaatcctagaaaagttacttaaactctctgaatcttattctcctcatcttcatatatgaaaatactggacatcttataactctaaaaatgtttaaatttataaaattgtattagggaggaggaacctgtttgcaaatttgcttgacatacccgtggagtttttaaaaagcgcgctacaggggaagtgtatggaattagttcaggaatatttgtaagttgaaaatattttaagtgaactagagccaaagttaaagtaaagtgttattgtgccatgtgtatagtcgttgagttagtgatggttataacacatgaactagagaaatctgaggtttaatcttggccctgataagtactatctgtgagactttgggtaagttatttatccaagactctttcatctctaaaaaaggacagtgtctttttcaaaactttgtggtgaggattatatgatgaaatatacgtgaagtcatataaaatgatactattattattgttatgctggtgtccccagcatactattataacaagtatttgtttatgaaatgatagaatagcttatttacatttatagaagcaaatttcatgtgggaatgctttggagtagtacttgtccttttctaatgaagtgaggggaagatctagagcagaattagggaagagagatttggaatatttcttatgtgtattctctcaatcattacaaaaccataggcataagagattgatctaattttacagctggaaaattgagccttaaaaaacccaagtgatttgttccagattttaacagccactggattggaacccagatcttctactcaggaacctgtgctcacagacaatagtagttcatcaaagcagtcgaaaccatcatagaaattatctttgaagctcaagttaatgtggctatattacatgtaattcctgattaattcatgtgtatgactgatatatttggttaatgtatataacattttagtatattttgaaaagcgtttttagaagaataggacacacgtactttaggaaaatccagcaaaaaagaatttcccaaaatagctaaataataaatgtaaactaattttttaaggtctgtatgtttctaactatatgacaaaaatatgattactgatatagtttggaggtgtgtcccctccaaatcttatgttgaaatgtgacctctgatgttggaagtgggcctggtgggaggtgtttagattataggggtggatccctcatgaatggcttggtgccatccttgtggtaacaagtgacttctcactctggtagttcatgtgagagctggttgtttaaaagagcttagaacctcccctatctttcctgtgacaccctggctccccctttgccttctgccttgatcgtaagtttcctgaggcctcaccaggagtagacgcaggcaccgagcttcctctacagcctgcagaactataagccaaaataaacctcttttctttataaattatccagcctcaggcatttctttctagcaatacaagaacggactaatacaattactttatgactttagtgacttatctcttggtaaagtgagcagggtctggagtttggtgtggcatgactagacttggagtcattgtgtgaattccgcttgttttgccggatgtggggctgttgtcttttgttcataattgtttcgtcatgatttctccagctttataagctatttctttaacagattaaaaaattgaaagaattacgttctatgttgatggaacaagatcctgatgtggctgttactgttcgaaagctggtaattgtttctctgatggagttatttaaagatattactccttcatataaaatccggcccctcacagaagcagaaaaatctactaaggtaatgctagattgctagatataattactatctaaaataactaaacattttggagagatagactttttttttttgaggcagagttttactctgtcgcccagactagagtgcagtggcgtgatcttggctcactgcaacctctgccttccgggttcaagtgattctcctgcctcagccccctcagtagctgggatcacaggcatgcgccaccaggcccagctaatttttgtgcttttagtagagacggggtttccccacgttggccaggctggtctcaaacacctgacctcaggtgatctacccgcctctgcctcacaaagtgctgagattacaggcatgagccaccacgcctggcctaaacgactgccgcgttttttgttttttgtttttttaaatagtactgggtgtatactagacacacatattttatactaattttgggcttttaatgttctgattttaaaaaatgattgacctttttggtcttttcagacccgaaaagaaacccagaagttaagagaatttgaagaaggcctggttagccaatacaagttttatttggaaaatctggaacaaatggttaaaggtatattaaacatatcttcaaagtttgtaacatacttagccttgatcatgaaggtgaattctgtacagtgttctgtgttgtgtagtgagaggcaggtatggtcaggaacagaatctagagtcagacttccaggggtcaaatcctggctccaccacttactacctatgtgatgggaaaattacatagtctttctgtgtctcagttttcctgtctaaaaaatggaaataattatagtacttaccttccaggattattgtaagaagtaactgagtttgtagatatgaggtgctttaaacagtgcctagcatgtactatacactatattttatcaattattagtattattgctgcagtttttagtaagtagttgtatttttgttgactacaatgcatttaacaaaatacattgttatgaacagttgggatttattctgctgttttttatttggaggcatggtagtcagggaagaaggataactagaggccaggcgtggtgggtcacacctgtaaccccagtgcttttggaggccgaggcaagaggattgctcgaagctaggagtttgagaccagcctggggaatgtagtgagactcctgtctctaaaaaaaaaaaaaaaaaattaggcatgatggcccatgcctatagagccccagctactggagatctgagctgagaggatcacttgagtccagaagtttgagcctgcggtgagctatgattatgccactgcactgtagtctgggcgatagagtgagaccctgtctcaaaagaaatgaataaataaatagaaggataactagaaatggatatttgcatgtcttgaaaatggatttatgagtcaattatttgggatgataaactcttaaactcttcagaaaaggaaggacatagaaaaaataggggtaggaatagggaagacagttgttgcctaggccaggtgttttcatttggcctaattggctcatttacccagcttatttactaagatcacccattgctgtcagctggaacaggaccactgaatcctgttggcctaataagggcataaaggtagtggagtatagtggggtgggggtgggtagtatggatattgcttctatgttctggtgttccagctggcaccctattagtgtttgttcttccagtgagagggcctgggagtttttcttttgtttttgaatttctgaactgtttggaaagctcctgggatctttgtgcaaccatctctgtctgatagaactataacatgagccacatatgtcatttaaaaaaaatgcagacacactaaaaagcaatgaaattaattttaatagtatattatatatattcagattatcatttcaacatgtaataaattttaaaaattaatgtcttacattctcagttttttttagtactaagttcaaatctggtttgtattttatacttagagtgtattttatacttagagtatatcttaatttgtattagctgcatttcaaatgctcaattgactcctatatgtggcagttagtagcctccatattggacctttcctgagcagatcgaaccattatgaagtctttttttcttcttcttttttttttttttttttgagacgatgtcttgctctgtcgccaggctggaatgcagtggtgcagtcacagctcactgcaacctctgcctcccaggttcaagtgattcccctgcctcagcctcctgaatagctgggactacaggcgtgtgccacccaccatgcctggctaatttttttttttttatgttagtagagatggggtttcaccatgttggtcaagatggtctcaatctcctgagctcgtgatctgcccaccttggcctcccaaagtgctgggattacaggtgtgagccactgtgcccagcatatgaagtctttttttaaggggtgtgggaatgtgtgtgtgtgtgtttatgtgtgttaaaatgtacattgattgtaaaagaaagccaattagtttaacttttgaccaatgagtaaagtaactacagttatcttttgattagattggaagcagaggaagctgaagaaaagtaatgtagtttccttaaaggcatacaaaggactggcagaagtcgctgtgaagagcttgtgtgagctgttggtggcactacctcattttaactttcacaacaacatcatcgtattgattgtccctctcatgaatgacatgtcaaaattggtgagttgctgtaaatggttattgctgtcctccttagaaaattatacaccatgtgggccaggcacggtggctcacacctgtaatcccagcactttgggaggccgaggcaggcagatcacgaggtcaggagatcgagaccaccccagctaacatggtgaaaccccatctctactaaaaatacaaaaaattagcagggcgtggtggcaggcgcctgtagtcccagctacttgggaggctgaggcaggagaatggcgtgaactcaggaggcagagcttgcagtgagctgagattgcgccattgcactccagcctgggcaatagagcgagactctgtctcaaaaaaaataaataaatgaataaaaaaagaaaattatacaccatgtgatttttttccccctacaaaattcttctgaagttatttattggtaaaataatgtcaatttattaaacactgtctatctgaagaaaattatctgaacataagtttggtgtagtggttcacaacaggaagcaaatttgtcccccagggaacattaggcaatgtcggcatacatttttgattgtgatgactgtggtggcgatagagtcttaactactggcatctagtggagaaagtccatggaggcttttaaacatcctaggacagtccccctacaacaaagaattctgttacccaaaacgtcagtagtgctaaggttgagaaacactggttaagtatgacattttatttttcagatatctgaaatgtgttgtgaagctgtgaagaaactctttaagcaagataaattaggccaagcttctcttggtgtaattaaagtgatttctggttttgtgaagggcagaaattacgaagttaggccagaggtgagcctttttttttttactttgcattttgtttttaaattacaaagttgattttcagttgttatgaggaatttattccttataagtgtatgaagtaaaaagtattcaagctccttaagtgtttaacatgtcaactcctgaaatgtttgatactattaacagttcggtatttatccttctagatgtttttctttgcagatatagtcatatatacttgcttatattttaaaataaaaaatgggcttatactttgaaaactgttctggaacagttttcattttctatattgtgaacttacatatagggttatcccattctttctaatgcctaccagagtattccattgtgtgccctaattgttgaacagctgagttttttctagatttttgctgccacagtcagtgttgagaacattttggccatattattttttcatattgtgtgaatattctgtgaattaaatttataaaatgtagatgctggatccaacagtaatcacatttacaaactcaaattgttgttcaaaaacatttaatcactgtgttcctgctaggaatatgagtgtcagttccctcctacctgctcagaatgttactatttaatctttgttagtcaggtaggtgaaaagtttatatatatataaactttttttacctgcttattatttgtcagtttttctcttaaagtaattgtcttaatgacttgtgatgagtttttagtacatattcattttaataaataactgctatgtgccaggcactttttttaggtcctgggaataaaatagtaacaaaagaaacgaaactatctgtttgtggagcttgcattacataaagaatattaactctttgttacataggttgcagattgttctcttttttactttgccttttaattctgtgttcagccttatatatgaagctatattttttgttatgcacatagtctcctcaatcccaatttacggagtctctccgagatttttaattttaatttttatatttaaatatttaaaccatttgacatctttgtatgtgtggtatgagtacagatttaatatctgtgtttaatatatgtaatgaatatatattttatatagtttaatatatattgaatatttatattatgtatatatttgatataatctgacagccagttatttcatcaccattttttttctgctgatataaaatgctgcttaattattgtgttatatctatagtatatttgggtatgtggtacaataataatcagaaagggtataattgataaaagacatgactattcttttttctccacaatattcttatttatttcagtatattactccaggcagtttagaatccatttttcacttccttccctcaaaatagtccacacagagaatctgattagaatcgattcaatgtattgattagtttggatgaattaaaatatttacagaattgatttttttctattcaagaatatcatatcttgccatttatttaagacttcttttatgttcttaagtaaaattttatagttttcttcactgaggtcttagatattttaatttgtctttagtaatacagttttgggtgttaagctgttctaccattttatttctggatttcacagttttcctttggcatcagattcctttttattttcttaaatctgatttcagttgaattgctaaaattataaacattaaatgaaagtaacagagcatatttagcatctttacttagaattgtagagcaatcagataaggcttgaacatgaaactcagccataggaaaaccctttaactttcgtgatgctagagtaaaaactacatcatttgatttggagttatttttcgttggtaggtgatattttgagcacatacagtacctacaaaatattcagagttggtctttctgatacctagaatgacttcaggttcactctttatgcctttagttattccttgtttcattctgtgcttttagccgtgtaatcccaaatactcagctttcttccaaatgtgcatattggaacatcaaaataatacaaacctgtagttctcaaggttttttccaggaatgctgctgtgcctgcgggaggtcggtagggtgatttcatccagagaaagtgtagcattttaaaccccttttgttcttagtgtttgagtatgcgaagtttgctgtatcacacaaaacaccagtttccaaattagtttctgaatttttgaatggcataaagcaataatttttatttttgtccccagaccagcatcagctgggaattagaatgcaaattctggggctcaactcagacctactaaatcagaaactctggggatagggcccagcaatttgtgtatcttctcccatactggtccaaaccttttcctggcctgttttctctttgtcatcctgttggcatgtgttctctcttccttatactcattaaactgcaaagaaagttttgtatatttagttagtatttgctagcgtccgttttgtatgtttgctcccgtccttccatagacacaagttattaatatagcatacagataaaagaagttggtgtaaaatgttataaaagatgtttgaaggttttttcatgaacgagggaaataacactgttaaatgcttttctatgtaaagtttttgagggcaatataaatattaagctgtatatttgtgttttttttccaatattagatgttaaaaacatttttatgcctaagaatcaaggaagtagaagtgaaaaaagatacagaagacattaataaaccaaaaaaatttatgactttcaaagaaaagagaaaatctctatcaagaatgcagagaaaggtttgacttatttccccttttgtttcatttaaattttctgtttatttgatcttagattaaacttataggcacatgtaaaaatcatagttaaatcataaacataaaagttttgaaatacatcatttagagaattttatcttttcctgttactgcaaagaaatgttttcttaaatcagttttaactgataatgattggcaaggagagcaatagatgaaaagatatttttgccatgctggcttttatcctttggctttttagatcaatttagagttatgatacacagattccttccttaacagaaaagatgcattcacgtgaagttggcagcaaagtgagtttctgttaattgaatcttgtttctttgttggtttgtattttaaacttgggttgaaatttcagccgcttgtttatttactgaaactttggaaactttatttatttatttatttattttttgataaacggggctaataatagtacctaccttgcagggtaatcgtgcaggttaaatgagatgatgcatataaaacacttggcaggctttataaaccttagttttagtaccaccaccatcatcactattattgttatcatcacatctcagaacatttctaaacagtttattagagtgatcaagttgcttgtaaaaacaaaagtaatctctggggatattcatctttgaatgggtctaattttgaaaacatgatggaagtatcaaaatagacttaataattgtgaacaaaagaagatacatattttaactatttatattatactatcctaatgcaggttggatagctctgttaggaagagcatgtgtatagatgaggtgaggaaacaaagaccaataagaacatggcagctctttaacaacttctcatgagagaaggaaacaatttttcagttccctgtgcctcaggcagcttagaaattatcatttactgctcttacagcattaggtagtagaaaaaaaaggatattttattgaatttctttatagggcccagttttatgcattgtatgtaaatgtgttggggaagtattgttggtgactggcttccaagttatagatgatttaatcctagccattatttttgggctcaacatgttctttccttttttttttcttttttgaaaaactttaataatagaaaatgatagcatatcccagatatctgctattcagaatgagcaaatattaatagatttactttagtttttttcctggaaaagaaagaaaccataggtgagagagtaggaatttcttttctctctccaatctcattcttctaccttcttcccaggagacaccatctttaatttggtttgtatatacttcccgtccatgtttctctactttgtttatatttgcattcatagacaacatgtggtattactgtatgtgttttatgacatttacgtattctgcctctgcttttttcactctgtggtatatgctcttagatttttgtttttcaatctattttcagtggaagaaagcagaagagaaactagagcgagagcttcgagaggcagaagcttcagagagtactgagaaaaaacttaaactggtaggcagtttcatattctgttatgcttttaaaatgcgttaagttgtttaaactagaaatttattgtttcagcttgtagctgtgtaattttggtttctttcatgaggcttagatgtgtgacttttgtgatgtgcgggaaactgtgatgtgatcagtgctagttttatgcagtcacagggtgtatatcttcattctgttttgttaaaaatttcaaagattgcattgtggggagggatgggtagggaaaaaagttaacctgttgaagtgatacttatgctcactcaggagaaagcataccaggttatcctaaagtcattttgtctgtctcctctgccagcacacagagactctgaatattgtgtttgtaacctacttcagaatattgaagaaggcccagaggtcacctctcctgccagcagttctagaaggtcttgccaagtaagggctgtgtaggttgaaatcttttagattccttctaaataggaaagaccaaagaattttcgagagttccctaatgatggcccattatcctcagttctcattccttttctgattgtcaccagcctttacttgaagctattcataacagtgggcttttttgattttctcatctcaaaccttttatttttaaaatctcctttaccaactccttctttctgcctactaaattctaggtgttcctaaggttaaatctctcagttcttgactctttctgcactgtgtagtcaattgcccatcgtcatagtttgagtggatcatgcagatgactcttaagtctattttaacccggctgtacatcatttctctagttctgtgtaatgtgtttctgctaagatagatcttttggtgtattcactcaacactaatggccttgtcaggatgtgagctagagtaagggttgtggttgtcatgatagcgttccacaattttttgaggtggtatcctatagaacattgctattcggtaaaaatataatgtgaacttacatatataatttaaaattttctattagccacattaaaaagataaaaagaaacaggtgaaattaatttttatatattttactggatttgatttatctgaagtattttaacacaatattaaacattaatgagttgtttggtgttttttcataacatattttcgaacacttatattttacgcttgtgtcttaatttggactagctacattttaagtgcctaacagccacatgtggctagtggctaccattgttgggcagtacaactttaggaatagagttggaaataggactgatggctagaagatatagaaaaggcaagttctgtttatcataagaaattactttctaataactggagctatttggcaatggtatgcatttccttatatggtgatacggtccttgtggttaaaaatcttcagagaggctggtcagagaagggattattcctacattgtgtaggacttgctgtttttatttttgtttttaaatagagacaagctctcaccatattgcccaggctgatcttgaactcctgagtgagtcatcctccagccttggcctcacaaagtgctaggattacaggcgtgagccaccatgctcgacccagctatttgttttttaataactaattcctttatttaaaaaagtttaaaaaataatatatggtcatttaaaaaatttaaataatgcaaaagaatatacaatttaaaattgcaagctccccctcctatatatgtatgtagtctgtctgcgtgccatctgccacctttttttttttttttggagacactgtcttgctctgttgctcaggctgggttgcagtgacgtaatctgagctgactacaacctccacatcccaggttcaagcagtcacctgcctcagcctctcgagtagctgagactacaggcatgtgccatcacacctggctaatttctgtatttttagtaaagatggggtttcctcatgttggccaggctggtctcgaactcctgaccttaggtgatccatccgcctcggcctcccaaagtgctgggattacaggcatgagccatcgcaccgggcctgcctgccatctttcatgcaaatggaatcatgctatgtttagtgtcctgtaacttgcttttttttttttttttggttttgtaaacagttacttttggtacctctcccttatcacatatatatcacttaatttttaaaaaatttatagtgctccattttatagatatattgtactttatttggtcagtcgcctatttgcactgggaatacttgcgcacgtgtgtgtgtgtgtgtgtgtgtgtgtgtgtgtatcttcatgcatgtgtgtgcatgtagtgccagatcaaagggtatgctcattttaaattttgataaataattgtcagattgcttctccaaaaagttgtaccgatatgcatggaatatgtcactcataaggtcttttattcttctaagatttacatagatcaaagacttcttgctaatattgaagagatgtcctgactttaacctacttcagtgtctactatagtatatggagtaactctcaaatttagcagctcatatgattcttctttaaccctattgggtggtctcagttatttctacaaatagaggcccaggacagtgaagtgagttacctaggatcacgcaggtaattaagagcagagcctgaactagatactggggtccagtattctttccattttatccttaaagctgtcataaggtccatattcttgtaagtagcagaatctttccttgtctctcttcccaccacctgttttcttagaagccgatcctgccggatacctcctaaactttcctcaggaagttgtttgcttctagtaatttctttctcagtgcagaaggatttttgaaatatttttggtttgttcagtgccttatatatttctactgagtttagtgttcaatggtgtatgaattgttgaagaggccaatctgaattaatgaaaagtatcaataattgccatgtctttcatagctaacatttcgaaataaagaatattaaaaatacagttttaaagtcaagcttaatttctaccagctttatttctgcttttagttcactgattaactgttttgtttgattccaggtttgctcaccttataaatgtggaattttttgatgatctgttagtagttcttcatactctcattgagtctggtgtaagtaataataaattattttttaaaagatataaatggtaattactattttaaaaatttttcaggtttattgagatatattttgtatacagtaaaaccccttttagatgtacagtttatgaattttgacaaaggcctatgatcatatgattaccaccacagtcaagatgtagaacgttttcaaccattggagagttttaagcaggagggttgtctgacctgttttcttttttttttttttaaattgatgcataatagatgtacatggtttcagggtatatgtgataattaaatatattcatataatatagtttgtaaatattttacttgggatatcagtcaccttaaatatgtgtctttatgtgacaaccattcaaattcttccctcctagctattttgaaatagataatagattattgtaaactatagtcaccctgtaaatctgcctcatactaggttatcttaaagataacctttataggtcttttttttcttttttgagatagggtctcactcagttgcccaggccggagtgcagtggtgcaatcacagctcactgcagccttgaccttccagggctcaggtgatcctcccactttagccttttgagtagctgggactacagatgtggggcaccatacctggctaatttttctatttttttgtagaaattttttttttttttttttttgagagggagtcttgctctgtcacccaggctggagtgcagtggcgtgatctcggctcactgcaagctccgcctcccgggttcacaccattctcctgcctcagcctcccgagtagctgggactacaggcgcccaccaccatgcccggttaattttttgtatttttagtagagacagggtttcaccgtgttagccaggatggtcttgatctcctgacctcgtgatctgcccgcctcggcctcctgaagtgctgggattgcaggcgtgagccaccgcgcccggccctgagagatgggtttttgccatgttgcccaagctggtcttgaactcctgggctcaaatgatctgcctgcctcagcctcccaaattgctgggattacaggcttgagtctttgctcctggccttaaagttcttttttaaagctataaatggcaattaccattcttaatattccatccccctcaccccccccttttttttttaaaggacctaagctatcaagaaagtcttcactgtgtccagactgcttttcatattctttctggacaaggtatgatattttcttaatcaagttttgtttgccttacctttgaatgctataacatacctaattggtgtttgttgtcatttcaaaggtgatgttctgaatattgatccattgaaattctacacacatctctacaaaacactgttcaaattacatgcaggtatgtatgtttagataatgtttcttttatatgtatttatgttttaagaatatgttatgacccatcattgtagacaaatgagaaataggaacaggtacataaaatggtgactttccagtgccatgcatctgtatttaatcttatgtaagacttggagaaagagcttctggaattgactggagatgcagtaagtatagcccgctgtatctccttagcagtatagcactacctcattgattagagaaatggtttgggacaggtacaaaagtttatcttgggtttatctgaagttcagtccagttgcgtaatgaaaaagtaatgagaacagctctgaagaatatgtctgctgttttaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatgtaagtagtgatacaaatgaacagagctaagttcttataatgcaatgattttttttgtttgaggcatgtcttttccccccttttatattatttcaattacagaagtaattcacacttgtaacaaaatcaggtgacaaaagaggtatataaaattgaaaaaaagcattttatacctattgacacttctcagtgtcattaggtgggtatccatttaccatttggtgggtatttttccagcagccttttaaagttcatatataaacacatacacatagaaacaactcaactttgtattttaatggaaagaggattatgctatatattctaccacttttttaaccttagcatttaatcatggtaaacacattataatgtcactactctctttatgtaaggtttatttaattctttgcttaacaaacaccatagttctgactatgtgccttccagttataaatgccttacaaaaatttaattttcataactctgaggtagctactattcttgttcctattgtacatgtgggaaaactgaggtccagagaggttaagtgtcttggcttgagtagcagtgccagtcagtggtagaagtgatattcaaatgtaggcagtctggtttttctgcttctttctatttctcttgatataggttatttctttttttgctattacaaatgatgctatagtgaatatctttatgtatttatctgatgtaattatttctatcagatttctaaaagtgtgattgcaaggtgagaagcatatttttttcttttgcaagataaaattaattttcaaagcaagcaaagataaaatttttttttgcaactcttgttcttactatataaacttaaattgttttttattaaatctaggtgtaaagactttatgcaaagctcttatacaaccataaatttaaatgcaaatacaactacaaaccagtaacacctcttatattaacaatgttaatttaaccaattctttttatgtgacatttttgcagactttccccaaaacagatctactgcttgacagtgaatctcagggaagtggagttttccttcctgaactggatgagcctgagtactgcaatgctcagaacactgctctgtgggaactgcatgctctgcgggtaagagtggccctggtttttttctttttggggatgtttgtgaataattgttttccagtttttcttcaaatagttgttattgccagagtacttaattatattttgttctggggctgccttttttagaattcctgtgttagtatgctacattttactttgctgttactattctttaagctgttgaggtacattttctaaggaagcagaaaacagtgtcagttctgtagggtgcagttgtggaagatttactgaaacctttccctttattgaaatctttccctaacactcttcagaggatttgttatcaggtacatttctgttgagtcttatccaaggagactttagtaagccctgtttcaagatggtttcacctatgcagtgatcctacagtatggacagcattagagtgagacttgtagaaaatagaagtggcaggtaacctgttgtaaattaacttttttcactctgaaagaggaattgctttttgatttttctatttatattgtaaaagcaagactaaactacttcactggtaacttgatttgtgttttaatcctattagcaaagataatattctttctgtgggtatgtgcttctaatgaattacatatactgtacataggtgatgaaaaaaaatttggtgtaattttatttaagaaaatctttgctgtggctagtgttttttgtaaaggactgacctgtgcagaatgtgattgtcccgttttcccttcagaggcattatcatcccatagtgcagagatttgcagcccacctgatcgctggagcaccttctgaaggctctggagcactcaaaccagagttgagtcgaaggtaatatttagcattgccttattctaaaactacagaattgagctgatagccacttactatgagaagactgtttcataaagtaacatactacaaaatgtaaagtgccagttgggtatctggattggtcttgcttcatattcctgaattgttctgaaagaaaacatgctatgattttgttgatcacttaaaacattttttttcttcttctgtcattcaacttgaaaaacatttttttaatcgtgaaaagtttcgcacatacaggatagtagaatggcatagtgaatgtccatatgccccccatcactcaggttcaacaatgaataatctatggctataggtgcttcatgtgaagataaaacacaagtcaaccaaattaagcttccttgctttctcgctcgctcggtcttttttttttttttgaatggccctgttagggcaggatgaggagaaaaaaaaaatgaggagagggaagaaaagaggtgctttggaacactgccatccagaagggcagctttttctttttttggcccttgcagagtaccttctgacctataagcagcttggatgggtacttccagcatctacctcacacccagatggggaaaaggtcctcctaaaagagtcttcttttccctgaactgtttacttacaaaattttcacaagtacagaaaggtgaaaaatagtaattactttttttttttttttttgagatggagtctcactctgttgtccaggctggagtgcaatggcgcaatttcggctcactgcaacctccgcctcccgggttcaagcgattctcctgcctcagcttcccgagtagctgggattacaggcacccgccaccatgcccagctaatttttgtaatttttgtagagatggggtttcaccatgctggccaggctggtctcgaactcctgacctcaggtaatccacctaccttggcctcctaaagtgttgggattacaggcgtgagccactgtgcccagccagtaattacctttttttaaatacagacaggaaatacttaagttatacagagaaagagagaaaatggtataaaaaatccctcagtccatttatggtgccataaaaaatgcctaagactgggtaacttataaacaacagagggccaggctcagtggctcacgcctgtaatcccagcactttgggaggccgatgcgggtggatcacctgaggtcaggagttcaggactagcctggccaacatggtgaaaccccatctctactaaaaatacaaaaattagccaggcgtggtggtgggttcctgtagtcccagctacttgggaagctgaggcaggagaattgcttgaacccgggaggcggagattgcagtgagtcgagatctcgccattgcactccagcctgggtgacaagagcgaatccgtctgaaaaaaaaaaaacagaaatttattttctcagaattctggaggctgggaagttgaagatcaaggtgctggtaggtttggttgactgatgagggcgcctctctgcttctgagatggcatcttgttgctgcatcttctggaggggaggaaccccatgccctcacatggcagacaggacagaatgggagcagtgccacagcttcacttcatgaagcctcttctataaagactttaacccatttatgccagaggttgcaaattttttttgtgtgtgaaaaatcagaccttggcgatgaccttgagcagtaggatataaataactcctacaagcttagtgttctgataatggaacactagtaggcataaatgggttaatcccattcatggcttaatcaccttttaaagcttttgcctcttaataccatcacattgactgttaagtttccgtatctgaattttggaggggacacattgaaactatagcaccttacaatgtactcattacccagaattaatattttgctgtaggttttttccgtttgcaagcccattggtttctgtaattcagagatcatagtttggtgacctgtgggccaggccgatttttctggcctcaagagtttgaaaaaaattgaattagttgctgtcttttaaatattgaaagaattcatctgaaattcacatttcccgcttttcttgaaatactgggaggtttggtgacattggcttgtattttacatgacagtagtcagtcagttgctgcctcctctacatgaggcaagagctctgcagttttccatgagccctttccttctgagtaggatggagataacttttggccttattaaataaaatggccatttactttttcttccctcacacttctcacctgtccccagtcttcaccccaccagcctttttttttaaaaggaaaaaaggagaaaacaattctttgtcactcttcataatgattattttatggcatgttttccttagcagttttgctaaggaaagatgtttcctttgtggagaaggatgaggaatgagcttatcccaaaggcttaagaaaggagactcatagtgggcttctggagagtgggtattgggatgtgagcctaattgctaccttcgtaggcccttgcctatgtgttttggcgagtgtgaactaattccaaatcattaaggattcatttacacgccatgggtatagacatgtattctgtcctgaatggcctttccttgtttttcatccaggccagtagctgaagagttgagctgtgttctaagtctgtggagaatgactccatgcttcagtcctctggctcccatgactaagatatacttagttgcattatcagtgggttgggatttgatcacactgaactggagttcttcagcttagctttctctctggagtctatgcctgtattgctaaatgtataccaaacctctctgaggtggatttagttggataatgttgacattacaatgggaatttagaatttgttaagtgactggattggttggttagtttcaaatcttataccttaatatatgggttaagaatgaatcattctctgagtataatctaattatttttgagttacacagatgtggtggtatctttacattttttgtgtttgtgatttagatctgctactgaactttttgaggcatatagcatggcagaaatgacattcaatcctcctgttgaatcttcaaaccccaaaataaaggtatgggatatttttcatttttttaaaggaagaaatagaaaccaatgtatctcaataactctaactccagtttgcttaattattttataggtagttttttttttaatgtttaggatttcatcataggatggatttctgaggttgaaattctatagagatgatcatgaaactgttcgttcaatataggatatgtccaagaccttaccaagcatctgtcattgtgttgcatgtgttggtgtcagctgttgccattttcaacttggttcacaggttggctttagcttatagcataagtaacttctaactcatactttaaatattttcctagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttcctattcttgtgatatgataattttttgaaaaaagcacagcagtccaactaaagagatctcttactgtttgaaagtcatagcagccagttattttactctggagcttagagttcttttttcacatgaagtaaacgaaagtagaaaattcctttaccattccagcagagtgagaggatatgagcttaacagtgtatgtcagtcttttagcatattatatatgatttttaaaagtggttctgaggtcacattttttaaggcttgattatttaatgagaaaggtatgattcagcatatgaatatttgcttttagtccaccttttaggtataaaacaaagtccaggaatgtgataaatatttgtgtggataaccaaagggtctaatccccatcagagcacaagtgaccaatacatgtcacaaattatttattttccacacatatacaaatacatttatactttactttggcagcagaaactatacttctggtgaaaaatcagcttaaaatagaaactcatcagctatttcacagctgtattatgcctttaattttcttgttatacatatggagaatcacagtgggactacaaaattatacatctatatttgagtatcctatgtgaatttgaggaaatatatttgtgcattaacttacatacgcttatatgtaagcttatgtttaaacacacacacacacacacacacacacacacacacacacacacaggcacacacatatcctgaggctatattaagctacagccttaatttgttttttaactagacaaataatgagcacctactgtgtgtttagcactatgctggcacttaagagtggggtgggaaataatgggtgtaagacaacctcagtcttccatgctgagtcaaatcatccacataacgcttttgaaaaatgcgacagtacccaattcagtgttagaattacttgtgtcaaaagtttagagacctatgtcatctgcaatagggaaggtttcagagatctgtttggtgacaggcttgtgcatagtatgttttgaatctaagagatgtataagagtaggtaggccaggtgtggtggctcacgcctgtaatcccagcactttgggaggctgaggcgggtggatcacgaggtcaggagttcgagaccagccttaccaacatagtgaaacccccgtctctactgaaaataaaaaaaattagacggacatggcgcacacctgtagtcccagctacttgggaggctgaggcaggagaatcacttgaacctgggaggtggaggttgtggtgagtcgagatcgtaccactgcactccaggctgggcaacagagtgagactttgcctcaaaaaaaaaaaaaaaaaaaagaataacttggtaatcatagagactcagtatgtgtttcaaagggactcatttcaggtattcctatgtcagaatccatagccatcagccaaggattgcttttaggaagctgctacataaggatggcagagaacacataaattattaacaatggatcatggggaatattgacccaagtctagactctgtataagagacaatctcccttttctctctaacttttttggggtcccaggtatatcttttctggcctcactgctgatatataagcaactgaaaaggggtcagagactttcaccatgagagcactttccctgcaggctgccaatgtaagatcaaagacaccagccaggaaaatcctactcttctttactagcatgggagcatagatgtggagttttgtgttttagagttaattcaattttattgggccagtaagcaagccctgataactttccagaattaagcaaggcctgtgggtctctgggcagaggacagaagtctatagagatattggaagaggagagaagaaaggaaggggacgatgtagttagcaaaaggtaaattgatacatatcatagagggcccactttcattaatgagcttccagtgtctccagaggtattgagatgggaggcataaaagcctcccataaaagaaagcaagtttgattaaaaacaagtcacttgtaactcaacttttgttgagtctagacttcatattgactcccaactggagaatttgtaaataacttttacttgctaatgatgacatgaaaagaagctttacccctcaaagggcactttctacccagataggatcattcctacagatttggcatcactgaatagagtgacagaattcatgctcctttctcttcactttcagtgatgcttcttaaaattttgtaatgaccccaacttgcatatttagattcttgtccacatcaactttaatgagaagagtttgctacccagatttctggtggcctaaaaagtgtgaaatggtaatgggtatagtcatagtggctatttaggataatttctttcacttggcataatatagctgtttaattcagaaagctttaaataaaacttaaatattttcagccaacatcagattgtgctggccatttgtgtataatagtagactagactctttactttttttttttttttttgagatggagtctcactcttgtacccaggctggagtgcagtggcacagtctccactcactgcaacctctgcgtcttgagttcaggcaattctctcctgcctcagcctccccaatagctgggatttacaggtgcccaccaccactaatttttgtatttttagtacccagctaatttttgtatttttagtagagacgggtttcaccatgttggcctcgaactccagacctcaggtgatccacccacctcagcctcccagagtgttgggattacaggcatgagccactgtgcccagccaactctttacattttgaaacaatgtgttctttctgtaatcccaaagactcaaatacaatgaagtatgtactttcacctcaaaatgtgataaacaactaaattgggatgcaacctaggcagtaggctggattctctcacttgctaaacaacctggtctcaacttcagtctcagatttatgttgtaaaacatacacctgtgttaaaggtcatggaggaggagtggggcagcgcttagcatcagaatcaaatgtgataaacctaaagagacgagtcttttcatcttgttactctgcacagttttcatttggcctctagccacttagaccagcaactcagttttcaacacgtggtagggcaaactgtttggcatgttcacttatagaggcttgataaagtgtttccggaatatttttaaaatggagcagcattgtgcatttgttagaatgaatatttgacttaaaactgtactactgtatagattacatcaaactggaatagcctgaattctgttgacaagaaaatggtagttctagccttaaggctttgacccagtaagaactttcaatgacatgaaagctgtatggtgtttttttttttttttttttttttttttttttttttgagacggagtctcgctctgtcaccaggctggagcgtggtggtgcgatcttggctcactgcagcctccacctcccaggttcaagtgattctcctgcctcagcctcccgagtagctgggattacaggcacgtgccaccacgctcagctaatttttgtacttttagtagagattgggtttcaccatgttggccaggatggcctcattctctgtcctgatccgcccatcttggcctcccaaagtgctggagttacaggcgtgagccactctgcccagcctgtgtggtgtatttttaacacttctgtttttagaatatgcaagaaacacatggggatggttttatttttataattggttaaaaaagtttctcaaagtgaagtttaggagtgagttttagtgttttgtaatttgaagaaaagtgtcttaaaattcaaagataccaatggaaagataaaagtttgggttttagaggaatacatatttcatttttaaaattcataatttgcttcatactaagaatatgaagaatcctttacacttaatggttttgtacagcaaagtttaaaaataatttacattaaatggcaagtatgacttggatcaatagctcttcagttaatgagaaatgaagcaattttacttgaaagtctagcccatttcagatgttcagagcatatattttctttttagaagtttgtcttcaagtactgagaactaatgcttctaatccatggcaatatcaagagagcgatgtataataaatatataagtatagtgtcagtacaaaccttgcaaaataaatttaaacgccaactcaatctacttttgctttaaaaaattgttaggtttcttgttaagacattgcaattcagtagatattaaattatacgtcattctaaattcattttgaaaaccaaaaatgagtaatctaatctatgattaagcaataaccttttttaaagcaaccctattaactgaataggcaataaccttaaaaaaaacccaatattatttctatatgtaaaaaaatcctaaagaggagtgcactgtggtacacaatacaggaactaaattgaattttaatgactcttatgttataggacatatttacacttgaaatgccccaaagcttctaattctaagcttctaattctcggccataaaatgtatggctaaacttcctttcctgttttcagatctttgtgctccttgttcccagttctcttctcttagttgtgttggcaaattaaggtccttgggccaaatctagcctgccacctgtttttgtatggcccctgaattaagaatagtttttaagtttttaaatggttgaaaaaaagtcaaaacaagagtatttgtgacatgtgaaaaatatatgaaattccaatttcagtgtccataaataaagttttattggaatacagccacgttcgttcatgtatgtgttgtctatggctgcttttgcactacaatggcagaattgggtggttgcaacatattttatggcccccagccctaaaatatttactgtttggccctttacagacaagcttgctgacccttgctctaagtcaattcgtgacgatttttccaactgctgacatttataaaatggcagtcccctgggcttcattcatcagtaaattggttggtggcaactagccctgtgccattttgcttctcctcagcatggatctcacatgtgtgaaggcttcagttcagaaatcatcaatttccagtttaagtctgatgaaaataattatattttttccaccatgttcactctttaacttcttgcttaaagatcttcacctgtaatgttgtatacagaggcttattagtatactgaaaatgaagaaacagaaacacttgcggtataccaagggttcagagttttccagccacagctctagtggctaggtttggggaagagactgtttcctctgtactcacaatgttagaacatgatgtttctaggaagtagaacattaggttatttctgccttggaaataaatatttcacattctttagaaagtttgtttttttaaaaaagatcacatcaaataaactgttcaactttaagaaaaggtggaattccttcagctaactactacttcagatagatgaatatgttctttaaaaatctgtagattattgaaactttaaaagggatcattttagaacaaatatgaaatatgttacctaaaaagtggaaacaatactaaactaactttctttttgctctctctccctcttgtctggctggactgctgcctccaaagttcaagcaattctcctgcctcagcctcctgagtagctgggactacaggaatttttatattttttggtagagatggggtttcaccatgttggccaggctggtctcgaactcctgacctcaagtgatccacacacctcggcctcccacagtgctgggattacaggcatgagccactgtgcctggtcctaaactctaaacttcttttcttatgagctcttcttttcttttacaagtgctctttcttgaaaagaccattgtaaaggaggtcataacatgggatgtcaattcacatagatgcaccaatgactataagagaagcctccctagcttttgttttgagacggagtctcgctctgtcgctaggctggagtgcagtggcgcaatctcggctcactgcaacctccgtctcccgggttcaagcgattctcctgcctcagcctcccgagtagctgggactacctgcgcacaccaccacgcccagctaactgttgttgtatttttagtagagacggggtttcaccatgttggccaggatggtctcaatctcttgacctcgtgatctgcccgccttggcctcccaaagtgctgggattacaggcgtgagccactgtgcctggccaggcctccccagctttaagcaaagctgtgaagttaacagaatgattctaaatatctgcttgcttagaaaaagaaaaaaaaagtcatgtgaatccattggtcagaaaaaataaatatctacttgctacaggacaatagaatctaaaggcaatcatctaaatcactatcaatcaccctcccccagtctcctaaaatataagcaattagcaatgttcattatagtaggcatattatttttaagtcaaatttctaatggagttgtattcttctgtacttaagaagtaatcttgtagcacatatcgggctctttatatgtagagaagtatatgaccaatttactagctttagtgtaatttcacctcattacagaagttatagaggtgtgtataacatcacacctatgatttatttgatactaacttctggatatggaaaacaatatttaaaattttgaccactgcagagtgtaatataggacatcagttattttaggagttgctctttaaatgtggaaacatgatctcaatgtattgggccttcttttgggctgttttaagtaaaatttggctctgggaagaggcatcactgagttctttaattgtgagtttctgcagtttggcagttttatatcagaagttcctcattgtcataaaggcagatggtgaagctctgtcacataaacagcaatgctttcactgtgctgttcatcttgggaattttaaatctgtgaactaccatggaacaggtgaaaagtgggctttaatgaacccttaggttcattaggaaactaagcgaaaaggagagacttaccactggttccctcacatgcttttattcaggtctcatgtaaataatttgctttaagatagaatgaaatttgtgtgactatcaagcagtcagtttactgcatttccaagattgaggctgttatgttattttgctttctttttaaccacatcccggatgccagatttttatttttttaattgaggcagaaggagatgaggttgttgaagctacatcaaacctaaattagaacagtaataaaacgagaaatccaaaagaataaaagctgaatgatccatagagcccttgaagaatgtttctgtcagctattaatactgaagacagttgtctgatgaaataaggctatcagagtactttgggcaagttgattgacttcttgggagctttgcttatttatctacaaaataaataaggggtctaaaattacaaaagctcaagttacatatatatatttttttttttctttttttttttttgagacggagttttcactctcattgcccaggctggagtgcaatggtgtgatctcagctcactgcaacctctgccttccaagttcaagtgattctcctgcctcagcctccccagtagctgggattataggcatgcaccaccatgcccagctaattttgtatttttagtagagacggggtttctccatgttggtcaggctggtcttgaactgacctcaggtgatctgcctgccttggcctcccaaagtgctgggattacaggcatgcgccaccacgcccagcctctttccctttttctttataggcggtgttcaatagcatatcatgttacacatatcttcagagcccttttcctgttttaaggtcccattcctacctgccttcaagggacatcctcctgttggaaaagataaaagacattgtactaattatgccttccttacaaagtagtttaagttaagccctgttccaggatggtgcaatgacttactatacctgggttaaacatgctgcccttagtcactgtcggtaatccattgtgtcactggaggacaagccacccacaggtttctcctccttggtttggatactttctgaggtcaagagctgagaaggtgatgtaagtcctcggggctgtttagttgacttggtgagcttcttgagttcacttgcgaaagaaatgcctttctttttatcttctcgagatgcctgtgggaacaaagaaccttccattggtgttaggttaaactcaggttcctctgtcacatgacactatttcagaagagcgctttcctcttctctctagagctttggagagagtagggctgaggagctcccctctaggactgcttaaccgcaagctcggccacatgttttttcacacagtgaaaacaaagccaaacaattttctcctaactccattccttgactcaggaactttctcctaaatttcaccagcttccagatctggctacagtgtaattatgggtatcagataacttaagaacagagcaaaataactttaaactttacctgcacctgctcctttagcttaaggatgaattttcctgcacctttccacttgctttgggcttgaaacacacactcctgatccagaaggacccgctgagaggactttggtgtggtagtcttcttgttggtagtgtctttcaccacctcttccaaaagcacatagtcgcttggattggggttgctcaggatgctgtaggaatatttggctttgcataaggtctgaaaggtaagttatgatcaactgaataaagacacagaatctccaacatttgcattcattctatatgaaactttaaggtggaaaaatggcccagactagagatgaaggggatcttccagatcatttcatccaactcattttgcagttgtatagttgtagcttgtaatgtaatttcccacgttacctcatttagctttgcaacagtctatgaattaggtgttattatcctgaatttcagacgaggaagcttatacttaagacaggttaagtagattccaggatatatacagctataatagtaacaataaaggtctgaaccagattttctgcatgtaccagcgctcacagacatgaaagtcagccagtgaggaatagaatcttgctcttcaggagcgtctctgtcccactgggctatctctatcacagagtcttggatgttgaaagaattttagaagtcaactgatctctcttttcatttaatataagaatgtctttcattgatgcatttgttaattcattaaatgtttagtgagggccaattatgtcccagatactgtgctgtacttttaggggagacaaagataagttaaagaaatgtaagtctgggccctttggaattcaaagtcagttgaataagatggctaatattaactaagttatcatacagtaagaacagcaagtaacccttaagtaatgtttaccatttgctaggcattgtattaaacatcttacatatacttaaccttcaaggaaagtactatcatactatctccatattgtctatgtggtggtctatgtggtgacttaccatgtagtgttttgctggagccaacgggaatagtctggtgaaatcagatatggtaggggcatttacacaaaagaaataaataagggcttttatctttcttttacaaagagctggtttaccagcacactactataactaaggcacagatctgagcttttactccaggtctcagaagtagagctgggatttgaatctaacacagcttgatctagggtctgtgctcttaattgttgtgttgtatgtcttctcaaataggtgtttgatgaatggcctaccctaacaaggctatgaaggaagcaaacttctctgaaaccatgtaaactctcagagaagcgtgatttagaggaggggagaggatcagagtaggcctcctacttgtcctctgtaggatccttgagagatggtcagtacctactggcttaggtatttctgggaccatgacattgtcactgcagagtcacttcctaaatccattattatcaatgctttatagagatccaaactcactgtagatactaagtgtctgttgaaggaatgaattaatatttccaagattttaaacttttaaaatttgtttttgtttgagacagggtctggctgtgttgcccaggctggagtaaagtggcacgattttggctcattgcaaacctctgcctcccaggctcaagcgatcctcctatctcagcctcctgagtagcagggactacaggtgcatgctaccatgcctggctaatttttgtactttttttttttttagacgaagtttcactcttgttgcccaggctgacgcgcaatggcatgatctcggctcactgcaacctctgcctcccgggttcaagcgattctcctgcctcagcctcccaagtagctgggattacaggtgcctgccaccacgcccagctaatttttgtatttttagtagagatggggtttcaccatgttggccaggctggtctcgaactcctgacctcaggcaatccacccgccttggccccacaaagtgttgggattacaggcgtgaacccccgtgcccagcaatttttgtactttttgtaaagacagggttttgccatgtcagccatgctggtctcaaactcatgagctcaagtgatctgcccccctcagcctcccaaactgctgggattacaggtgtgagccactgggttggttgttttttttttcaattagagacagggcctcactctgtcatccaggctgcagtgcagtggccagtcatagctcactgcagcctccaactcctgtgctcaagtaatcctcctgcctcagcttcctaaaactgggattacaggcatgagccaccatgtgaggcaatttcccagccttaagaggcacacactcccctttgaggtccctgttgttgaggaacttcactcataaaatgagccatcagtgcacagacatttgttccaataatttatgctgaggaaaggactcaggtgaggaagggagaggcttttacctgctgaatgacatcctgtgcagtgctgacgcggggtgctttgatgactgttcgaggttgctctggagaaacatcatgcacttggacaaagaaactctcctcctctgagctcaagatcacctctttgtcatcttgaacaatgtttttctcttctaggttctatgtttaaaaagaaaaaatgtgagtaaataataggtttatgcagaataaagaaagacaaatctagcaaaaatctgagcttgtatcttggtgatgtagaaacttcttagcttaatatctcatatactatgttattatttcataaactgttctaaaaggatatacctatctcctgagaggaggaaactactgtgcttctgatgatgttgatagatccataacaagccaatttatctgctcctattagctgtgggtttttttttttttttttctgagatggagtcttgctctgttgcccaggctggagtgcagtggcatgatcttggctcactgcagcctccacctcctgggttcaagcaattctcctgcctcagcctcctgactagctgggattacagatgtgtgccaccatgcctaatttttgtatttttaatagagacagggtttcgccatgctggccaggctggtcttgaactcctgaccttgtgatccacctgcatcggcctcccaaagtaccagggttacaggtgtgagccactgtgccccgcctagctgtggattttgagagtccaagttgactgtaggtaaatttgtagaaagacaatataccattttgccaattagcaaaagccaaataagaacacagtaaattgtatttaaaagaaagctcacccatttccacagacgttgagcatttaagaaatgctagacatctgaaatataaaccatgaaattgacaggttgggtgaacaaaactgcagtgacaaggctgaatgaatggctggaggtaagccacattgaaacaaattttgacaaaattcacagtaaaattatgagaattagattaattggctttttggtggattatgtatctacagatatatgtatcttattaaaaattttcaaacagtacagaagcgtatcaataagaaaaaccaaacttttcccattctcatcttttttccttctcccaccttattcgccacaaaataccccactgtcattggataatacatccttttaaacatttgctgtggatgttcaaatgtatttttgtgtatgtgactatgtaaagcaacacccttgaattaggtgaatttagatataatgtgattgtcaagcagctgctgctgttctttgtccaccacattttcaaatgaggatagcttcccttttgcaagagggagacttagtaaaagggcagggagaggtaaagtaagtaaacagtagacaacctcatctcagcaagtgaggtcttggcaggaaaactcccttatccccagaattctagcctcatctctccagaccaggctactgaaatgggtgctaactaactaaccagaagaatccatgagttgctgtcgctatcttggaagttccaactagaattgtacccattgattaaagtcagaatagataactgccaccaggtggcgccaaaactgcaaccagggccagaaaggactggcttctgaagcttgccccaatcatttaattaactttgcaatcatggccttataattacatgattttttgttaaataaataaagatatataatctattttaacttttttcaatgagtgaaaaaatccatttgatttttttcccatgaatgaatactccattatataatggaagggggggaagagatgagctattgtctctttttacataaaatgagattgtatcctatgtatactgttttacaacttgcttaataatatgtcattgcactgatcatcatatatttaaccagtcagagagtaagattgagaggtaattcacatgacataatttataatctttgtcccccaaaccaggaggcaagaaatcagaaaaccagagttggcacataaaatgtcccaacaacgatgcattaagctttatttttaagagagcacccttaggaggctgaggcaggagagtggtgtgaacccgggaggcggaatttgcagtgagctgagatcgcgccactgcactccagcctgggcaatagagccagactccatctcaaaaaaaaaaaaaaaaaaaaaaagagcacctttgagcctccctcagagcttattttaaggtatttctagccacattagttcgaagccacaggttatgaacaaaataacaatagccctcacttatatccctttttactaagcattgttgtacaccttgtctgtgtacatgtttgacatgagtctcatgatcatttctttgagtcaagtagggtagtttgtatatagattttacaaattagggcagtgaggtttacagaagttaggtggtctgttcattgtgacaatcctggtttacccaatttcaaatccagtaacagaagaggacacattgaccacaggaagatgtggtatctgacagcttgaaagcccaggagacaagaaaattataaaaggcaggagagatcagaggtcacagagagcaactgaagaattttcatatatgggcaaactgcttatatgtcttattagttccatgggataaaataaatggaaatacttatagcccaaatctgtctcctctagtagtgccctcttacattcagtaattactgaattcatttattcaatcagcaattattatttgggtatcactatgcaccaggtaaacctagatacactaaatttagttatcttttgagatatatttcagtcatttcaaaaatttcctaacaaaggcatataaaggacaacttgccatattttacttatcagaaaaatcttgttagccttcccttctgatttatgcccctttttcttcaaaatgccttcctttaccagccttttggaagcatattcctgaggtccctactgcctgttgtcatatacttttttttgtttttaaagatgaagtcttgctctgtcacccaggctggaacacagtggtgtaatcttggctcactgcaacctctgcctcctgggttcaagtgattctcctgcctcagcttcctgagtagctgggactacaggtgcctgctaccacgccctgctaatttttgtatttttagtagagatggagttttgccatgttggccaggctggtctcaaactcctgagcctgccttggcttcccaaagtgctgggattacaggtgtgagccaccgtgcccagcttgttgtggtatacatttaaattgcatttgggtgtccctcacctccccagctcctctgagcataaaatgaagcttcctgtgacactcagcagccagcctgtcttccctctagcctacccactgcctcctgctcctcccaaggtgctgagtgtgggtgatccacaaggatggacacaatttcagcttgggtagcacaggatggtggaaagaacactgacctggaagccatagacttgagttctttctacttctaaccctgtcatgatttcacctctctgaatctatttccttaagtgtaaaatggtttccattatatcattcaacatagtgtttgagggctttcaacgctgtaaatcatacacaagtatgaggtttacaaatttactgattttctgacatcgcttagaggatacatactttttacatgtagctaattaataaggcaagacaatttaggaacaggacaaaaatttagacattaaagatggcttcaaaagtacagctaagccctctgatattttatcataaagtgattattattagggttgcctggtctctgtcttagcaattagtgtgtcttaatagggagagaaggctggggagacaattacatttttttgcttaaattaaatgccctttcattgtctcaggcaaggtcagggaaagaaggcagtggctctgggctctagagttgatgctagagctctgtagaggctttaggtcacattcactcactgtgactagaaagtgaaaacacacaatggttaaaattggctattatcttcactgtgccctagcaagcatgggcctgaggcaccttctatcaggcaagcactattacatgccccaaaggagcagatcatgtgcccagaacagggcttggtacatattaggtgctcaatatttatgtaatcaaattgttgaatagactcaactgcttgactatcaacatgtcatgacgcatgactgtctatgctagagaaatgaccttatatgtcattcttaagttagtagggttttctcagttaattcagggaaaaaaaaaagtgcttcatcaattaagtcaaacaggagccaatcagtttggagtcaacatggcagttgttgcatcctttccttcccaggaatgatcatgggaatcttagcacacgtaatataaattgttactaattctgactcaggccaagatattattcttactttgtatgaagttctggaatattttcaaagaaatattattattttacttgtaagcatggaagcttctattagctaaaacttctattagctaaaactggaagtcagtcatccccagaatagaaaatacctgcaggttttgcattatacagtaatgtgaccctcacaacgatgtcttttcacacatacaaataaaatactggacccatagctgatgacatgcataaggaatctttgcttcctttatcttataaggtatgtttttatttatttttaaaatggaatagtttatttgtgtgagaaaacatatttccttgtctttttttttgagacagagtcttgttctgttgcccaggccagagcacaatggcacgatctcagctctctgcaacctctgcctcctgggttcaagtaattctcctgactcagcctccctcatgagtagctgggattacaggtgcctgccaccacgcctggctaatttttgtatttttagtagagatggggtttcgccatgttggccaggctggtcttgaactcctgacctcaagtgatccacccacctcggcctcccaaaatgctgagattacaggcgtgagccaccacgcccggtctaagggatgttttttagattgaatttctgtaccttagagataatattctgattatgtgcagaagaataaaactgttcatccacatttacttaagaagaatataaaccaagttgcaattacaagaaattctgaatttcagggaggttgtgagtggtaaatggctaatcacataatgagtcgttactgtgtaggctgcacccagacacacttacttcctgctgggtttttaagacaatcctgcccatgtatccctcttctggaaaccagctgcttaaaatttgcatgatctcctcttctggaccaatggctctctggaatggttgtttcctacattcattcttttctttagatataaaatatttttcttccatcaaaaaatagtctgtggtaacaggtttgatgtcttgttcatttgtcagaatctaaagaaaaagtgaaggcaaactgaggagtgaggcaaaaacttaaaacaaatcaactttcatggtgttcagataggtttgctatgcaatttataagtgaaatttactctagagtattgcataattctttttggaagatctaagaattctcttatgttcagaatggattgtttatgttcactccgggcaacggcacaacttattcataatccccagacagcataactattttttcccactgctggaatgagagctcctagtgaattaaaaattttaggtttctcattccatgaacttagccctttgtaatcttgcaacacaggactgagggcaaataacctagtttagtatttactaagataatctctttttctcacattggaaatactcggtcatcttctcatggaaggtttgtagggctaggttctcatgtggtctaagttcctgggaattcttctttaaataaacttctgacagtgtgcttaaagggcttgttttctttgttggctgctgaccctgtgcagtcaaacagggcagctgagacaaagccctggaaccagacagacctgagtctgaggtctgcctttaatacttgttggctacgaattattgggtaagatacttaatcccttggagactgttttccgatctacacaatggaaatagtagcaatcttaattttgttttatggttgaagcataaatcataacatgggtacattaggtgaactcaataaagatgagccattatagttactttttttttttttttttttttgagacagagtctccctctgtcgcccaggctggagtgcagtggcgtgatctcggctcactgcaacctccgccttcccaggctcaagtgattctcatgcctcagcctcccgagtagctgggattacaggtgtgcaccaccatgcctggctaatctttgtatttttagtggagacagggtttcaccatgttggccaggctggtctcaaattcctgacctcaagtgatctgcccgcctcggcctcccaaagtgccgggattacaggcattatagttttaccaatgtattttctcactcatattgtacaggttactacaaaaggctgaatttgaagggagtaaaggtcagttgcagtgaagaaactccctttgttgccttcccgtgagaagtagcttggtgatgagagaaagctgccaccatctggtctggattaagcaaacacccttctcctcaggcccctgccaataaggcaaagcccagagcgaacacatctcaccaggaggaaaagcagaatgtgatggactgagggcagtgggagtgaaggttctcaggaagactgaaatctctccaccccagcccttggtctataaatgatgaaatgctgttgactcaaaagggggccaaggcaaatactatagggataattcaggatgtgaagcttctgggccacctccacaagagggccagcatcaccccctgctcagtcctgctttatatctgtgtgctgatttgcacgggtgacagtaaagcaatggactgctatgggtggctcttggtaagttttcctttacaaaacttcagcagtgctttgtgatagtggacactaaagtacatggactgatgtattaaaacaaaaccaaaacaaactgttggtaatagcttctgtttgataatctatgaaatgtgacacctgagctgttttctctatttaagtcagttataaaatgttggacagaatgttagcctgtctatagagatgtgcccttgaaagacagagccatttattgacacttattatttgtgattgttcagttggtttttaattcctccaaatgttatgatcccagctacatttcatcatacaccctaacttcagagggagctaaagggccattcccttggtcattgcttcctttagtctactcctattcaggagaaggaattcttttttatctttttgagacagagtctcactctgtcacccaggctggagtgccatggtgttatcttggctcactgcaacctctgcctcctgggttcaaatgattctcctgcctcagcttactgagtagctgggactacagatgtgcgccaccacacctaatatttgtatttttagtagagatggggtttcaccatgttggccaggattatctccatctcttgacctcgtgatccgcctgcctcggcctcccaaagagctgggattacaggtgtgagccactgcgcctggctgcatggagaaggaattctgaaatgggttaaggataaaatcatctgcaaggattttaggccactgtgccaagcaaggatagcgcttctggtgtggtgaaaaaaggaattacgcatgggccctgcctcgccctttggaggacatgccccctccctctttggatgctgctccatgtccctggctctctcactcttagaagtccccccatggatggggacctgtctgcagaaggccacaaagatccttcggagggggatctagggcggaggtggcacagcataaggagacttaggccagttctgctacagggcttggggtaacaggtctcagggtctccatgcctcttgctaccaccaaaaggagaggacctcaaatgccaaggtcaggtgccaggggaggggagcaagggggctgctcaacatgcaaaggaaggccttaggctggaggggcagaaaatgtctccttggtccacgtggcccatcctgaagctctaagaatttgattcagctcctcagatggcaagaagattccattcacctaatgtgcaaattctgattgattaataatctctgcgtgaagaaggaagattaggccatgtctaggcttagggcgaaagtgtatatatggttggaaggccactcattccggtctttatcattctagagcctggtattttatatagcttaagaatcattaaaaatcttctctacaggttgaaggtagtttgtctagtggtaccaagatccatcaggtgattcttggagtggatctcaatgttgaataacacatttccaaataatcaaaaggcatatcatccacatggacttttgcgcattcatgtgcatctgtgtatgtttacacacaggcatttatacacacacatacatccatacatcttagattttggattctcccaaccacggctcagtggacttacttgctgcagaagctgctttgccttggtgcctccattaatagtgaaaacggtaaagggctctggccctgggaccccatgcaccgtgactctgtgagtctgcaaacattttctttcttctgtattaaacatctgtcaagaagatcacatggctgatcattcatccgtaatcacatatttctaagctctatttgatacagaggtgctagtacttagaagtacggataggaacatgtaaatgcaaaagatgagagtccatttgtagcctagtgctacaaatggtacctcttcctcagtcatttagtgagggtatttcataagcacatcaccaaaatattattttaaattacagtgtctctttccatcataattagaggctgatattatctgaaatgtatgttagttcttactcattaactgatgttccatagtatctattgagttccatctctcttcagggtactgggctagaaatttggatggtaataataaaatgttctgcctttagagagtacatcattcaggcacatgaatcattagaatgcaaacatatatctgttagaaagaggtcggtaagtgtgtaactcaattcttcgggcattttgtgtattaagatatattcatttgaaataaataatttatggaaggcttatagtgaatcagtcattatgcctgtccctagaaaatcaggggcaaatgggacactatccctgccaagggcttccagttgaatgagatagctagaggggaaagtaggcagttgtaaagagcattttaagttccagaggaggtggcctagaagaggtaagggagaaaccagggagggctttctgaaaaatggtatctgaaccaaatcttgaaggacctagtgtaatttagcagatgaagaatgagacaagagaaccccaaattgacgtaacatgtgtatgaagacttagaaatggcctacagcagggcattctgggaacctcagcaagttctacaactaacctgttggagggagaaaggctggagatgcaggcaaaagcacagccattcagggctttgcctaactggctaaaatttagactgaaactggcaaaatgaggacctgagggctgaagtgtattgtttagcatgtacttaatttttatttggggtggggaggagaggttgtctttgttatgcttgcacaatgtgatttttttaaaatcagttttactgaagtataattgtcatactataaaatgcacacattctaattgtatcatttagcttgcactatattattaattaaaaagattaaatagttgccaacatttacaaaaccccagatgtcctgattctcttgaaaaaccaagagatctgacgacatcacaaggcaacaagcagctagagctgagagctaggtgacagctgcccctctaaatgacccatgagctcccctctaaatgacccatgagctctctgctttctaagagtctgtgctcagcccaggtccatgcctgcacatcatcttcttgggatcctcctggcatgtgaatttgttacttctggtataaactataccctgaaagcaatggagaactgatggagggttttccacagaggagtgacatgatcatatttagatagatctgtttgggatgccctagatgaggacagacagaggtggcaaacccagaggaaatgagaccaattaggaagactctaccacaagccaggtgagaatgaaccagggccaaggcaataaagacagatcaagatgaatggatttgaaagatactaaggaaatagaatgatcaagtcttaaatggggcagaaggccaggatgatctacagttattggcttcagcaatggagagtgatgctctccatggtcaaatgcacatttaccaagcacatatccatatatggctgcccaggaagcccaaggatggcaaggtgtgatataacaaaaaatacatatttggtctttgtccccagtttctgccacacagctcctaaaacctttgaaatctctggagtgataagagtgtcctttgttgctaatgagatgattggtggctgagaaagaccaaggcatgattagaagggtgaaaccttcagccctgctgccagacctcaaggaggggagggggctgaagactgaactgatcaccagtggccaataattgaaccaatcatgcccaggtcatgaaacctccataaaaaccctaaatgatggggttccgagagcttccaggttggtgaacacatcgaggttctgggagggtggcctggagaggacatggaagctctgcactcctcctcccataccttgttccatgcatccttccatgaggctgctcctgaagtacatctgttctgatcaactggtgataataagcaaagcactcttgtgagttctgtgtcattctagcaaactcttgaatctgaggatttatatggatcccctgaatttatagctgtttggtcagaagtcctggtgacaacctgggacttctgactggcatctgaagtaggagtagtcttgtgggactgagccctcaatgtgtgggatctgacaccaactctagatggatagtgttagaattgaactgaaatgtaggacacccagctgttgccagagagttggaaaagacaccatgtttttggtgtcagaagtgtcgtgagtaaaaacagttcatttgtggcatctgtggaatcttcagctgtaacagatatcgaggtcacccagctcagaattgggtatttggccctgctctgcctttctgaaagcatgtgattcctgctctttgtaccacgcggccctgcccttgcttgtcaatcctctgcacaaggtggaagccacacctccctccactttggccaaagtgctcttctaaaccttggacacatggtgcaatcgcctgatgatccttaaaaaaactgatgcctggggcccacctgcagagactctggtttaattggtgcggggtgtggcctgtgcacatggagtttttaaagctccccaggtgatacaaatgtacagtgaaggttgctgtggagtgatgaagggaaaaaggaggaacacctaagcaaacaagggcagggacagcgggagtcaaaactgatagtggtgagggcaggagaagggcagaaaagaaagcagaaagtggcagtggaagccatcatggccagtgccattgtgagcgcagaaggtgcctttccaaagattgttaggactacgttgagtctgagattgacacagaagtaatcacattattaaacatgtaaagggggtaaccaatggatacacttttaaaatgtatgtttaaagaggaagcataatggaattagccagttaattaaagtagttgttttaaaaataccttttttagagacaggatctcattctttgtccatgctggagtgcagtggtgtgatcatagctcactgtagcctcaaactcctggactcaagcagtccttctgcctcagcctcccaggtagctgggactataggtgctcgacactatgctcaattaaaacacgttttttaatagagatggggtcttgcccaagctgatcttgaactcctggactcaagctatccttctgccttggcctcccaaagtgttgggattagaggcatgagccgctgcactcagcccagattcttacctaattaaaccatcctgcattagtgagggggccatggtccaagtgtcctcaaactttagtgggcactgagtttccatgaggcacttgttaaaaagcagattctggccaggtgcggtagctcatgcctgtaatcccagcaccttgggaggccaccttgggaggccaaggcatgaggatcgcttgagtccaggagtttaaaaccaacctgggcaatatagtgagaccccatctctatagaaaaacattatctgggcatagtggcacacacctgtagtcccatctactcaggaggctgaggtgggagaattgcttgagccaggaaggtcgaggctgcagtgagccaggatggcaccactgcactccaacctgggtgacagagtgacactgggtgacagagacacactgtctctggaaaaaaaaaaaagcagattctgcaactatggcactttctacagtgtccttcttccattctcaagggagcagcttctgcatctgccaagcactgaggtgcaagttatgcatcgccagcagagcctattgctcactccagccttgctctgcctgtgacatttgcccctggactgctgaagaaacaaaatattttcctggtttaacctaaagtttctagaagtattggaaatgcttcctactaggcttcgcataataagcctcttcctcactttgttatatttggcttacttccctgatagacactgtaatatatgggctttgttactggaacttgggtgtaaatcctggactgctgcttgctagctgtgtgacctcagatgtacttagctctacctttctcatctgcaaaatggagatgatactaaatagctactgcctgacgttattgagaggactgagttagtatatacgtaaagtgcttagtcagtgccaagtgtcagccattattgttattaatttccatagctacctaattaataactcacaccgaccactttgctgggccacaaaaaagcccaccttcagtgtagcaatccccataaatatgttgagtgaaacagaacttcattaccgaagaggctgacatggtattgccagaggaattttcttccatccttctgctgttaatgaataaactagaaatctccaagacttcattgtgaaggtttcgcagctgaagatgtcgatatcctggagtaatacagaattgggaaaagcttgttaaccatggctactgaaaagaagatgctcctggaagtcggcaaatgacaggtagaaagaccttaaaatgggcagggatggcaacaggcatgcaaccaacaggcgtcttttcgccaagagagtgctgccccctgagttacccaatggcaattaatttgtccaagtactgtttccaacttagactcaaacagaaaaccttaaactcagacaaaacctgatctagtaggaaaacctgatcactaacagtccctgtgaatgaagcactaacagactaacagtccctgttttacaaatgttccatcttagagcagctttagtgataatagaacattcccacaatggaagattggttataatttatggtatgactgtaagtgtaagtatagaatggaataatacacagctggtaaaaatggtaatgtacatgtatagttattaacatgaaaggttgctcactgtatacattagtaagtgaaaaccagtaagttacaaaacacaaagattagtagaaagcctgtttgttaaaaatatatctgtatgctcatgtgttacgtacatggggagagaaacaaagcctgcaagacttatacaccaagagtgactgtgttggagagatggaaaaatggataattaaaaaaaaattgtttttgtttctatgtactttctcacatttctataataacagttatgggtctcccccgaccctatactccccattcttgtgtagaagtcctaaccctcagtacctcagaatgtgactatatttgaagagagggtctttaaagaggtaactaagttaaaatggggtccttagggtgggccttaatccagtgggactggtgtccttatgagaagaggggattaggacacagacaacatagagggctgactgtgtggggaccatctgcaagccaaggagagaggccctagaagaaaccaaacctgccaacaccctgatctcagacttccagccttcagaactgcgaggaaatacatttctgtggttcagccacctagtctgtggtattccatgatggcagcctgagcagactaattaaatgaccacgggctacttgcacacagaagagaaacaggaaaagatcacaaaagtaggaaactgtaatgtgtttgtgagctccaaggatggcagcttgagtgtagctgggagaggaagtgtgtacttagaatattggtgctcaaaggagaccatcagagccagcacacctggaaatatgttagaaagggaaactgtcagtcttcacctgaggccactgaatcacgatctgcatggtattaccagtcctagcagattcctgtgcacatcaaagtttaaaaacaatgcacaggctgaaattcatcagagtgccacaacaaagccaatctacaagcaaatagctctagcctttgcccagaattctccattcccctcttcctgcacctgaaacccagccccagcttccaaaactggacttctgccaggcaccgactccaactgcacggtcacttatgccaccaccacacccgacccctctgacatgtttcctctccttatttcaatccctgctttcaaactgccagcagtgccgtgggtagcaacaaccactgctcctgacatcagcaagcatgggtgaggctgtactttacaagggatattgttaatacctcagattcttaaaaaatgtaaaagaaaaacttcttttgagatgtgcttcaaaagtgctccaatttgtatttccttttgcttcttaattcaacttctttataggaaaatgtcaaacagaaaagagagaagagtataaggaaattctggcatccatcacctagctacaacaattattaacatttggacaattttattctacctcgttttaaagctttcagtggaatgattctctgagcagttaccgctgaactattgttttccacaactgcaaaacgaagaaatacaagatcttcgaagtgaacgtggaacagaaactgctcgttccacatggggttcagggtgtttcgatggatgggctttgtgcggaaatggcagctgtccagaggcatgcccaggacgtcgacttcaatgcacgggcttcccatgctattactggggcacacattctgaccagagacaatctagggtgagggagacaaaagggatcaaagtcaccgaggataaaaaagaaagacaacctctgcacctcactgcttccctctgcaaaggaatcccaagaacactggaatggacaaagtgaatgatgaataaaactgtttaaaaagtaagtgattgtagggctgggcgcggtggcttatgcctgtaatcccagcactttgggaggctgaggtgagcagatcacgaggtcaggagattgagaccatcctggccaacatggtgaaaccctgtctctactaaaatacaaaaaattagctgggcatggtggtgtgcgcctgtagtcccagctattagggaggctgaggcaggggaattgcttgaacccaggaagcagaggttgcagtgagctgagatcacgccactgtactccagcctggtgacagagcaagactccatctcaaaaaaaaaaaaagtaagtgattgtaactgggtaatcacacgactggaatcatatgaaaagcctattttgtcaacatcattcacttaactgtaagctttcaactatcaaaatgttcaaatatcttcaaaaaccaaacaagatgaagttaaatttctcacaagagaagactttatgcaatataatcataaatttgttactaatattctgttcaaaatgccacaggattttataacttcaaaatctttttcttgaatagtttcattttggagcaagtcacagacgtgttaggaactaattcacagctttctgtaaacagataaaactaccctcgcctctatctaaaaaataacaaataggaaaggggctactgccctgctgtcttagggaaagagaaaaagcagtttgggtggtaggaaagtctgtgaatggggttatcccaggggtttgggggtgtcgtacttggagggctgcctggcattcttcctgtggagagagagagacaagatctaaaggtggaaagagatgaccaggtctctgttgttgttttgttttgttgaaacggagtctcactctgtcacacaggctggagtgcagtggtgcaatcttggctcactgcaacctccgctttctggactcaagtaattctccagcctcagactcccaagtagctgggagtacaggtgtgaaccaccatgcccagctaattttttttgttatttttttgtagaaacagggttttgccatgttgcccaggctggtctcgaactcttgagcgcaaagcgatctacccacctgggcctcccaaattgctaggattacaggcgtgagccaccgcacctggccaggtctgtttttaagaggagtctgtggagttttgacaataagttaattaggtgaaaaggaataaggaaaggcccaggaatgataaaggttaaattatacggaggaaatatacttaattgtatttatatattgacatgagtttgatcttagagctttgaagcctaacatgagctgatctaacaaaaagctcaacttccatgggctatactcatagttatgattctgtgggccctggaagacagagttaccatcatcagaacatcaggtgaaacagggacctcatatgccctgctcctgggctctggcaaacacagtgtctggcaacagcttgtctagccatagctactgcttcctggaaaataaatacattattctgggaactaaatctgtatgacccaaattgtgacatgacagctttccaatgccttgaattcaaaaccagttcgttttcaggaaggcttaaacccgaccttatgttctttctctaggggccgtacttacagttaaagaatagactgcaggatccatgctgtccagatctctttctagtggagaaaacttctgatacatggggcagttcttgtcccacagaactggaggtttcaatacataaccacaaccaccatttgcctcaaacattgcagcatttaaatgtaaagggagatctgtaaaacaaacaacaaagaaagccaatatagcttgttactttgtcgcttaagtatcaccttataaattgaaagttcaaaagaactttgcatcaattttccctaagctccagcatgaaaaagagataatcacccattcgtcccacagattgataaatgactactatatgccaagttgtgtgaggcatcagatacagcaggtaataagagaaaaattcctgtccctctggggcttacagtctatggatatgcccagtgttaccactccaaactaggtgaaatcacttaaaaactcctttgcaaatatttgctacatctgtctgaaaaatcttgtgaaatacagttgaccatgggggattggttccaggacgagaaggtaccaaagtccacagatgctcaggtctgtgatatagatggtgtagaatttgcattataacctataccatccttctgcatactttttctttttttttcccctgggagcctagattcaagttgccctgaatatattctcccccttctgtatacttaaaatcatctctagattacttatgatacctaatccaatgtaaatgctatgtaaatggttgccatactgtattgtttagggaaaaataacaaggagacaaggctgttatatgttcagtgcagatgcgaccatccattttttttaatgaatattttcaatccatagctggttgaatccacagatgtggaacccaaggatatggaggggcaactctacttattttatactaaattttagaaaggaataatggcttatctctaagccatgcagacaattgtatggacaattcttgctatttcaaatgtaagataaaatcttaattatacaagaaagaataggagaatagccagaaaaacatgcttttccttgaaatctcaatttcatcccataaattacaatacacctatttctttttaaaaaatcgtaaacaagaaaaaaaataatcacatctgattcacatcatgtccacaatcccctcaatcataaacatcaggaaccttcacagaggcttttttgttgccaaattttatttggcacagtactttgatgaacaattggattcttgcactgtttctgggctcttacacactcaaatgctcacctgatggtgcaagtctgtataaaagttacccaaatgagcaaaaagttgatgagacacacctgatgaatactccctctgatagattccttccatgtgtaagaacgaactctgtacatgggccacatcaaggcaaagtgcagtaaacgccctggggcaatgagaagttggcctctacttgtcctgtctgtaaaatgtttccctgtctgtggggttggccagtattttgtgcaggaattcctagtgtaagatgtcttagacatatgaaagctccttatctgtaaaatgattgcagaggacctcatctctcaggcccctgccagtcctgatgtgactggttcattgtggccatgctgcctcacctgcattgggagaaaattctcttctcaggccacttcatgacagaggaacacagacatggtgagggtagcaaagagggtgaagccagctagctcatatggggttggtaaaggtgaaatggacatacagtactaacaacagcaatggcagctcgcactctgcactcttactaaggaccagacaccattctaagcactttatgtgcatcaagtacctcccaataatctatgaagcagatccttttagtatctccatttttatggatgaggaaactgaagcagaaaaagtgaaaacacccaagaaacataacgagtaagtggtggatgctataaatcgagcccagatggcctcacccattgttcccaatcttaactactgagccatataatgtacatcttataggggtgtggatacagtaaatgagatttggcacatgcaaggtgctcaataaatggtaactattttttttttgtgatcatgacatcaacctcaagtgatttcagtagcaccgtgtctaccctaatagttttccaaaactttaaagctgtaaagccaaaactctaaagctattattaaaactttgaagcttttaaaaaattattttattttactgttttaagttccggggtacatatgcaggatgtgcaggtttgttacataggtaaacatgtgccatggtggtttgctgcacctatcaacccaacccctaggtattaaacccagcgtgcatcagctctttcccctaatgctcagtttcttaactgaaatctaacttggtgaccaaacatgtaaaagagatccacgtagagccgcacggtttgaaataaaggtcggacctcaaatctagccctcttgctgtcccctggacatggtcccagaacttcatctggggctatagtttaaaaatcatcattccaatcaagtgaaaaagtgtgcacaaatcagtgtaaccctgctacacctctgaaacaatgcacataatgatagataaacataccattgccttgatggtcttctacccattaaaatactctgcattatgtagacaccattcacataatgtttatccttatatttgaggattggaagtctgtcattcaaaaaagcttaataaattctttaaaaaaagaagtttttcttttgactagggttgcatgtttacacattgtaagtctgggtgtgaggcggtattgttctgcctcagatgcaaagaacttagagggtctgttgccagcaataaccaggggtttgcataccagcctcacgtcagtttctaaactcaagagttggttttattgagtgttgatctgggaaactcctggttccagatcacttcagaccttcttggagttgatggaaccagcagaaagcttgggaagggatggccataagtccatggacacccacttggagcgttagaatcccctgaaatccaggaagtcacagagcagatgatccatgaaacctcttgggaggctggccctgggagggtttctctgctatttagttgggatgcttcatggaaaatcaagcactttccagcctggaaattcttttcaacaattgaaaaatggtgcttccactgttgactcttatcgatctattcgatctatctatctatatatataattttctttttctttttttttttgagatagtatctcactttgtcgcccaggctgaagtgcagtggcgcgatctcggctcactgcaacctttgcctcctgggttcaagagattcttttgccttagcctcctgagtagctgggactacaggcatgcactaccacgcccggctagtttttgtatttcagtacagatggggttttaccatgttggccaggctggtcttgaactcctgacctcaggtgatccatctaccttggcctcccaaagtgctgggaatacaggcataagccatcgtgcccggcccctagctatgtattttttgagacagtgtctcgctctgtcacccaggctgaaatgcagtggcacaatcttgatacactgcaacctctgcttcccgctcagccttccgagtagctgggactacaggcatacaccgccaagccccactattttgttttaatatttttagtagagatggggtttcaccatgctggacaggctggtctcgaactgctggccggaagtgatccacccacctcggcctcccaaagtgctgggattacaggtatgagccactgcacctggccttatctatctgtttgaatttgcaattcagagaagtaaacacttggaaaagatcttgaccaaaaatcaagaaccacatgttcatattgcagtggggctgacagagataatctgcctcaactcagagtaacaagcatttactgagcatctactgtgtgcaaagtattaatattaaatcaggctgtacccccagtttgcagaaatgaagaccatttttacagatgaacacactgatactgcatgttgcttgtattttgtccaacatggggagatgtttaatcagcacattgaatggagagaggttatatgatagcaccttttcccggtttggaagattatgcagagaaacttgaggatgaaccacacagcacagccatttgagtgggacggcttaaagacgtactctcaatcccaacttgatttggaagagaggcaaagcctttaagggtcagtggaggacaggcagctttagtttgtacttctggactgcaggatggcccatggagtggcagctccctgtgtccccttcacctgttgctcccttttgctattcagtggagccagtgtgtctataccagtcctggcacttccagagaaagggcacatccaaaaccaaatgcacttccatttccttgagaaaatcttttgatagtgacttcagtttacttaaaatatgccgggataataaccaatggcaccaggtggacacaggactacagacagggctggagatgtgaacccaccagccactcaggaaagaatgaacagaaatagaaaataaagtttttacaactttgaaagtatttcacaattatttccatttgtgagcccaaatcatactgttttcataacttatcaaacacaatcaatgatagttaacctttgtagaatgctttctatgtgccaggcactatgctaaatatggtacttcaccggcatcatcttatttaattttaactgaaagaagcacatataacaagggcagaaatgtgaccaatatctctaatcatatgtctttggggcatccaccaatgggtgttgttggcaccagtgccaggtagctagctggtcccagagctaaagctgtggtttgacctcagctggagacaaggccatactgtggtttgtggttcagcatggttagatgagattggattcagttcacgcgagatgaatgataacagctgcctgccgcttgactgttcaaaggaaaaactgtggtttatgaaagagcttttaggaaacatttatctactcttaccttctgtagctcctctcctcccccataaccaagtggaaacataatgctttatcctttaaacttccagactccttgaatttattactacaagtcatcctgcaaccttgaacaaattaaccaatttgtgccttgatttgctcatctgagaaatggcgatcataaaggtacacaactttagggctgttgtgaatattaaataagataatagggggtcaaaaattcagcgtactgcctaatgcacagtaagcgtgcaataaacggcagcttctactctggagttttaggcgtcatatcagagtctcattgacattggagaaacatgatcactacttactctgttcatgtacttcacatagttgttttccttttgctagctactcttcgggcactgaccattattctccatctcaattccaaaaggataagacgctaacatggttttaacttgcaaagtggttggagtgacactaccttttgactgcaagaacaactgcgtagtgagacaggttaactgggcagtgttaggaaatccctgctccaaaaagagctttaaacataaaccgggcatggctttgtcaagagcagcttggtatttgaaaaactgcattaaaaaaggggcaggaccaggagaccttacaggccccttcaagattcttttctatcaccttaatctgaaacatcggaggcacaattcagtatcaaattcacttctgttttccatcatcatatttttactctcacatatggtgtgccccagtctggaatcttgcccctttgaaaaaatgctgtcaaactgcatttactgaaatgtaagatgcaaaggagcgaggtgagcatgcaggccccttaccatcagtctggtagttgagtgccacaagctgtatcccatggagccagaacatgagggggttcgggttggaagagtcgatgcgggtggcagcagggtaagttctcagcagctgacaggcggtgtgctgggtcagtttctgagaatacctgcgacacagacgtttggcggcattttcattcagcgacgagatatgataacatttgggagttctaatgatagcactgagggacgtggttgggttgagaggggaagaagattcctcccaggtctgtcgaatgccttcacaggaacctaaaccccccaagaaattagccgcagattagtgtagaaaactttaaatattttagaaagataaacctgaacaacatcccagtaaacagtcatagcatataaaccacatcagaatacctcttggattttacttgtgagttagttcgccactttaaaacaacatggtggctacttagttttaaaatgagtgtggtggctgggtgtggtggctcattcctataatcccagcactttgggaggtcagggtgggaggattgcttgagcccagaagttcaagaccagcctgggcaacatggtgagagcccatctctacaaaaagtaaaaaaataaaataaaaccaaacaaaaaaccccacacaagaaacaaaacaaaatgaatgtagcaacatcaatttaaattaaaagcctagaagtcctttgcctcagtacttcatttgggttgtggtatatttgcacaaataaacaatatatgtacaaggatattcactccagcattgtttttcataggaaacaacaaaatcaaaccaaaccaagaagcaacccaaatgtatcagtgaagaagtgattccataaatgacagtatatccatgcagtggaccaccacacaagcattaaagagaataaggaagctatatgtacagaaaattatgtgaaaagttatagcaaatataaagttatacatgtatgtttggttatacaggcataccttgttttattgtgctttgttttattgcactttgcagatactgcactttttttttttttttttttttttttttttttttttttacaaatttaaagtttggggcaggcctgcctccagcaagtttattggtacaatttttccaacagcatgtattcactttgtgtctctgtgtcacattttagtaattcttgcaacatttcaagcttttaaacattattattatatctgttatggtgatctgtgacgagtgatcttcgatgttttattgtaattgttttggggtgccatggaccatacccataagatggtaaacttaattgacaaatgtgcgtgctctgactgctctacccaccagcccttcacccatctccctccctctccttgtgcctcacgattccctgagacacaacgatactgacatgaggccaattaataaccctacattggcctctaaatgttcaagtgaaagggagagtcacacgtttctcacttgaaatcaaaagctaggctggtcacggtggctcatgcctgcaatcccagcactttgggaggctgaggcgggtggatcaccagaggtcaagagttcgagaccagcctggctaacatggtgaaaccctgtctctactaaaaatacaaaaattagccaggcacacgcgcctgtcatcgcagctactcaggaggctgaggcaggagaatcgcttgaacccgggaggtggaggttgcagtgagctgagatcgcgccactgcactccagcctgggcaacagggtgagactctgcctcaaaaaaaaaaagaaagaaagaaataaaaagctagaaataattaagcttagtgaggaaggcatgtcaaaggccaagacaggttgaaagttaggcattttgcgataaacatttagctaagttatgaatgcaaaggaaaagttcttgaaggaaattaaaagtgctactccagtgaacacacaaatgataaggaagccaaacagccttattactgatatggggaaagtgttagtggtctggatagaagattaaaccagccacaacatattttaagccaaagcctaattgagagtaaggccctgaactctcttctgttttatgaaggttgagagaagtgaggaagctgcagaagaaaagttggaggctagcagaggttggttcatgaggtttaaggaaagaagtcatctccataacataatatcagcaagtactgatggagaagctacagtaagttattcgtaagttctagctaagatcattgatgaaggtggctacattaaacaacagaattttttttttttttttttttgagatggagtcttgctctgtcgcccaagttggagtgcagtggtgcgatcttggctcactgcaagctccgcctcccgggttcacgccattctcctgcctcagcctcctgagtagctgggactacaggcacccgccaccatgcccaactaattttttttttgtatttttagtagagatggggtttcaccgtgttagccaggatggtctcgatctcctgaccttgtgatccacctgcctcagcctcccaaagtgctgggattacaggcatgagccaccacacccggccaaacaacaactttttattgtaaatgaaacagccttctattggaagaagatgccacctaggactttcatagctagagaagataagtcaatgcctggcttcaaagaaaaggctgtctctcttgttaggggctaatgcagctggcgacttgaagttgaagccaatgctcatggaccattctgaaaatccttagggcccttaagaatcatgctaaatctactctgcctgtattctatagatggaacaacaaaacctagatgacagcacatctgtttacagcatgatttttcatgtctgctaacacagtatccagtctgcagcccatgaacaaggagtaatttgaacttttaagtcttatttaagaaataaatttcataaggctaaagcttccataggttgtgattcctctgatggatctggtgaaaataaaatgaaaacctcctagaaagaattcaccattctagacgcccttaagagcattcatgattcatgggaggaggtcaaaagagcaacattaacagaagtttgggagaagttaattccaaacttcatggatgacttggaggggtttaaaacctcagtggagggagtaactgcagatatggtggaaacagcaagagaactagaagtatagcctgcagatgtgactgaattcctgcaatttcgtgataaaacttgaatggatgaggagttgcttcttaatggatgagcaaagaaagtggtttcttgagatggaatctactcttggcgaagatcctgtgaacattgttgaaatgacaacaaaggatttagaatatttcatacatttagttgataaagcagcagtggggtttgagaggtctgaccccaattttgaaagttctaccatggccgggcgcggtggctcacacctgtaatcccagcactttggaaggctgaggtaggcagatcatgaggtgaggagatcgagaccaccctggctaacatggtaaaaccccatctctactaaaaatacaaaaaaagtagccgggcgtggtggtgggctcctgtagtcccagctactcaggaggctgaggcaggagaatggcgtgaacccgggaggtggagcttgcagtgagacaagatcttgccaccgcactccagcctgggtgacagagcaagactccgtctcaaaaaaaaaaaaaaaaaaaaaaaagttctatcatgagtaaaatgctatcaaacagcattgcatgatacagagaaatcttttgtacaaggaagagttggttgatgtggcagacttcactgttgccttcttgtaagaaactgccagacaccctagccttcagcaaccacccccctgatgaatcagcagccatcaacgttgaggcaacaccctccaccagcaaaaatattacaacttgctacaggctcagatgattgttagcattttgtatcaataaagtattttctattgaaggtatgtacatttttttgacataatgctattgcacacttaatagactatggtatagtgtagacataacttttatatgtactgggaaacgaaaaaattaatgtgactcattttatcgtgatattcactttattgtagtggtctggaaccgaacctgcaatatctccgaagtatgcctgtatcccatttggattatcttaaaaaggatcttatttttcttgaacaaaacacaataaatttaatagtggttacttctggagaatagcaccaggacattgagtggaaaggaattttaataatactctgtattgtttgagtttttaactacaagaatttattactttcataataaaaagtaactagaaataaaatagccatatcttctggagttataatggtgaagagaacagctccaagaaaccactagaatgttccaagaatgttccaaggtgcctctaatttttactcgtgaggcaaacactgttcaaacatcttcagtgaaatgttatttttattttttaattttttaatatttttttgagacagaatcttgctctgtcacccaggctggggtacagtggtgcgatctcagctcaccacaacctctgccttccgggcttaagcgattctcttgcctcagcctccctagtagctgggattacaggtgtgcactaccacacccggctactttttgtatttttaatagagatggcgtttcatcatgttagccagactggtctcgaactcctgacctcaagtgatccacctgccttggcctccaaaagtgctgggattacaggcatgagccactgtgcccagcctgaaatgctgtttttagtacgttaaaagtgtaagttagcaattacaaaaatttatactatactcagacaatattaatgttcaggaaaaagaattaaaaaattcaagggaagtgcttagacagtaaaatatctaaatcatccagcatgcagaatcaagcaaagatattgtaagaaagtgactttactttttccagatgttttgttaaatgatgctgtctcccctgggctcattctgcccggattgttgccaaaaatggacttcctgcttttcctttcttttcctctgctagagccagatgcatttagagttgacagtcctgttcccataaaatgaaaataaataagccaaaaactacaagcaaggcaactcaacattttccatccccattaatatttattttgaagtcctactactcccttggaacctagtacagaaaccctactggcagtttttgttctgttaataatagcattgtaggcaattaaagcaaagttttaaaaatctctataggcaaatgcaacaagaactgcatgcttatcacagaatgaccacaaaatcacacacacacttagctgattgtgcatcagaaagattttgaaaaactgcatgaaaagaaggtgctgtggccagaaatgatcagtggctaattatttaatttggagagatgaaggaatggctattacttgggttttagtgtcatagtgtctaggttcaattcctgctgatattagccttgacataacacctccttctttggtcctcagtttccttatctacaaaatgtgtgtaatgataggaactcactcatatggttactctgaagatgggaaatatggtgataatgatgtttatggcttctctttctcactcctggtctaacaactccctggatgcttcatgcctggcacagtgcctggtgcagagcaggaactgaatacatatttgctgaaagaggaaatgaatgcaaaccacatagacctggctccaatgtaaaaagagtgagctgaaggcaccagtgaggccagaattgcctccaaattgttcccactgtcataactgtacctttggagagtaattccctaagctgaagcagcattcaggaggtcgtatttcagatgataatacacattccaagaacatcatcagaggagacaggatagagtagtgtttaagagcatagactttggagtgagacagctggatttaaaatctgttcctagcagggcaatctcacacaagttacttaacctctctagaacactccctcctcatctgtaagtgggctgtggttaggaataaacaagataatatacatatacaggctgaatatcccttatctgaaatgcttgggacatgaaagtgtttcagatttcagatttcttcggattttggaatatttgtatcatactcacctggttgaggatccccagtctgagaatccaaaatccgaaatgctcccatgagcatttcctttgagtatcatgtcagcgttcaaacagttttggattttggagcattttggattagggatgctcaacttgtccatacttagtagtgtgtcttgttcagggaagtgctcagtccatagtagctgttattattatagcttaatgtggggcttctaaggttttcttttacctccaaagtattcataatagcaaacatgcacaaacttagactattgagttctcataccttgatcttaatatttgtgtacattttgctcttgacacaattacttaataatggattttctcccaagtaaaactgatgagggaccagtggggaggggctctgttcattctggacttttgcctgtatcctgccacatgtcaatatcttctaccagaatgtgggtacttcagtgaagagcctggttattcttttgggatggggaggggaagaatgtaaacaagggctgagtgatcaaagaaggggaaggattttgaattgtgagaaggggcccagaaaaataatgaagaagcaacaaagaaccttcatctaccccgttggctcacttaccgataacaacatttccagaaagctgggattacaggtgtgcaccactaatttttgtatttttagtagagacggcatttcaccatgttgtccaggctgatcttgaactcctgacctcaagtgatccacccaccatgctcccgacgatgtgctaatcacactagatactttattgctactttttacagcaatcctttaagttaggactgttacaccccttttacagatagggaatcccaggtgcagagcagctataatacataactgttcaagtcaaggtcatggagagacagagctgggatttaaatccacatggttagcctggtggctgcctctcttcctcagctgagtctctagttaattttagggtcttcctctcatctgtgtttttacttgtgattgtgaataagaatgcttattttagatatagatgttggaacatctgacatgactaaagcttcgagatggaagtttgagcagaagccatctaggtatttaggaatacaccaactccagaaccagatgcagtggtgcacaccagtagtcccagcgacttgggaggctgaggcaggagaatcgcttgagcccaggagtttgaggccagcctgggcaacttagcaagactctgtctctaaaaagaaaaagaattacttaaaaaaaaagaataaattgactccagtgcatatgatggtatcttccttcagaaatcctaatctgtctggaagctttgaaatcaactccctaactagacaagcgatgtacagtcattagccatatagcaacatttaggtcaacagaccacgtatatgatggtggtcccatttaagattgtactggagctgagaaattcctatcaccttctgctgtcctaacatccatagcataacacattactcaagtgcttgtgattagattggtgtaaacaaatctgctgcactgccagtcatatagaagtctagcacatacaattatgtacagaacatacttggtaataataataaatatgttactggtttatatatttactatactttttatcattattttagagtatactcattctacattacatgtgtatatatgtgtgtgtgtatatatatatatacttttttttaagttacatatatatatatatgttaactgtaaaacagcctcaggcaggtccttcaggaagtattccagaagaaagcgttgttatcatgggagatgatagctccatgcttgttattgtccctgaagaccttcagtaggacaagaggtggaagtggaagacaatgatattggtgatcttgactctgtgtagatcgaggctaatgtgggtgcttgtatctgtttttaataaaaaagtttaaaaagtaaaaaaataaaaaataaaatgaagtaaaaaaaattaaaaatagagaaaatcttacagaataaagaaagaaaatgtctttggctggagtcacagaatgggaaaaaaaaaaaaggagaaaaataagaaagaaaatggccgggtgcgatggctcatgcctgtatttccagcattttgggaggccaaggcagatcagtccaggagatcagcttgggcaacatagtgagacccttgtctctaaaaaaaaaaagaaaaattagccaggtattggtggcacatgcctgtagtcctagccactcagaagactagggtgggaggatcacttgagcctgggagttcaaggttacggtgagccatgattccaccactgcactccagcctggatgacagagcaaggccaggtctttaattaaaaaataaaaataagataagaaagaaaacatttttatacagttgtacaatgtgtttgtgttttaagctaagtgttattacaaaagagtcaaaaagttaaaaaaataaaaatttataaaatataaagttacagtaagctaaggttaatttatttttgaagaaaaatttttatttataaatgtagtgtagccttagtgtacagtgtttataaagtcgatagtcatgtacagtaatgtcccaggtcttcacattcactcatcactcactcactgatccacctagagcaacttccagtcttgcaagcttcattcatgataagtgccctatacagatgtaccattttaaatcttttatgtcataattttactgtaccttgtctgtttaggtatgtttaaacgcacaaatacttatcattgtgttacacttacctaccgtattcagtgcagtaacatgccgtacaggctggtagcttaggagcaacaggctacaccatctagcctaggtgtgtagcaggctacactgtagctttgtctaagttcactctatgatgtttcacacaatgacaaaataatctaatgaagcattctcagaatgtctctccctgattaagtgatgcattactgtaaatataatcagtgctaggctttcttctggatgctctcccagagacatcagaggattcaacatattggcactgctaaaatcaggagagaagctgagtctggggatggtccgagagccactcagggtcacacggctacttttccttcctgagtgccttgcctgccatgctctgcagggcctcatcttacccagtcactataggtccgaaaagctgtgttcactggttttgcaagatattgggaggcaccgagggtaattaagtttcagtgaacagggctacctctcagtggtgtgttggttgacattctcccgagagttctgttccaagccctctcatttcttgaaatgcatccctttgccctccaaggtgttccaacctgcagcactactgtgggtctgagtaacccagaacagccatgggggatggccaaggctctctgtgggggaggcaactctcagtgccagggacctacacccagctagcccaaagctgtccaaggcagcagggttctacttttgtcattcaaatggcttgttagcaaaccactgtttgatgaacaaagcttgtctctcagtgctgagaaaatgacagtgtgtgtccagggaatggactgacacttgcaaggctctccccatgtggctccttcagtgtaggaataaaaatgagccctggaagtcacagaatcttccggacgagcctcaccatggaatccctgggcacctgctctgtggactgtgtggtggatccaaaggagaatgaggcaaaatccccctcagaatcagacttccagatcatctggctctacctgctcctgaattgcctgccttagaaacccagggaccaggacctcccagtgccttccaaatgtaaatccctggtagagaggcctgagactgggtatgttaatcaagtggcctgggtgattctggagatttcagcaagtgtagtaaacaaggattctagtcaactccacttttgagtgagaaaggctcagagagatttgccttggccaaatcacaaagcatggtagccaagagcccaggtctctgacccacgatcttatctgatgatcttgtcaccactgaataatttttgtcttacagggttgtaatcttttaagctatgggtatgtcaaggcatacagagcagcgtaatggacattggagactcagaatgagagtgggagggaggtgagggatgaaaaactacctggtgggtatgacttacacgacttgggtgacaggtgcgctaaaatcccagacttcatcactatacaattcatccatgtaaccaaaaactacttgtaccactaaagctgtcaaaataaaaaaattcaaaataaaagaacaaggttgcactcctaactgtggaacaactgggtatctaggaggtacccaaacatatgcctataaatgaaggagctccagaaaggagatgtcacaatgagttgaagagtctcagatactttccaaggaccccgtccttggaatttggaatggggccaaggggagaaggaaggccaggcaaggttgagaacactctgagcaatggcctggcactagaaagacggcagtgtatgtaggtgcctgaggagagtgggggatgcaggggagcttgtgggaagatattggaaactaggttgatggggtcataaaataaaaataccatatccttttttttttctattagaaggagaaaaaaacccaggacaatagaagtactaaatgcaaccgagaaataaaccctaagagaaagcaggtcgaaaaaattcaactacttccatagtgtggtgcaaagagcccacccctgggagctgacaggaattctggctcttgccctgccactgacctagcttctgatggtggggaagttccttcctttctgtgggcctcataccacatgattgttgagtgcctcattgcaatgaagggttttttttttttttttgcatatggcttgtaagaagggacttgggatgatgaaaggtgacatacactgaaattgataatgtagcaaaattaaaataaacggcatagcaaaatgaacagtttatagtattttcctcatgtgcatcaaacaaatgattgtaaaaagaaatatttagaaggtattataacaatcattctggcaatccaatttagctattttgagacaggaaataaaatcagggaaaaaatgtaagaaatttcatttttctaaagagaaaatacactatacctatgaagaaatgtatgctatgtgaacacttttaaaaaacaacatacttggaatttttaaaataagccgaacaaccacatgcttagaagctctatcacatgacctcctgatcttccacgattctctactggtacagagactttatctttcacacagacttcaaatatctttgggaatttgtgctccttatttactgagtgcttgagaagaaaagacaaagccagtggaatggtccgagtgtggcatccgctgcatttataaagaataagagctgcagtgggtgtgattcttggacagagtggcgctcatccttgttcctgcaatgaaggacatgccagcctccaggctctttgacaggtaaagggttttactccatcagaaaaagagttttgccagttgcaaataatggtcatattgtacttatatgccatgaggtcatggtctgtgaaattaaacttaaatggccaggttcctgcatttctctgaaatctttgctggctacttattgattcatatcctcctcaacaggatttgctagcagacaagcagtagcagctgccaaaagtttaaaaacagcttataggagaaaacttacaattaaaatgattttaatatcatgaaatatatgatttttatcatatcattaaataatatgattttttttactctgatgtgtgaaaagctcactattacctaactgtgattttaaaaatttaattattattttttagagatgaggtcttgctatatatcttgcccaggctgggcttgaactcctagactcaagcatttctcctgctcagcctccctggtagctgggattacaggcacgcaccactacacccagtttgcctaatttttaaatagcccaatgcctctggcccatttgtcaggcactgtgtgagaccaggtgcttaagatatgctctgggagggacctgagttcagcccatcttgaaaagatgagggcattttagtgcctctctccaggccaagtctataaatcctgtttactaacatttagactgatcctcctatctcagccactttcctgttctcagaaattatattcaagagaatcctttttcttagtatgaggagatgaatttttctgagttccatgtacttagggactttcttgtttgtcttctaccccctggtgccccatttgtgggacacataattgagtacctcattgaaaacagcccgaaacaagagaggccaggcagtataacgggtaagggcaggactttggagacagacaggcttcagagccataggtctaccattcattaattgaaaaggacactgtttttggaaagtggttcatcagcctgtccactgtacttctaaaaacggtcaattgggggaaatctctccttccacttcaacgccatccttggtccttgtggtttgggtggggccttgctacccagctcagagtggagaatgtgacatgggatccagaccatcagagcactgcatctcctggccacagtgattggtaaaggacccaatgagaaacaatgacacttctgcgggaagttctggaagagactcttacactgaagctgaaactggaagcatgtagtgctggcctgctgtagccgtctcgcaaccagaagggaataaaggggagaaagccaacatgatggaggcggaatgagaaatgaggaaagagaaagcatgtaccttggttaagctatacctgaaacctgtgtgtcttcatttttaagcacatgagtcaataaagttccctttacttaggtcaatttctgccactttcaaacaaaagaatcttgactgatatactctgaaacttggggcaaattacttcatccctctcagactttattttaaaatggagataataccgcctaccttgtagaatcattatgaacggtaaaggagatgtacgtaaaatagcacaaatcctagtacttaagtatttaatacatttagcaattagaaattatgagtattataacttttataattattaactattataaaaagacattgtgtgacctgaaaaatgaatactttatggtatttttcttcatgagcatcaaggcaaattataataataaagatatttaggaggtattataacaatgatttcagcaacacaatttagttattttgagagtgttcacaatgcccaattaaataaatggcatatttttaacctttgatatctttaaaagttatagatgatattgcctaatcttacctggaaattttactgcttgacaatagattacaaggtcagaaagctctggtgcaatctgtctgctttcctttttattctgatcaagataaaattcttctcccagttccatatcataaacctggtaagggaaaaatgataccattttacatggaaggtatatgctactcacctctggattcccaaagctcttttatctgtcctcctctggtgttattactgtatttccccttgcatggtaattatccatatacatgtcccaacagctttcctagagtaaaagctttctgagggcaggaggtgagtctaattcatcctccatcttccctcagtgcatggtccactgtcttacatgtggaatggtcaataaatctttgttaaataaatagaggattgactatgtatcttccgtggctcaaatttttgacatatcttacaattccattgtccaacaatgtcactgcaactgcgtctaaagatttgctcagagtctataaactgtgaggcacttgaggatagggtctgggtatctcatttatcttcctattctcagtgtcattcctctgctatctggcccgtttatcttcttggtcatcccaaatgcctttaaaacttcttgcaattccctggacataccaggctgccctcttggcccgaatgttctgtttttgtctgtttagccaaatcttccttctgaaacctcatcttccctgagagcctgtccttgattctctgataacacagtataatcactgttctatgcacttacattcaacacagttgacatgtctgccttcatcactaaaccacctctgtgccacttcagtacctgccacacatacaccattagtaggtattggctggatgaatcagtgactaactttccacaaatggaaggtgggtgtcttttaatatcaccaagtgaactttggcaggtatctaagggaaagtgaggggaaaggtgaaagggagggacagggagcaagtggaatctcatctgaaactgacaagagtaccacatggtcaaagtgtcatttaacagaaaccgttcacccacctttcctttgttgcaagcagagttatctgctttctttatcctctttgggatttcttcattatattcaaactgaagcttgtcattacatgatttattttcaggtctgtcttccagaatgttgtctgaaaataagttagcagacttcagtgaaaacgaacccaatgcttcacttaagagctacatgtgcatcactgtgaggacatccagatacttgtacttatctataagaatgaggctctaactatatagtatgttaacaaaatgatggcttgaagcataactgtaaaaattgggttgatgcagttattttcaatttaattgatttatttaccagtagtttttgtcacttatatacataatttaaatgattcaaaataatctggcatatagacataatctaaatgaagatgccaattttcatacagatgattggaactgtgcaaatattatggaagataccccgtgtcaagaagctgacagcacacacgtttgggaaggatttagtggctgaagcacttctagaaggtacatacatgattgactcactctcactttgaaatgaagctatttacttcttttaccttgagaaatgccaaaacctagggggaaagacttattattgggtgcaatgcaaagtcttcacaattataattaaaaagtaaagttttcatgattgttattaatttactaagtgataatcataacagaaaataaaatatatctgaatattatatcataagatataatcttatattttgctctttttttgcttttctatttggaatgactctaaaggtattagaagtgtatcgtgatgatgaccttttaaaatgaaaaacaagaaagctaatttctcactcaagatttagtatcgcatcatcagagcacaaacgattagaccaaaaggaccttataccaaatcagggccatgcaggctgacaagaagtaaatgagataaatcatttcattacatttgtattcacagaagtatcacaacgtcatgctaaccgggcccaagaaattggaaacagaatgctgacatccatgcagttaaaatgccccgttcaaatggcatttaccttcctgaccgttaggagcaggggaggcagtaaggacatctgctacagaaaaacagaatcagaaaggggtaaaggaaggagaaaattaagacaaacaccagataaattaaacaaaggcatgaagcaaagcacaaataacagcagcttagattataaataaatgaaacaggaaatgctctatagatttaatattttgactgtggaacaatgcaaggactagcagtaaacgaaatgtaaacattattaatgtgaatcatgccaagggctgacacattcatgttacatattttcagttactgactgctgtaatactcccaatatgacttcatttcaaatgtacagaaacagattaatttcttggaattgtgctgtcattgtcatagaatatgtctgcgttaagttgtaaattcaaatttgtctgcagtgtatgttcaaaactagacacaaggtaaacaacaaggttgggagaaaaatattaagaatttattacccaaaaggcagagttacaatttctcagataaataactctcatttgcaacttccttagcgttttcttgcaataattctgtggctaggcattatctcatttttatagcccaaatggtgttagattaattcctttatttaatgggcatgaaaaccaaggatgagagatcacagagataaaccgggcaccctgactttagagatgggttcctaatctaggatgcctatgagggtctcaggaaacttgtgaaactcttgcagttgtgcagaattttgagagcacgttttatttttcagaggtgatagctttcatctgattctcaaaaagacccattattacgagaagctaggaaaccttttaggccccctaagaggctggtaacggtgcttcccacagcaggtagatttctgttctctatccctgctggagaaagtggagatggtcacaacaataatcaaaggcatgtggttagtaaggcatctaatagtcacatacggaagccttaactggacaagcttcaacaagtcacagcataactacaaggcctgtttgagaatcatccagtcagagcgatctttcaatgaagggggaaatactcatgtagtggtagtgggcttaagtggtcatacattacagatcttagtgctggaagtagaggaagaacatcaccaaacacttcgcagaacttttgattacatatctgaggcatctaaggcctaaggtggtgaagacattgccccaggtatcacagtctactggaacagagcctggtgtggtccccttttccaatgatactccacctctgcatatgtggattgttaaaaatacatgcaactatcttagaaattcagtggtataggactaaatttcccaaatgaaaataaatcagaaaatccttctcccacctgttcattttgttacttgcaaatcaaaaccatctataataattttttgttatttctttatgtgaaatctacagtataataataatttctaaaaaggcttttcctttcttattctcagaagtacagaaaaagcacaggagtaatttatgaaagagcaaatttgttttctagtggactaactacttataggggcatatgacatctagattagttgatttcttaggtgtgatttttatttcatatctgaatcaattagttctatggggcattactgcaactgtaatggggaagaaaaccatggggaagaataagttaatataaaaaattcacattcccatgactttgcagagaaattgtcttgactccttttaattttttcccctcttactatctgatgagatatgtctctcatattagctcatggggtttcaggtgtagcaaactggcttttaattggtggtatggagcaatcaactattactaaggacaaatactaaatgatgtagtttggtattatatttgggggcagacagtttggtattatatttgcagtataaccagtgatggaggctcacaaaactgaactatgactggagacaactcaaatttctgctgaggagcagatatttggaggagggggctcagttgtcttaatgcatgagacaacttaatggtaaatggtttctggtctgggcatatctgcatatttagcaaaacaattattctacatagaaagaatatattctactatataatgtttatagaaataggaaccttggcattttcttattattatattgttgcctttcagacatcaccaaaatgaaacagtctactatcagcaaaggtacctgagtaaacattctgcaatctctaacaaatgtttaatgcaaatgaaacacactgaaaacctaattctcatgtgagaagaatccttcgctagtaatctgtagttaacatcattcgtgtgactttttgtgttgcgtcattagcattgcctatgttttttctctttggtggggccagaaggaaagatcttgttggcttagtggtatgaaaaccagggagggaggggaaatgaggctcctctcctttcttttcactactagaatgccagagcaagagtgtgaaacagagagcacagagccgtgatgctgccccctgccggtggtgcaggagaaaggacgcaacctcagtctacgactcctgccaagattatcagccacgctagaaactaaagggtgaaaacagggtttctctgctgcaattccatctcttcctctagaaacttgtcgtaggaatgactccctgtaacttcccacacctgcctcttctttctgtaagtgttggctaacagaatcccctccttcctcggtccttgctaagtgactgaattcagaaactcctggacaatattacaaccatccgtattactggtctttggcgctctagacttattttagaaagaaaaatgtggcaaatcatccaagaattttcctgtgcacagcatagggatctgtttctcttaccatcagaaagggattcatagtcataatcatattcgtcctcctcatcttcctcttcctcattattggcaggtcgggggttggcattcccaccattataagcctgcacttgcatagatgctaactgatgagcctgtaaaatagcaataattgtaaactgcagatgccaagttaatgaattcatttataacctttaaaactacccctgatgtttaacacaatcgttaaaagtggcttaacctattttgatacatttgggagaggagaaaaaaatctagattccctcgaaatgcaatgtcaacacttgggtgaacgttagcattcctacaggaagaatcctggagcttttataaacaatctccagaagactgtgtgcagtgcccagctagccaggttcccaggacaacccctccaagagaaagctttggtgatttggagaaccagcatcaatcccaagtgactgaagaagtgaatcacccatcaatttttcagaagtatgtctctgttaagaaaccattttttccccttcttaaaataatatctacaggctcctgaccttgagaacaatattagaatccctatggacaaagaggccaaaagaattgttgttggtttaaataaaattgttttcaaacggctttctgaaccataaatcagattaacaaaacaggcctagaaactttaggaaacttgatgtgtgcagccagggaggtcacatactccgtgtttactggaattactgtgaagtgataagcatcagtacaggtctgggaacctacctagcttaagaaaatcatctgaaatataggaaacgttacttgcatgaactaaatgcaggaaacaatctaaacggggtagaggaacggggtcagtaagcaatggttgtctgctggagagaatgagatatgaaaaaataattgatatatatttattgaacaaaggaagtgaacaaattcttttattcaatatttatgcattgaatatactatatagattatatatacacacatatataattctgcatgtgtatgtgtgcatacatgtgtgctaatatatactatatataatgtatgtgtgtgcatacagataatagctatacatgtaaatatatacactatataaatatacatataattctgtatttgttttatatatttaaagtgcaattatataaaatgacagtcacgaagtcctagatattaaatgttaatatggcaggggttcttcacttgtttttgcatcacagacttctctggttgtctggtgagacaggatcccttctcagaatgatgttttaaatgcataaaatgaaatggttacaaaggaaatactgttgaatacagtgatcacatgttataggaacaaatttgtgctattagaatatatgtgtttattaacacagtagaaaacatagtagtaagttaattaacatttttgaaaatataaattgagcataaataattcttggagatattagcgacaactgtgaagtataatgaaaaagttgccatttctattgatgacaataggtattgcctatattactgtagtttattccctacatttatgatcagaggaaatgctaaatttcagctagaggttagtgaaaataaagatgtaatttttttccatttatattcgtagactccctaaattctatttgtggatattaccaaggttaagaactcgtgtaatacagttgtgtttgaccctggaattatgtatgttttaaaataattctctattccctaaatttttgaaatgtggttatattacctttataatgaatatgtatacataaggaagatacaatttaggctgtgtccatatccagatgaaatgtattacaaagcagtccattccagataactggacatggtctaggctgcgatttctcaaagtgggttttatggagctcggtgggtgttaataggtgttatggaaaaactgacaattacaggaaccacaagatacactgaatgcctggaagcagcagcttaaccaaacctgaacacattcctactacagggtttcacacagccttcatttaatacgctaaagggcatcacgagtcttcaaagatctccagtgcagcatttcccatgcttacttaaccaggaaatttttttcccctgtctttctcttctcagagtctctcataggattagtgttcttcaaaactttgggaaatctgttgtaggcacaagtgagccacaaaagcaggtctgtttatcgctgataagagaagggccttgactcagcgagcactcaaggtaatgccaagtgctgggaatgatgacgccaagggctggacagaccccactggcagggaagcatgagaactgtatgggagaaggacactgctcaaagaaccacgaatagcagtgtctgaaagtggagtgccaaggcccccaagatgctcaaggagaagcatgggagaggtagcccaacaaacggccaacagctgggacccttctatgcaatatcctacttattctagggtagaaaaatgggacctcagcccctgaataaaagtaactcggatataggttgtggttggaggtatgggtcagatgaggagactggccctcatagggctaagcaggagcaatgtcttacacttctctgtttccccagtacctagccgcagtgtctgtcatttaaggtgaactgagttttttgggttcaaattcaggagaggaatgtcagaatcctggaggatcctggtggggtatagttaggagacctcaggatgcatctcagtacaagccagaggcaggtggagggcttcagaaatcctgctctgagtcaatccatccttgctgagggtgagttctttgtatgggaaatgactccggccttctatgttagcgggtaggtctgagcccactggagctctggatcacctggtttatttgaggtcagatcatcactaggtctagacccatgatctaccagaaaacagaaaggccttacggatgtgactgtggaatcattgctggtaccccttgggaagtcatcatgaaaggttgcaagcagtcttagaaaactggcaatagggattatattgtcccatttttccaaaataaggaacaagtaagttgtggaaattatactgtgggcagtgtcaaggtgatagctgacaaaatttcatgatggggtattaatcacttggtttgtgagaacttagaaaataaagaggtgatttgcaagagttagagtggatctactaagaacaagtttaccacacagtgacctccttagctgttttggataagataattcactttatgggaaaaacagcagataaatagtgtttctcaaacttccaggataataagaattattattgttattattttttacgcagacaccatggtgacttaaggaattatttttatataaacagatgaccaggcctttcttctggaaattctgacttagtcagtcagatttgtgaccttagaatctgtttttcaaagtgctccagcgattattcttattaatgtactctgacttctgtatcacctttgaaaagggcttctctaaagacccaagtctgagactaagctctattgctatgagctgggtggccttgagaaagtcacacaagtggccaggtttcagttttctattttataaataaagaaatcaataaagaagtcgaagcacactctgggaaatgcaggctacaagagaggagagcaccagacgggggcaataatcatcaaatgccagggggcttatttaagaagggcacaggcctctccatgtggctggctgactcaagggcaacttgggatgaagacacagtttgagaaactgctaataaatgtaccagatgacagaaacaaaattcacaaagaactttgtaggacgtaataatataccaaaaccaagaagagcagaaatagagataaatgtgaggctcccatatacaaaaggttaaaattcattgttaatctggaaaaatgggaacgctgggcataagaacagtctatatgaaaataactgaatgctttttgttttctacaagctcaacatgagctcagtgtgtgctaaagaattttttttttttttgagtcagggtcttactctatggcccagactggtatgcagtggcacaacatggctcattgcagccttggcctcccaggctcaggtgatcctcctgcctcagcctctccagtagctgggaatacaggcacatgccaccatgcccagctaatttttatattttgtgtagagatggggatttgatatgttgcccaggcttgtcttgaactcctagattcaagcaatcgacctgcctcggcctcccaaagtgctgggattacaggcgtgagccacagcggctggccaagaatttttgaaaagcagacagtctgaggctgtattaacaaaggtttaaagttcaaattaggggaggtgatggtttcactgttcttgtgctgtaatatactacctagaatactgatttagttctggaaatcacattttcagattgacgaattcaagaatatccacaaatttaagaatatctacgatattcttaatggtaagtaaagagtcttagcaaccatatcctgtcaggaacagttggcacaacaagaatttttagcttggagaagaaaagctggtggggaaacacatgatagctttctaaatataaaattagtctgtacagctgcagagggaagagggagggccaatgagaaggaggaaaaggaaggaagatttgggctcaacataaaaaagacttctgttcattagtggaatgaaggccttataagtaactgcaaatgactgtgcacagaatggaaaaggcaaggacattcacatttatcatttatcttgaagaccacagtggtatgtgtggttagcagctttatctgcttggcagtgaggactgggcaggaattgttggataaagaaaacagcacagatgaacagggctctagaagaaaaagcaccacactgggtggtcagtcactgatgtggcatttgaggaaggcaaggtagagtatacatgctaacatttaaataactttgtaacaaggcccatcagcataggtgccatggcctctgaaacccaagcaaaagcaaggtcacctggagcagatttggaagtgcagatctggataaaggtagacctactggaggtctccaactggtggcccttggggctgactgcacctccagacctgacttgtttggctggtgcagtgtttaaaaataattgaattagagctgttctttgacacggcgtgcacactccactcctgtcctcaccacttccagctgtcctgtatccagctggctcctcacactgatgtttcctgcttagcccctgaaagtggctgattttgcaacttttggcccagaatcatgggtgatcttcaaattgggtaatgtattaccttcagaggacacaaacacttcaagggaatatgcaggttcggatgtttgtaaagaaactggtttctgtatgtttagcatctgtgtgcctgtactctttgagccagcctgagagcaagtctgtagctggctagtttccaaagtgatgttttaggaccaacagtgccctcctaagtaggacaaatagttttgtcagctgtcatcctgtgggataagtaggtgcagactggaaaatggactcagtgttctgtacctgaactttttcacagacctttgagccgagggtctcctacacaggtgggtttgtcgtgcttgggcccagatctctgttgtccggatctgggcccaagcagcataaactagtgatacgctgggatcacagggctatggcttttgggcttctactacaggccccatgccaagggctcccctaaggggactctccctaaaggggactatagcagccattatgggatgaacaaccccctaagctcagtttcagacacaacagtcacacttcatcccactcagaataaattaaataacggaggtatattctatgtgggaactattccacaaattaaatcttgggtgagtgagatgagagaatttattggtctatggaatgaaaagcccaaaatcaaacttatcatttaaggaaagtcagtcttgaaaaactagtaaaccagcaggtcatctgaaaggttagaatgatgttatttttctttgttctaggcacactgccttttcataactggtttaacagaggggagtaccttttgctttaagatatccactggcgtctgatgggcttttagcttcttgtttttaagaagaactttctttctgagttggtcaggtgaaggaagcattggatcatctgagaaatcagtctcaaataagaatttagtcaccagcttttctccaaacacagtctaaaaagaatgaaggaaaacatacaatcaatgccttttatctataattgataaatatatgtacacttcataaacatagtagatattttagactggttgaattatttaaaaagtcttaggaagaggaactaggaaagaagctgtcccctgctcctgcccccttcacagtttcttactgaaaggaagggaggtgtttagaaggacaggaggagaggtcgaggccactctgcagctggtgtcagttctaactatttaggaaaatattctgtggtctgatgtattaaataagaaaacagagaatcagttagaggctgttgtttgtagaataaggttagtttcagatgaagtcaagtcaaaaggataaaactttggagggggtagggagcagggacaaagacataggtagaatttgcgtccacatagtgtaaagaaccacagacacaattctcacaaagattttgagcatggatctccaaagcagaatgtgtgtctgtcaaggaggtgggtggagggaaagcagacacaatgcttatatcaactccattgttgcccaggctggtctcgaactcctgagctcaagcgatccacccgcctcagcctcccaaagtgctaggattacaggtgtgagccactgggcctggccttgagttattttttaattgaaaaaaaaaatcaaagcttaggccaggacaatatgaaaagttaattagttttgttggcattaatatttggggacattttgtcagtgcccctctttcccactgagagcctcatttccacaaatgcctctaccattaaaggaagggggaagtataatggaatatctgcttctaaatctgggtgcattattgttgtgggaagtcagggatcccgaacggagggaccagctggagccgtggcagaggaacataaattgtgaagatttcacggacgtttatcgttcccaaaattcatactttttaatttcttatgcctgtctttacttcaatctcttaatcctgttatctttgtaagctgaaaatgtacgtcacctcaggaccactattgtacaaattgattgtaaaacatgtgtgtttggacaatatgaaatcagtgcaccttgaaaatgaacagaataacagcgattttagggaacaagggaagacaaccataaggtgtgaccgcctgcagggtcaggcaaaaagagccatatttttcttgttgcagagagcctataaacagacgtgcaagtaggagagatattgctaaattcttttcctagcaaggaatataatattaagaccctaggaaaagaattgcattcctggggggaggtctataaacagctgctctgggaatgtctgtcctatgcagttgagataaggactgagacatgccctggtctcctgcagtaccttcaggcttactaggattgggaaaccccagccctggtaaatttgaggtcagaccggttctctgctcttgaaccctgttttctgttaatatgtttatcaagacaatacgtacaccgctgaacgtagacccttatcaggagtttctgattttgccctggtcctgtttcctcagaagcatgtgatccttgctctgccttttgtcccttgaagcatgtgacctactccctgtttgtaaaccccttttgaaatccttaataaaacttgctgggtttgcggctcaggtgggcatcatggacctatcaatatgtgatgtcgcccccagcagcccagctgtaaaattcctctctttgtattctttctctttatatctcagactggctgacacttagggaaaatagaaagaacctacgttgaaacattgggggcaggttcccctgatacattatcatacccttatataaggaaggactgactgttaacacagcaactgttctggccagtctaagctctttgctaacttggatctttgtactgtggtataagaagatcttcttggctgggtgcggtgcctcacgtatgtaatcccagcactctgggaggctgaggtgggtggatcatgaggtcaggagttcgagaccatcctggctaacatggtgaaaccccatctctactaaaaatacaaaaaattagccagacgtggtggtgggcgcctgtagtcccagctactcaggaggctgaggcaggagaatggtgtgaacctgggaggcagagcttgcagtgagcagagattgcaccactgcactccagcctgggtgacagagcgagactccatcgcaaaaaaaaaaaaaaaaaaaaaaaaaagatgatcttctcctataagatttgacttacttgccctgagatattttcagcttttccacatacaactgacagatgacatcctggcatccctgacttgtggtaccagaagtgttggagagttggtctatcctaatctcctaaggctttctggaaagggtaaggagaccagagagcaatacttatatcactccagctgaaaatagggaccatcccagagagggcccaggctctaagaacagcccaatttctcaggtttgtgggaccctaactgtatatgcttcacagccaaggtctaattgcagcatagtccacaaaggcctcatttaaacctaatgacggctgggtgcagtgtctcacgcctataatcccagtactttgggaggccgagatgggtggatcacttgaagccaggagttccagagcagcctggccatcatggcgaaacctcatctctactaaaaatacaaaaattagccaggcatgggggcgcatgctggtaatcccagctactcgggaggctgaggcaggacaatcgcttgaacctcagaggcagaggttgcagtgagccaagactgcaccactgcactccagcctgggtgagagagcgagactctgtctcaaaaaacaaaacaaaacaaaacaacccaatgacaattgcaaaacaagggccaacataccatcctgcctttttgttgagagctcaccttgaaaatttctgccatttttcgttgctgaggcaatgaacagtggttctcaatcgatatgatgattggcaggtcagagttgatgaaggcactgcgatcaatggcttcaaccacttcctatgagagccaaaacagctcattagagtccagatatctgtcaaggtggtcagaaggcagggtagttatagccacagaaagcatctcaattgttacatgcagcagactctggccaaagatggttttcgtattttcaaatgaagcatgaggataaggccattttgtagaaagacattaaactttatagtgagtattgttcacatactataaggaacaactatcatattgaatttaacaaatctatttatatacatatactctctctgtatacatatatagagtatattgcaggtaaaagacactgtcctagttatagcagcaaacataattaagcataaaatactttcttgcttataaagagtttataatttatttgaggcaataagacatatgtcacatatatttatgtgtatatgtaaacacagttatcaactcatgcccatgccaatatagcatacaggagttttaggaatgctaaataggaaaccaagttgaggagaaaatgcattttagccactatttctacatgtaaaataaaaataatattccttcacaacctggccacagttcagagaaaaattatgttatatagcctaagaccctctgaatgaaggtagtaattgcataactcaactaataagctacccagaatttgaaacacaaatccagtgagatcagtcttcctgggtgaccaatcttcttaggtggaactgatgctcattacattataatgctaactatttaaccatctcctaactcctgacattggcctttgtcagcatgacactaggacaaatgaccattaattcctatagcaggaaaatagaccttgcctttatatatcatattacgtaaaaattgcaacaatattattacatgctaactaatgtaaggtaatggttactaacttgggttgaatggggaatctaatgagagttctagattaactccagaaaaatgaacatgtgcacattccacatgatacagcaaacacttttgggaagtcttcatttagacccagcataaagacccttgatctaaggtgtaatttggtcaagtcactgatttaaataaagaatgaaggccaggcacggtggctcacgtctgtaatcccggtactttgggaggctgaggggcgggcggagcacttgaggtcaggagtttgagaccagcctggccaacgtggtgaaaccccatctctactggaaatacaaaaattggctgggcttgatggtatgggcttgtaatcctagctacttgggaggctgatgtaggagaatctcttgaacctcggaggcagaggttgcagtgagccaagatggtaccactctactccagcctggataacagagcgagaacccgtctcaaaaaaaaaaaaaaaaaaaaaaaaagacaaatgaagataatgtctctttgtgatttgatttaaagaaagttatgaaggattaccttgaaggggatcttggttgtcagcgtatgtccatgataaatgatgggcatcccatcgtctccgtcccagcagtccaattctacacttcgacagccttgcaaaaggacctgtgtgatcaatgagcgaatccaccccaggtgagcacctggagataaagcctcgaactaaacccagcatgtagttctacatatcaggcagtgtttacactcaggactaaagcagaagggcaaatggtctaaaacaaacatggcatttttgccaaaggccacaattaatccagagtggggaaggaagggaacagattaaggtagaaagagtgtttaccagagctggatattaaaggaaagtaaaatttgatagcaaaaccatatggccattttcctagcaactttggccccttgaaagggcacgtcttcaaattagagagccaggcaagtgctctctatctgggtagacatcaatggaggtgaaaatgctgatgccacagcccagagaaaataaggccactgagtccttaatgaactggctaaacatttacagcaagccaatcaggataaaatcacttccattaagacccaaattaagccacgattaaacatctttgctgtgaatgcataacatgtaagaagagtggaagcagagttatcaaggatttgcctggctatctaattccagaatagcaactagagcagggatggcaaataatccataaatggttcctttctcccatacccacagcagacatcagtaatcaagctaggcacacttgtcctttaagctttaatatgttagctcataacctctttattaaagtgctccagaaaacactaccaaagaatcagatgagctgatacctatttgttatcctggatctgaagtgggaagcagagctcaatacatgtgcttgggttgcaactctataaagtttgcttgaagcaacctcttcctccatagatctgtacatcatcttaaaaaattattacatactggaatagtgacccaagccaagaaattgatacatctgtaaatgtgcctacccactgattttagaatgcacataactatttctgtgtgacagcaatccattactggggcttagtggccactagagtttctgcaactaagctcagatagtggaatgattctcattttaacacttttatatgggataagtgctatattcttcctattttacagcatagtcagtggcctagaatctcaaggctatctgcttctttcagcagctagagtatctagaggtgcagtgccttgggctggaaattgctatgtaaaatggtggctggaacaccaagctgcttatctctgtggtgcccctgccagaccaggaataatgttcagcaactggcaacagatgagatggcttttcagcattgaaggactaaaggtcttcaccaaagtctgtgtaaccttagatatccacatatggctagaagaggaaaacctgggctggaaattctagatgagaagaacagggcttattctcacttcccatttgccccatggagtaatgttaagaggtaattaggaagggctaaggaagagtggagaggggttagaaatgaagtaagagggatccacctgcacactaggtttagtcacatctctgagtctatttgaggggttcttgtgccttattcaaaagctgtgagagtctctccttggggtgtgatattaagaggtttaaaaactgtttgaagtcaaacagaggaatgaaatagaaattaaagccaggacactggtccttgtttatttccctgggataaatgtggatacacacaagtacataaatatacatagatatgtatatatgcacttacacatatatgtacacgcatgtatatgtgtgtacctacaaatgtgtatatgaaatatatataagtatctgtatttatatgtatatttaatttcattcctatagaataatggatttcaaacttcttttaactttggcattctgtgtgcgaagggagggccagtatgtagtgtgtagaggagtagtacattacctgaaatggggcagcgtatggcacccctcctactctctggcttcctcatctcagtgtggggggctgaggccccatgacagaacttctattttgaaaatcactgctctaagaacacatcttcattcataataaagtttccttagaaaatagagtttaaaatacatattcccgctaagcaagctttgggacaaaaaattgccccatgctttgaggaatatctggactaatctggagaacaaagaaacctcactggtgctggggttatgtaaacaatacacctgtagttttcaaacctggacccacgtgtgcacacaatgacacacttatattccctgcctggctccaaccgaattgacccttcttgaaagagttaagaaaaaaggcagaatagatgaggaagctgcagaccatccagcagagaggcaatggacacgcagatcattgcaagttggatgtttaggtcaaaaggatgtactttttctagtctagagaacctactgagtttcaaagaacattctgatgaatttaatgtgtagggacagtgcctaaagtctgtgtagatttttttctgcattttttttggttaccatagggatagattgattatttaacaaactgaaaagcaaaacaaacaatattttgggaataagtacataggaagttgcattttctactatgctttcccactacaatatattatttagcagttagagagacgattagataattttcccatgggaaaatctaattttagtgggagtaggtcagactaactaggatctaaaagctatgagtctcaaacaaacactttcattttggcccagaataaaggttaagtatagatgggggaaaacaaaacaaaagaagtaaagaaaacgactgctgtagtatagccagttttcccacacatcatggttcctcacatttgacatgtaatagcttactctataagctcttcaaaggagtctggggtcaggtttttttgactttgggggttacataaataattaggtttaataaaaaccacattccaagtggcattccctgtacctggctgtagagttctaccgaggattctcctttgagctgatggcccgtgaggtaggtattgtgcgaagattcgatgtaatagtatgagaggggtagctgcagttctttaatgttctcctgtgactcatcattttttgaggcaaaattttctttatccatcagaaacctaggtgaaacaaattttcttaagactgcatgggaaaaatgcatctactcttaaaagatgggcaaaagatattttaaaagttacctggcaaacccttcaaatgacattagtccctgatgacacatactgatgctaggctcgaacttctgcaagggattaaaaaaaaaagtgttatttaggttaaggaaactaagagggggaaagaaaccaccacatcattttttaaagctgttctgttttcatcaggaaacatctaaaccaaatatttgaactaatttagtaacgtagtggtaagaagtagtttttagtccaaaagaaaacatttattatatgtgagtttattatactaagcatatttatttaatagaaaaaagaagagaatgagaaaagaaggctgatttctatgaaaacaaagtgtatcagtttatccaggtgaaaatggggataataatagcagctaccataaagttggtgagaggtgaactgagatgattcacatagagcacttagtgccatgcctgtatttagtaaaatcataatgagcactcaacagtgtgatagtaatctcacaattttagcattttcggtgatcaaatccaactgctggacaactaatacactgatacccagtcaggtgataagggaggttgaaacctagactcatttgttgcatggagccacaccgctcctctctgctgacaccctgtagtgtaaaccttcaccagctattgctggttactatgatagcttcctaagcagtctctctgcatctgttccttcacccacacagtttacaatggggccagagtaaccacttaaaattttgttttagagacagggtcttactatattgcccagcctggcctcaaacttctgggctcaggcaatccttctgcctcagcttcctgagtagctgggactacaggtttgtgccaccatgcgtggctcagagtaatctcataaaaaataaatcagccaggcgcggtggctcacgcctgtaatcctagcactttgggaggctgaggtgggtggatcacgaggtcaggagttcgagaccagcctggccaacatggtgaaaccccatctctagtaaaaatacaaaaattagctgggcatggtgctgtgtgcctgtaatcccagctacttgggaggctgaggcaggagaattgcttgaacctgggaggcggaggttgcagtgaacaaagatcgcgccactgccctccagcctgggtgacagagcaagactctgtctcaaaaaaaaaaaaaaaaaaaaaaaaaaatcaaatcatgttactcccctgctcaaaaatttcagtggtatcccatttcacatggactaaagccaacctccttatcaagctctaaaaggcccggatgattgggcccttgcacatctgtctgacaccatgcctgccattctctgcctggcttgtgcagctcacagtacaccagctttttgtggttcctcataaacccccagcttgctgctgtcttggtctttgaccttgtggctccctgtggggaatgctctttcccgagaccatcaaactggttattgacttagggctcagtccaaatgccacctcttccaagtggcctttgcttactctcctcagcccacctcctgtatcattccattcctttacttgactcagtttttcccctaccccattattacctgaaattacatcgtatctttgttgtctgcctcaccttctagaatgtaagctgcattgaggaccagaacttttatcttattctctgctatattcccacctcctaaaactgagccagcatagtaggaactagtgcatgttcatttaatgactaatgaggttgaaaacctagactaaatctgttgcatgttctagaataacaacaaaaaattatgtaccaactccttataatagttactgagttagagaaagcctgggacctacattaatatgtaataatacactaataatatgttaatattattacactaataatgttaaagaagaacatataatatgttaaagaaaaacatattatgtaataatacactaataatatgttaaagaagaacacttacatacttgttttttgtttgtttttttgagacagggtttcgctctgttacccagactggtgtgcggtggtgtgatcttagctcactgcaacctctgtgactcctgggctcaagcgattctcgtgtctcagcctcccaggtagctgggattataagcgtggaccaccatgcctggctgatttttctttttctttttttttttttttttgagatggggtcttgctctgttgccgaggctggaatgcagtggtgtgatctcagctcactgcagtctctgcctcccgtgttccagtgattctcctgctccactctcccaggtagctgggattacaggcacgcaccaccacacctggctaatttttgtatttttagtggagatgcagtttcaccatgttggccagactggtcttgaactcctgatctcaggtgatccaccggcctcagcctcccagagtgctgggattacaggcatgaaccaccacacccagcccatacttggtattttgttaaaaaacatacttggtattttgttaaaaaaacaaaacaaaacaaggtcgggcgcagtggctcacgcctgtaatcccagcactttgggaggccgaggtgggcagatcacgaggtcaagagattgagaccatcctggccaacatggtgaaaccccatctctactaaaaacacaaaaattagctgggcgtggtggcgcacacctgtagtcccagctactcaggaggctgaggcaggagaatcgtttgaacctgggaggcggaggttgtagtgagccgagatcacaccactgcactccagcctggccacagagtaagactctgtctcaaaaacacccaaaaaaacaaaaaaaaaaacaaaactgtatatctgtcccagatttaaaggctttggaaagaagtatagaaagaataaacatttagcagcaaattattagaatagccagaggcatcacacacacatgcacacacaaaacaggcacaaacctggatgatgctgaggatttcatcataagtgcagtgttctccttggcaattcacgaggaaatcgttgagctgaagtatgcccaccccaaaaatgcccagagatgtgctctcaatcccagtgccatttgtcacaatgcttgcagcagcaatggcatcagatatctgcctctggttgtccgatagctgctgtttactcttaatgaacaaccccaaatccgagacatttctggtcaacagatctgaaacagaatcaccacagtacatggacaagatagccagcatcttttgcaaagttcattttggagataatggtgtggagttattaaaatggagaagctctttactaatgtacctaaacaagccatcaaagaagtgtttatttctggcttcacatagtgataggaataaaaaacaaatcaatgaataaataaaggctgagcatggtggctcatgactgtaatcctagcactttgggaggctgaggcaggtggaccacctgaggtctggagctcaagaccagcctggccaacatggtgaatccccgtctctactagaaatacaaaaattagccaggcatggtggtgtgcacctgtagtcccagccactcgggaggctgaggcataagagttgcttgaacccaggaggcggcggttgcagtgagccaagattacgccactgcactctagcctgggcaacagagtgagagtctgtctcaaaaaaaaaaaaaaaaaggaaaagaagacagagctaggttgatgatcttgatatcccatgtggtattacatggcaactaaatgtaggttcagctggggacttaggtgaaattcaggctttggttttagggagtaactacttgcacatttttgtttgtagagattgaagatatacccttaaaattacagttttactgtttaatataagcatttgtttacagatttttatgtgaatataaatttttcaactcatttgggtaaataccaagtactgtaattgctggtcacatggaaggaatatgtttagcttagtaagaaactgccacactgtcttccaaagtggttgtaccagtttacattcccacctgcaatgttccaattgcttcacattcgcaccaactttggtatggccattttaattttagccactttggaagacagtctggcagtttcttatggagctaaacataggcttaccatatgatccagcaattgcactcttaggtatttacccaaatgatggaaaaacttatgcccacacaaaaacctgaatacaaatgtttatagcagctttattcataattgctaaaacttggaagcaaccaagatatacttcagtaggtgaatggataaacaaactgtagtacctccgcaaaatggaatgttacccagggtaaaaagaaatgggctaccaagctgcaaaaagccacggaggaaggaaacttaaatgcatattgctaagtgaaagacgccagtctgaaaatgctatgtactgtgtgattccaactatatgacattctggaaaaggcaaaactatggagataataaaaagagcagtggctgccagggatttggagggaggtcgcgggggggatggaaaaatgaagcataaggaactttcagggcagtgaaactgtcctgtatgatactgtaaaggtggatacatgtcattacacatttgtcaaaacccatagaatgcacaacacaaacagtgaatcctaacgttaactatggacttcagttcatcataatatatcaatattaactcaattgtaacaaatgtactacactaatgccagatattactaacagaagaaagtctgtgtgggagagtagaagagagtatattggaactctgtactttccactcatttttccataaacctaaaattgctctaaaaataaagtctaagctgggcatggaggctcatgcctaagatccctgcactttgggaagctgaggcaggaggattgcttgaggctaggagtttgagagcagcctggtcaacagagcaagaccctgtctctacaaaaaattacattattttaaaataataatattttaaaataaaacaaaaataaaaaatacatgaaaatcatgataaataataaaataataaaatataatagaacaaaaaataaagtccaataatttttgaaaaatgtaactacttgactaatccatggttatggagattttatgactaaagttgaacaatacttaatagtcttagctcaaggacaacataaacttataaataattatgaagcaactgcataaaagaggaaagttttttgttttgctatttgtgtttatagtttccaggaagaacagaggaggaaaatgataggctggaaatgcataagtggttagaaaatgcatgggtggtgatagtaatggtggtggtggtgagtgagatagaagaatgagacattcttgtttatacagtaggaaatatatcctggacaatcattcagacagaagtaccctgtggaaggcgctaaagactctccttgtcaaagggcaggagactactgccctgtgattgaacacacaactgtctgtaggtagggaagagactgggggttctccactgtgacacacaccacatacctagcagacatttggaaatggtcagtgatatggtttggctgtgtccccacccaaatttcatcttgaattgtagctcccacaattccatgttgtggaagggacctggtgggaggtagttgaatcatgggggcaggtctttcccatgtgaaaatgttctcatgatagtgaataagtctcatgagatctgatggttttataaaggggagtttttcctgcacaagttctcttgtctgctgccatgtgagacacgcctttcatcttcttccatgattgtaaggcctccccagccaggtggaactgtgagccccttaaacctctttttccttataaattacccagtcttgggtatgtcttcatcagcagcatgaaaatggactaatatagtcgggaaagggtttttggttgtcagaatgactggaaggctttattggttaaataaatacatgggcagaaccacacaatgatgaatttctttgctcaaaatgccagtagcacctgctccctcaacaccagatgacaccttaaaataattctctaagtgttggccaggtgaggtggctcatgcctgtaaactcagcactttgggaggctgaggtggcagatcacgaggtcaggagatcgagaccattctggctaacatggtgaaacccttgtctctattaaaaatacaaaaaattagccaggcatggtggcacatgccagtagtcccagctactcaggaggctgaggcaggagaatcaattgaacccgggaggtggaggtagcagtgagctgagattgcaccactgcactccagcctgggctacagagtgagactgcatctcaaaaaaaaaaaaaaaattctcttaagtctttccctacacagcagtaatagcacactatgtgggacaggctcagagtttgtgtgactggacctctgaccttaagttttagacagattgatcccaaagggaaatcctaaaatgttcaacaaacctaggtcaggctgaagatcgctggtgttttcatcaattgtcaggttggtgtagagtggggctgactcggagccagatcggttgcagggcactgcatagacatcaaacagatccttcaggtccttgcggctcctgacactgaatgaggaatggaaaacacctctcattgagtatctttatagaaatgggggggcctgagaaagaataagaaggaaacataagactgtacctgaatgatttgaacagctcaacaaattcaacaaaactcatgttgctatctgaaaccatgaagctctgaaatcccttcatgccgcctttgatccgcccgtgccagctactactgctccaagcactgcaacaaagacaaggccttcatgggcacaagggcaggccactgttgtgattctgtcccaccagacttgctccaattagcaatatgagcaaaaggatgagtgcaagttatttaagattgaagctattttccagtactctcttttcacatctcttaacctatattgtatcagaggaaataaaacatgttctatgtgaaaaagaaaacatgtttctagtctatttaataagggcccagggctgaggttaatattcctctattaatcaaatcagttctttgaaattgcagatcaatgggcaaaataactcagtgtttctgaagatgtctattaaaaagagccccaaattactcactcttaatctatgggaaataatgcacgttcttttctatattctaagttatagaattacatttaagaagaaacctttgagtgtattgtctgattcctttcttaaccagtccttagatgaaaacagagaagagcttttaaatattaatgaaaaatgtgaaccggaaaaatgttaagaatggaaagggctgggtgcggtggctcatgcttataatctcagcactttggaaggctgaggtgggaagattgcttgaccccaggtgttcgaaaccagcctggccaacatagtgaggcactgtctctaattttagaaaatttaaaaaagaatggaaaaaagccagctttgactaggattatatttgcaccttccaaggctgcatctattcaatgtagaaatatcagtcaactcagaacagacttactgtttcacaacattttttattttctatactgatttcctgacacaatggtatgagagatgttttgattatggtttgtagtcaaattaatgaacaggatctattttttaaattatactttaagttctagggtacatgtgcacaatgtacaggtttgttacatatgtatacatgtgccatgttggtatgctgcacccattaactcgtcctttacattaggtatatctcctaatgctatccctccctcctccctccaccccacaacaggccctggtgtgtgatattccccgccctgtgtccaagtgttctcattgttcaattcctacctatgagtgagaacacgcggtgtttggttttctgtccttgcgatagtttgctgagaatgatggtttccagcttcatctatgtccccacaaaggacatgaagctcatcctttttatggctgcatagtattccaatggtgtctatgtgtcacattttcttaatccagtctatcattgatggacatttgggttggttccaagtctttgctattgtgaatagtgccgcaataaacatacgtgtacatgtgtctttatagcagcatgatttataatcctttgggtatatgcccagtaatgggatggctgggtcaaatggtatttctagttctagaggacctgtttttttttgtcttggattttaaaagttttttttgaaatatttcaaatatataagaaagtatagagaatatcatgaagtctattttatgtatattaaatatataatctaaaaactatatatttaagactataaatataaaatatatagtttgttgaagtgactctcaaccctgctaacaatgttcactcatggaaaattaatttgtgctgacatttgaaggtcaccttcagcaatgaaagagcactacaaattgatagctttttagcattttgtagtcataggttgtaggttgtcgatccccagtgtagtgcaggaaacatagggtagaggtgcaggaagaggaaaaaggtgacttcatcatttgcagctaaagaagtaaatttcctgtcttgcttctttctggttgcagatccagctactgtctgtaggaacccatctccctttgattctaggaaactctgtttgtccactcttcccactatcagacttaggattcagtctagctttctcccttaatagcattcaagctgatttttcctcctgtcttgtgttttctttctgttttaaaacacttgagtgggtgctgatccctgtcctcctggggttggccttctgatcttgcatctggcatgttaatttctctttttaaaatattttcctcccttacttcgtcctttcttttcctgctcatgaatgattgaaataaacgggaaatgccatttaatccaggttccttgctgtttacccaggatactacacaggctgaaagtataataaacaggattctgatttttgtaacttttagttttgttatgaatctaaatttacataaaagttgcaagagtggtacaaagaattcccatataaccttgacccatgctcacccattgtagaatgtgaatgtataaagcataaattataagttcattgctcacattgtgaaagaatttttatttaaaagataatttactgtaggattcttttttctttctattttctgtttctttttctttctttctttctttcttttttttttttttttttgagacaagctctcactctgttgcctaggctggagcgcaatggcatgattatggctcactgcagccggaacctcccaggctcaagtgatactctcacacctcagcctcctgagtagctgggaccagaggtgagaaccaccacacccgctaattgttttactttttgtagagatggggtttctgttgctcaggctggtctcgaattcctgggggctcaagtgatcctccttccctgacctcctaaagtgctaggattacatgtgagagccaccgtgcccagccaggattgttaataagaagcttccaagagaaagagagagaaagggagaaagagagagaggggcgtggggagagagggaggggtggggagagagagagagagagagagagagagagagagagagagagagtgtgtgtgtgtgtgtgtgtgtgtgtgtgtgtgtgtgagataaagtaaagagttcctgttttagcttggttctgtctggaacctccacatctcttaaactttaatgtgggatacaggaggatggagcagcattctggttccctttggaagtctgccattttaatatcattccttcttctgagagggaagatattgtttcaaatatgtaatttgcatggaacttataaagtaatttatccagctttagatttatacttaaacatatccaacttgctgtgatacttgaattcattcctctagacatgcataacttacatatgagaaaagtattaaatatatttcatcgattagcaaaggggccaaatagtttacattaaaacaatctattctctcttcttcgtttagagcagtgctatccaatagaactttctgcaatgataaaaagaaatgttctctatctacactctttgggataataaccatcagcttcttgtggctatggagcacttgaaatgtcactactgtgactgaggaactgaattttaaattttctttaattttaattaatttacatttgaatttaaatacccacatctagttagtggctagtgtactggatagtacagatttggagaatcatggcttaggttttgttactgctactgacctttgaagtaatatgagaaggtaggagtacaaaattgggagaattaggatcatttaaaattttgggatttttcagttttcagttcaactatacatcaaaatgtgaaatagtctttccatagacaactgtaaagatatgcccttccacacaactggaataatgtgaagggtccttctgttttatcatgttaaggccccacctggatgggctcttgtttgaagaagacagcacaggggaggacactggcctgatgggagatgacgtcccggcagccaagttgggggacccagctgtggtcaaagagtgggctcttctggaagggagggggtttggagggttagcgatggcattcacctctgtgaggatgaaagacagaaaagagagaatgactcagattatactttccctcagaaccaaatacaaaccagagaggcttctggatgtctgagcaaatcaacctatgcagctggtttctatacaagcagcaccaaaatatctttatgaatgggctaatctggtggggtctcaactggctacatgttagaactgtctgggaagcttcaaaaataaataagatgtccaggtcccaaggtcccagccagagaatatctgaatcagttattcttagatgtggccagaggaatcagattttcttaaaagctctaatatgcagccaaggttgagaatcactggtttaatccatcaaattataccatgtatatctaatactccctgtcagtaatggcaagttaattaatggggattttattccaagcacactatgcttgcagaagtacctttaggtttcattgtctggttaggacaaagagttttgttagaaatgtttgcaatgcttaaatcacaatttaaaaccaaatgtatactttttttcccacaaaaattaaaaaacaaaaatctcagatgtaaacatgccgctttacctgattcttcttgttcattaatgtcttgaggatcagaaccactccggcttcgacactctttgtgcatcttggcctttcgggttgccatctcatcgtcagttacctctccactctcaccctgggaacacaaagctcacgatggttccaagcctgtatttctctcccatcactgctttagttcaggtaggtctctattttctgacctacccaccttcaatactgcctcttcctggtaaaaccggtaaagacctacattaaggctgaccgagtattctcatgtcatattatttcagttgttctttactatacagcagtactcctcaggggagggaggcagacaagaggcggcacagaacctccggaacctctgtgtacagaaaaaaactgtgaagcagataaaatttgacatgagcatcaaagcctcccataagcaaagagagtggcactttttctagatagatgatatggtttggatgtttgtccccttcaaatctcatgttgaaatgtaattcccagtgttagaggtggggcctagtgggaggtgtttggatcatgggggtggatccctcatgaatggctgaggatcattcccttggtgatgagtgagttctagctctgacttcacacaagatctagttatttaaaagtgtgtaggctgggtgtggtggctcatgcctgtaatcccaacactttgggaggctgagacaataggattacttaaggcctggagttcgagaccagcctgggcaacatagtgagaccctgtctctataaaaaataaaaaaaattagccaggcatggtggtgtacacctgtggtcccagatacttggcaggctgaggcaggagaacagcttgagcccaggagtttgaagctgcagtgagccatgatcacaccactgcactccagcctgggtgacagagcaagaccctgtttctaagagaaaaaaaaagtgtgtggcacctctccccttctctctcactcctgctcttgccatgtcatgcgctggctcccgcttcaccttctgccatgactgtaagcttccggaggctgtcaccagaagcagatgctggcaccatgcttcctgtacacctgcagaactgtgagtcaattaaccttctttctttataaattacccagcctcaagtatttctttatagcaacacaaacaaacaaatagccatgaagcaaatatattatcacttcatagtgatatttcatattatatagtttataatacacagtgctaatatactttacattgtgttctacacacagtatttggggcctctgtgatctctgttctcttctagcccttccttgcccacagagtgctcatgctctagccatccagaacagcatgtgcttccttgaacaagctgtcttttatgcctctatgctgtctcctctgctggggatactttctcctatgttctttgcttggtaaaatcctacacgttcttcaagacctgcgtgtcagttgctctgtggagccctctgtgcctgcccctcagctctctattttccttctctctgcccccacagcactttgtgggtgactcaacgatgtctctttttagctcgcactgtgtttgtttacatgtctatgtccttctgcggaccttgtcttttccctggtgttcctggcactagcatggcaccatggaggtatgtggtaagcccttgtatcttctattttatacctgactttgtcctcaacccaaacaaccttaagtgttttatggtgatgttcaccatacagcggtcctggaagatgggtttaatgcttaataaacaaataacactctaccctcatgaggattttcttctttttcttggtagtgcttatgcccagggtattgtttctctgcatattgggcttctcagcattctttgctgatgttccggggctggggtttcgagcactccaccgtctgccaccaaacaactccacagcgtgagccaaagttgggccttcataccgtccatcctcctgtgaaagagccacatggtgaacacaataggaagcatcaagcaatggggaagtaaatatattaatgtctcccagaaaattccaagaggtggaagagcacagacggccacagaagaataatgatctggccacccaagtgactgttttctaactcacaagattctctgtcaggaatttcatcatgtcccccgttgtcctggtcacatcactgctgagttccagtgacatgctttaatacatcaactggggaacaaaaacttcccatcccatttacagaggttaaattgcagaactaccactgtaggaaaattcatttagacttactttgcaaattagggccttggacatcctggaagggagaggggcagggtatcaatctaagtaaaatcaagttgtatttgtccattattgccaggtaggttttcaactagtttgatgcttgggacagtcggacttgaaatacagggtgtgtgtgacatgcatgaaattccctttgaagggccccagggagctcctaaaatagttgggctgccatccccttgagtggctgaaatctaaagatagggagcccatgggactcagaacaccatacatattaggatgctctgagcagcaacaacacactcaaggggcaggcaattgttcacagtagctactgcttctaaggcaactctgtgtagcatcctgtaagtaacagcagggatctattaattaaacaattgtcaatgattctccccataagtcagttaataaaaccacaaaaagttgcctatgagctaaagatgatattgatatttcatacactgtataagcgggctctttaaaaattaatttccatgtactgtgtttactcttcaaaaacatttcaggctggctctcctttgcagttccaaagaaatgcttatggatagattttgctttgttgcagatcatatgcaaaaaacaaagaagctttgtgtgtgtgtgtgcttgctccttcagcctaatgtttaataactatctgatgttatgacttgtgcattcccacttcctgcatcctgctgtggatcccaggatgctgaataacttgggtacttgacaaagaaacctttgggtgacctcttatagtgggacattgtgacttatggctgtccatgatctgtttctcccttctctaaccataccccgattttactttaactgtctattctccactggatatagtctcgatgggtgtgtcaatcaagatgaaatatcctcctttgaccaatgattggcacatgatcccaataagccaatcagaagccccttcctggagcagggttcttgaatgcagtgatacagagaatgaaaatggttggagatcagtccatctgctggaggcctgctgaagagaatccctgctaacaagtcactaggagtgacttcaaattggaataaacatttcatgaatgaaacctaatggatacgttttaactaccattttgaataacatactctgaatctgaaagaagagtaaaacttttatttatggattttaaccaatacatctttaaaagcttaataggcccattatagtttacatgtaaaataattggcaccattaacctatactgctttgatttttctaatttcagaacatcccaacatgggtcaaactttaccactaacagaaatatgtttaggtcaggaaaaggaaggatacctttgtttagtctttaaaggaagctttctgggaagtaaaatgtagttttaatctttcttttgttttacacaaaataataaacttgtttgggatggatgaaggatatactttcttctcttttttttttcttggagatggagtctccctctgtcgcccaggctggagtgcagtggtgtgatcttggctcactgcaacctccgcctcccggtttcaactgattctcctgcctcaattcccaggtgtctgggattacaggtgcgtaccaccacacccagctaatttttgcatttttagtagagatggagtttcaccatgttggccaggctggtctcgaacccctggcctcaagtgatccacccacttcggcctcccaaagtgctgggattacagctctgagccaccgcacctggcctaccttctttttttaatgtgggagatggactactgtaagtgaaggcacatgttcaattttagaaaacagtttttttttttttttttttgagacagagtctcgcactcttgcccaggctggagtgcagtggagaaaacagtttatgtgaaagttgaagattagaaaatagattccttaaaaaatatccatgcactgttacctcttggcatatctttgcatgtgacattttgaagaccattaaactaatctacatcctttgaatgaatcttttttttttcccccacgtaaagatagccagaatcttttttgcttataaccaaagatatttacctggtaattccatatttaactttcttagcctcccagagcaccttccaaatacccaggattatgggccatcagttctgtccatgataaccttgggccaaagctcaagacattggtctttcctccacaccccacatcaacatctctgcagtttactttcttggattttcctgtatttttctaggcttctctacaaatgttattacttcttcttgtcttctgtgttatctcttgttactacttccatcagtagtactcaaatacttgtagtatttgaaagtaacttcacttacatttactacataaggaaattctaatgtcagaatgattattttccatataagcacttcccaaactagggattaaaaaatcctcttatagagctgttaacagaagtttggaaaaacccaaacattgtttcacaaatttctttagcttataggtaaatttaaatagtttttttttttaactttagggcatctgagagaatttaattttctaagaggtattataaatcaccaatacagctattaaacattaacaaaagatttgatcttttgttctctgagtactaagttagcatctttttggtgatccctgagtcagtttgggaactggtttatatgatgagaaaatgatcagtccattggtctttccaacttttttctttcgaaagaaatcttgagtgtctgtttctaaggcacgttgcctgacttcataaatggctcatgtagagagagcagtgtcaaggaataacatcacctatatttcagaagtggttgagtatgagctgttttgcctctacactgtaacatcttggttctgtgcaggggtggtgggggagggtggagctgtgtttgcagctgggtaggactgagtcttctctaagtcacttctgtctctgttctagcagcaactcttacctcttcacctgccgttcgtggtctcagctggtgcctccttcagtaaaagctgaagagtgccagggtaaatgagaaaccaagtacctcttatgtattaattcagttacctatgctataagcttgagaagcagacaaatggaacaactaaaccacatagactttgtgacaggaattgtaattgagctcaaacactggtctatgtccatatttgatgaattttcctgattctagaaggccaaggaatagctgtaattaaaaactgacattcacaatagctcctgaagacttttttttttttttccagctgagtacactgaaagctccctgtgccctgtggagtacacaggaggcgggtattttttgtttgtttgtttgtttttttgagacagtcttgctctgtcacccaggctggagtgcagtggcattatcttggctcactgcaacctccatctcccaggctcaagcgattctcctgcctcagcctcatgagtagctgggattataggtgcatgactaattttttgtatttttagtagaggcgggattttgccatgttggccaggctggtctcgaactcctgacctcaagtgatctaccgcctcagcctcccaaagtgctgtgattacaggcataagccgccacacacagtcaggtatttgttttccattttagacgagttaactaaaactggctttgttctgtgtaacattaggataattgtgtacataggcctatctgcttattaatcaattaatcaagttagtcactcaggatatggtctctgctcataatcgtgacatgggtgtagggaaagaagaaagaaggggcattacatgtgccttgtctaacttcctggggcgagaaatgtttttaattgtcagaaatgtattagaactgtgacaagtacatgaaatcaggcatttgagtagttcaagtggtagttctatttgttctgtgacaatacaaaagatatttctttttgccatgaagatagaaaagcatagcaaagaaaaactgaatactttgacacaactcatttgagaatgacacttcaagtgtcacctgcttgtggagtttaagatttccaagcaatctgtatcctcttttccccaagggatgctactctggttatgcctgtgtctcttctatctcattcagcccagccctgttgccacgctaaactatagtgttagagtacctgataacgtagggttaatgaaagactaattcactcaatgtaagcagctgactgtgaaaaactgcccactaagggctgccaccactacaaacctaataaagaagaactccacataagaattatcccacatttggaaaaatttctttcaaccttaaagaaattaacccctcacctctacaattaggcagcaatatgcagtaagttaaagaactctccaaaagtcacatagcatgttaggaaatgaaccaggattttaatttcaatagggacagttttcagtgaatcagctagtcactaactaataataaaagtattcagataacaatgctttccattgaaacctgagtaagtgaaaatgcttatattaactggtttctttgcagatgggagaactacaatgatcctgggactatttttatgtagtataatacaatatataaatataatacaaaataaaaaccgcgaccagggtcattatagttctcccatctgcaaagaaaccagttaacataagcattttcagttactataaaatctaagtaaaatgtatttcatacaaaatacaaataggaccacctatgagtgcagatactattcttcatacttatgaattatactgtggctttacacatattaactttttttttttttttttttcctgagacagagtcttgctctgttgcccaggctggaatgcagtggcacgatcttggctcactgcaacctctgcctcctgggttccagcgattctcctgcctcagcctactgagtagctgggattacaggcatgtgccaccatgcccagcaaatttttgtatttttagtagagacggggtttcaccatgttggccaggccggtctcaaactcctgaccttgggtgatccacccatcttggcctcccagagtgctgggattacaggcgtgagccacagcctcaattaattctcacagccaccctgtgagcaggtgttattatttccattttatagaaaaggggattggggtaccaagaggttaagtaaaagctgcccaaggtcaccacaggtagtaactgtcagagctgggagcatgaacctggtggtctggtcacccagtgtgtgctcttgagtattatgccagtgaggaaagagggatggctgcaccccttacctgataaaggctgacgtactgtttccgcagccactgctgtctttggtcagggaatttcctcatctttctcacagctctagtgagttccaataatccgctgaagagcattttagctgtgtgctttggtgccacgaagtgcaataatctgttgtctgtggtctgaagcccatagagcaatgtcacaccagtctctgacaggaacatgctacccagtttgttctgaacacacacagtgtgtatatcaatgccagggtggcccatgtatacagccttcactgcaaaaagatccaagaccccttccgtcaggctacttaatccagcattacccagtagtgggaattttccaggctcagctgtgttattaagtacaccaagttttgctttactgctggctggggaggcagttgtgggctttacccaggtcaaggtgctattgtcgggctgaagctggaggaagcagcgggcagagaggtgtgtgtcctggtcgtagtggatgaccgtggccccctgcagcaggaactggtgcacatcggcttggatggacagcacgtaccaagggatgagctccgtcccatggtcgaaggccttctgtgagtcctctgaaccatgagagtcgtattctttggattgctcaaagatgtcattgtctgaatccaacaaatctccaattataaaccttaaggaaagaaacaccaatttggtttgtcttataatcaagtgagaacaacccaaagacattttcactgacactgggctttatttttcatcgcactatgaattcaaattagcataggaaatacaaaatactaaatagcacacagtaacttctaataaccgaggccaggtgtggtggcttacgcctgtaatcccagcactttgggaggctgagggtggaccacttgagtccagtagatcaagaccagcctggccaacatggtgaaaccccctctctactaaaaatacaaaaatcagtcaggcatggtggcatatgcctgtagtcccagctacttgagaggctgaggcaggagaattgcttgaacccgggaggcggagcttgcagtgagctgcgatcgtgccactgcactccagcctaggcgacagagcaaaaaaaaaattttgagtaactttttataaccgtattctaatattctttataactgtattcttatctttagcaaggtatctgaccataagcataagaaaacaactactagatgagttattgtatttttattctcaacaacaataatctttattatgtattagttttccttcttgtgtcaggaaccgtgttaaatactttatgtacattttttgtactaaatccaatctacttgcaaggtaagttttattattctttttctacctatgaggaaaccgaggttcagaaagggaaagtaatttgttcaaggtaacccctctcagaggaggccaagccaaggtgagattttggtctaactttatacctgggattttcattgttaggcttgtttgccttcaattaaatcataaacacaagtcatgatctgaatatactgggactttagtcctttttaggtttttttaacctttttaggttaaaaaaggacttaataggctggcttgagaagtacctctgttaaactgttaaaaataaaatacaattagttcaaagatactccttggaaagaaagtaggcagactgcttgagcccagaagtttgagaccaggctgggcaacatggtgagatcccatctctacaaaaaatacaaacattagctgagtatggtggcatgcctatagtcccagctacttaagaggctgaggtgggaggattgctggagcctgggaggtagagtctgcagtgagctgtgatggcatcgttgaactccagcctgggcaatagagcaagaccctgtctcaaaaaataaaaataaatgacatttaaaaaggacactccttgggaaatatggtcacggtggccagaaaagcataacagttctcctggactcaaccttagatttctactctctctgtgcatgtgtgtaggtatacacagaaaaggctagtttgcatagaaaatttagcacgttccctccgctgagtcaggaacctggattatttgagccaagaggatcagagaacagtgaaggcaagcgattgcttctttcttacatggccaccttggcaggaacctgcccaagagtctcattcttttcaaagcataggaagttgttagtaagatcaaggtttctgctatttggtccacagacatcaccagcaaagtggtgagtaaaattgtgaaggagctggtacataggctggtccacgcgtctctgggaaggaaggctctcatgctcaggagacacttgggccacctactgcctcttgatgaggcaacgacagtatcatggggcttgttgatactcctcagtttagactatggtccctgaacaagattaccattcttgctttcaaacagcaggttctacatccttgccccacacgtggatattctttaaaaaaaaagtctaccacaaatattgaattttagtgtctcacaaatctgacggtgagaaaatccatttcagagccccataccagaaataaccaaaagtccagcaacaataaaatgtatgcatagattttggtgtattcatgcaatgtaattctgtacagcaatgaaaatgaataagcaatagctaactacatggaataacacaaattttaagcaagacacacaagaatgcatatggtatgtatttgtgatacataaatacatacatttctgtaaatgtcaatttcaaaaccaggcaaaaactatactgtactatttaggaaggcatattagtagaaaaactacaaagaaaaacaagatgttattgtaaaacttataatagtagttttctctagggggaggctggtaataattcagaagggaaataagaagtttaggggtgctggcaatgttctaaccctggatgctagttatgctcagtcacctgataattattcaaatacactgtttcgataaacttttaattttaggatagttttagatttatagaaaattccaaagacagtgtacctcacacaaaaatttccctattaacatcttacattagtctggtatatgtgtcataattcatgaacaaatcctaacacattatcactaattaaggtccacactttattcagattttcttagtttttaatgtcccttttctcttccaggatctcccattacatttacttgtcaggtctctttaggctcctcttgactatgagggtctctccttgttttaggtgctcttgacagtttggaggagtactgctcaggtgttttcttgaaggcccctcagttaggacttggctgatattttttccataactagatgcaggttatgggtttggggagggaagaccatagaggtaaagtatcattcttatcacatcatattgagggcacctactaccaacatgacttctctctggtgatactgatcacctggctgaggacctgtgtgtcatgtgccactgtacagttactactattattatttttaactcatttccatactctactctttgggaaaaagtcaccatgcccaactcactcttaaggagtggggagttatgttgcacttccttgagggtgaagaatctgcctaagttattgggaattcttttgcacaaaagatggatctcttctcccccatttgtttatttatcatttacacatatcatttacttgtatcagtatgagctcatgaatattaatttaatactttgggtgatttataatgtgatactactttatttattttgttgctgtggctattgggagctcttccagttggttcttgtattcctttcacagctcccatcactgtgtgtttcttttgagaacttccttactacaacatgctccaggctcaccttgtgtattttctgccccagtcctcgaatcagcctctctaggagaaaccttgcctccctttactgaagaatggtattagaaaccaagatctgggccatgcgcagtggctcacatctgtaatcccagcactatgggagaccaagacaggtgaatctcttgaggccaggagttcaagaccagcctggcgaacatggtaaaaccccgtctctactaaaaatacaaaaattagctgggcgtggtggcaggcacctgtagtcccagctacctgggacgctgagtcacaagaattgcttgaacttgggaggctgagcttgtagtgagcagtgagctggcattgtgccactgcattccagcctgggcaacagaacaagactctgtctcaaaaaaataaaaataaaaaataaaacaacaaaaacaaaaaaaacacaagatctggggttacatgatattttatgctcttttcctaatgttacttcataataaaaagtgaaataagaaaaaaatcatttgtgtcttatttagctccatccctctgaaattgctctcggtaacactggaaaaccaatacttatgtcctcttacacaatggcttcatacatgcctgctgcagtcatcctgggtttaatgttaaacatcaccacctgtttcctgtgtgacctcatcaaaacactcaacctctctgagcctcactattagatggcaaaaagacaatgctcatctcatagaataatggtgaagatcaaataagataacagttggaaagcacttagcacagcgcctgtcttggtaaagtacactcattaaatataggaagaccaattctttgcacttttcctttctcacttcctcttctctaggctacctcagcccagcccagctgttcctctagaggggcttttttttttttttttttctggagatggagtcttgctctgttgcccaggctggagtgcagtggcacaatctcagctcactgcaacctccgcctcccaggttcaggcaattctgcctcagcctcctgagtagttgggattacaggtgcccgccaccacacccggctaatttttgtatttttagtagagacagggtttcaccatcttggccaggctggtcttgaactcctgaccttgtgatccacctgcctcggcctcccaaagtgctgggattacaggggggagccaccatgcccggccaaggggctttcttttgggaccatttccacattctccatgtcctacttcttgttgttttaagagcaaaaaggattcaattggtgagtgttagtacccattaaaatacaacatgtaaatttgtacatagaacttctgattttaatttagcaagataaatggtgttttccatattccatttaagttctgagttaagtcaagcatgttccagtgaaataccacaagcattataaaaaaatagtgtctggaaagaaaaattataaggcttttctggagcctgtttctgctgctcagagatgatgtaagctgggagagaggggacgctgtctttcttggcgtcagtttttattttagaatgcaaaaaagaactaatgccagatggtaataattccattaaaaagcaatcttccagggactaatgctcaaaataaaattgacaattgtttgtaatgaaataagttcatttcaagcaggaaactagtagcttttgtctcttacatgatatagtgaatgttatgcaattttgtgcctgattctcttagaagataatttcctgtgggtttacaagaagggataaggtggaatgttaagacttatttaggaactaaataatgttaaccgaagatcaaagatgtggtttaccagcaaagaaactatcttgtcaaactcaggttgtatgccttaaggagaggaccaaggagtaaaaatagaagaaaggtttttatcctgttcctaaagagcttccatggtatcattcagttagaaaccgtagacagataaatacttgtctaatgttccctgatgaaaattttacattgggtgatcaacaggtatttgttaacctggttaaatattttctttgtaagtgttcgtttgcttcctgccaatttaacataatcccttgaacatgaattaccacgtgacaaacaagcgtaaatttaattttttaagatagaagtaaatctatgtcctttccaaaggacttgccacagctgttctctctaataaaatctagcgtttttaatgctctcttctggaaaattcttgcttttaattaacctagcaccttccttgactataagcattctcttattatatgtgagtagtctgtgggttttggaaccagtctgcctgaatttaaatcctggccctgctagctatgagagtaaaatggaactgttgtgaagattaaatagtttaatatatggaaagaatttagagcagtgtttgcttaaagataggctctcaataaacattagcatcttaaatattgctaatgttattgttgtctggcttgagtttaagttagtatcataaaacaaaagacatccatacaaatagagcttctctgtaaaaatggtgtccaagtttcaagttgagatttaagtgagaaaaaagcctaaggtgaatgttgtgcagatagtgggaaaatggtctctgttacaaatcatgttgggtctcaggtgttggccaaagaagcagaaagagagaaatacaggatcccaggtatccccagcaaagccagaaagtgagactgtatgaaggtctgggctgggctgaggcagctgttgcagataaaggatgttgtgtgttgggcattgataaggttgaggcctgtctgcatccttccctgtggagaataactgatttcctatcattttatgatttggggcatccacatgcgtacgtgtgtgtgtgtggttaatcctggtaactattatcttttctcagatattctactttctcatgcttagctttctttttttcctatccctatggggttggattatcgtccaggcgcgtctctaacgaggttattgaggtagaaggacacagaaaatacctctttgcagtaagggagaggaggatgactgaggattgcctctgaaatggtgattactgccaagggtgtccacacttaagtgctggaacctcctgtattagtccattttcacactgttataaagaactgcccgagtttgggtaattataaaggaaagaggtttaattaactcacagttcagcatggctggggaggcctcaggaaacttacaatcatggtggacggtgaaggggaagcagaaggtgaagccttgctgcatcctcttcacaaggtggcaggaaaaagaatgaacgcaggaggaacaaccacacacttataaagccatcagatctcatgagaactcactatcgtgagaacacatgggagaaaccgcccccgtgattcaattacctccacctggtctctcccttgacacgtggggattatagggattacaaatcaagatgagagtttggctggaggcacagccaaaccatatcaccctcagaacttcagcttggtattttaagggtgtgatacacacattaatcacgatagccaccatctatattggcacttatagtatgccgtgcaatttgcttaatttataatcctcacaaaaaccctatcaagtagtattgtcatttccagtttacagatgacaaaactgaggcttagtaagattcagctacctacctaggtgacagaaatagtaagaggtggtgtcaaaattcagtcccaggcaatgtgactggaaggtttgagttcttaatcagctgaagcagcttccattgtaggtttctggcatcatctacttatatcttatttttccaaatgtacaaatccttcttaaggtgcagcatgccaaagagggtcaacaatattgaaaatgatgacaataagaacttgcagctcctatatgactctatactcttctctacacaccttcatactcctcatttctatttcccaacaatggtgccacatgctactcttaggtctccatgcctctatatgtttttaaacatacaaacgcatagtttatttattctttatgctggtaaataaaaaagtaattattaatgagcattataattcatatgaaatgtaattggaatgctttcagaattcagatgttcctaatcttcaggagttagacataaaaagaggctaagggttagtctctctacaatcaaaagaaatgccttaagcattttaggacaaaggatcctcccctgtgactgaacacatggtcaggctcatgacccggctctactgtttattagtcagacaagcgacttcagctcgctaggcacaacttcatctgtacagaagttagacaagcctacttgaagaccccattgacatttcaagattttttcaacccaattcccttcctgctgagatcttgaagtttgttttttgttgttgttgtagagacaaggtttcaccatgttgcccaggctgctcttgaattcctggactcaagtgatctacctgccttggcctcccaaagggctgggattacaggcataagccaccgggcccagcaaaaataaatcttgaactttttataatcactttttgagatttctatgagtgtttctagtggttttctggcaggagtagctgtgaggtttgggaagaattataagagcaccctgtaggtggggtaaaccaaaggaccatgagattgtcccttctttctttgctgtagttttcacagggctggttgttgccaagtgaacaggggctagaggttgctgtttgtagagtctctgtttcagccagatcaacaaagcatagttcctatgggcttttcaatctgcacatctttggcacacataaccctgcactggacaaaacatggggctctcaatcaggaatggattcccaagtcccagcagatggccacagaaatagtgcttactgatctggttttggtgaattctattaaacagccccaccaacctaacttgtgtgttgaggttcctttcagagtagcagtcacttgaggtaaagaagctatcactggcacttaggtacacaagtttcaaagtgaggatttcaatatgacttcacaggttttataaaagaaatatctgcatttttgtgtttttctcctcttctaagagtgcttgcagcagggcttggaaaatgggcagtggaagagaaatgttcttaggatgtacgtgataaaatgattaggaaaaagacaagagactgtggagaaaattagagacaaaaatttcataacgggtgaaaatgatgcaagaaagttaccacttgaaggaacttcgagggaaaggaaaggatagtctaggggtctgacactcagtaaaagtggcagtcctgaaggtgttttagaaaggtcaaacgacatacacacacagccccagatgaagccacattgtaaagcttcatctttaaagatgaaggctctttaaaaagagccatatgaaattcattattttatctattcctatctgatgtatcctagccttaacagtaggatttaaggaaggaatttcagccagatccagtatgaggagaaggcattcttctcccaaacatctgtttaatttttcttacaaatactgtgaaacttataatgaattgtgatttcctctttcctttgactgctaggaatctcagaacaaaatttagtcactgtatagactacatagtatacatttttgtatgttttattttctcatattcttatttttcttttctttaatatcctcaattattcatagttattcttaaaagcatctacaaaatcttttgttggaagaaatagatatatacatagatgccgagagagagagagagggagattaagaacttaaatggctctgagaggctttctgtgcagaggtgattatttgcagatggtcttctctctatatatagattgccactaatgttagcaacctgttaagtgaaaaatctttgaaataatctctgagaaactggaattactgagcaatttaaaaacctgcagatgccttgtgtgtgtagggttaattttaacacaccttacagagcagtgtttctcgaagtgagatcactaaccctcgacttagaatcacccagaggttggcagagataaaaatactgatttctaggtatcacccagacctaactaagtcagtagatttgatttaaaaatatcttaatacccaccctagtaccccacccaagaattaaaaaaaccactgttacaaaaactaggaaataaaagatcacagctctccttctgaaatttaatgtgttgaattcttagaaatggcaggatagctctaggtttttgttttttttttaaaggggtaacagatggtaagaagttaaattatgagcagtaattttagaacaaagcagcaaaatgagaaaggtaaatgtgaatttggaattggtaaggtttgaagataaagaagtgtggcttaatgataaaagtggcaggttttgatgaggtgtccatctgaaactaagctgaagtaggaaacaactcatcaacaggaaaaaagaagagatgagcattcctcacttttaacgtgtaaaacttactgccatcggcttttatccttcaaggagcttttcctggagctgtttccttcactggggctgtcctcctcgtctgtctccagacttcgattgcagctccggatgacctgaaagatgctgttgacagtggactccttctccgaattctttaagccattttgtcccactcgttgtaagaaattatcttgtccactgtaatctgctacaaactacaaaaaaaaatcgagaatttgctattgcaacttaatatgcctggataacatacttggctagggaaatgaaatcataaagtaataaataatggcatttgtgcctattttatgggaaagaaaacaagagcctccaggaaaaacattttttcatttcaccacatgaaatatcaaaactcacccttgtttccactgagacaactttaatccctctgggaatcgacactccacttcaaatttaaaacaaaaaaaatattatttcagggctccctaaggagaagattagccaatttgcagaggaagagcatggttattttatccttatagtgagaactgagaaaaaccatgagtaaagtatgctattctatggaaccagaaaaaatgactgggcccaagcaaaacactgagaagaggtgatgttttgctttattgctcatgtgttctataataacacagtggcttcttcctggtttttaagctctttaagccttattgttcatacagttgattaggaagcttctctcatcagaggtgagagctgtgtctgggataagagatgtggagttccctcttcttaagacatgaggaagctagggggtgtggcccgggagtcttcctttaagctttctcctccatttcttgcccttttatcctagctcataacccagagagatgccggtggtgttgcctgtacctgtcaggagctcttaagtctttctgatatcaggtgatgcctttgctcccaggtgacaaagaagaggctgaaggttgaggagagtcttcccactccatggagaaggcatgtacatgactctgtgtgtgtgtgtgtgtgtgtgtgtgtgtgtgtgtgtgaaaggtcagtagtaggttctgtcatcatggcaggaatgatcctagatttgggtttggtccccggtaagggacttctcaaaatctccataaagttctttccattttagtcacttctttcatttttaaacaccttggagggagcctccttatcttttccctccagtttctcaactccccttctctccaatgcccaatgccttgggtcaaagctcacactgtcccttctgctctgggaatcaggaacaggaggcaatggatctgggagaaacaaggctctgaggatcaggagcctggagcttgtctctacatgcgtctccaggctccccagcattttcccacaaaggatgaacagaaagcagtgttgacttcccctcttttttcttccactgatgtggaaaacttaatactctcaattgactgtcttcatcccctgcatccagacattcccacccaataagaaaaacctgtcaatctttaaaaaccatcagaaaacaacaccctttttgacttgtacttacatattaaacctaatacattaaaactaacttcacaatactatgtcccacacagcgctagttggcattcttttctacagaacttccaaggatctatgtgctacccagaaataatataacaactattaaccctgtgttcaatcagtgatcatttctttggtgagcacagacagggcctgatgagacagccagcaacagtggctcttcaggccacgatgattctgaaaggccttacctctaaagtttcttcttgggaattgtaccgcgggcaaagcttcatgagaccggaggcgccgtcaagcacttcacagagctccttcagaaacaccccacagaatggaaccaccttacagccagggatgtgcagggcacgtgtcaccacctttctgtactcacaagaggactcatgctgggccatagcatccttcaggctcctcatggtctcaatatcagactggtccatgaactgccacatttttaaaacttttcttgacctattgcaagtaaatgacatttttcagactgaaggagaaataatatagtttacagcaaggagcctaaattccatacaaattcattctttttaccattttttttttttaggtggagtctcactctgttgcccaggctggagtgcagtggtgcgatcttggctcactgcaacctctgcctcctgggttcaagcgattctcctgcctcagcctccctagtagctgggattataggcgcgcgccactatgcctggctaatttttatatttttagtagagacggggtttcgccatgttggccaagctggtctcgaactcctgacctcaggcgatccacctgcctcggcctctcaaagtgctgggattacaggcatgagccaccgcgcccagccccaatattctttacttgttaatatttatgtagggttcctatccccacctacttccccagataatatgaataatacttttgtaaattgaaactgaaaaataaataggacagatacaaacacaaataggcatatgggacgcgttagttatggaagctgggcactgaatgtaggtttgagtttttctggcagctatggccaaaaggggaaagtagagggtaatgtggtttgtacagatattggtggaggaggactgcctggggaaacttggcccatctggccctcttgatcttttaaatattactcttggatcaatccagtcccttagtgatcaacatgaagcccattgttttcacctcttctgtagaattgatttttactgaatcaagctttgacatgaagccaccagcccattttgggggaccttgttgtaaagtattatttgcattacaggatgttaagtgggactttccctattctgaaactcctgctgagacccacagatgacaatgcaccacaccttctaaagagaggccctcacaaggtgttacctgaactgctttgcccacagtggtctcccactctctttcagcccatgcagagaaagtggatctgagcagatagcttgggaatatttctctggggggaattgtgggagagctcacctttctgtgagaggatgaagtcaccccaagtgcagggggcagtaagtgaattccctggggacattgacctgtgtcccgggcagtctgtagatcacgtgaactggtgcatgactcttgcctaaagatttgaggctagctggagctccctggtggcaaagggagagaggattccagtagatatgtcctgtgcttgcagagttgggagggcaacatgctgactatttcctgtgagtcaggaggggatactgtgcaaagaggtggggcttgagctgtcttgaagggtctgcctgccaaatgaggcgaccctagcagaaagggcctgtgaggacaggaccccagggggtgaggaataagaggttgaccagagggtacactgcattttgctaggtaattgtgcagtggggagatggaaaaaattagagagagtaactagtaagaaaacctaaaagcaccctccattggtctctgtgagggcaccaaggccagattacaactgccccatcaagtaagactctgtgctccctctatccccatcctttcccatctcctctcctgtccacttcttttctgcagacacccagttgcagggaaaaggaagaaaaaagataaactctatcttcctcactactacaagtctctgagactggttgggttgtgaaacgtaaggaagggaagaagatatatattgaatgagatattaaaattttgatttagattaactgggttacaaaatcactgtgtaatatataagacatccaaagacataaagaagtacaacatgacaaacacccatgtgccaatctctcagtttaaaaaatcaaacatcaacaatgtggttgaggccctagtgtattcctccaagagcacatactctattcttccctcaccagacaggaccaccactggtactttggggttctcctttccttaaaattcttaatacttttccaacatatgcatatatcactaagcaagttacagaattgtgtatttttaaactttatgtaaatagtatcacatggtagatagtcttagaccaggggtccccacccctgggccgcagaccagtactggctcatggcctgttaggaactgggctgcacagcaggagatgagcagcgggcaagcaagcattacagcttgagctctgcctgctgtcagatcagcagtggcattagattctcatagcagcgcaaaccctactgtgaactgtgcatgtaagggatctaggttgcacgctccttatgagaatctaatgcctgatgatctgatgtggaacagtttcatctgaaaaccatctgcccccacccccacaccccgagtctgtggaaaaattgtcttccatgaaactggtctctgatgctaaaaaggctggggatccctgttttaaacaacttgctttttttttttttatacagccttaaatttgcaagactcattcatattcaagagcataggagaatgagattgtgtgttaactaggaaagtgactggaaaactacaggatctctcaatgtagcataatccagggttgagggagggagagctagttggaagctttgaaaggcaatcaaatcagaaaagtaaaagcattttatgatttcatcccactaaatccagcttgtcctataactggattcttataagacagtgagaattcttttttggggaatgaagtggaggttacaaacaaatgaagtgaatgaatgaatgagacatggttctcactggtttcttattgtgtgagtaatgaagtagttatggttcacttgggggcaaagggcaaacttcagcaaagatcaattctttattgttgaattgagaattgaaactatttttaaaacttttattcatctttatgattataaagatactactcattgtagaaaatctagaaaatatcaaaaatatagaaaacccacttacaattctaccacacacagacattaggtatattttctttcagtatttcttctattcttgtctatatgggcatataaatattgctgaggttattagggatagacagttttgttcccagatagattcatgtattatgtgtctcctgctttccaatgatataaaaacttttcaggccaggtgcagtggctcatgcctgtaatcccagcactttgggaggctgaggcaggggagatcacttgaggccaggagttccagaccagcctgggaaacatagaaagactccatctctaaaaaaatttttttaaatagccattgtgctggtacactccttgtagacctagctacttggaagccaaagtgggaggattacttgagcccagggtaagaggttacagtgagctatgatcttgctcctgcactccagcctgggtgacagagtgagatcttatctcttaaaaaattgttttttacctcatgcctgtaatcctagcactttgggaggctgaggcgtgtggatcacttgaggtcaggagttaaagatcagcctggccaacatgttgaaagtccatctctactaaaaatacaaaaaaattagcagggcatggtggcgtgcctgtaatcccagctacttgggagggtgaggccggagaattgctcaaatctgggaggtggaggttgcagtgagcgaagattgcaccactgcactccagcctgggcgacacggtgaggctccgtttaaaaaaaaaattttgttttttataaacatcatttttgatggctatataatattccattacctggatatagcatattatttcctttaactattttcctattgttgttcatttgggttattttaaactgacaccatgactgagtaaatactcttgattgtaaatatttgtacttcttactagtggcttaagagagctaagaatttagttagaggaagcaaaatgtacaatgtccataaaaaaaccaaagtcacttaataagtatgctttctcttcccatttaattgcttaaaaaataaaaaaaatctctattatgttggtaatagttaattgcttggaacctaaacactttcaaacctaaaagtgcacatataagctctgcctccataatcattgcatcataagagtatctggccacttatctcctgtgtacagaatagctgtcaacaaaagacctattatacgtggtactttcgcctatctatctgtaaagatcagtttagttttaagccaaatataggagcatgaaactaggcagcagtgggtctggggtgtgagacaaaatgcactgggatcaatgttgaggtctgtcctggtttgagattattcctcatttagggaaatcaccaggttctatggtcttcttggattttggatttaaactcagttgaatcttaaagtcccattcactctaggcctccataggtcactctgaggccgttcctgtaataagagaatctagaacatggtatgtggcagccagcctccaagacggcctcccatggtccacatctcctgattttgtggctttgtgcagtccccacccacaaggaatccatgctgtcctatgtgatcagtacaatatggcaagagtgactatgtatgattcccaaggctatcatataaaaggcattgcagcctctgcctccctctcttggatcacccacttcagaaggagccagtcaccgtgctgtgatggcagtcatgttgtggggtcaggaagcaaggtccctggccaacagccagcaccaacttgccagacacagaatgataagcatcattaaaataaaatgactttatcaaaatatgataattcttttcttaaaagaaatgtaatacatattttcttttttctgtttttttttgtttgtttgttttgttttttgatacagagtttccctcttattgcccaggctggagcgcaatggcatgatctcggctcactgcaacctccacctcctggttcaagcgattctcctgcctcagcctcctgagtagctgggattacaggcgcctgccaccatgcccagctaatttttgtatttttagtagagatggggttttaccatgttggccaggctggtctcaaactcctgacctcaggtgatctacccaccttggcctcccaaagtgctgggattacaggcatgagccaccgtgcccggcctacacgttttctttatagaaaattgatcacaaagagaatctaaatcatctggatataacctcctgttctccaaggctttgtttttttttctccccactttttccttcttttgagccatgcctgatgcatttgtatgactattttaaatgtcaaggacatgatcatttgggtttattctaagttaagaaagttgaaaacgacaaaaaaaaaattagaactctgggagttttcatctcctcccctaacccagaatccctacctagggacctggagaatcaaagaaaaatctcagtaatgttatgaactaacattcctttatagtgagaaccctcatgaggatggtgaatctcaggaagcaataacaatatcaatagcttctctttatgaggccttactatacgccacgcacatgtgtcaaatactatattatttcactgaattctacctaaagatgtaggtgctttttagtattatccccattttgcagacaaagtaactgaggctcaatgaagtcaagtagcttgcctggatcacacaggtattccttgggggaatcaggatttgattcctggataaggatttgattcctaatttgattctaacttaagaactcatgctcttcttcctcacataccatgctgcctcccacaggagtaagaacagttactttatgccaggtagctgaggctaaaaggggataaagcaggcaacctgatgaacagaatggtgattttgttattagcttgatggaaaaagcataagaacaggatatcatagtggtcaagctcatgggctccgaaaccaaggttgcctgtattcccagcaatgccaggtgaccttgggtgaatgacttaatttctcttagccttagcttcctcttttgtataatgtgggaataagaatagtatctacctgataaacctgttttgagaattaaaacatacaatatagggaatgtgcatagctcatacttgacatatagtgtttgttaataatgagagcttacattattggaggcctattgtcaatgctagccactgttattactaagggcagttggtggtctatagcatatagccctggaacactacataaggcaggcctgaaaagagacagataacagtggggtttacaggacaggaaggggaatagtcagtggtggggttgatcgggttatgcaaccaagtaatttcacttggcttggcaaagaacacaggatcacagcagacccagtgaagtaggattgtgactggcccacaggggctgaattctgcagcatctttgagggacagggcctttggtgctgaaagaagataatacatttcccaagttaatcatttccagttacctggcttgggtaaaggtgagtccctggacaattaattcagtgccattcaggtgatgagaagcgattgtgccaagataaccatattccccactgactatacctgaggccagccaagaactccatgacagcgttgtagttgcccatgttccagcagcatttggccacatgcaccaaatatgaaaagacttctcgcttctcctccatggagcctgccgtgaggatcagccatgtcacccaggagctcacctggaaaacacacagagacattcacgggaattatgtcctagaagcttggcaatttttttttccaaaagcattctttgtttttctaaaaatatcaatttggtattaggaaatgaaagacctgtaggtcctggctgggcgtggtggttcacgcctgtaatcccagcactttgggaggctgaggtgggcgaatcacctgaggtcaggagtttgagaccagcctggccagcgtggtgaaagcccgtttctactaaaaatacaaaaattagctgggcatggtggcaggcgcctataattccaactacttgggaagctgaggcaggagaatcgcttgaaccctgcctcagcttcaaggttgaaggttgcagcgagcagcgagaggcagaggttgcagcgagccgagattgtaccactgcactgcagcctgggtgacagagcaaggctctgtctcaaaaaaaaaaaaaaaaaaaaaaaaaagacctataggtccttaatctcttataactctctctttattttctttaaaacaagaaggctgaaaaaggcaattcataaaatcctttgattgaaaaaatttcttttgactataagaaaataaggcctaaggataattttgattgaaagatatttgactgatggacattaaaatgaaatgtacttaacccatcagttaaagacatttactaagtattaaaatacataatatcaaaggaaaaataaaaacatttttaaacaatcttttacaaatgctttatctattatgcccctcaaatgacaaaatattatgaacaaatatttatagagcacttattatgtgccaggagccattctaagcactttacctatattacctcatttatctctcacaacaattctaagagtcagggactgttactgtcctcagggatgtgtgtaaggtcttcaaccacgttgaaggtagcaaagcctaggtttgaacttagggtgtcttctccagaggttgcattatcaaccactcacaaaatgcctgatgtgtttacacaaactctaatgttcttcagttctgggcttaaagttattctaatgtgattcgtttttcctgctacacagactggaggacaatatttaaaaataatccatgtctacaccctccccttatgatatgcagcctctaaatcatctgcttctgctctatgattattttgctgccacctttactttggtgcttagatgctggtgtccacctaagttaccttctctatcctgactagcatctgggttgataagcttggttgtcaacagaccaaagtcttggtcttgacctcacatggccctacaagctccgcttggttcagcatcagtgctgaagcctggacagcaacacttttctctggactaagttagagaggccggaacacagagtttatggtgacccatgacaactgcaggaaataagagctcaaggtcaatggcatactgcctgtaagtggataaaatgataagaattaatggcattgagtgctggcagcaaccacagagggcagtgcaaccccatttttccagatcgagaatctatggctcatgggagaagtgacttttcaaggtcacaattcttgttgatgtcaaaagtaggactcccagcccagtgctctttcatctggtgaaagttgacagtttctttctttctttcttccttttttagacagaatcttgcttcgttgcccaggctggagtgcaatggtatgatcttggctcactgcaacctcgagtaactgggattacaaggcctgccacctcgcccggctaatttttgtatttttagtagagatgggtttcaccatgttggccaggctggtcttgaactcctgacctcaagtgatccacccacctcggcctcccaaagtgctgggattacgggcgtgagccaccgcacccagccgaaaggtgagttttttcagacttggctctgggtaggtcctcctaagcactcagttttgagctgcatatgtgaaggcagagcaggaataaaaggagaaaatactgagaagagtccaaaatatgactaaagagatgaaaaaaacaaaatgaatggttgctcacacctctttcctatccctacatagaaacaaacaggaaaatcagagcaacagggagttttagtgataaaacaggtctattctctggtatgagccagaggcactggagtaattaataatcttcctcttcccttctgaaacagactgaagcaaaacgtgctgggctacctgccaccctcaagctcagtcctgagcctagtgggctcccagcatgtgcctctgccctccatctgtactggacttcactgggccctcaggtggcatcaggagaacaggtctggaatcagacccttgggacaaaccctggtccacatcatcccaggaactgtctgggattcctagtgctgacccgtctcctgcagctatgagtaaccccttgctcacagtctccatgcctgtcctctcacttgattccttggttaaaagtcacctttgtgaaaccctggctcactagagcaagaaattattttgctaacagagactgagtcattggtgcatccatctaattcttcctttagtctgactggcttttgatgagccctatcctaaaatgggaaaccatcagcaaacacttagcatcataaccctactgactctttgagttggaaattcaaacacttctcacaaataaaaatgagatcctgaaaagtaaaaaaacagtttctcaaagccacccaactcattagttgttgaggcctctggctatattgtctctatggctttagctcctttctagttgaaattgatggcaaatcagggtctctggaaagttgtcattctttcaggctgttctgataccatgcattgacttactagtccagtggctggaaagggttaactcacctccccctggagaggtctgcttcacagggcaggtggagaccaccacttggtttgtgtcacaatcctgatcactcatccagatttatttcctatcagtcaaatcattttccatatactttcccacaatgctaggaaaaaaacagcgataccatatttcacatggaaacctaatttaaaccaactgttccattgccgagtgtgagtccccagggccctggttgttgagattatgtaagcactgttatcataaacacacacacagacacaccacacacacacacacacacgcacacacaccccaacatctgtttacaagcctcacggacaattcttattatggtctgatgtattcataattttataagcattaaatggtgagagggccaccgctagttataaaataataaatgacacaaaaaggaaatgaagattcagtgacaaatgtcaaaatgttgaccaaagcataaaaggtggtcacatttactaagtggaaaatgggatgtgttgccaatccagaaagaatttctgtgcaatcacacagaaaaacaaaaaaatcatataaatataaagtactatggtttaggcatagggagtgctactagagcagaaaggtgttaatggtagcagattattttgcttatttcaatagtaagcacagaatgaggagagaatctggcccccagcccaattctttaagcacctctcccagaaggttctgggcttaccctgacatcataaccccctggaccatgcccacaactcctccacaactgcccctcccaaaatatctttttttccttccttttgcttttctcagtactcttgggcttagccaaatagaacagtttactccctctcctcacatcaaataccttattggtgtcacacatgctcattttggaaggaattttcttgcatcattcaaaatgacctttccctggtccaccatgtcttgcttgtgtcctctgcaaagccaaatctttactttggcccaccaggcccctgtccattctccaatcacctcacctctcccctatatccctccttttagggaggtaaagtaggctttttaacatctcaggaatcttgaactggttgttccttctgcaggaaggcttccccatcaccccagattcaatttttttttttttttttttgtagagatggagtatcactatgttgcccaggctgatcttgaacttctggcctcaagtgatcctcccgcttccgcttccatagcattggcattacagttgatccaccacacacggcctggcattttattcattgaaccctactcatcctttaggcagcactgccctgagaccatgccatcaggatcctgccctggaccccaggtttcagaaggctccacactggctgtcgtccagctgtgccctctccatagagtaagaagtctatggggtggaggggacgtgcctgtccataggctgcacactcacttctagataatttatcccttgtaaacccacgcttcccaaattccctgtccaaacagcaccaagcccactgctggtctgcaagggctgtttatctggatcagtccttcagagggtagattgtaacccctaggcctaaagccaggccagagggcagtgggggtgggggtgatgtgtggacagggtttgaacttgaggcctgaggtatacatactctggcacacaagccaggatgggaagagaaggtgggaaggccaacatgctggggcctcccttgtactcacgccctggccccctaaaggaaagggtgaggctgccttcaggagtctgataaaaacatcattttcttgagcagaacttccttgacttcccacctggagtgtgtccacacactgcatgctctgtggtgcccccacatcaccctgaccctagcgcacatttagtgctgtgatcctcattaaggcagatgctggatctgctatgctcacgggtaagcagcagtgtcggtgacctgtcaggatctgccctcggtaagtttaaacaagagtcagcgaaggagtgaacatatgaatgaatgaatgaatgaatgaatgaatgaagcttacctcctctagggaggcttttctcatggttcacctagcacctttcattccatttcttcctacttctctttgacttaatgtaggaccttgagttcaaagtttcacttgtattctcaccactgcatggatctgcctctggtttatttttgttatatttgtgtgcctgactctttcacatgggcctgttctgtctcccccagcagacccttagacctccaggacagagaccatctttcccacatttccagcatggagttgctcagtgtctctggcagacaggcaggccatccagagtcccaggaggccgtgggcagggaggattctcagcttccaaacgctcagggattatatttgggaaaaggcctgaacacttcccagtgctgttcccaggtccagaaaaaggagacaaatgactttctgccgaaaagtttcttgaaaatgccaagcagaagttttcaaagagatgatcatttgtaatgggtatctggtcattctaactgcaaaggttgaattcaaatggtaaagtctacaaaatataatgaaagtctagacagagctactttccttcttcttcttcttcttcttctttttttttagacagaacttccctcttgttgcccagctggagtgcaatggcacgattttggctcactgcaatctccgcctcctgggttcaagtgattctcctgcctcagcctcccaagtagctggaattacaggcatgcgccaccacacctggctaattttgtatttttagaaagatggggtttctccatgttggtcaggctggtctcaaactcctgacctcaggtgatccacccacctcggcctcccaaagtgctgggattccaggcgtgagccactgaacccggctatgacaaagctactttcaagtagtttatgtgtagtgcacatccatacctatcctccatggagctttactgaaacatcttgactagcacatgtgggcatgtacacacacacaacatgcacatgtgtgcatgcacaggcacatacacacacacacacccttgcagaggcagtgcttctcaaatgtggagcactgacatcagaagcactgggggtggtgtttaggtgtttgttcaaatgtagattccaaggcctcagactgagaaatcaggctctcttaaggccagagatcaataatttgcattttcagataaactccctggtgattcttatatgcgctggagtttgagaactcacccaggggcttagtgacctttttctgcaccccagggccttgagtcagatcaggcgtcatttctgtagtaccagcgcaaaattgtaaatcacctctctggcctcaccagttaactgtacctgagattgagactgtaacccatttggaacaaggggaagctggagggaggcagcacggtgtagtggcggagcccggcgctggaggtaggtagacctgtgtgcactcccagccccaccgtttcctgtgcgtgcccctgaggcaagccatctaactgctctgagccctaattcccttttcagtaaaatgggcatactgtttacctcctaaaattgttgtgagggtgaagttggagagtgtatctaaagatctcagcatgatgcttagtgtgcagttaagggatagatgttcactactgtgactgctctgctgctgcaagtactgttgtagagatgctgaatttcaggtgacagaacacagaaatcctgaagactggaatctctaaatcccacttcctaactaacaggctggaccaagaagaatctgtgactgccctgagaagggtttgtgccccgagtacagtcttctcttaagagaaggataactcaaatgttacctcttctctcaaggcttccctggctcattgctaggaataaaagagcatgtttctattacaatagcccaatcatatatatatatatatatatatatatatatatatatatatataaaatgtttagtttttaagcttttatttctttttagaaatggagtctctctatgttgcccaggatggccacaaactcctgcctcagcctcccaagtagctggtactacaggtgcatgccactgtgcttggctacatatatgtatgtgtgtgtgtgtatgtgtgtgtgtgtgtatgtgtgtgtgtatgtatgtatgtatgtataaaatgttgtcctagaccaagttcttctaatcataagctccttaaagcacgggccatggttcattcatgccaggatctcagttctgaggatacagcagccagcatgtttcccacacccaggcatcctccttgacatgaagtgggtgcagaagagtctcttgaactccttgctgtgcttggcatggttccactgatgactctttgcttaggagagacacagaggggaaaaggcaagtacccaaaggtagctttttcagagcctcaaacacagctcagattatctccccttacccccaaactacatcacatttgtcttcagaacaaactctaaatctctttttggctttcaaggatggcactatttgctctaaatttacgtctccagtattaattttttactgttacctgccacttatccagataacaatccaattgtactatgtgtatcattttctattctttgtctattcttaggctcatttcaatctgattccttgtgtagggggttttgttttggctgtctaacatcttaatctatacagattacataaggctgaccatactccttcctgcaagcctgacctcagtgatttgttcaaagattgtcatatgacctacaccagccaactaaagcccttcttgagtcttttactgaagctatcaggaaaagagacaacctttttgttggaatcataaactgtaaagatatgagcctggagctgttgagagctgtctttgctataatataaggaaagcctgcctaagaaggaagccaacaccaagaaaagatgaagatagatttttaaaaacattggtgggttcctaaatccagccatccctgaagccctctgatgactccatatacatacaccaatttcttattttgtttgaacagatttgaattgagttgctgttaactcataactgaaaaaagaaccttgacaaatatatcttgacttgaggtgatcctccctcttctaataaatacttagtgagtatccactatatagtatgcactgtgctgggcgctagtaaacaagacagacatggtatctgcccattgatagcttggcatctcatgggggaaaataacataagcaagtaattaaatagtggtattattgatataataattggataattatttttataattatacataaaattaacaattaataattatttatatataactataattaattatattttaattatatttaattatataataatataattataattaaaatttttatagtcagattttttataattatatataaaattattattttataattatatataaaagtatgattgatataataattggataattactttaccatttatatgctgtcatctttagaaatctggttcttctaccacttcttggtcccagttgccctcccaaagcactttatttatatctctgtagtaatgcctattttttccacaaacagttactgcatgcctgtgaatttgcctggaactatgctaggcatgagggtgggagcagttaaagcaagtataagaaaagtaagaagctacaaatccgtatccattttctgttcactagaacagaattgtagacaagtcccaattctaagctgacagaagtattggtttatgtcattataatactatttatgatcttcattttattttatctacacatgaaattgtgggtaaggagataacagagtttcctaaggatggtatagcagaaaacatgcagacctaagagaaagaacccaagattcttgaattccaagcctaactctagctggaaatcatacggaattcacttaacctatctgggctttacctaacttacctgtaacataaattgaataatcactaagatgtcatctggttataatatttttaaaactaacaatgtaatatacatactataaaaacctagtgttcttattctagaactccattaattattttagaatgtgttaagtataactgtatcacacagaaagtgtaataattcatgttatcccaaaacattaaaagaaaagtgtgttaaagccagcaacaccaatggatatggatttgtagacatcatttgcttcatttgtgctaagatgcatcattatgaaattttattttatatttactgaaagtgctcttttagacttatagtgacaccaatttctataatatcttacccttgtgtataagtaaaaataaaatgtaagcaaaactaaaaaaaaaaaaagtaagaagcatactctgtcttgcaattaaaccagttgtgtatatgtccattttctctaaattgtcacctccttgagggtagagaacatgttattctgggtatctttctattgtttgcagaatggcttgcccacagtttgcaagagacagttgattattctcaaattcttcaactataaatccctaaatactgtactcagaaattgggttctaagttcactagagttatttactgttttaaaatcaactagggagaatattttcactgagatttgcaaataccatgtctagttaaatggaatttggggaattgccaacagctatgcagaatgtgttatcctcttctctctcaccatagttaattgaattgaatggatcattccttgtgaagccaattattaaatgctgttcagaagtaagcctcatctcatgcagagtctccccttttgtaattgtattaattgatggccctagaatagggtcctacttatttcatcccactttaatatgatgagattaaaatccatcactaacagtttacataaaatgtcttgatataactgagctgttagctccgaactatcctgatcctattgtgggaccatttataaatcaatttcttttcctctttgcataattttcataatcataattacaataacaacactctccatgtaaatggtaggcttgtgagagggacgctgcttatcctatcctttcagctctacaaggctggtactaatactgctgccattttacagatgagaaaggtgagattcagagtgagtaaactagcttgcccaaggttacacacctgcaaagtaggaatgagccaaatcaaaagcctgtgcttttacattaccatgctactgccttccattttctcttttatgaagattagactcaacagtaaattagactgtttgctaatttactgttgagtctaatcttcataaaagagaaaatggaagatagtagagcatggtaatgtaaaagcacaggcctttaaatttttaaagctttgctccccacacagccaccctgatctactgggcaaagaaatgcctcagcaaacactgtgcggagcttagctccagaatcagaatgatgcagccgagtcgcattccctttagaaacagaattttagcattctgagaagtcacagagaatgtggcattggtgcttaccagttgcttacaaatgttcctattctgtcatgtatctaaaattttaagtttcctatgacatgcagagtaggacagggtccttctgaattagagaagaatgtgtgggagaaggcctgtgagagattccatccctgaagctcactcacccagacagctaggtatcccaggcagaggccagaaagtcagggtataccccctagtaaacctcaccccaagctgctgccacctctggactgcctgctccctgcagccccttcactccagctaagtcagggaacttcaacaaatatatacttgttcagcaaatcattcctgagtgtctaccctctagagctcgcactccagtgggcactagagcacatgatgagcaagacaaacacagtccctaccctgccaggaggtggtggcatcccaagcctgacgtgtccctcctcagctctgatctgcttcctataaggagtgctcctttacctctcctcaccgaggagatctcaactgggcagtgctgactctatcattggctgggtttgcccttttccgacatcagtgaaataacagtgacaccaaatgcttttacagagtctacttaacaggtattaattcatttaatcctacaacaagcctatgaggtatatgtccttatcatttgcattttagaaatgaaattgaagcaatcacttgcctaagatcataaagctaattaaagtggtgaaggtgggattccaacccaggcaggccggccccagagcccatgtactctgctggcatgtattggtttttgaatgctgtgtttcttgtggctctgtcttggcctattttattttattttatttgagttcgggtctcattgtcacccaggctggagtgcagtggcatgatcatagctcactgaagccttgaactcctgggttcagctgattctctcacaacagcctctccagtagttgggactacaggtgtgtgctaccatgccttgctctgtctcggcccttctcgaatctcttcttatgctacatcctctccatatatgttttccttcactaactttcctttacccatcctctctctgctgctggctccaaatgtctagctcttatcttgtatatccaagaatgaactggacattcttacctggaggacccaaagcccatcctgtttccagtccttaactccttcactttccattcccacatccaattagcttccaagtagcccagatgtcatgttctccaggaggccgtccctgagccctcagataattaatgggtcctctgtgctaatataaccttcctgctgcactttttatactgcacggtgaccactatccccctggactttgccactgcagatggagctccttggatgcaggcattgttttactcatctgtttcccagcacaagtgacataagtgagaggtgtttgacaacatcttgttttgagttatgcataatacattgcagccaactccatgttggtgctgcccttcccagaagactgtccaagcaccttacttgcccagggtatctggggactccagtacaggaagtaaggcaggatcatttaccctagagctcacagccccagagctgcctgcttgatcttcacccaagaggctcagaaggctagtgttgctggggaaggcaaccaggggagccatgacatagaagacctatgggcagtttggtccatgactggaagactccattttccctgagatgattgggcagcagagggtgagagtgtggtgggtttctcatctgcactggaatgggctggacccattctgaggttctctgagtgaaggacaagaacatagcttacgcaagtaccctggatggggaagcctctggccacaggccacactacttaggaaaaggggacaggtgaaggttgtcatccagggccactgagcagggtcacgatgtttggagaccatgctgtgattcactcttggtcctcgggcaggtgtgcacctgtcactggtaagcaaaagtaagcccgcaagtcactttttcacttgcggtgaaatgcaaattttcaccaattagaatgtgaatggtgagcaagtagaaggagaccgacaaccagccaacaataatgatggagcaggaaggacagagcggaagggaataaaatggtgtgcctgtgttggcgtacattccactgaaaacaaatctgtgtgaacaaacaaaggatattggcatcccaccaagatcaattcatcctggccccactggacactggtagatagaacagaccattaagaagaagataattaaatcagcagtctgtccagtacatatatgttgggtgagcatctgtgaatgaaactcgtaagggaataaatctgatgaaaactggaattctaatctcctcagcttctctgttccagtggggaagagagtgtatgtaatcactctcctcagggtgaagatcaagtaggcagctctggggctgtgagctctagggtaaatgatcgtgccttactgcccgtactgcagtccccagatgccctgggcaagtaaggcacttggacagtcttctgggaagggcagcaccaacatggagttggctgcaatgttttatgcataactcaaaacaagatgttgtcaagcacctctcactcatgtcacttgtgctgggaaacagaaaaacacaggatgtggagccaaaggaatgtaggttcatttcttggctctgcctttcactatttctgtgaccttgagcaagtttcctacctaccctgagactcttatttcctcgctcataagatggggataataaaatgcccggtatcataaggagtgtggtgactaataaaagcgatgataaatataaagtctctttatattcataaactaataaaagggacgataaatatgaagggctccggtgcttggagaggagtagtatgtgctcaataaatgtcaactaatactgataattaaaaaataataagcagctccttcttcaagatgtagcacttgtggaaacaatgttggcctttttattacagggccagcttcccttcactgtttagcagagagggactttccaaggattagattctccaaaagaatgatccttcatttctttcaaagaagccagaaaggagaggcagaggaaaaggggcaagaaaaatgttcagaaagaacatatcaatggaacatccaaggaaagttggcagtgaagggtgggaagcagaagaggaagaggtctgggtcagggctctctgaggaggtagggacacagggacatggcttggtaggtggggaagtcctggaaaaatagctgtgagtcatagacaggttcaaaaagggcagccaccctgagaacccagggcctttgtccaggaaacatcaggtacactggactgtggttacaacatttgatgggctgggattaaaccacatcacatgacattggctgtttcatcatctttcttgctttttgaaaagttcatcatcttttccaggcaaagaacagatcctaattctgagtaaaaactaacagagctgtacatgaaaggcaaaaattctagggtgttcagcacaggataaaaatgctggatgtgtcccaccaactacctaagatataaacagtgaatgtcctgaaatgagatcctgtaactggggagtggtaaccgcactggtggagcaaagcaaaggaacttgagactgacagctgagagtatggaattcaattcggggagtcaaacaagggcccagcagcctggctgcagcacttccaagctgcacttagtacttaatttgtcttgtttgttgactggcctgcttattcatatgcggcaaccctctgcagcatttgattttgaaatcttgatgagcagattgatctgccaattttgaattattcccacatgttctgcacaaagtagatgctcaataaatattctggaaagtgttgttatccctttctgctccaaagaccccagacagaaacagatcagcaatgttttgtggtaatgtttcccaaactgtgtttcagggcacatgttctacccagatattaagtattaaatattttgtgaagaaagtgtctggagccatatgacttcaggaaattctaggataagcattttgggaggctgaggtgggtggatcacttgagttcaggagtttgagaccagactgaccaacagggtgaaaccccatctctattaaaaatacaaaaattggctgggcgtggtggctcatgcctgtaatcccagcactttgggaggccaaggagggtggatcacaaggtcaggagatcaagaccatcctggctaacacggtgaaaccctgtctctactaaaaatacaaaaaatcagctgggcgtagtggtggatgcctgtagtcccagctactctggaggctgaggcaggagaatggcgtgaacccgggaggcggagcttgcagtgagctgagatggcaccactgcactccggcctgggcaacagagccagactctgtctcaaaaaaagaaaaacacaaaaattagccaggtgtggtggcatgcacatgtaattccagctacttgggaggctgaggcaggagaatcgtttgaacctgggaggcagaggttgcagtgagccgagatcacgccactgcacttgcactccagcctgggtgacagagggagactcagtctcctaaataaataaacaaaaggtttttaggggcaggatttttggaggctttaatatgctaatatgcacgataaacctttaagaagcagctaatattcagtatttctcaagttcttttgaccatgtaatttttttttcaaaggaacattaattaacatttagaataatgctgcaatattgacaggggtctctctgagctcttttagcttgaagaggacatagcaggggcttgtctccaccagtagttcagtaggtcctctacctgcacctggccaaaccaaaaatacacccctccttctctagaaaccgcttggggtgggtgggttataggaggtagaaacagaaacagcagcataggattttataattggtgtcataaatccagaatcaatatgtcattggaggaactctaaaaccaagacatgaaggaagatttttctttagactccaaagtgaggagatgaaggccaactgttatttcatagccaaggctgtcatgaaggaataatccagaaagcagaccaacttttagctatgcggttctactacataatgtaacaacgaataaatcaatggactgtagaatgtttgaattggaaaagactttagacattatttagtccatttctcttatttgatagatgaagaaacagagaatcagagatgttaggtgacttgcaaaggtcacccagttagtgagtggtaatgctgaggctagagcccagatgtcacctcaggacacctacagtcataacttgctgcatttgtcatctctgtgaagacagtctgatacactgccacctgccctccctctgtaggccttcataggcaggcttactgggtgaagaagtggtggataaggaggacgaggagagctgggagcagcagcaattgctagagcactaacctcagatggcctaaaagatgggggcagtgggtcctagttaggcaaaagccaaggaacaaaagggagaagagtccaggccatgaaaacaagggtgtccagcctagggcctcccacgacacagctctcagcaggctgaacggagtccaagaggtggcagtggcggcagacttgtctggagaatttcagatatgctggccttgaacttttcccctctagcttcagccagaaggtaccaccagctgtgccctgcagactgggctacagaagggaaagggcagaggagaatagagatttggggaagaattctagaagggaggccccaacaaggaaaacaggagaaataatggtgccattgctatttgtcttcattaggaatggccagagagggagaagccaaaggaagaaaacttcctctgcttcctagaagagaggaagctggcaggaagagcccttcagggaaaattctggctaggatctgttttaggaaaggagggagcagctgctcaccagctgctgattatgggctggagaccctgattaacagctcaacaggcacaaagccaaggttaaaagtcacaggagttcaaagcctaggacgtggggaggctgaagtgagcctcagaccagcagaggaaggggatttattttggagactggggccatgcagctggaaggacttgagtgattttggtgagcaagctcaagttaaagcctgcttgttttcttcagggtggtcagttaaaaaatttcgggggtgtgttgacagttcctgtaaaagtgacagacctgtttgggagcctaggggtctgataatttaggggtcacaaagatcctcagaaggaatgggggccaaataccagccttgctttttttgtagagaaagggtgagttttaacctcagaggagtaaagacatgttgtacatctggctcaagaaatctctttcaagaaatatttacttgggaagtgcttacggcatagatgatagaaactgaaaagtaaaaaaaaaaaaacaccattcaaatattaaaacgtgacatcttataccaataacaaacaaacaacaaacaaaaaaacaccaaacgaaaccaaagccaaaaaaaagatcatttttttggtctgttgactggacaaatattctgtactagatgcgtagggtaggccaggtgtgaagtcagaggtgctggctttaagtctcagctctagtatcaccaattgtgtgatactgagtcaattatttaatctctcttctatgcccttcagttgaaagcaggcctacgagcaacacctcccttacagaactgtgggactaaaggacataatatgaaagtgcctttacatacttaagcccacagttgaaaggttagccaattttactaatattaataggcatatagtcaatgatttctagatatggcatttgattttgtgaggcacctgcattgaattgtggtgtttctttgaatttggaaattacaatttttgaagtgtcttattacatatcccttgctgttccaccacttagtccctccccagtctctgtgttggatagcattatttcttatattcattcatagaacatacctacattataaccagcctcatgcttggaattctatgcttttatatcttttctggaagaggtcagaaatttgtaaaggatatttttatgcccatgaggtactataggcaaattgagatctgcaaagcaagttttgctatgagttgatgaaagctcagtatataatataaaacaaagaatatctgaaaactatttgcctttaaaatggactaaaagatttatttctattttctcctatttttcaaagtgctggaaaaatcaaaacttaaatgttttcatcaagtattatctgaaacaaaattggcaggcacacatatatttttccttttaactctaagttactagactccagccttctgtcaaatatactcaacacctgtagcacataaactcaggcctaaatttcctaaaaatactggacatgttttagtattttaatgataaaacccagatgtcctgttttacatgccctggaagaaaagaaacatacaaccttacacagaactctcaccattttaaatctgattaaactctatgccaaacaaggaatggaaagagtatgatgtttgtacaaacaatcctttaaagagtatttttcaaatccacttaaatgttctagaaaacttctgaaatgtgaatcagcaatatttatttacattccacccctggactgaagtttggggtcatgtcttggtgcctggagcaggaattgtggcgacgattagtttggttctccaacctgtgttttgaggcccacgtgcaatgagacccactttggtcacttatgcatatgtcaacactatttacagcccagtgattcttagatgtaccttggtttcagaaccagctgggagagtttcttcagaatatcctattgtagactccacagtttagtgtctaattcagtagatctggggaggggagtaggaatctgtccttacataaagttttcctaagtgattctaataaagccttgtgtttgggaatcactgatctagggccctggctatttacaaccttaaatgttcatggggatcttattaaaatgcagattatgattcagtgggtgggggtaggagcagaagattctgcagtttcagcaaattcccagatgacactgatgtgctggtcgggggaccacactttgcattttgttttcttctgtctcttccaatctggaatagttcctctactgttccctgtctttcatgtctttatgtaatttcaaagattacaggccttacattctgtaggatggccctcagcctgggtctctctgaggtttcattgccagacttaggtgatgctgtcctggaagaaatactcagaatgaagctgggctctgcttggtgcatcaccgcagagggtacaggatgtggaacttttgcatcactggtgatgtcaatcttgatcacctggtcaggttggtgtctgccaggtgtctccgccacacagttaccattttctctctggtaatttattagtatttgtgaggcactattctaggaatgcaccaatatcctactcttcatataccctctattacctgccttcattgataaataccaccggaatcagtcacctctatgacagctaccaaatggtgatttatatttccttcattatttttatatttattagtttcattcttcagtaagaaataacaatcccttgtcttccatttatttgttcacatattcatttaaattggcgtagtcaaatggattataattttttttcactatattggaatccattactcgctttatttattttgaagctcaaatgatcccaaagtggcacctggtccttttaatatgtttccatcatcactggaacatttcctttgtttctggcataacaagatgtttcagatttatctttaattttcccttccccagccatggcatcagccattttctccaagaagccctggtttctttttagtaaagaatggtatttagaatccaatatctgtgtgcttcatgtgctcattgcctctggagtgccattgctttgaggtttcctagacagacagagcttgaaaaaaaaagtctatacacacacacacacacacacacacacacacacacacacacgtataactattccctcatttatttgtgtatatagattataaaagcctacattcataatgaaacctacatttcaaatttaacacctcaaagttctttccagcctttttcctttttgtgtttgtaagtatcatttccaaccgtgagaaacctggcttttgtatagttatcctaaatatatttgcttatttactcatcaatttagtatctgctcacagtaaccaatgtcccaaccatttcggctttcccttctgtctcccagctgtgtgtccccttctccattctgcatccttgcatgctgggggcacgctcctgacgtgtcactgatgtgcttctgtgaagctcccacaccctccccacacgagccagggctgccctccatgctgagaaacaaagggaagagggaatggaagatgggaaagctgcttgttctttgtaaatggttcactagtatcttacatttgagctacatacaatggttaatacatttataattatgaaagtgaaagtaaatttgaccttttattaaagcatttaccaatgaaaaaataaacatcaaaacattttaaacatattgtatgtacgtgtgtgcatgtatgtgacagctgtactttaaagttgtaaagaactttagaggtctcttatttaaatggtttcaaatctgggggcctggaggctttatggggacactttcaatacaacactgattaagagttggtctggaataaagagaggctggggaaaaagtgaggttcaaggaatattccctagggctcctcagagcagcatgtcaacaccactggcctgttccaacccctcaagctctaaacaagagaagacaggctttaccaactactttgctatttgctaacagcagtttcaaatgtttggccacatagatttgtccactgtccacggttgatgtatggcccaaaccacccacagggccaagctgtacccagtagaataagatagagcaatggaaaagaatcaaccatggctacgcatatcaactgggctgaatgacagaaacaagtcagaaaaggacacatgcaatttgatcacaactttcaatgacttcctgtaccattctgggtaaaattgaaagcacttacaatgacctacaaagctctacagattgggtcctctgacctcctctcttgccacttcctttcatgtcctgcacagcttacccccacctcagccacactgaccctcttcctgttgcttgaatatgccaggcacgctttacacagggcactggcacttatggttccctctacctggaatgttcttgctttgcatgtccaggtagctcattccctcaaccctcccttctttactcaaataccagcttctcagtaaggctttccctcatcactcgacttgaggttgcaagaactacccctccccaacacttcccatccctctgccttgctttatttttctccctggcgcttatcatagggtatatttatcttatttctctaatctgtctccatctaactgcaatggaagctccatgtgggtagggagttttatttgttttttcgttgctggatccgtagagcctagaacagtgcatggcacacagtgggcactcagtcaatatttctaaaagaatgactgaaagagcaaatgaaggatattccaggagaggcctcaagaagcgaccaaaagtgctggccaactgacgacaggaggaagagttcacttccaattatcctggatcaaaacagtggtttttggcagcctgcctctgacacataattctagttgacagatgaacagatgaaccgtttagagatctgcagatgcattttggggctgctcatcctggaaagggcattaggatattgccatgaacaaagcaaagtgttttaaagaaggcacagtccatttgtttcctagttgaggtggccagttggcaacttctggcttccgactcttgccagctggtcctcttttccatgttctatttatttagtcattcaatgaatatttgtagagcaatgtctaagtgacagggctgccccatggcttcatgtgcataactttcttttattcacatgcaactgtactttatttccattctctcttcctccccacctccaccagtctttggtttaatctttaatattgaaagtaatacgtgcttgtaaagcaaagatccaatatcataacattctctacagtaggaaatgaaatcccctccctctctcttcttcccccactattattaccataataataaaatttcttggccctctctgcaggtagacaggtgagagtcccctggggaatggaaaggtggtggaagggagaactttcataaaccaagattacttttgcatattaaaggacgtgtaaggaatctcaattttcaactgtctgtagcatgtcatacttgtcaaaagcttggctaaggcaattgatattcaagaaaaacatcttaaaagtcataccaggtattcattccttagattttctaagctttatccttacgccaagtaagactgtcagtgagcaacatacctgaactggattactttagctccccatatcatatctttatagagagtcatgttttgaattatgtctttttattaacaatcaatataaaatatggtcaaaaggagattgcttttgccaatgtttctgccctcaaaactgctcttgaagacaccatcattttctacagcacacattattttgcttccttccttccttccttccttccttccttccttccttccttccttccttcctccctcccttcttctttccttccttccttccttcttttcttccttcctttctttcttcctgtgtatctttctttctttctttcgggacagagtttcactctgtcacccaggctgaagtgcagtggcgtgatcttggctcactgtaacctccgccacctgggttcaagcaattctctgcctcagtttcccgagtagctgggattacaggcgcctgccaccacgcctggctaattttttgtatttttagtaaagacgcagtttcaccatcttggccaggatgatcttgaactcctgacctcgtgattcacccgcctcagcctcccaaagtgctaggattacaggcgtgagccaccacgccttgccaggacacatcattttctaattcctcccagagttctagaaggtagcttggagtttctgatgatttgatgtgctgatgcttttttgccttctttctctccttcctcttcttttatctgctcctccaactccttttctttttcagataatgagaatgatataatctatcatatcaccctttttgcctaggctgccaggaacctctgcccaactttttcatcaatggaagcatctgtttcctttgcctaggcattctctctggcactattctagtttttttattctaccatttaaaaaaatcttcccccaattttttttttattttttgcaaatacgaagagacataaataaatgtgttaacaaagagtccaatgctgatattttacaatttataggtaaggaaaataaggccccaagaggttgcctttgctatcagccacaaacaactagttagaagaaactttcagactaaaacctgagggttcctgccctttccattacttgatgctgtttcaaattagagactaatatttcttctgccttcacaggttgtggatattcactcagcatgctttcctttatgtcctcctcttgggaagggaagccaggtctgtggcctgtttgctcttctcttcatcatcatcaatgcacaaggttggcagcagagtccaggaagaagagagagatgttctcacctctttttatttctgcttatgtaggctcaactccagcaacctatctaatccattcaggaattcagatataattatggggacatggatgaaatatctttgggaatgaaggtgttcctgagtattacatttttgttgagaagtgtgaggtcatcaaaaagagaaaaacattgagtttaatgcaagctgaagaactctacatttcaaagtttacaaaatggtagtttataatctcaaagcaagtctgatcaaccagattttaaacgaataatttctgcttaaaacatgaatatgaagtaaaagttcctgtttggacctttatgcttccttgcatggaaatatgtagcaaatgtaaagatgggtccaggaatgctaacttggataaatattcagggtgatctgataggggttcataagtgtcatggaggagggggtcacagttgggagcagagtgtgacagagccatgatccatctgcagcaccactgtgtataggtgctttggaggcacagagacttccctgaattctagttctcctacttaccagagctcagacatgttttctaagttctaagttttccaaatcctgtaaattgagaatgacctaaggagcatgcaggatatttaaaaaggcttcacatatgcgtgaagcacatagcaccatgctggcttgcagaagtgttcaactaattgtagctattatcacctaagtcaggttagagcgactattgaagccagacaataactattttatgtaaccaattaaaataaccaaccaggaaagaatcacaaagaaaaacccgagaggacacactagttgcagaaggcactgaacaggtactggtacttttagcagaggacagacttaatcccctgaggttcaagtagctgcagagatgtcagttttcagaatgaaactgtgatgagccacacttaggtcaggatgaatcaaatcaatgaacaaactctgtatttggtcattgtctacctctgccgcacggacacaccttgtagccaaggggccaaggtttccttacactgtcatcaagacaaaaatggccaactgagcaaacaacgtgataacgcgcctctagagagtaataatgggggaaatatcctaggcagagctcaaggagaagaaaccctgacaaatgtggttggcagccctgagccttgtgaattaggagtcggggtagcgtcagcttctatggggggtggtggtaaagttcttggctcagttttgtctccgttttgtcatagacaatgatctgggtctgaatgtaaaaacatcttgccagaaactttctgttacaggaagctcactagaaagcaatgaaagaacaaactgctacatatcctttaaaggcatcactattatcttggtgggggtggggtagagggaagggtaattgcagccaggaataaataaagttgataaaaggaatacgggaattttcttttgtgtaaaacgtcttgactgatggagctagatagtccagacatttatcatgtggacatattctacacgtggcagtcacattaaacaaatgttgttctgtaacacctgtaaattgatgctatttgtacccttgctcttatttgtttatttgaaaggcaaaacaaaataacaaccatacacacacaaaaacccctaaaaccaagctggattttgtctttaacttggcagaaagagtggcctctgatttgtgcctcatattttgaatgattatctgctagatttttatttttttaccaattcattttccatatttatttaagtcttagaaaggaaatgcccccaaaatatggtcatctttttcactgggtatctcaatgaacagcaattaaaaaaactgtactaaatgtttcccttgggactcacataattcattgtcatacaacctttacaataacatgttagcctgggcgtggtggctcacgcctgtaatcccagcactttgggaggctgaggcaggtggatcacgaggtcaggagatcgagaccatcctggctaacacagtgaaaccccgtctctactaaaaaataccaaaaaaaattagccgggcttggtggcaggcgcctgtggtcccagctactcaggaggctgaggcgggagaatggcgtgaacccaggaggcggagcttgcagtgagccgagatcatgccactgcactccagcctgggtgacagagcaagactccgctcaaaaaaattaaaaacttcatcaagattaaactgaaattcctcagagaatattttttagtggggcaaatgctgcaacctaagtggcagcatttcttacttgggtatagcactttatagttcacaaagcacttctgctataccacctcacttctatttctatctttacaacaatcctgagtgagtggtagggtagggactgctgtcccatttacaaatgaagaaactgagctttttgacaagggctggtgtggatgtggagcaactggaatatttttagatttatagaaaaatagcaagaatagtacagagaattcccataatcctggcacccaagtccccgtttattaatgtcttaggttagcatgatacatttgtcacaattaataaaatattattgatgcatgactatgaactaaattaactttattggttatgtctcagtttttacctaatgtcctttttctgttccaggatcccacatcaccttcagtcatcatgcctctttaggctcctcttggctataacagtttcttacacttgccttatttttaatgaccttgacatttttgagaattactggtcatgtattttgcagaatccccttaacttgggatttggtgactatttttctcatggttagactggtttaaggttttgtgggaggaagaccacggaggtcaaatgcaattcccatcacattatatccagggcacacactatcaacagaatgtgtccctgttgatgttgaccttgatcacctggctgaggtcatatttctcagctttccttactgtaaagttactcatttttactccctttccctactgtacttcctggaaggaagtcaatatgcatagctcatactttaacaagtagggagttaggctccaccttctagagggtggagtattcatgagttatttggagttcttttgcacagatttgtctattctctttcatttattctcccccatttatttattcaatcatgtcagcatagagtcaagaatatttattttatacttttggttataatatatttttcctttactttgtcttgcaagttgctccagctttggctgttgggagctctttcagttatcttatctctttgacacaccccatcacttgtgtttccgttgaagcacctccttactgcttggcactaccagatgctccaggctcagcctgtatattttctgccttagtcctacaatcagccatttctccaagcagccctggttccttttaattggagaatggttttagaaaccaagatctgagcacaaggtgtccttgttgctactgggatgtcagttgtttctatgccctctcagatgacagagcaagggaatatatgtatgttatactaacttgtttatatatgtgtatctatagatatttctatatgtaaccatctttgtaacacactaagaattagtccattctgatgttaaggaggtaacgtttggcttgtttcttacagctttttgtttctaacatggaaaaaagtgattttcaaatttgaaaaaagttgaaattagtgctttgtcagttttctcaccaactctcccagactcaccatagtggagcatattagccctctttgctgctgtgcagtcatcctcagcgccttaccctggggacactgcctggttagggctgcctttatttcttccacagcacgtcacattgtctgtcatgctgactccattcctgctgacttccatcccacagggtcatttttcttgacaaaactgactcacgcttaatgatttacatctcggtcatttattcatttctgtgaaaagttcaaaaactggagccaaaacaaactccacaatgcatctaagacaaacctttttgccgtctaagacttgttataacttattttgccaagatgtaggggaaaaaatgaaacatctagctcatgtgggaaacaagttttgcattgaagtgagcatgatctctatcaaactaagtggcagcatttcttacttgggtatagcactttatggttcacaaagcacttctgctataccacctcacttctgtttctatctttacaacaatcctgagtgagtggtagggtagggacttctgtcccatttacaaatgaagaaactgagatttttgacaagggctggtgtggatatggagcaactggaatgttcacacattgttgctgtgaatgccaaatgatacagccacttcgcataacgcttcgtaaaataatttagtatctacccaagaaaaaacctacattcacctatttgagaatgcttttagtggccaattaataatggcataaaagctgaaaataaatgtccttcaactggtaaatggataaataaactatggtagattcatataatgacatgctactcagaacaaattattgacacatacagtaacactgagggatttcttttttcttgtttttttgagacagggtctcactgtcacccaggctggagtgtagtggtgtgacttcagctcactgcagcctcaacctcctgggctcaagcgatcctcctacctcagcctcccaagtagctgggactacaggtgcgtgccaccatgcccagataatttttgtgttttttgtagacaggaggttttacatgaggatttgcccaggttggtctcacactcttgagctcaagtgatactcccaccttggcctcccaaaatgctgggattaacaggtgtgcatcaccatgcctggctgagggatttctaatccatcattctaaatgaagaaagccaggctcaaaagactacctactgtaagattctatttctgctacattctgtcaaaggcaaaaggataaaaagagaaatcagatcccagaggtttgagataggggaggaatgactacaaaggaggcaaaaggaacttttgggatgaaaacttttgggatcagtatcatccctttgtaatgatattctctatcctgatcgtggtggtcattacgcaactgtatgcattgtcaaaattcaaactgcatgccaaaaggcaaattctattgtatgtaaattatagttcaatttaaaaaaggaaagaagataactgaaaaggggaggatgaaaagaaaggttcaaagaagctaattacctactaagcaacttattcatatttgccaagtagaagcaggaattgagcctagatcttctaccttccagtccagacttctgttgagaatgaacacatattcaggaaaaaactgattttctctctatcctgtttatacatataatcccagaccagagtgggaaccctaagtgctgatccctctcttcttgttcatacttggaagtgggctcttacttcccccacctagcatatacattcatagtcaaagacttagaatgacaacagccaatctataaagaatgagattatatcttttttttttttggtggggggtggttcatcagttcatccaacaggtttcatcatcagctctttcatgttcttaaattttttttttttttttttttttttttttgagacagagtcttgctctgtcacccaggctggagtgcaatggtgcaatcttggctcactgcaacctccgcctcccaggttcaggtgattctcctgccttagcctcccacgtagctggaatgacaggctcccgccaccatgcccagctaatttttgtatttttagtagagatggggtttcaccaggttggccaggctggtcttgaactcctgacctcaggtgatccacttgccttggcctcccaaagtgctgggattacaggcgtgagccactgcacccagccaagaatgagattatatcttaatgtcacgcttcattgtcagaaatattgccagaaaatatttgaacagagatttatccaaagaagatatacaaatataagcaggtgaaaagatactcaacatcattagctatttaggaaaatgaaatcaaaaccatgaggtatcacttcatacctactaggatggctgtaggtatgtgttgtaggactagcaagtgttgataggaatgtggataaatcagaaccctcatacattgttggtgggaatgtcaaatggtgcagacactttggagcagtttggcaattcctcaaaatgctaaacattgagttgtatgacccagcaattccactcctaggtacatactcaagataaataaaaacatatgctcaaacatttttcttgaatttcatagcagcactatttgtaatggccaaaaagtatacataattcaaatggccatcattatttttaccaataaacaatatgtggtatacgcacataatgaaatattattcagccataaaagaaatgaagtactgattcatgctacaatgctgatgaaccttgaaaacactatcttaagtgaaagatgccagacaaaaaaggccacttattgtgtgattcaatttatacaaaatatccagaataggcaaatccattgggacagaaatgagatcactattttccaggagctgcagttagggaggaatggggagtgactgctagtgggtatgtggtttctttttggggtgatcatcatatcctaaaattgatttatggtgatgattatacaagtccgtaaatatatgaaaaaagccactgacctgtatactttaaatgtatgtattatacagtatataaattgtatctcaataaagctgttacaaatatcaaacagaaagcaacaggcaaaccaaaaagatatgttgtatagaaagtagagtgctttctctacttctagcaacacttctagaaggggtggggattgggtgttctgggctggtgagtcccacctcattatacctgagtggggtcctctctctcaaagtctttttttatttttaaattttatttatttatttattttagagatgggtcagcaaagcccaggctggttttgaactcctggctgcaagtgatcctcctgacttggcttcccaaagtgctggaattataggcataagccaccatgcctggccctctctctaagtcttgcacctgaaaggtagcttatagatcctccttttccactttaaaaggctcttcccctcggagcttctcctggggctacagctgcttcttctctgggggcactacccagctgtgacaaccaggctgagggtggatcagacaagaaatcattatctcaaaggaacgaagaagagaacactttatgctataatacataggatagagcaacagcaaaactctcactgtaaccctcaccctatagaaggcaagcccctgagcccagagtgaaggtgtatagcaaggaggtagtgtatataggttagtttggattcagtattacttacaatgcaccttatacattaagtatcagaagattataatagcaataggtgacttttattgatcacaacaaccctaactagaaggaattattatcctcatttgacaggctggcaaaggaaggcttagaaagacttagtaacttgtagatcatataaacaatgtggctgggattcaaactctgagagttcaaactctagagtctaaattctaagaagcattagatatcatctggcctaattctttatcttatggggcagaaactgatgttcagaggggctaaaagatttgatcaatatgacacagctggctagagacagaacaaaaggcctagactcataatcctgttcaaagtttccctgaccttttttagatgtatagtacagatatcaaagaaattcccaaaagtcaggatttcatatccagagttatttaactattagagataatgattagcatcatctaatagtcctaaaactattgcaagcaggtgggtatgtattgctttcttaaggatttctaagaaagaagtcttcaaaatcttcagggagttacatgaatgtcatgatctttttctattagtttcaacatcccagagaaaggaaatcaccaagtgaagtgttatcctcctacaacatgagttgtgtcatatcattcctcttaaaaaaaaaaggagcccctaattcttagggtgacattcctagatccaaacttctgcttctatttcatttctcatgtctctttacacagggacttctttcttgtttggagaaggcttggctctccagggtttaggcacttagtccccaaatcacaaactcctagaactggaagagccctattagaaatccggaccagcccattgccctttctctctaaggcagtgactctcagcttgggaggagatgatgacagtcttggacagggttagagcagggtagctagaggaggggagaacatgctatgtttctgaagtatatattcagcgttataaatggttttattcatgctagcaaatctattttgaagtttcaaatcatattaaatgtggatacaacgtttttttctttaacattctgggccaaagagtgttgagaaaactttactttagataaagttcctatattctatgaatccagataaagacagtagaaccaaccctaatatcagcaccactatctaccacctttgtaatcatcaaggagttcaaaatggtggcccctgtttcccccaaacttcttggtagcctctaaatggagtttaaaatatgatagtattggaagcaaggaaaattttcttatctgttctaaaagtaaatcattacaagctattagctgtctagaattattatcatcatcattagttattgagtgcttgattcagggtcaatcaccttggtaaacacatttcctcaaattctcttttaattcttgcaacatccctacatattagatcaatgttataagcaccactttacagatgaagagactgaagaatacaatagttaggaaacttgcctggagtcacactgaaagtaagtggtgagccttggatctgaattcaaatctgagccagggctcttacccagggctactgtcttgtgcactaagtgaacagtgccctctggaattgtgcagagtctttgcctcttcctgtacaatccaacagtgagtcatccgggtagacagatgtaaaaggggcatgaagtgattaatggggagaaaacaggacagctacattgcagagacaagccttgaatgtggttaaaatgcctggacacctcttggtcagcagtgaagagcaactaaaaaattaagaacagagggctgtctcttagtattaccatagggacaaaaaatgaatgtgaaaagcaaatgaatgaatgtaaccatttgttaatagttgttgtgtaattccccacgaaaaggatggcagaaactaggcaaattaagaaatttggttctgggtggatttttattagcaggatatctggttctctcattggcacagataacaaaaagtcacttgtatctgactccctaataggcatcttgccttgtttggaataagaacagtaactaagtttctgcatctagtttgaaatcccacttgaatatcattatactttaaaacagtgtgaagtaaacatcttttaactgttaagagatgttaataaagaaatcacactgtaaaatgtaataaaaaaatgctttaaaaaaagacaatttcattctacactttctgtgactttagcctgcttatctcatccattggttggtgaccaagctattgagcacccagcagggaagcccgcctggtgtttatatgacagtagagcgaatttgtttcaacttacttgcagaagtggatttcagaggaagggatttgacaaagttgttaaaccccgtggaggcagaagaggaaagctgggatggttacagagctaagcactgtcattttgaaattcgttttggcccccagagtataaatacacctcagtatttttgttaggattgccagaaaatcagcaagtgctcactttcttttgccaacaaaagcatgactctctgtgcaaaaattttctgcacattgtataaacaagaacattcagaaaatcccctcttgctgagagatatgacaagagatatattaaaccatgctgtaaaataaagcagatactaagtacaccactgtgttcatcaaacacaagaaaagcttttatatatcccttctgccacaaacttctacatgtcatcctatcccccaaaatatctccccatactgtgctggtctgaggatggtggctttcaccatccaggctttcacctttgtttgctgtgagtcttctccaataggcattacctaatccattacctacattttctcaccactgcaccctagtttcccatccctgcaggctattgtgttggcggtctccaagtgatccatgacctcctatccaaatctcaggctaaaacttttcttcctcacagaaccttccagttcaaaaaaggccattggaagatcttaatcaggagttggcaaactttttctgtaaagggccagatgataagtattttagcctttgtgagccatttgatctttgttgcaactactcagccctgacactgtagcacaaaagcagctgtagccaacacataaatgagcatagctgtgctataataaaattgtatttatggacactgaaatttgagcttcatataattttcacctatcgcaaaatagtatccttttagtttttccaagatcagatgagagcgggtgcgttccagatgggatggccgtagactgatttttaaaattgttaaaaatgagatgcttgtgaggctatggagaaaagggaacactgcattgttggtgagaatgtaaattagttcagccactgtgaaaagtagtttagagacttctcaaagaacttaaaatagaactactattcgacccagcaatctcattgctgggtatatacccaaagaaaaagaaatcgttctaccaaaaagacacatgcacttgcatgttaattgcagcactatttacaataggaaaacatggaatcaagctaggtgcccatcaatggtggattggatatacgtatataccatggaatactacacagccataaaaaagaatgaaatcatgtcctctgcagcaacatagatgcagctaaaggctattgtcctaagtgaattaatgcaggaacagaaaaccaaatactgcatgttctcacttaaaagtgggagctaaacactgggtacacatggacataaagatggcaacagtagacattggaaactactagagggggaagagagggaggtgggcaaaggctgaaaaactacctattgggtactatgctcactacctgggtgacaggatcatttgtaccccaaacctcaagtgtcatacagcacacccatgaaacaaacctgcacatacatccactgaatttaaaataaaagttgaaattataaaaacaaaatacactttaaaaagttctcaccataaaagtgataagcatttgaggtgacggatatgttaattagcttgatttaatcattcctcatcgttcacatctatcataacatcactttgcactccatatatatataattatgtcaatttacaattaaatttttaaaaattgttaaaaatgtaaaaaacattattagctcacaggatgtgcaaaaacaggagatgggaaggatttggtttgatgtaggtcatcctctcagctaaaaccaggggtttcttcccagctttgcagctgggcagccaggctctgtgtgaaatttctccagttataagaaactcactacttcaacaggcagccttttctaaggctgagatgaaataactggacctagctctgcctactaaagacacaacaaataactcaacttcatctttatggcaacccttaaaatattgaaatgtacctgtcttgaccatcttggaagtctcctgtgtaggaagtccaagtttctttttttccttatcccccactttttttttctgagaaagggtctcactctgttccccaggctggaatgcagtggcacgaactcagctcactgcagactcaacctcccgcactcaagtgatcctcccacctcaggctccctgaatagctgggactacaggcacgtaccccacacctgggtaattttttattatttgtagagaccgggtctcgctatgtcgcccaggctcgtctcaaactcctggacacaagtgatcctcctgccttggcctcccaaagtgctgggatcacagacatgagcgcctgtgcccgtccagcccaagtttctttaactactgttgtacaacatggtttttctgtttggggcagggggggtcctctctgctctagtgaaattctcctgcaaatgtcaattcaagtgtgcccactttagggagaggagagtaatgttatgccattccacaatgtttgccattgtgccattctgaatgctctgttaatgtacttctcagcttccctggctcagggtaatatgataatcatctttaaaatttttccccattggtttttcttttttcttttagtcaccctatgaggctggggccccttaatttctcatcacccacacttgcctgattctcttgtgatgcccacatgatccttctcactggatccttttatgatctgccatgtcagggggtgttaccaaagcttgatccttgaagcctgtgatctctctcccactttatgtcttagaagacagattctcatggctcgctcatcccttctataacaattattccaaaactgtatctgcatcaccaatctagcacacgagctccatgctcccgccttgcactgcctagtaggcatccatttaaagatcatactttactctcatcctagaaccaacatgtaccaaactagatatttcttcacaagatgatgacgatgatgatgataatagtcacaatggagatagcaattagcacttgttgaacacctactatgtgccaggcactatcctgagctaaggattcattatctttcgttgttgttgttgttttttgagttagggtgtcactctggcagccaggctggagtacagtggaacaatcctagctcattgcagcctcttattactgggctcaagtgatcttcctgtctcagcctccccagtagctggtactacaggcgtgtgccacaatgcccagttagtttttaaatttgtagagacaaggtcttgctgtttttcccaggctggtcttaaactgctagcctgaagcaatccttttgcctcagtctcccaaagcactgaaattacaggcatgagccacagtgcccagccaggattcattatctttttaaaaaaacgtaattaattaatttaattttgagacaacgttgggctctatcagccagactggagtacagtagcgccatcttggctcactgcaacctctgcctcctgggcacaagccatcctcccacctcagcctcctgagtagctgggatcacaggggggcactaccacgcctgtaacttctgtatttttttatagatggggtttcaccatgttgcccaggctggtctcgaacttgtgagctcaagcagtccacccattgggattataggcatgagccactgcactcggcttggatacattctttctaaacctttacaagaatctatgaagaaactactcttagtccccttttataattgcagaaataggctcagggaagtaatttggccaaatacactgctaataagtaacagggttaggatttgaacctttgagtgtatgaattaaagcacatgctcttgacctctttggctggtctttgtaacccaaaatgatgtcatgggtgctccacttattccgaaagccacgcttggaaagcctgaattcagtcttgacccctccctctccttcagcctccctatgtgaacagtcactgaattactgggactctttcttctaggcatctgggagccatttttcccttatattctcactgtcatcctaaatcaggccccttgtcatcttctgttgtttactgcaactctctcctgatggatcttcctgcacccaggtcttcagtccatcatgcatgatcctgcccagaatatgtttgagcaagctgggtctctcacttgagacatcttcctggcatctatatctttttattcatttatttgatccaccttagaactgtccagccctcacttgcctggggtcctcatcttgtggggagaggagggaagggatactagaatgtatgtcaactgccaggtaatttaaatatttcacaggtgaatcttttttcctttatatatatttaatatctatattatatgtatgtgtactatatattatataatatatattaaatatggactatattaatattatatatctatgtctatatatagtctttagtagtttcaagagtggtgtgttttggaaaattggagaaagattaggaaaataaagttccaggttaagtatatttgagaaatgctggtgagttaaaagtgtctttatgactggacttcttcagccttcagtatactaacatgcatggcgactatcaatacacaagtggaaagagctgcaaaagggtatttgaaattcactggaccacaaatttttttttttttttttttttttttactttctcctactgagcatattgagaaaccagggttctgtagaacaattcttaagaaaaactactctaggaatgtctatcaaaatgctatacagggctgggcatggtggctcatgcctgtaatcctggcactttgggaggccaaggcaggtggatcacctgaggtcaggagtttgagaccagcctgaccaacatggtgaaacgccatctctattaaattcaaaaaattagccgggagtggtggcacatgcctgtagacccagctacttgggaggctggggcaggagaactgtttgaacccaggaggtggaggtcgcagtgagccaagattgtgccattgcgctccagcctggacaacaagagcgaagctccatctaaaaagcaaaacaaaacaaaacaaaacaaacaaacgaacaaaccaaaccaagctatgcaggctgcaggagtgaaagtcagcagtgatggacagtaggagcccaggacgtggagtcagaaggataggccggagtccaagagccacacagagaggccgtgtaagggttaatgtcataatgtatgtgaaaggctctgcttaagtgtaaagctgtggtgtaaatgtgcacattagttgacaaatggtttaaatttaagtatacttcaaattttttccctaagattggttgttggtttccatagctaaaaattaagaaaacatattttatacagcaacagagaacttcttaggaattattaaaggactataaatatacaggttttttattctctctacttatagggaatatttgttgcatttgtacacttgattgacccaaatagagaactatcacaaatacaagacaaattttacttttcattgaggagaatattttacaaattacaaaatgacttataacaagaccactataacatgaattatggtgctggggggtgggaggatgtgatttaagggaactgggacctcatggtagctgtgagtacctagggaagggggcaagtgggttccatggtagctgtgcgtacctagggaccagggcagtgagatggagaaaagaagagggggttgtaggggctggaaatgtcaacaaacttcttggctggatttttgtctagggccagtccggcatgttttccaccctaatgatttacatacaactttagtgtctgtctaactttcaaagtatgaggtgtgatgaaaaggaatgaaacttgtgttcgcgtgaggcttatggaatctgaatcgtgggattaagatttcaccttgtaagtccatgtgccagggcaggagggatccagactcatcacccacagcatctgtactgctttgacctgcggctgagtcctcattctttccctgctccttccctggcccttgaggaatctgtggccaagctgcttggggaggctgaggcattaaggcccagacccacctcctctactacagtttccaaaagcacactctgtaatgggtaccgagccatcgggtatccagtacccaagtatttttatgaaatactcattctgagggagtcaccatgtacctcagcataagtccatgagaagtcctgcagtgaaacaaacaacttacttatcattgctttcctagcatgtggcttatgtgttagatgatggggcactgtttttacacggaatgaatactgacatcccatatcatgttgggagatactgccctgccctcacttggttacccctaaactcccttccaacaaaccagaatttaatgcccatgtttctttattcatgatatttcctattacaagtatttatattgcaactagatgcagtaatgtgtgtgcacgcacacacacacacacacacacacacacacacacacatatatgtttcatcttggcttagccactttcaacctatgtgatattgggcaaattctgtagcctttcattacttattaattattatcatttttttagccccatgtcttaatttatctgtagcctctctctcagttttgttatttgtaaaataaagccatggctcccacctttcagggttgtgtaaaagctaaatgagattagggttgtaaagtgtttggctcagtgcccagtgcaaggcacaggattcacagcagcttcatcatcactctctccatcattatcatcatatcaacgaatgcgagagaaattagatgtcctcaagtagctaattgtcaaattaagtttttttcccttttgataagataatttgacttgcatatcaattatgtatcttggttttaggaagaggtttcacagaggagacacaaaatggagaaacatttgttggatgattgtagagttaaggagattcacatccagttgaaaaaatgttctgttaggccaacccgatgaatagtctctagtgacatgccataaggctttctattaattcctattagatttgacatttttaccaacaatttgaacaaatatacatggcacatatttatcaaatctgaatatgaaaaaatctagagtgttagttaattcaatacagagctgaattaagattcaaaattattttgataggcctgaatgccccaaaattaaaatgtagtagacttaaatataaaatactatgcccatgtgagaaaataataaatgaaacaacctatgcagagaaatgatgagcttgatggctgtttatatgataaaagtctagcagttttagttgatcatcaaccaggctaataattagagctaatagagaaaagcaattaatttagcaggaattaagagcggagaattacccaattgagagaaggaagagactcactgttcagaacagatgaggaagccccatttttaccttttgccagatgacgtaagttctgaagatatggggaatgtccagcctcaagagaaccaaaccaaaggaagatataatttttactattcctcctggggactgacaagtggaatttgtaaggagaaagaattccgcctgttttaaggaagactgttaaaacaaatcgagccgcatcctcacaatgagtttgttgaaatggagcgaagtccgtcttcaaaagtttttagcaaaagctgggcaagaagctgcaaggaagggattcttacatttggtgaatgacatgagtccacattacctccaaaacttcatcagtgtgaaagttcagagctgtgcctgacaaaagccttcccaatctccaaagctctgaagcctttggtcatcctcaatggagatgtgcctgtgtgatctccctcttcaaatctcatggcatgcacagtctttatctctcattctgcacaaatcacactagttaccatttattgagaacctatcctgtacttgattttatatatgttatcttgtttaagtgtccccataaccatgtgaaattaattaaattatcccacttcatagatgagaaatatgaagctaaattctgttttttaaatcactcacttgcccagggtcccacagtaagtggcagaaccccatgttcatgcccagacatttttttttctttttaggtggagtttcactcttgtggcccaggctagagtgcagtggcacaaactcagctcactgcaacctctgcctcctgggttcaagtgattctcctgcctcagactcccaagtagctgggattacaggcacacactaccatgcctggctaattttttgtacttttagtagagacagggtttcaccctattagccagggtggtctcaaactcctgatctcaggtgatccacctcagcctcttaaaatgctggttattacaggcgtgagccactgtggccgtatgcccaaacttaatgatggaattatactctttcctctttctactaactcatggcacttctctaaccatgatctcttacacaatagttcatgcctggcattgctttatccccttttgtgtatatttattcattattttatgtcttgtatgccttgaactagattgtaaattcctcgaacaaaatgacccatgtcttgcttttctttgtatttctaacagtacctaataggataattatttacactaattagcattattcataaaatactattacacatctactatatagatggtaccatgcataaaaaccagagatatagcaatgaacaagttagaaaagtttctagcctaaggagatagaaaaaaaaaaataagcaagtcaagttccctggctcttgagctaagacatgaccaagggaaggcagtagctgtgatatggtctgagaaagaaggtcttttgcagaggcaacaacaactgcagaggctatgtacagaaaactaacttggcatgtccagggaacagaatgaaaggttgtgtggctaaaacagagccagagagaggggtgagtgtataaagttaggttggagggccgggcgtggtggctcgtgcctataatcccagcactttgggaggctgaggcaggcagatcacctaaggacaggagttcaaaaccagcctggccaacatagtgaaagcctgtctctacgaaaaatacaaaaattagctgggcatggtggcaggtgcctgtaatcccagcgactagagaggctgaggcaggacaatcacttcaacccaggaggtggaggttgcagtgagctgaccgtcgtgccattgcactccagcctgggcaacaagggcaaaactccatttctaaataaataaataaataaagttaagttggagaagtaggcaggagcaaaaccatgcagggtcttgttatcttggattttatttcaaacgcaaaggggggccgttgaagggacacttagcaggggagttacctttatgcttataaatgatcaccccgattgttgggtggagaatggattatagcatttgtcagcatgaaagcagtgctggagataagtgcaatgatggctggtttcaacctagcttagcagatgaaatactaaggaataggccaattcagggggtattttgcaagtaatgcaaatgaaacttgctgatagtttatgctatggtttggatgtttgccctgttcaaatctcatgttgaaatgtgatccccaatgttggggcctcgtgggaggtgctggatcatggggtggatcccttatgaatagcttagtgccatccccttggtgatgagtaagttctcactcatttagttcactcaagatctggttgttttaagagtctgggacatcccccttttctctctcttgctctcattcttgccccatgacgtgcctcctcctgtttcacctcccgccatgagtaaaagctccgaggcctcaccagaagtggatgccagcaccacatttcctgtaaagcctgtagaagcatgagccaattaaacctcttttcttcatacattacccagcctcaggtatctctctatagcaatgcaagaatagcctagtacagtttagatgtcagggtttgaggaaagagtaaatcaatcaaactctggttgatggcctgaacacttcagttgacactgaagctgctaagtgagatggggagggcagcagcactgggtgaggggggaaggtcctggatggtatgtgaatggtgtggagggagaagttaattctattttggccatatttgagatgtcttttagacatgactagaatgtaagctcagtggggcaggagctttgtctgtgttgttctgtgccatattccccatgcacaaaacagcatttagtacaaaagttggtactgaaatcttgttgaacaaaaaaagccaaggtgaggcattgagaaggcagttggatttatgaatgtttaaatcttttgggcaaatgcagatcctcagtaaagcataaatacattcctccttggctctcacatgtgcagtaaaaatctctaaaagtggtttttcaaagagcagaattaaacatcctaatagggtcagctaatgccgtcctgaaaagaggctcaaaatcctaatctctgaccaaagctgacctgatctttcccacagtgttcagagtcatttaagtgatctgatggcaaaggccttgaggaactgctgcagtgcttctctgggtcatgtttattatttttaatagtaataacactgctcacataggtcaaaattcctattcatctatttgctgatttccaccggatccattattgtttctaccagtctcaggacagaggtgttaactgatacctgctttaaaacagaattaaacatgtctccaataagtcaatggctttgacagttaactttctgggccagttaaattctagagacacaatgtgagctttaagaaggagaactaagaattaagatagcctattatagtaataaaatagtctaaatattaaaggtttcaaaatcacatcctccattttgtagtactatgagcaaacaatgaaaaaaatacagaaagaaaggaaagaagaaaaggaaggaatgaaggaaagaagaaagaaaagaaatgaagatggggccaggcatggtagctcaggcttataatcccagcactttgggaggccaaggcaggtggattgcttaaggccaggagtttgaggccagcctggccaacatggtgaaaccccatctctactaaaaaaaaaaaaaaaaattatccaagggtggtggtgcacatctgtgatccagctactcgggaggctgaggcacgagaattgcttgaacctgggaggcggaggttgtagtgagccgagatcataccattgcactccagcctgggtgacagtcagactctgtctcaaaaaataaaataaaataaaaaagaaatgaaggcagggaaaacaacccattacatttatttaaatgtacgtggaacaattctcaagtatctgcactaatggatgaccccaaagatagaaaccattttcctcctgtttcaaaatgaagtcctccatggcagtactatgagcaaaaaatgaaaaaaaaaaaaaacagaaagaaaaggaaggaagacattttcctcctatttgctttgggatacagctttgttctctttgagtactgctgtgactgatgttctagagcagtgattctcaactattggtgtgttggtagcatcagcgttatctcgtgaagttatgttttttcctttttgttattttaaattttagagaaagggtctcactctatcattcagactggagtatagtggcatgatcctacctcactgcagcctcaattcctgggcccaaatgttcctcccacctcagcctccccagtagctggaactacaggtatgcaccaccatgccctgtcaattttttaattttttgtagatacaggatcttgctatgttggtcttgaacttctggtttgtcttgaactcctggactcaagcaaccctcctgcctcagatgcctaaactactaggattgtaggagtgagccactatgcctggccttcatggagctttttatctttttattttattttattttattttatttttttgagacagagtcttgctctgtcacccaggctggagtgcagtggtgtgatctcggctcactgcaagctccgcctcctgggttcacgccattctcctgcctcagcctcccgagtagctgggactacaggcgcctgccaccacgcccggctaatttttttttgtattttttagtagagacggggtttcaccattttggccaggatggtctcgatctcctgaccttgtgatccacccatgttggcctcccaaagtgctgggattacaggcgtgagccaccgcacccggcccatggagcttttcaaaattataaatgcctgggccccaccttgcatccacggaggcagaatctcttgggggtgggctacggatacgtgcacattttaaaaatattctgattcccattgtcttcattccgctgatcagtgagaactactgttcaaggaagtcacattagatggttgaagaatgagtgcatgcgtgccagtcctgtctgacaaggtgcaaggcagccccttcccactgcctcctcctgctgccccaactgggagcacaggtaggacttaagattttgaatttcaaagctatctgtcttagtccattttgtgctgctataagagaataccactgtgtaatgtataaagagtggaaatttattttctcatagttctgagcctgggagctccacaaggtgctaacaatttcagttgtctggtgacagctgcatcctctgaaggggacactgtgtcctcacatggcagaaggtgaaagggcaagtaagctgaatgctgcatgaagtctcttttacaagggccttaatcccattgacgatggaggagccctcacagcctaatcacctcttagaggtcccaactcttaatcccaccacagtggcaacacctgagttttggagtaaacacattcaaatcatagcaccatcaccgctaagggtgtgggtttcatgtaaaataggaatgaacagacagagaggtggaaaaatgtagtagaaatgatgtggtcaagagaggaatataaataaactcctttagattttgggggcaatctttctcaggcatttcacaccaaaggaaacctcagagccaagaagggaacttgaaaagccaaaaatctgaaatctgccttctgcctggtgctgtggaaatgataaattatcccccatgctctaatattctcagacattgagatgctgttgtcctccctatttcaagggccacaatctcctagttcaaaggagatgctgcatttacaatatcaggaagtcagcacataggttaaaatcaacaaacaggtcaacatttttacacatattgaaatcataaaaaaattctgaatcctattgcgaggaaaatggtttcatttagagtaagagaaccgagtggtggaaagaaggtccctcagcttttgattcaaaagtatcaagcagatgagccaagaatgctggctctggaagccagaacaactgggttcaactgtcacctctgaaaccacaggtcattcatttagtctctctgtgtctcagttttctcacctgttaagtgggggtgatcataataataaaaaacggaatttattatcattagttattctaataatgctgttatgttagtggttttttttttttttgggaactaacatcaaaccactactgtgtctttggtccctgataagtgctttaaacatgtcatttctctgaatactcatataaagcatttggggtagatatattattagccccatttaaagatgagagattaggccgggtgtggtgacgtacgtctgaaatcccagcacattgggaggccaaggcaggtggatctctggagctcaggagtttgaggccagcctggacaacacagtgaaatcccatctctactaaaaatacaaaaattagccaggcgaggtggtgtgcacctgtagtcccaactatttgggaggctgaggtgggaggatcgcttgagcctgagaggctgaggctgcactgagcaaagatcagccactgtactccagcctgggcaacagagaccctgtcaaaaaaaaaaaaaaaaaactaaactaaaataaaaataagataaagatgaagggttaggtatctggcttgaggttgcacagctgggaatggtggatcagaacccaggcagcctgactccagagctgcacctgaatgatgtcaagcctccatgcccctcttatttctcagccctacgtgttactctgggtgaggaaagccctgtgtgggtgctgactgccaggaaccatgagacatgatttgctgtcaatcagcttcaggatggaagtgccatctacagctaaccttgcacttaggatgccgccctgcacagctgagtttctgtagtttatttgcctactgtattttttttagtcaagaaatttctggagtaaaatatctgttactcctggaatgtgctgtgaaatgttccagggaaagaatacaatatctgctctgagaggggagatgtgctttgtcaaggaaaaatttgattttccaaagtgagctgaaatttcccttaccctgagggggtttttatcagcagtttatcctgtgagtgttcagatttgaggaaggaagtttgtaaagcagccctgaacagatgatttgctctgctgtctgcttttataaaagagggggaaaactttgattgagacgtttctaaacatggttcaatatacaaattcaaaaaccaatattttttctaaaacatttcaagtgaaagaacctatttggacatgacactgcctcacatcgttataatatgctatgctttctgcttactgtgctgaaatggtctttccatagctatgaccagacaggcttttagatgctggaatctgccaaagcgatcatcattgctatgaagtatataaggaattctggctgaaagctcaaacggctcttctttgaccagatggtttatttattcttactactctttaccaggaagttaagctgcatcttggcattctttacagagaggatggcctttaaactgttgaactgacatctggtgaaacctactggacagaaggaacaagcaacaactgattgtcactttgggctgcccaagattgcatggctcagggaagctagctgatgaatgctcaggttgaccacacagaattggggaggggaaaagacacccagggcagagccacatggaggccttgtagaagctgctggggtctcaatagaactgggggtctcaatctaggactcatgacctaccctcagaccagctggtctgaaagagaagccctgctgaatggtgttgccaagaaccacccaacaagcaaaaactgccctcttaggacatagaaaaaagtgaacctgcttatggccccttgaaaatcactttccagccagagatatcaactgtctgttacacaaaagagtgcctggaagtggtgtgggtggtgacaggttatgaagtcaaaaatttgcttgtgtgatcgatcccaaggaccagctgtagatgcaatgaagggttccaacccccaaaatcatcattggtgaacaacacaacaagagcaaaggacatattaaggagacatgaagtttgagaactagcaactcagaactgtgatgccaagatcctccccctcactccacgttccaccaaagtgcttctcaggaaagaggggagaggtagtgaagggaggaaggatgccctgcaatctcgatttgcctctcctctcttttcacctgcatgcactaaagtatgtaatctttttggtaaaattgtctataaaaatgcctctgcatttcctctagaaaagataaagggcttgggaatttattttaggaggaattttttaaaagtaaggtcataaggaatgtgggctagaggtataagctagatgcaggaagatgaaggataggaaaaaagaacaatatgatttgagactgtcaaagtgagagatttcgtgggtggtcaagaagtgaggctgctccacctgaaaggagagagaaagaacactggcttctaagagcttcagatcaggaatatgactacagagaggtgtccagattaagaaagttcgggaagacctgtctctcaaactaagcaaagcaggatgaagcctacgttcaacacaaatcttgactagctctgcctgaggactgacccctccttgtgcttctgtttcttttcaaggataaagagagactgcctttaagaagtttctctagtgtgtgcatcacagtctaatagggcatgagaagggggaatggggaggaaacactgcttccaagccacaatccaaactgattttaaatgatttatctccaggccttcattaatgtaagctgaaccttttcagtaatttcatggtcgtactttgagttgcattttaaccatgctttcctaagaataaacattatgcaaaactgcccaaaaagtattaggaattttcttcctttttctcacattacagttaagtcattgtgtagagagttgttagaatatagaaacttctagctcataagcgtggttctgggggcaatctggaacaagctgcctccctaaaccatgagtcttgctcatgacaaaaactgtctgattgtcttcttgtctggactgccttccatttccatgaacttccccctctattcctcccatctctcaagacccagccccagactcgagggctcagcagaatgagctcttgtcacccacctggacaccccagccttctctgttggtgccactctcactgcacttactttctgccttttttggtagatatttgtgtccatgtctcatagcttctggcagactgctatttactttccttagtgcatatctaccacagtacactgcttctaagaagtcctggattaactgaatggatgcacgagtaaatgcattcacttccccccaccccaagtgactagcaccggcaatggagctaatattctctttcttgtctttaagatactataacattccaaggaatatacatctttccactgaggaaagtgcatttattttgtgtatccaattttggcagaatcaaagtatgggcttataacatcaattttcaccatatactgctaatttcttatttttaaaaaatatgtttgacatgccaatggaaaaaaagagaagacgagagaacagtaggtgctcaatgtgtctgttttttgagacagggacttactctgttgctcaggctgaagtgcagtagtacgatcttggctcactgcagcctcgacctcccaggatcaggcaatcctcccacctcagcctcccaagtagctgagaccacaggcatgcaccaccatgcctggctaattttttgtactttttgtggagatgaggttttgctatgttccccaggctggtctcaaactcctgggctcaggccatctgcctgcctcaggctcccaaattgctaggattataggtatgagctgctatgcccagccaataagtatgtcttcagtgatctcgcaaccccacttctaggtatataccccaaagaaagaaaaccaatctattgaagagatatctgcactcccatgtttatttcagcactattcacaatagccaagatttggaagcaacctaagtgtccatcaacaagatgaatagataagaaaatgtagcacatatatataattcagccataaaaaagaataagatcttgtaatttgcaacaacatgaattgaattgaaggtcattatgttaagtgaaataagcaaggcacagaaagataacctctgtgtgttctcacttatttgtgggagctaaaaattaaaacaattgaactcatggagacagaaagtagaaggatggttactacagggtgagaaaggtagtagaggggagtgagggaggaagtggggacagttaatgggtacatacaatagtcagaaaaaaatgtaagatctagtatttgatagcacaaaagagtgatatagtcaataataatttaattgtacatttaaaagtaacaaaaggagtgtaattggattgtttttaatacaacggatcagtacttgagatgatggataccctatttactctgatgtaataacacattgtatgcctgtaccaaaatatcctctctatcccataaatatatacacctactatgtacccacaaaaattaaaactaaaaaattgaaataaataaatctcttgagtgaatgaatgaatgaatgaatgagggagtaatggcaggaacctagataatgggaaactggataaaaatcagaaagagaagtagaaaaaagatagacacacaggagattttgaaaagaaatagaaagagagggagggaagagggaaaggagacccaaggctaatgaaattctcaattagcaagtcaggttttactacagacttgaacctgataatttaacaagagagaagcagctgggtgagaagagatagactttgaagaaagatctggattctgatatccactcagctacttagacaagtgactcaatctctctgagctcactgcttacaatttttttttattttgaagtaattttagatttacagaaaagttgcaaaagacagtacagagagttcttgtacacccttcactcagcttcctctaatgttagcatctttcataatcatagcacaattgtcaaaaccaggaaattaacattgatacaatcatactaactaaactatgagcctcagagtttctccagtttttccattaatgtctttttctagtccatggtccactaggatcccacactgcatttagtcgtcatgtctcctggtctcctctagcctttaacagttcctcaattttttcttaccttttatgaccttgatgcttttgaagagtagaatgtccttcaatttagagttgcctgatattttttttcattgctagatttatgtggtgtgtttttggcaagaacactatagagatgaagtcctgcctttctcagggcatcatatcaggaggcatatgttgatatgtctcattactaatcatgttagccttgatcacttggtcaagccagtgtctaccgggtttctccactgttctattttcccctttgtattaataaataccttgtggagagatgctttgagactatttgcaaatgtcctatttctcatcaaacttacttttgcccaataattttagaattcatcagtagttcttgcctgcaacagttattactgtagtattctaatgatgattttctatttttctcattctttctacatttattaattgaaatttttctataagtaagtgctgtccctactccccaaccccaccacactgatgtatttatatcggtatggattaaaaaatatttattttactctatgggccataatccaacactgtcattatttattttgttgcctaagcttcactttcctcatctgcaagacagggttgatgacaactgtcataagaactgaatgagattttaagaaatgtgaaaatgtccagtccagagcatctattaaataaatgcaaactccatttcttccttttctttacagtatgtaaagccatgctaatttcaaggcaaggtcactcaaaataggtgaaaaatctgaatttgaaaattctcttttgatgtaatggaacttttctactttaaggtatacaaaagaactagaatttagctattccagtcgtgtccagtagagatcatttgggatctgactatgtaagactgatttttaatcagcatacccataatttgtatgaaaatagatgcttgagaatacttgaaacagactgttctcttaagtagtttaagtgttttcccagaaatcttgtttacgttctgaagttgcttagctaaactattttcagagatagtccaaagcctgcctctacccagctgtaggtcatatcatctctaactctgaattagtgaaatcactgattcgtctttgattcccaaggttatggaagtgaatggaagaaatccaagtttagtttaaaattagattttaaaagttttggcaattcacttttaagttcaggtcgaaatttaaaaataaagacaagatagggtcctaaggatgtgagagtgggtagatctggaagtttaaaataattcatgaaatacagtgaaatccactaataaaatcactcagtttactggaactttcatttttccatcccatttttatcagtaaggaaaatcaagaacatcaggagttttatttttaaaaacaactttggggcagtgacatttgcaagctctcatgtggactcccagagattctgtcttactcagtttgggggtgggaccaggaatctgcagttttagcaggcaccaccccccagtgcaatcctgctgcaggtgggaagcagcatcctatagttattcaaagcccagggcctgactttgtgggcttaaaccaaaattgccacctaccacttgtgtaatcttgggaaaataacttcatctccacatacttcagtttctcattgataagatagggctaatgacaatatctgtctcccaaggttgttgtaaggagcaagtaagtggtacatataaaatggttagcacaacagtgccagatagactggtgttcaggacatgtctggatacagaaccgcttgagctcagcctctaacactcgttgtattcatgggccttatcatggtcactgacatttacaaccatcatcaggattttgattggcaagctatggaggctgcaaagtgagctacagttagaaagtgttttgtgtttttttctaaagatggtgtctcactctgtcacccaggctggagtataatgacgtgatcctagctcactgaagcctctaaacttctgggctaagggatccttagagggtctcagcctccacagtagctgggactgcaggtgtgcaccaccatgcccagctaatttttaaatttgtactgacaaggtcttgctattttgcccagtctggtcttgaactcctggcctcaagcgatcctcctgtctcaccctcctaaagcactgggattacaggcatgagccaccgcaccttgccagaaagtgtttatgtaacacaggatgacagatcctcagacaatcagagatatatatgactcagaataggaatatcctgttagcatttaggtagagtttactaaatgaccaaaataggcaactactctgtgttcagccaactaacaaccaacaaacataccaattaaaattttgtgattgaatacacaaaacaaaagaaattaaatctaaaacataaaatgtagaatagaaaactctgggtgtgggttacattactaagagaaagtgccttttaagcccaagagtgcagtccgcccaaccccagtactgcatggagactccctgctctttcctgacgctcctccctatcccagggccacagggatgtcagccagtggctcttgatctcccagtgagtccctagacccccacgcaatggctttgtcctaagtattcccagactccagtcacacctgtcttcttcagaactggcttctaatgtggtctcagaggctttggattgatattctggggctgaggatcttcaggggatgcagagagagaaccgaggtgattcactgcccctcaatgaattgccccacgtttcctgccttctctggtgacctaggtgtttctgctgagggagtcctaataatggaagggggtcagggggttggttatacgaatgtggtcagggatcatgctgtcaaaactcaaaattgagacatgtggttttaaaagcacctttgggaatgaggggttggtaggggagaggaaggggttggagattggcattctgggtgcccaaagggactaggattggtggactgggtaatgcaatagaatggagttgagatcaattaggcttaagggcaagttggggtacagtgagaggaaggattgcaatgtgatgtctgtctctttgcctggaaagaaaaacagccatcatggaagtggcaagacagaatgaaatgaacacatcaggaacagacaaacctagaaggggaggtatgcttgaaaatcacttacgggtgagtcaaataccaagacatcaaaaagtggcttcttacctcattaaacctcatcaccagatcttcaagggcattgtgctctccattctgagtggtaagaatcgacgctgagatggatgctttgaggcagggcaaggagctctggcattcaggagtgcccaagtcccgtgttaagaagcaaaggtagtcgactggcaagaccctgcggtaaatagtctgctcttgctccatcaggatgctggcgacttcctctgggaactggatgagaggctgcagatcgatcagctccttgctgatcccagctgaacttgaagggagggcattggaattggccacagaggggcctggctggcgttctaaaacaaagcaacagaagtcgtggttacatcaaatctggtgtcccctgcaacagatatttacttgagagccattccaaatcttgtatgttctttaaccaaatcctctgcttagtgaagagttctgtactatttttctttttacaaagacctttctgatatctgtcctatttgtcttctagtcacctaatgaggtgggggtggagtggcggtggtggtggtggtagggttggttttccattttcagcagcagcattaatctagcacataattccccaaccagtttactatgatactttgtaaaataccatttgcttccttatcctcctttgctaactaccatcagaatgacatgaaatgagggtaggtataagcatagccaacttaaatggaagaggaaagaaggctgtgtggtgaagaatatgtatatgcatattatgtgtaaataggcaggacacctggggacccaaggactctctggacaaaaggtttcaaaatgtcatggtattctctgccaacctgtcaccctcaaagagtggctttgatttcactgatatctatttgggagtttgcaagaacagaaccatctacaaacataagaaaggaataggtaataaggagatgtatctaaataaataaatcttaactgcctggcccacaactggtagcaagaaggtgacagagggatgcaggagagaaggtggcagttcatgagatggaagtaccagagtaggggatgcctaggctcaaaatgatttctgtaattagagccacatacttgccttctctttattttgacactgtcccaggctgcctcttaacttcttacctgtaattcattcattcaacaaacggaaagtctctgatgagccctagaacagagttttccaaagaatgatctctggaatactggcatttacaagaaaaacagttttgtggtcacctgagttggggaaatgtcacatattcatgtcactcattctcttcctggaaatacctgtcatccagcctggacactgggtaacagcaaagttcgtaaggatgacttccttcacattcagacctcagtattctctgactcttttctaaatctccattgcagaaaactttggaattatcactccaaactgcttcatgtctgtattattaaactctgaagtcatcatccctgaatttgacttctttcttcccttttattctgtctaacaaaatttctctgtcctcagcaaacttctagttccttggccttcgtctggtgctacgataagcattttagatggcactcaccagccagagattccctaagaagacagcttgactttccatcacaggcatgtcccaatccccagtgctgggcagactcaaaccatccattccttggcttctgggctgctgtatgatgacactgacaattatgctacttagtgatggggcgggtgctaattcctattatctaacttcagctaggccctcagggtgactcaaagttgacacaaacttatttattttttcctaaacaactcactatcctcttttctattcttctcacattcccaaacctgcgtttgctttcctcacagtcattcgactgtttcttaactatgctgagacagtgtaggtcatgtcagaaactccttcaattcagataccttatatttcttccatcttctgcttccctgagaatggcatgtgtttcctcctctccaaggcccacccaggtttgtgattaaatctacctttgtctcctccagaacttgcttcagtggttatctccacctttaatccctcactttctactgacttctttgcatacccaaatgttcagtttcctttttccttaaaaactaacaaaaacgacatcccttatcctttaaactccaaacctctctatcttttccttcactatgtccttctataccaggtaacccacagtccctgattccttcctccatgagtatggtgactatatcttctgatcaaaaaatcaggccatgctctctggccaaattactaaaccaatgaggacatgggacagaaaaatggaaaccaggttggtcctggttgactctaagcattttaatacatcttttggaccaaattaccaaaaatcttctgtaacaaaaaatggagactattaaattatatttggttctatctaagctcatattaaaaaaaaattaaaatcaggttgatgcttaaatctaccctagatggcctccccctccagctttctgaatagtttagaaactgcctaagtttcctgaaaattgaatcagaatgtggcttgatgaaagaggccaaccgaaatttctagatactgataatatatgtacagtggaattagccaaatataagaactcttctcagaagtaaccaactctaagacatgatctcgaactatagcactctgcagaggaaataaaaataactccagtcacttctctaatatataagagaagagataatgtaatacaatatgcaaataatgtaagataagatgtcatatgggaaactgcaatacatttgagatatgaatcacatgctgttacaatgaataacaagtctagtgactggtgggaaacagcaataagagaggcccaaataaattaaagaataaaaagaaacctggtcagtgtaaccctaataaatctggcggtcccagtataagcatgtatctcagtataagcatgacatcacactcaaaggaacacaaattgaatgctagaagctttgaaacaatgtcaacctttcatgtaggtttccttaaagctggaatacccagggatttcatattgtgtaccacaaaaaacatcccagaagtcttcttggggcataattctttgtcttctaagttccatacttttagcagctgttaaaaacacttcccactttccctcatccttgctgagctctccctattatgtcctctttcctcttcataggacacattgccctagtgctcagctgtaactcacctctgggccttgctctctaacaacatgggccactggaagatggatttaaaaccgagtagctctaggacccctggtccttcctcatgatccatgaagcaaagttcataaaacccactggacactgtggctcttctctttttagaaagtttctggtgaataaaattatccacctcattgtttgctctcagtcccatattcttcagttaatagtcattctaggtcgggcgcagtggctcactcttgtaattccagcactttgggaggccgaggctggcggatcacttgaggccaggagttcaaagccagcctggcaaacatgatgaaaccctgtctctactaaaaatacaaaaaattagccaggcacggcagtgggtgcctgtaatcccagctacaggattagggacatggatgaagctggaaaccatcattctcagcaaactatcgcaaggacaaaaaaccaaacaccacatgttctcactcataggtgggaactgaacaatgagaacacaccggggactgttgtggggtggggggaggggggagggatagcattaggagatacacctaatgctaaatgacaagttaatgggtgcagcacaccaacatggcacatgtatacatatgtaacaaacctgcacgttgtgcacatgtacccctaaaacttaaagtataataataataaaattaaaaaaaaagagtgcctactatgtgccaggctttgttttcagctaccctgatgttgaaatttagtgaacaagaataaagttttgttcatatggaacaccctaggaaaggacataaacaataagcatagtaaatgagtaatgatgcatatgagaaggtgataaaattgttatggttaaaatcaaagagggttcctggatgtaggtgggaaaggtgtagtgttacatagcataccttttttttttgagatgaagtcttgctatgtcatccaggctggagtgcagtggcacgaaccgccgcctcccgggttcaagcgattctccggcctcagcctcccaagtagctgggattacaggcgtgtgtcaccatgcccagctaatatttgtattttttagtagacacagggtttcgccatgttggccaggctggtcttgaactcctgccctcaggtgatccacctgccttggcctcccaaagtgctaggattacaggtgtgagccaccatgcctggcccacatagcatatcttaactagactgttagtgattgtctcatatttttctgcaaaagtgggcaaaactttaccctccaaggtgcccgtagcttggtcataatcaccctttctcatgtctcaatggaagccattaattgagctcttagtcctcaccatttattagccttttgtgttaagtaacacatttaattctcacagtgaaccctgtaaggtggtgtgattatccccttgctatagacgataaaaaacaggtcagaaatgttaaacattttgcttaaagacaagctgctattgagagacagggctgaaatttaattgcagctctgactccaaaaatctgccctctgttacactcagcattttgagggatcctttgcagaggagacatatttctacacacacacacacacacacacacacacacacaccttttttctcttctgggtagagaatggagttgaagagttaggcaggaataccttacaggattctgactttagaaggcatctcctccccaagccagctgagcaaccttctgatcatgattttaaattatatcttatcaaaacccggcagaatctccatgtacctatgtttcagaaactttatctttcattctcattccatgtgaggggtggtgaaatgggcacaagctttcttgagaggcaaaacaaaattttaaacgtgtattctttgtactagaaatcttacttctaggatattatccaacagaaactcttgcaaaaatatagaccaagtgaggtaaatgtatatgtactgaaactgaatttatttcacaaaaaatttaggacaaaaaagcaagttgagaacaatggaatattatcctattgaggtaaaaaataattttgtaaatataggtatatgttgcatatctgtccagtgaacaccaaacaaataatagtgtataacttacacagttctgttttgctcaacttttttgtaatgcacatataacagtacttttgaaaatagatcaaaatgagccaggcatggtggctcacacctgcaatcccagcactttgggaggcgaggagggtggatcaactgatgtcaggagttggagaccagccttgccaacgtggtgaaatcccgtctctactaaaaatacaaaaagtagccaggtgggtggtgggcacctgtaatcccagctactcgggagactgaggcacaagaatcacttgaacccaggaggcggaggttgcaatgagctgagatggcaccactgcattccaacctgggcaacagagcaagacaccgtctcaaaaaaaaaaagatcaaaacgatatccaaaaaattcaaggcaacaaaatctcaatcttctcatgctcaaaaacctggttcagctttttttggcctgttcagatttttttccaatatatatggtaatactgtttttttgtaagttacttaaagctaaaattagaggggggtggagccaagacagccgaataggaacagctccagtctacagctcccagtgtgagtgacacagaagatgaatgatttctgcatttccaactgagcaaatggcacaccaggagattgtatcccacgcctggctcggagggtcctacgcccacagagcctcgctcattgctagcacagcagtctgagatcaaactgcaaggcggcagcgaggctgggggaggggcgcccgccattgctgaggcttgagtaggtaaacaaagcagccgggaagctcgaactgggtggagtccactgcagctcaaggaggcctgcctgcctgtgtacactccacctctgggggcagggcaaacaaaaggcagaagaaacctctgcggacttaaatgtccctgtctaacagctttgaagagagtagtggttctcccagcacgcagctggagatctgagaacagacagactgcctcctcaagtgggtccctgacccccgagtagcctaactgggaggcatccccatagtaggggcagactgacacctcacacggccgggtactcctctgagacaaaacttccagaggaaagatcaggcagcaacatttgctgttcaccaatatccactgttctgcagcctctggtgctgatacccaggcaaacagggtccagagtggacctccagcaaactccaacagacctgcagctgagggtcctgactcttagaaggaaaactaacaaacagaaaggacatccacatcaaaaccccatctgtacgtcacatcatcaaagaccaaaggtagataaaaacacaaagatgggaaaaaaacagaacaacaaaactgaaaattctaaaattcagagtgcctctcctcctccaaaggaatgcagctcctcaccagcaacggaacaaagctggatggagaatgactttgacgagttgagagaagaaggcttcagacaatcaaactactctgagctaaaggaggaagttcaaacccagggcaaagaagttaaaaaccttgaaaaaagattagacgaatagctaactagaataaccaatgcacagaagtccagctgaaaactatggcacgagaactacgtgatgaatgcacaagcctcagtagctgatttgatcaactggaagaaagggaatcagtgatggaagatcaaatgaatgaaatcaagcgagaagagaatttcagagaaaaaagaataaaaagaaatgaacaaagcctccaagaaatatgggactatgtgaaaagaccaaatctacatctgactggtgtacctgaaagtgatggggagaatggaaccaagctggaaaacactctgcaggatattatccagcagaacttccccaatctagcaaggcaggccaacattcagattcaggaaatacagagaatgccacaaagatactcctcgagaagagcaactccaagacacataatggtcagattcaccaaagttgaaatgaaggaaaaaatgttaagggcagccagagagaaaggtcgggttacccacaaagggaaacccatcagacaaacagctgatctctcggcagaaactctacaagccagaagggagtgggggccaatattcaacatttttaaagaaaagaattttcaacccagaatttcatatccagccaaactaagcttcataagtgaaggagaaataaaatacagataagcaaatgctaagagattttgtcaccaccaggcctaccctaaaagagctcctgaaggaagcactaaacatgtaaaggaacaaccggtaccagccaccgcaaaaacatgccaaattgtaaagaccatcacggctaggaagaaaccgcatcaagtaacgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaacagactttagaccaacaaagatcaaaggagacaaagaaggccattacataatggtaaagggatcaattcagcaagaagagctaactatcctaaatacatgtgcacccaatacaggagcacccagattcataaagcaagtccttagagaccaacaaagagacttagactcccacacaataataatgggagactttaacaccccactgtcaacattagacagatcgatgagacagaaggttaacaaggatatccaggaactgaactcagctctgcacgaagcggacctaatagacatctacaaaactctccaccccaaatcaacagaatatacattcttttcagcaccacaccacacctattccaaaattgaccacatagttggaagtaaagctctcctcagcaaatgtaaaagaacagaaattataacaaactgtctctcagaccacggtgcaatcaaactagaactcaggattaagaaactcactcaaaaccactcaactacatggaaactgaacaacctgctcctgaatgactactgggtacataatgaaatgaaggcagaaataaagatgttccttgaaaccaatgagaacaaagacacaacataccagaatctctgggacacatttaaagcagtgtgtagagggaaatatatagcactaaatgcccacaagagaaagcaggaaagatctaaaattgacacactaacatcacaattaaaagaactagagaaacaagagcgaacacattcaaaagctagcagaaggcaagaaatagctaagatcagagcagaactgaaggaaatagagacacaaaaaacccttcaaaaaatcaatgaatccaggagctggttttttgaaaagatcaacaaaattgatagactgctagcaagactaataaaaaagaaaagagagaagaatcaaatagacgcaataaaaaatgataaaggggatatcacaccgatcccacagaaatacaaactaccatcagagaatactataaacacctctatgcaaataaactagaaaatctagaagaaatggataaattcctccacacatacaccctcccaagactaaaccaggaagaagttaaatctctgaatagaccaataacaggctctgaaattgaggcaataattaataggttaccaaccaaaaaaagtccaggaccagatggattcacagccaaattctaccagaggtacaaggaggagctggtaccatttcttctgaaactattccaatcaataggaaaagagggaatcctccctaactcattttatgagaccagcatcatcctgataccaaagcctggcagagacacaacaaaaaaacagaattttagaccaatatccctgatgaacattgatgcaaaaatcctcaataaaatactggcaaaccgaatccagcagtacatcaaaaagcttatccaccatgaccaagtgggcttcatccctgggatgcaaggctggttcaacatatgcaaatcaataaacgtaatccagcatataaacagaaccaatgacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcatattcaaaatagtgttggaagttctggccagggtaatcagacaggagaaggaaataaagggtattcagttaggaaaagaagaagtcaaattgtccctgtttgcagatgacatgattgtgtatctagaaaaccccattgtctgagcccaaaatctccttaagctgataagcaacttcagcaaaatctcaggatacaaaatcaacgtgcaaaaattacaagtattcttatacaccaataacagacagagagccaaatcatgagtgaactcccattcacaattgctacaaagagaattaaatacctagcaatccaacttacaagggatgtgaaggaccttttcaaggagcactacaaaccactgctcagtgaaataaaagaggacactaacaaatggaagaacattccatactcatggataggaagaatcaatatcgtgaaaatggccatactgcccaaggtaattcatagattcaaggccatccccatcaagctaccaataactttcttcacagaattggaaaaaactacttttaagttcatatggaaccaaactttcttcacagaattggaaaaaactacttttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccagtggaacagaacagagccctcagaaataatgctgcttagctacaactatctgatctttgacaaacctgacaaaaacaagaaatggggaaaggattccctatttaataaatggtgctgggaaaactggctacccatatggagaaaactgaaactggatgccttccttacaccttatacgaaaattaattcaagatggattaaagacctaaaaccataaaaaccctagaagaaaacctaggcaataccattcaggacataggcatgggcaaggacttcatgtctaaaacaccaaaagcaatggcaataaaagacaaaattgacaaatgggatctaactaaactaaagagcttctgcacagcaaaagaaactaccatcagagtgaacaggcaacctgcagaatgggagaaaatttttgcaatctactcatctgacaaagggctaatatccagaatctacaatgaactcaaacaaatttacaagaaaaaaagaaacaaccccatcaaaaagtgggcaaagtatatgaacagacacttctcaaaagaagacatttatgcagccaacagacacatgaaaaaatgctcatcatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagttagtgtggcgattcctcagggatctagaactagaaataccatttgacccagccatcccattcctgggtatatacccagaggattataaatcatgctgctataaagacacatgtacacgtatgtttattgtggcactattcacaataggaaagacttggaaccaagccaaatgtccaacaatgatagaccagattaagaaaatgtggcatatatacaccatggaatactatgcagccataaaaaatgatgagttcatgttctttttagggacatggatgaagctggaaaccatcattctcagcaaactatcccaaggacagaaaaccaaacaccgcacgttctcactcataggtgggaattgaacaatgaaaacacatggacacaggaaagggaacatcacacatcggggcctgttgtggggagggggaaggagggagggatagcattaggagatatacctaatgttaaatgacgagataatgggtgcagcacaccaacatggcacatatatacatatgtaacaaacctgcatgttgtgcacatgtaccctaaaacttaaagcatatttaaaaaaagttacaattagagaagaaagtaggaaaaacttattctatctactctatccattttcctttgctttgaattaactttgtagacttgttttaagtattagattctcaattgcacatttaatagtcctttagtggtacaattctaattatataaaataagagagagagagagaagaatattgatttcttcttatagaagattcagagctgacttaaatacatgaatctcaggaagagctgaaaattgctttcaacagggaagtgatgggtttagaaaaagtttggttaattggtgattttatcttattatctgttattggttttcaaagtaacaaaatccgtcttgcaacaaatgtgtctggcttgtcctgaacattacatgaaaaagatgagctcacaaaatcaatgaagcatattacttctaagtcagtacttaaaagagaaaaaaaacccaatatattcagactgagtgttaagacatattcagatgaaacaatctaccagacagaagagccttagagcaaaaagaaaaaagttgacagaatctccattaataaaaaaaacaacttttgctccagttccaaagaaacatgctcactgtgaaaacgtggaaaatataaagaagtataaagaagaaaatttgtgggaggctgaggcgggagaatcgctcgaacccaggaggcggaggttgaggtgagctgagattgcgccattgcactccagcctgggcaacaagagcgaaactccgtctcaaaaaaaaaaaaaaaaaaagaaaaagaagaagaaaatttaaaataataatctcatacccagaggtaatctctgctaatgtttttgttgttacatttcatatttttctataaacacacacaatattcacaaaattaggatcagagaacacatttttttctaacttaaaaaaactctatagtgcacttttcccccgactctgaagctattctttgaatattagattttcgatggctcttatatttacaactttttaccattataataacaccgtgataaacaatcttgtaaatataactttatctgtgcttattatgttaaataacattgaaagagaaaaattccctacccacattgggaaatttccagggagcagcattttctcatctgttctttttatggcaaattaattaactgttttatcagtatctgtcactgatcactcatctatttctgattacattgggtaaaaaggaatacttgagtcaaaattcacacagtaagttataatagtgtgttgtctcatataggggaagatggcattactgactcaaagtttacaagaggggaactctggagtgtttttggtgacaatctgatgccctcttacccagcagcatagtcctgaggtatggctaaccttctagatatggaatggtttcaaaactcagcataagcaggcaatctgagctccaaagtctgacctgggtgagctaacctacactaattattctgaaaggattctgtgtctctgttttataacaatcaacaatcatcatcataaataaattataatattatttaacatataataatataacatctcagtacttacaatgtgccaggaattgcattaaagctctcttccgagatctcactcaatcctcacaaccactctatgtagacagcacagcaccccacgctgttattattcccattagcagatggggacacaattaaagaacttgctgaacatcacactgagataaataatggaaccagtgccacatcagcccaacaccaaagtccagcatcttgaaatcaccagcctacactgactcgaaggttttcttccttttagtctcaatgtacaaatcagagggtgaatgaggcaggacttgggctgaatgcctgagttggaaggaactacagggatagctgggatgaattttccacactttacacatcagaaaaccatgcctctgaacttcttgtccaagcctcttgcccaaggtcacagagctgattagtggcaaaggtggaccagaactcagggaccttgactcccagtccagggcactgcctccatactctactgcctcccttactggtgtggttaggatctcaggtgctgtaagctcctgggggcagctcccccagagtagaagtagagtgggatcttgggactcacatgtatgtgtgatcgcagcccagctcagttgttgacttgcttcatgaccttgggtatgttctaaacaactatgggtatgtcacagtgatgatggggaaattaaaacaagaaaaagcatgtaatgtttactacacattcagccctcaatagtcagccatcttattatcatcattaattcaacatttgcaagaggaagagggaattctggggcctttcatcttagaagctcgacgaggagactcagtcatatttccaaccatttcaggctatggaaacttttgctttgtttttataacctgcaacttgcaccctttggtgtggtgcccaccataataaaaagaaaatattttttaagatcccaagtgatacctcacttactcatataaaatgtctgtatcatcctgccacacactgtactaatgaatcccccaatttaaaaaagacctcgccccccaaaaaacaccaaaaaaaggctgttcttaactcgtcagctcttctctctatgaaaagaatatgtgtgacataataaaaaatatatatatttggtctctgctcccagttcctgacatagggctcctaaaactctaggagcatgtttttttctaatatatggtcctaaatctcttggagtttcctagtgataggagtgtcttttgttctaatgaggtaacttttggtgggttcctggatagcttcaagacgagggctgggcaccagaaaaaccaaggcatgattacaagcttggaagtttaagccccacccaccatcctctagggaggggaaaggaactgaagactgactaaattaatcatgctgaggtgatgaagcctcaataaaaattcctcaactatggcgtacacagagcttctgggtgaatgaacacaaggaggtgctgggaaggtggtcacccagagagggtatggaacctccacacttccttccccacacgttgctctatgcacctcttcatctggctgttcatttgcatcctttatcataaactggtaaagtaagtaaagtgtttccctgagttctgtgagcccattagtgcaaatgatcgaacctcagaagacagtcatgaagacccccagtttgtagccaatttggtcagaaataccaaaggcccaggacttgtgattggtgtctgaagtgggagcaatcctgtggcactgagcccctacttaacccgtggtgtctgatgctagctccaggtggaaaatgtcagaattgtgttataagacgcccagttggtgtcaggagagacggagaatacattcttggtatggaaaaccccacacatttggtgtcagaagtgttgtgagtgtagaggaaaacagtttttttttctgttaatattcacatcccttccactgtggcattattatcacaccccatcaagatgtcagaacattctcagagttaaattctttcatgctaaaacattgctaagctatttatgtccattctttttttaaactgagatataattcacataccgtaacatttattttctaggctgggcacagtagctcacatctataattccagcactttgagaggctgaggtgggaggggcacctgagcccaggagtttgagactgcagtgagctatgattgcgccactgcactccagcctgggcaacagagtgagaccctgtctctctctctctctcttttttttttaactttctaaagtgtacagtttaaaatatacaatttgtgctcacttcagcagcatatatactaaaattggaatgatacaaagaagattagcatggcccctgcgcaaggatgacatatacatttgtgaagcattctgtattttttaaaaaacaagaacaaaaaaaaaagtgtacaattcatggtttttagtatattcacagagttgtgtaactatcaccataatcaatttcagaacatgtacatcacctcctaaaacatgtaaccctgtatatgttggccatcactccactcccccagtccctctcacccaggccctgacaaccactagtctaccttctgtccctaaggatttgcccatgctggacatttcatataatgggatcatagaatatgtgaccttttgtgtctggcttctttcacttagcataatgatttcaaggtttatcaatgttgtaatatgtataaatatttcatttctttttaataactgaataatattccattgtatgtatataccacattttgtttattcatcagttgatggacatttggtttgtttacattttttggctgttatgactaatgttgttacgagcatttggataaaatttttgtgtgaatgtatgttttcacttctcttgggtatataactagcagtggattgttggatcatatggtaactcctatgtttagcatctggaggacattccaattgtttcctacaggggttgtaccaatttaagttcccaacagcaatgcttagggcttcaatttccccacatccttgtcaacactagttttctttcttacttttttttcccccaattatctatcctagtgggtgaagtggtaccttatagttttaaataaatatatatatatatatgtatatatatatatttaaaatagagacaggggtcttgccacgttgactaggctgggcttgaactcctggcctcaagcaatctttccaccttggcctcctaaagtgttgagattacaggcgtgagtcaccatgcccgtcctgtactttatggttttgatgttaatattcctaacgactaatgatgttgtgcatcttttcacatgcttattggccatttgcacattttctttagagaaacatcgattcaagtcctttgcccatttttgaattgtgttgttgggttctctgttgttgaattttagttctctatatattctggctattaatctcttattatatatgtgatttgcaaatattttctcccattctgtaggttgccttttcactctgttgatagtgtcctttgatgcaggaaagtttttaattccaatttatctatttttttgtttgttacctgtacctttggtatatatccaagaaatcattgccagacccaatgtcgtgaagcttttcctctatattttctatgagttttatagttctaggtcttctgtgcaggtctttgattcattttgagttaacttttatacagggtggaaggtaagggtccaacttcattgtttggcatatggatatccagtttccccagcaccatttactggaaggcttgttccttccccattgaatggttttggcatctttgttgaaaattatttgaccatatatgttagggtttatttttgggctctgtgttctattccattggtctttatgtctgtctttatgcctgtatcacaacattttggttactatagctctgtagtaagttttgaaataagaaatctttaaaaaaattattttggctattctgggttccctattcatttctgcaaaaaagacaggttgaattctatagagattgtacttaatctacagattgctttgcaaagatattgccatttgaacaatgctaaatcttccatttcatgaatacaggatgtctttccattcgtttaggtctttaacaatttctttcaacagtatcttgcagttttcaatatataagtcttgcactttttttgttaaatttattcctaagtatttgcttcgttttcatactactataaatggatttttttcttgatttcatttttggattgttaatggctggtttgtagaaatacaacagatcttgtacactgcaaccttgctgaactcatttattaattctaatagtgttttagtggattccttaggattgtctatctttgagtagatcatctgataatagaaatagtcttacttcttcttttcctatctggatgccttttatttatttttgttgcctaactgccctggctagaactgacagtacatcttttttggttcttgatcttaggcggaaagtttttagtctttcatcagcatgtgtgatgtcagctgtgggttttgcatagatacactttatcaggttggggaagttcctttctattcctattttgttgagtgttttttttcataaaaagatgttggattttgtgaaatcctttttctatgtctgttgagatgcccatgtggttttcgtctattgttctattcatatgatatattgcattgattgattttcatgtttaactctacattcatttttatatgaatatattacatgtttaagtatggtctaactgagaagagctttgtacgagaccaacagacatttactgtcgttttgcaattctggctctaacttggacctgtattttggacaagaacagatggtaaactgcaatgtgactgtaaccatgacttcatatcataaacaatctgatatttttaaaaattatgtttgttttaaagaaagaaaatctatatatattttgaaagtaatgttgaacatgcaccttttattgttgtttgttattatcacattttcaacctttgatgatacgagtatcaattaaaatagctctatgacttaaaaacagtacatgatatttctgattttgaacatactattgcagaaataacctgtaccagactttgggtaggcaaagtcacttaagttaatgagaaaaacacatatggacttggaattttttcccctataaaaggaagcagtaataatgatactgataaaatcacttgctaacatttacagaatgtgctgcttagctatctaagcatattacttgaaaaattttatttaggtatcttattcagttctatcagcaactccgtggctgacgtacaattagcattccattttatagatgaggaaactcagagatgttaagtaacttgtccaaatattcacaggtagttaactaatgaggacagaattctgaatcacatgcaggtgactccaaagcccaggcttttaaccatttgttgtagtttgggtaccagagtttaatttatgagggaactcataattgttcattttcccttttcaactgaaatgggaccaaaacctagaaggtcatagatttgcagcgttccacttgttgaccaaatgctattacacatttagtactcattgtatacttactatgtggattccacctatgcgatgtatctaatctagcaataaacaaggtcgtataggaactgttttatatttaactatgcagttaataattttttaagctacgtttgacgatttaagtagaaaatctttattgacaaagtcaaacccacttctgctgtccaggagctctttagtttaattaagtcctatttgtctgtttttgtttctgttgcatttggtttgaggacttagtcataaattttttgcctaggccaacatccagagagtttttcctaggttttcttctaggacttttatagtttgaggtcttacatttaagtctttaatccatcttgagttaatttctgtatatggtgagaggtagggggtccagttccattcttctttatatggctagccagtcaaacccacttctaataggaaaaaaatgactatgccaaagtgtctagtgattcattttgggatattatcactgggtgcattaaaatcaccatagagttgttttgtggagggggcttgggaaactacaactttaagcccaaccccaaggaccttctttgagtcttggctcaggacactaccttactgtggctttcttcttaactctccagccatggtgctcatttctggcccccttgcagcctttcagcctgaacttacagttctcagtcctttgcacacccctctctcatcctaagaaagctcacctcaagctgtaaccatcgcagttaagcagatggcttataaatgtgtgactctggttttgacctctcaccccgataaaatcctaatgcttctgttggcagtctatttgaatgtcccagcatctcaaagtcaagatatccaaactggatctaacttttcacgttctttttatagcacaaccttcatttccccaggaccaaaatcttggaggtatttgttattctttcatgtcttgggctaagtttgcgtccatttgcccaccagttgtcttgagaattgttcccttcatgtatattctcattgctttcccttgacttccacccaagtgaatatttgcaacaagctcctgattgtcctatgctgtgaaagaccaaggggagtccttatggaacccactacaggccaaagtctagaggattagatgggctatttggccttgtgagagatgatttccatgatggcagtgggaggtgggaggatggaggccagcccaatgagacatgtaaagaaaatgcacatgagttatacaggtctgggggagacctcaaatttccttcctgaggtcagtttctttctgatttggtataaaacaggacatggaagaacagctgctggcctctctctggagagactgagcagtacagacgaaggaggtgttggcccccacagctgaccatggacagctcagactgccagaacctggtatctgtgaacccccatgcccactagactgctgccagctctcactgtgcaaatcagggctgcaggcctgagagtcctgggcaccttcactcactgcagatgcttcctccaaccagaggcctccccagggcttcatatcatataaaggagagtgctcagaggcatgggctctgaagtgggatgtactcaagttcaaatccttgcttagatactccctagatgcttaaccctctaattaatcactcagaacagcaggccatctggtcaacctcctgtgaactcccagctagaaggactgcaaaacaccatggaagataggagatgatacagcagaatatcaatttccctaaactcttcacagataagatagcagaaatgaatttccctaaactcctcaaaggtaaagtatcctatgtggctggaacaaatactttggtgtgcctctgagtggaagtggattgggatcactacatcttcttcaaacagcctgctaaaataattgaacctactaagcctaaccacagggccttgggcttatagactgaggcaggaaagtttggggttcagaacaacaaagggtctgaagtcaccagctatcttctctctccttagtctccttcttaaataattgaaatttgtaggggcatcaacttagcctctaagtcacagttttcccatctttgaaatgaggattataattctaccttgccaggttgttttgagaagtacagaagacatgcatacaacactcagcacagcggcggggccgtagtggaaggcccgcatgtttccatatgacctccacggaggttgtcatatacatcgggagtgtgttaacatctacttgtttataagcacatgaaagttagcaacatgggtaaataggtcatttatacacataagacacatggctcattcactccattggagtcctaattacttactggccagttatttctttcagggcaatttcctttctgtctacagttacagatataaatataaaaaatacaagaagatactactttgagacagatggtgaatcatatctaattactctgtaatcccttcacctgaagggacccgactgcccagcccctgctgtctctgaaggaagaatcatcaaccagaacttccttctggtcaatctgagtgggttttatcattgttgaatatggactctgggcgccaaagagaatcaaacactttctctatggaagggaattgggagattttaaagttgaccttgaaactgaatgagaccaagagactcaaagacagaaggcagaggagaaaagattaaggttgtatagccagaactagaacccaggtttttatctgggaattttattttaaaaaatgcagtttctgacccaaagtctcaggtgaggcttgagattctgatggttctgggaccacacttttagttgcaagagggttgatgttggtaaaacacttagaacagtttatgacatgtagtgcctgattcaataaaaggcagttattattgctgttgtttttattacttgcagcaactgagctgcacgtagctctcagaaattgagaaatggcatttgggttagaagtcagttttctgtgaacttgattggctcagatcagtcaaggctcaaagactgattcaagtagcctctgtgaactgaccacaccaagcttttgaagccaccttctgggctgctctggctatgccgactgtgccaagagcactcaaatgcactgactgaggagtttagcagcatggaaccccttggcacacgggggtagatttcttacaatggtgctgtgtcatagtaaaaatgcctccattcttaactgactctaattttcattacatttcatttttctcccagtgatgctaaatcttcaagactagtccctttactgtaaccagtgtcaaggtagagtggaatgaacagggccaaggggattaaagatccggggtgctgtgtgagaggtgagaaagttctggaatagccatggcagccaactcttctcagacaactagtttaatctctccaagtccagacattcaaggcagaagcaaggaagagaataagcactggaggtcctacaagtggaatccattggcaaggctgatctgtgacccacttttgataaatgaggtatgacgtctacgctttgctgaacatatctgtttctgtgtttctgtgtgtctgtatagcctttccttccttttccctttccttccacttcctatagtccctttttctaccctctctttcttccatcctttctctctttttcttggaaaggaaaattttgcattaaaaaattccaactttctcatggttgagctagagaaggagaaaaaggatttatttgcccgtgcatgatccaactgaactagggaggaagaccagagagaccttctagggcaggtgagaactgattgtggccgatacaccttggaagagtgataagggccaggtgtgaatggaagaaatgaaccttgaaagcaagagctggcagtagctgctgtcctggatgcctatcttcccaagatttgccctgacctagggcccaatgcacctgcaaaccaggacatccattccagctccatttctcaaggccccctgtatgttccctgctcctgccaaacatgaaccctccagcccccatcctgagacatatcctgcatctaagcctttgttcttgccatttctgagtgccttcttcgctccatctccactttttttggacagtgttctaatcactttatattcattaatttactttttaacccattataatgacctgaggcaagtgtctgcattgtcctattttacaggtaagatgatgaaacttagaagagaagagttaagtaacttgccccagatcatgcagtttctatatggttgatctgggacttaggtctatctgtcatcaaactccacattcttaatcaccaatttttgccttttgtgtatcatgctgcaatgtaaacactggttcatgtctgtctctttgttaatctaaatcatactcctagaattaagaacagtgctttatttcattgttttcatccctagctagaacaggggtggcaggcattctgcaaatgtttcctatattgtgctacattctattatatttcctacaggtagactagaggcagggtaagagctccatgatagttcagatcacacttctgtgagctatggatttgtgaccatctagggcttggttcttagctgctctgtgctttggtttcccatctctatgcccatctccatctttaacagattgtgaatatcagggaactagggtattgtttcattcttcttcaatccagccccctccgctgtcacaatatagtgcctagcatagcatctagtccacggcaggcactcaattgactatttactggatgaatgaacattcataattctctaatctgcctccccttctttctttcttcctttctctcctctctctttctctctttctctctctctctctttctctctctttctttctttcaaggcaaggtctccctctgttgcctaggctggagtgcagtggcgccatcttggctcactgcaacctccatctcctgggttcaagtgattctcctgcctcagcctcccgagtagctgggattacaggtgcctaccaccatacctggctgatttttgtagttttagtagagacagagtttccccatgttggccaggctagtctcgcactcctgacctcaggtgatctgcgtgcctcggcctcccaaagtgctggtattacaggcataagccaccatgcccggccctgcctcctcaacttgaaaaaaaaactgggattaaaagagtgaaaatgatgccacttaactgttgggggagagagacacagcgtttctctacattatgcgtgtagaaaactagatcgtgaggctggaaagagtgacaaaggatattgaaaatagaaataaggttgggaacttaccaagaccctgtccatggaaaatgtgaatgctacctggaacctttccagcccagttcctgaatcttttgtaacaaaaggtctaacgggctttactataccattagcagggaaaatatagtatggtacacattacaggttcaaaacacaatccatttgtggatttgccactgaggcattaagacatttgagaaaagaacaaaggaaagcacagataaagccccatcttgagctaggcagccgaaagaagacattaacccactcgaagacccttgaggcctccagcctttccccttggataactctgaaaggcgtccagtgagttccaatttgggcaggggtttgtttattctgcttggttcaagtcagggctacggatccctaatggttttcatgtccctaaaggtttttcacatttggtcaagacctatgctttatgtaagcctggagaaggccttgctcccagctgctctggctgtgccgactgcactgagagcactcaaatgcactaactcaggggaggagtttagcagcacggaccccttggcacgaggcgggagattttttacaatggtgctgtgtcatagtaaaaattcctccattcttaactgactctaatttttattgcatttcatttttctcccggtgatgctaaattttcaagactagtccttttactgtaaccagtgtctcatgccaatgaaaactaagtgggcccatgctggcttctggccctctattttcagtgcacccaattcctaatccagggaaaagcattcaggtttgtaagtgccactctccttcctatagagggtgcctccaggctattggtcctaatgtgccactattcaaaattcaacctgcttaagggtctgcaatggctctctaatgctttaggttcaaattttcacctcattctccaaactgtaaccacagctaccaaatggaccttacctctcactatgtccactgcatcatttcttcattgtctcacagttgctgcacacattctcaccctggcactatctcacttgctttccctgcttggaacgcttcctgtatctcccaggaagaacccaaccagaaggttgttcacagatgacctgtctgtatttacagcccttctcctttttgtcccaactcccagttcagcctcctaaatccttgaactgaagtgccccaaagcttgtgtgaatctcagaatacaactccagggtccaaaatggagatgcctgcaggaccaagcaggtaaaggaaatgaggctagagctgaacaggacaccacctggaggtggggccaggtgtgtggtaaagagctggtgtgtctcatcttgtgggggttagtatggatcactgtcagcccacgggccaagggagaatagtggcccagggttgccagagaagccagaacattttaatgcaagattcccaatttttaaagtactgcaacggtcaaagaaaaacacacgtggcttggatttggcccatgaagaaggaatttgtgttcctgcagtataagtaaaacactgctacaactcatagtcatcagtgagtatggcatggggtagggggagcattaacagtccacctgggcctggagggaacaggtttttaattcccctttgtagtctacaccacaagcttccttctaagtccaacgtcttgaaatacagttcccaggaagtagagagagctgggttagtagccattactccttttcccaactcctcgaaacaattaaagagcatttcaactaacaccatctcagtctttatttcagaatagtcatttattttcaagttcaatatccatgaccatttcaaatgtaaatattttaatttggggtacaatgagggctggaaggggtggtgcccatgggggcatccctactttattttgatgagaatcatccttttgaaatgtaagtcttattgtgtcactacttctgcttaaaaccctctgatggcttcccattgcttctacagcccttaacaagagcctatgttatctggcagtttgttttgcctctctctgttttgcctctctctatttttcataggcaaaaatatgaggcttaaattaggtaacactttaaaaacacttgtcacagtgcccagctcacagtgagtgcccaatacctgttagtgcttgttattccgacttctccagactttattggcataagaaaccctccagctcaccactctccgcccagacttcaaacttggcatactccctgctgccactgggcctttgcacatatgattgcttctgcccagacactctttcagcccctcttctctagttaccattgatttgaccacttctctgcctgtgtccaatcaatggcttcttttgcagagtgaaatgtgttttacttggcccatcagctaacaggagctgcttcttttcccatttgattgactgtgttatgaacatgtaaccatcagtgggaagactcccactaccctcataggtgtctatatcaaagaatggaaggatatcatttccacagacatcctcaaaatcactggaggtctctagggcaagggggcagcaggtatgtgggaaaatgatcaattctgtagtcaaatgaacctccattcaaatctaagatttagtgttatactccatgtatgcacacacacacacagagacacacacacacactggtataagtcagtacacgggatccctgagtgggagataatactggagtgtttcctagtagttaagaacatggctttgggaatcagagaggcttaggatcaaatactggctttgctcctacaagctggtcaaccctagttaaggattttgggtctagacttggtagtgtatcagcctagatcttgtgagttgctagggtctctgaaacttgttatactctctcttaccctccatgttcccagatcatccacaacaacatctatttgaaatggattttagatgagtctgcttattgatgccaaaatgtgtctctgagtataaacaggggcaaaatacccgctactgtcacacagggtgtttctggtgactgtaaaattcaaaggtagatccttagtggtgtttgagcatacatttgttcaaggaatcacttgtgacattaacattatagaaaatatttttttaagtttgttgtcacaatgaaatatgaagttaaaaagacaaaataccaaatatatatttccagttgacaaaacttgttagactttcctgatgatagtataatatctgtaattagaattcaattaccaaaatctaaacaccgttaaaaatatctttttgttactttaactgtaataatttattcactatttcttggtttgaagactcaattccagtagaagtttaaattatgactcagactatggtgagatattctcttttttatcctcttaagtatttgctactgacccacatgttattataaacagattataagcattttattatgttctataaatgttcccaagagcaagaattttcatagctcattaaaatgaggcttactctttaaaaacaataaacaatttagaaacactcaaaagtagaagtgtcatgtattgaaaaaaatcctttaattttattgtaatgagtaagtcatcttcattaaaatatacaaattttaactggaacactaaattttgtcccagtcatagatttttagacaaggctcccaataccaggagtaaatgcttagcatctttctactctggagggaataaaatagagatgatatcagcagagaattaagtaaaaacaacagaagtttcataatatgggtcagggcttgttttccctggttaaatacctgtttagatttcttcaggtacttaaatggttgtagaaacctcagatgtcaatgaagatggtatagggacttccctctggggccctatatcctgtgcttatttcaattataacatttatactatcttaaaatttgcacgtttatttgtccatttcctccatttgtgggtaaatccctcgaaagtaaagactgtattttgtttgctgttatatccttggcacatagtagatgttcaacaaatattggtcaaatgattgaattaatcagtggcctaatgcatgggaactaaggaaaatctcgctaaaggagttacacaggtgtggcctccagccactagatacctccccttaggtgtcccaggagttgctagtgctctaggcccacagctagggaaacctggagggtacttgtcttttcttgtacatctacaactgagctaacagcagagtctttgaattaagaacagtggaatgctggcatttcaagatggtggtggcaatcctcattactaccatcatcatcaccatcatcagccccagcatgaccatcatcatcataagattggttgaacatacattaggtaccagatactatgccaagctgtttttatttttaatttttaaagtttttgtagagagagagtctcgctccatcacctaggcggacagagtgcagtggcaggatcatagcgcactgcagcttcaaattcctgggctacagtgattctacagcctcagccttctgaataggtgggaccacaggcacacaccaccacatctggctggcttttttttttttttttttgagacagcatcacgccatgttgcctacactcgtcttgaactcctggcctaacgtgatcttcttggctttgcctcccagagtacagagattacaggcatgagccacctggcctaagttctttatatacattgtcacacttattcctcaaaacaactctccgaagttgttgcttttattcccattttgtagatgcagaaactaaagcctagaggtacaatcacctgaataggatgacccaatgttgaagtcaaggctcaaatccaaaacacaatgaggctcacatttaaaggcctttcttggaggtaaccacttctgcagagtctgcagctattctctggcatttttaagaactattgttttacttaaatattcagtaagttttggagggaagttttggaatctaatggttgtttttttggatgcagtgtttcaaataactattttgcaaataaatttctgcaatatggtccattctgagtctctgtaattaggacttgacatttttataaccagctcagatatgtaaacccaaagtgtctgtctggtgttgctatcctcaccagtcatctttctgactgcattgattaggatttaaccaactttcaattacccgatcttccttctttccttcccctccctccctcccttccttctctccctcccttccttctttctttcctccctccctccctttcttctttccttccttctttctttcctccttctgccttcctttctccttccctttgccttcccttagccttcccttcaccttcccttagccttcccttcaccttcccttagccttcccttcaccttcccttagccttcccttcaccttcccttcgccttcccttcaccttcccttctccttctcctccctctccctctccctctctctctttttggtgtcaaaactttatggagaattaggccataatttgttcctttcataagctagtttcttggagcaaaattagggcacataagagaattaaatggaatcagtctcccagctcaaaatgggtgtattcacacctaggaatggagtgctatgttcaggtcacacctggtgacggagtcacattccttggtcacaactggtatggagtcatattcttaggttacacccaggtgtagtgtcacactcctggatgatacttgaccacctgtggtcctaaaacaggtttttgtcctgtgcctaccaagcttcctggccctatgacctactcataccacctttaatgtagcagcctagcactttatgaattctctttaggtggtaagggctccttcagtagacctgaaacctaatattacattttctctggaatgagaaatattatcttacaagttgaagacttccagatgtgatcttctccattcttaggtgccatagcactaggccacagtgggcagctaatgaatactttttagttgattaactggtagagaaacacacccaatattacattaaagcatacttttaaataccaagaaaataatttcaaggtcacaatactaacaagtcaggatatttctttaaataaacaaatcttggaattagagctatgcacatgccttccttgcctagtaggcatgtaaagggtaatcgttttgattttgaggaagtcaactaagccagcctttacaaactaaagtatttacgagttataatcatgtagttcaaatgtgtatgtgtattcctactataacttcttgttttttattcaaagctattaactttagagaaagatacaaatagaatatacaagcttattgtagtgaaagaaaataagttgaaaacttgatgggagtctcactgtgttgcccaggagggagtacagtggtgtgttctcggctcactgcaacctcctcctcctgggttcaagcagttctcatgcctcagcctcctaagtagctgggactgcaggtgtatgccaccacgcctggttaactttttttttttttttgtattttcagtagtaacaggtttcatcatgttagccaggctggtctcaaacttctgacctcaagtgatgtgctcgcctcgacctctcaaagtgctggtagacttttctatctgaaataaaatattccctcttttcaaacaaaaatattgtatctgtaaggtatttttgttttcatatcaatattctatttatagctgacatgtgataaataactttaatatagctaaatatagtctacagacacacataccacacactcagactggttaaaaatgaacagtttagtttttttttctaatacataatgtattattatttttaaaaatagaaatgtaccattttattacaaagtctcacaaaaagaaaatagtatccaaaaaaggaaactagactaccaatctgcacctgcagaattggaggaacacagagggcaggcagtgtgagcttcctggcttacttgaggacaatggggaggtatgagaacagaaccaatctaaaacatctaatattaccttaggaacctggaaagaacagaggatccttggagatccagccaccccttctagaatgctaataaggacacctttccaaaactactatatggctacctacaagtatccctcccacccagccctggctccctttatggttcaaagttaagaactggggaggaaaggggggcaaggcagctcctggaagagctcacccagcacagctgccctggactcaggaccctggtttctgtctttcactctagtccccaagatatttatgtttagtaaataaaaatttactaatagtctagagaaatagaaaatataaaatctaagttgttaggggacccagcaagaagccagagctggaaaggcctgctcagccaacttgacctccttctggacccctttggcctctggcttctccttggtcttctctgctgtgacttcttctcttctgggtctttctctctttcatcctgtttagacccacttggcttttttgaagttggaagaattcttgcagccaccctttccctcttcatcagagtcggagaattcatcctcacaggcaatttgttgtttatttttttgttttttgagatggagtctcgctctgtcacccaggctggagtgcagtggcccaatctcagctcactgcaatctctgcctcctgggttcaagtgattctcctgcctcagcctcctgagtagctgggattacaggcacgtgccactatgcccagctaacttttgttatttttagtagagatgtggtttcaccatgttggccaggttggcctcgaactcctgacctcaggtgatccacctgccttggcctcccaaagtgctgggattacatgcatgagccacgatgcccggcctcacaggcagtttgtttgtcagaggaacagatggagatgcacttgtcagggtcttcgtccttgttgtcactctcctctaggttacatcctcagcaagagcccacatttgggccctaggtgtgtggggcagcattctcaggttcccagacagttgctgtttgatcttttccaggcatcattagtgatctggttagttatattggaaagactgatatgaagcttgaaatctggtccaaagtatttgaagtagtcattatatgggagctcattatggatctctgtgtccagggccacagctgtttcctatgtccagcagcaggtgacattgcgaatgatgtaacacctcctcctagcatcagcatcagcaagatgaagctcataacaaattccacacacttgacatgccctttgatgttcagattgaagcaacctaactgatccccagatggagtctgagtcacactgtatgaccacagcactaggctggaacatctccattactacggacatatctggcttgaaaatggcctcacaggattcattatcaatcccatctcagagtgggtggttaatagcataatacttgccttttccagccccaatatcccataggtccccagttcctgggaagtactctcctcatttatgaaaggacacagtcatgacccagtctgtggcatagaaggcctcttccatgccatcaccgtggcatggaaggtcaatacgcacaatatgcactgtggaatatcaaggtcaatatgcagcaccccctggtgattctctagcaggtccaggagggccaagactgtatcattgacttagcagaagccagatgcctcagacttctttgcatggtgcagtctggttcatggtgatgtctgtctgccactcattaagtttcacagaacttgccacagagccgcccacagacaactgacgaaactcaaagaggccatgaaatactggacagtcctcaccaatgttgaatctctgtgcctgctggctgtactcagacatgttatcaggatgaatggagtgcaaggatttaatgtagtcatcactgtggtacttggtcatctcctcagcactggctttgtgagggcaatagattttcatttttcagtggagactgtagttgagcagcaaattatgaatcatgcagaattggtaaagcttcattgggtggctttgtccaacattctcatcatggtagtaacagactttcctcctggcaccctgtgtctgcactatcttgctggcctccatctgtcagaaagatggcagatgtcttgctggcctcagcaggtccatcttccctccactctattacacaatttaaatatgaataactatgttttgtctcggttatatgtaacacttaatcctttaatttatgtgctttactcagcaacaatttgagaaggaaaaattgagtttaacacactcaatttattatgttggctggtacaatatgcacatttgaaaacacttagctgccttatatgaaaaatcctcttgtcatcactttatttttctaattttgccatttttagtacttcacattaccatcagttatctcaattttttctctcccttttaactttatcttgtttttataattttcagtaggtaaaacattaaaagaaaagaaaaagcaggtgatagctttgaaaatttcttcctaattatcgaagtcaataattcttttgactgccactgctataaggtgttagtcctgagattctaacaagattaatggggagagggaaaagggcacagggacaggaagtggaaggatctttttttttgagatggagtcttgctctgtcgcccaggctggagtgcagtggcgtgatcttggctcactgcaagctctgcctcccgggttcacgccattctcctgcctcagcctcccgagtagctgggactacaggcacccaccaccatacccggctaatttttttgtatttttagtagacacggggtttcaccatgttagccaggatggtcttgatctcctgacctcatgatctgcccgcctcggcctaccaaagtgctgggattacaggcgtgagccaccacgcccggccagaaggatcttaatgtatcaaactagtggaggttcctgactgaaaggtaaaggcgctctatttttccactttgagacagcacacacttatgataagggcatatccttgtggatcaatgcttcacataagaaagtgtctctggttatttggcaaaccttcagctttataggcagatgacctttggtggcactgaaggcagaaaagcaggcatgtttgtgttctgattattggccttctgtatcaatccataaagccccaaggctgcagaattctggacaatcaagcctcgagttaccagttcttgacttgtgaataacgatcaacttgttggacatttccttctattttcgcctagtacaggtgaccacgacccccatctcataatcataaccacttccagaagaggagcgtttcggttctttcttacatcctaatagactagggagggggatgaaagacctgcaaaacatgccctttttcccaattatttcttcttatgataaaatacatacaacataaaatttactatctcaacatttttaagtgtacaattcagtggtattaagtaaattcatattgctgtgcaactatcaccaccagtaagctccagaactcttcatctggcaaaacagaaactctatagcccgtaaacactaactccccattcccattgcccttcctcatccccggtaaccacctttctacttaaggtctctatgattttgactaccctaagtacttcatataagggaaatcatacagcatttgtttttccctgttcctttttctctacctttaccaactccgtttaattcacttcaaacatgttttctcttatggaagaggttattcttttgaacttattcctttttctttatctctggggaaaaatttaaatcttgtgctacctccttccatccttcttcataccatttataaacatctcgttaaaaaacattaggaaaaaattactggggcaattttctgactccttcatataggtacaagttttgaagtgtaattagccataacaaaaagctacagctgccaacatctaaaatctcagaaatggctaaaactccttttcgaaatctctgaaaagtttaactctttactcatctttaataaaattattgcccctcaacaagaaatgtcttctaactcacttctattgctttttctttgaggctaatgctcagtattccaacaatagtgttttcctctttatttcgtgggaaatgtgcagatcacaactgtgttatgggttacagaggtttttgaggactagagtctgtgaaccaaatcacaacatttaatactgcttatccaggaaagtgttctaagttctatatcgctcctgggaaatgaacttgtagaatataacccatttataaactgaagactaagagtgtattatatattccccaatagctaaaagctgttggccaaatctatgccacaggacacatactaaagaagaaaaaaaagctcacaaccacatcacagcagctgcatgtactcctgatcctctggcagagtacatggccatcagagttcaagacccactaaccaatatgctgatcctacagattctgtaaacactctttgactttgaagacccatctttttttttaacttaatttttttaagttgacaaatacaaattatatatatttgtaatgtacaacatgatgttttgtaatatgtatacattgtagaatggttcaactgagctaactaacatatgctttacctcacatacttatcatttttggtggtgagaaacccatctggttttctaatgcattttcttccactgcatgttaaaggaatatgtttaactgaggcacgtaaagactttgaaaaccaaatgggagaggatgctgaaattgaaaaatgtttccaagatagtaagtcagaactacagaaataagcttggagcagaaggcaaccagctaattgtattattcagcaggagtttctagagggttctcagaaatcaccaaagagcttcaaagcaaaaagttaaagaaacttccaactcttgcataaaacgccaatttaaagataacacattagctgacagtctggtgagtgtcagagctagaaatattgatctatgaggttctatttcgaacagggaagtgcaaatacaattgaagtcaaattatgatcagggccatagatgcacacaccagcagcttccttatttctctccacagacctgtggaagactagaggcgtgcctgccttggttgggcagcctagagatccgtttcttcctacacactactgagcacaaaatgagttaataaaaactgtatacatttgtcatgtaaaacatgatgttttgaaatatgtataccttgtggaatggttcagttgagctaactaacatatgctttacatacttatcattgtttgtggtgagaaacccatctgggtttttaatccattttattccactgattgttaaagaaatatgtttaactgaggcacataaaaactttaaggccatgtgcagtggctcacacctgtaattccagcattttgagaggccaagatgggcggatcacctgaggtcaggagttcgagaccagcctggccaacatggcaaaaccccgtctctactaaaaatacaaaaattagccagacgaggtggcgtgtgcctgtggtcccagctactcgggaggctgaggcatgagaaacttgaacttgggaggcagaggctgcagtgagccaagatcatgccactgcactccggcctgggtgacagagtaagactgcatctcaaaaagaaaaaaaaaaaaaaagactttgaaaaccaaatgggaggggtttagtctacacatgttgattaactcatgggataaggccctggcataccatcacaagcattaaaacaatgccaattccacatgccaatctcagcccaacttcctgggaagagtatgatgaagaatgcaggcttggtactctctaggtgccacatcagaggggagaaaccttgagtcttgtgtgtagggaaaacagcttaccacctagagactataaattccatgagggcaggaattatgttttgttccttttccagcacctaacacctaataggggctcaaaaaatgtgttgaatggctgaaaaacatgaagccattagtgttcccacaccttctgttattcttcattcatttataaccaatcccctgaagttcgggcaactccagaaaacaaaccaacttggcacccaacatagtacacaaggaggttacagtattcctcttaggcctgtctaggggtgtgtgtgtgggtaggaatggagaaggctgaggatcaaggaggaaggtcattggcctgctggccttgggtctcaggacctgctatggagggacaatagctgctgtcagattgagttctggcaacccccaggcagtggaatgctgctttgcatggtccctgtctggttggcagcttcctgccagggaaggctgccaagcagcttgtgacagctatgcagtgtacaagtttctgaggttgtttggtgcactgccatttctgacctgcctgtctgctgctcatgggaagtagctgggaagttcatatgccaagggaccccacactccattggctttcatctttcagtgggatgcctgcctatcttgtcctttaagatgggagtagctggaagatggcctttggcttttctggtcaatagacacctattaattctatgtatgaaggagatctatatttcactctgctcccaaccacagtgggttttcaatatgactgcttgactatatttgtttcctagcatcttgtcatagtaattgacatttgtcataaactaccactaggagaaactacctgcctgaatcatttaaaaaaaaattaaagatagcgttttaaccatttacttcatttgaaaaaaagtttcaaaaatcttttttttttttttttttttgagatggagtctcactctgttgcctaggctagagtgcagtggcgtgagctcggctcactgcaagctccacctctcaggttcacaccattctcctgcctcagcctcccgagtaactgggacaacaggcgcccgccaccaccctcagctaactttttgtatttttagtagagatggtgttccaccgtgttggccaggatggtctcgatctcctgaccttgtgatccgcccgccttggcctcccaaagtgctgggattacaggtgtgagccaccgcacccggcctcaaaatcttaatgattactatttggaatgttgacaccttaggggattttaataagggaccacctttttatattctcttaaagaagcgacttttacttaaagttgctgaaaagtgaacttaattttccatcaggagatacataaatcttaacttagatccttctctgtagtcaaagatagaaagttaaaagtgaaatttcaggcattacctttcagcatcattcgtccagtggatcctccaaaagtactgagaaggccacttcttgctcccaaagacgtggttgcttctaggagagaaccggtgatgtactgcgatattgaagtcctttggagggtggcgcgatactcacatacagtgtctcggacacattgctttaagcatggaccaacgcttatccttccatgggctgtctcggaggctgggagcttggtgaggaaatggagtagagatccaactgtattttctgtttcttctcttctcactgcattgtagatctgtgaatagcacaaagtacaggaagtattaatctagtttcttaggaaagcaaattaacttgttgacaaaatgccaagatgacttattaagaaagaaggctcagatgctccaagtgcaaacactctgagcactcggctcatgcattaacctgaacattctacagacaccatctatttggaaaagctctgtgtagttataaaataggtcattcaaacaactctgctatcaaacagagaacttacaagtcataccaaccagaaatacattcagctcaaatttctcctcctcagcagagcaaagctcttctgcagagagatgaaggcaaacctttccttctggttttcctggacattactgaatgactgtcccaggtctgtctccctccatggagtgtttcagcctgacttttatgggaaatcttttctccatgcttaaactgaaatgaggatgagagggtcatggggaaagagaacttccctatttcccctttgggcataatccttcaaactgtcagctgagatcaaagtatttgaatcattttttctcttcctcctccctcacctcccatatccaataagttgacagatcctgctcactcttcttgccccatctatgtcactgtcactatcctgatttcttctccttttatcacccgaattcaccaagcattgtctcaagaagattgcactgttaggacaggttcctaaccatgtctccaatctatttcaatgcagtcattcaatgtgcatgtatatagaccctgctctgtgcaaggcagtgtgttggaagatgtggggaaagtgtgaggggcagcagacacctcttgtgctgctgcaggatttcacaatcttcgatgaggcctgaaaattataaggtttgacattattgaagggaggacttggaatttgtcaagcattctgagaagccagagacttctggatagtgtataaacaaacggaggagacacataacatgcagtgaggtaatccagctctctgatgggggaataaaggtgctgtctctatcatgctgtctctatcatgtcaccttgagcaccttgccttggctgacttgtcattcattcatcaaaccaacaaatagttactgtttatataccagaaactatgacagggctggataaataaaatagtttctctcctcagagttcacagtctagtaaaggagacagaaaagccaagagcttagagtagggtggaaatgaaggtcacctccttcggtgacactgacgaatggccagggagtagaagactctcactgccctgcgggccaggcatgtgcccccatgatgttgcatcctccaaatctcactcaagagggcctctcttgagctgtgctaggtccttatgataccccagaatgcaccgagtcctatgatattcaaactgtgtagaccctaactagattttatctgtcttcctctgtctggtggtatatatttgccacttgaaggcacagtgtgattcttacctttaattctctgtcattaaatttctagtggccagcatggccatggagatggtgtgctgggacagaaagagcccaggtttggggtcaggtacatgaggtcaggtacacctgactcgaccttcaccagatagagagctggtcattaagtgtgaacaagctgacttgaatgtttcaagacagctccctcctctgtaaaatgggaataataacactattcttagggagattctgggattcaccatgataaacatgtaacatactcagcctagtgtctagaaatgatgctctttactgttgagcaagtctataaaagagaatacactcctttaccctcaatgaataataggtggttgtataactatagaccacaatctatgaaatgcaatgtgattggagttatgcccttgctcttctgtgtttctgggcaatattatcctaaccctatttgggtgtactgtgagggcaaatgggggtagagagctgcagatctcaagacatagttttattctcttggctccaaatcatacaggccatctccaacacactaagtcccatgcaagtccttcagaagtaactgatccagttgtgtaaggaaaagaactgactggtagcttgatggctaaggaaggcttaataggcaaagcagggtttgacctgtgccttggaaagcaggcatttctctaactggagcagctggggagacaactcaccatgcaagcaataaggacagccagtggagtttagagcagggagtaagcataggaaataactggggaatgagaaaggccagggaacaactggggaataagaaaggtcagctggcctgataaaggagacctggaatgttaaagcaaggagatttcacccatcagaggagggcaccccttgatgcttttttttgttttttgtttgttttgtttttgtttttgttttcgctggtttgttttcagcaaaggaataatgctaaaatggttttgtcttaaaaagattactaagctggcaattcctagttcctaataggttggcctactttctttacttgccaagctgctgcgctggctcattgtgcatttgctcactaccatgtgcattccagtctccacatcaggcctccatagactcccagtgactcattcagtctcttatccagcttttccaaggtgttttcctcaaaacattctatctacaagggattgtatgacctaaggactccttgatcatgaaagtttaaaaaatctcagtaaatctcttctccttttggagatttacattgcataatagaatattaaagacaattacgagagtcagagtaaacaaagtattttaatttgcttaactatttcccatgttatttgatcatttctttaaagaacacagcctgtagacgtagtgctgtgccaaataattaatttactttaatctaatagccttttcttattcccatttctttgccctctgcagaatctctgaaataggcaatcatccatccttcttgaagtctttcatctcttgtcatctcattgttccatctccgccttattctgcatctccccttccacctcgggccttcaggacagttataatgcaatagaaaggtgccaacaagtgcctaatgtagggaggtcacaaatcaattgaccatgggccagattcagtcaacagacctgtttcatctgacataccctgtttaaattcaggaaagctttacatatacatctgaagttccagcatctcctgaataatgaaacaatctggtaacactgagcattcctacatggtatcaaatggctagatcttctactgttagatggggcatgagttctccactggatgccagtgcccaccattctttagtgaccacacctggccaatatctggtcaccattagtatatgtgtttttgaccctgtcttaataaaatacagatacggatgtagatatttacaacatgtactgagctcctccaatgtgtcctctgtgtgctcttgcctgtgctagttgctgaggatagagagaaagccatagtctctgatatcaaaaggtattgcaaatcacctccaagaaactattaataaacatatataaatgctatgtatatattaagtaatatttcaacatcgttatcagccacatttccaagcccccaaacttgtctgaagaaataaaagatgaagtgctctgtgaatgaagctctgaacttccatcacgattgccaataccctcaccacaaagaaccagaaagagatcaaaaattactaccaagatctggaatgatgcatcccagtcacaccaatccaggatgagagaaactcaaggtgctttgttggaaaaatgctgaagtgtggacaaactggtggtagatatggcaatgttcagggaacctgtcaaaatcaaggtattgatcaggcacagtggctcacacctgtaatcccagcactttgggaggcagaagtgggtggatcacaaggtcagaagatcaagaccagcctgaccaacacggtaaaaccccgtctctactaaaaatacaaaaatgagttgggtgtggtggcacatgcctgtaatcccagctactcgggaggctgaggcacgagaatcacttgaacccaggaggcgaaggttgcagtaagctgagattgcaccactgcactccagcctggtgacagagtgagactcagtctcaaaaaaaaaaaaaaaaaaagtcaaggtattatctcttcctagatcactcacttatgaaaaagaaggaatcatggaaaagcccacatgtagagtgtgaagaagagacagtagagaacggtcattacaagtatggctctggagcattggtttgaattccagctcccatgcttcccagctgtgtgaccttggataagttgctttgccattctgtgcctcagtttccttttcgccaatataggatataatagtatctgcctcataaggttgtggctagaattacaagctttgataaatgtaatatgattagaacagcatctggcacttagtaaatgctcaacaaatactagtttttatgatgacagtgatgatgaggattgtggcaggctacaaaaatggccgcgaattatttccttcactgacactgggctggaactgtgatttccttaactaatggaaatttagccaatatgatgcaagcagtcttgaaaaatacctgtacattggagattgctctctcttgttgcttttggcaactctgcaacaactgccatgtgaagaagcctgaactagattgcgggaggatgaaagaccatggcccagtcacccctgtcaccttggctgataacttgccaacagccagacacataatgaaaccatcctggatcctagatcatccacttgccagtccaactgctgccacagatgcatgagagggcccagcagagatcagttgatccagactagaactacccaactaattcacagaatcatgggctaaataaatgattgttgtgaaaagtcggtacgttttgggagtcctttgctacacagcagatgttaactaacacaatgatgatgtgtttggaaccataataagtattttaattacataacaattgaatccacacactaatctataaagttgattcattttgtagatgggaaagtaagcctagagaagtagagaaatacagtcagccttacacacctagtaagaggctatgccaggatagaaacccagatttctctaactctgtggtccagctttatccattgcactatccattgtcacactcaaagcccaacagtgggataaagatcacactgttaggggtgatcttggtaagaggtttaggtgatgtttacaatgctgttgttattgtttttattcatgataattcctttcatggccattctcaattccttttgaaaatagtcaagttaagtctaatgaatgaccaaatatgcttcctttatgtgaagatttatagttttaaattatacagtcacaaatgagagaaactcaaggttaatatggtgatggaaagttctgaaaactagacagactactgccctacataggccaatatcttttttgaaacaaaatccaacacatcacaacatggcatccacacttgctagacagctatgtgagcattcatttactcaacaagtgatttatatttactgagcacatacactgtgctaagctcaactgctggtgttctaccagtgagcaagacgagcttcattttcatggggaaggcagacaataaacaagtagaccaaataaattagtaaaaaattgtaggctattatatattatcaaaatatatttctacaggacttgctgaagtcattgggaggaaaggaaaggagtcaaagttgttatatttggtcactgctaagtttttagagatgtaggctttatatagagaactatagatcaatgttgcaaactgtgaatggatccttccatgggattacactcctcccattatggtaggtgctgtgaaatgacatggcctggagtggtttgggcaaaatgatttgacacagtaaaatgacttagagaaaagcaagcaatgcttagataacacttgcataaacactttaaaaggcatttgcagttccttgtgactcatgaaagagggatgccttatagaagccagtactaggatgtggagtttaggcccaaaacaaaagaaaacaagcatactgaggctgaaaagagctggggtaattcagatggagacaaaggcaaagacttgcatgcactaaaaggcatgaagcaaccagacacaccacatccacagcactcacccagaaggaaagctccttggaatagccagagctttttcttgacttgacttctactaaagtcaaaaagggtattgtcaagtggggtcaattttgtacttgctctgtttcagaagctatctttttgagatcacttatgaaaaattatgaggttctaagatctgatggcatatcttctgaaatctttcaacaggaagaaagtgtgttacttagaggtccattgactcaataataataataattgcatcatttgttgaatgcttaaaatgaaccaggccctgagtagtgagatgtgatttcaattaaaccgcagaacagctctatgaagaggttctactattatcagcatttaaaaataaggcgctaggtgtctgtagtcccagctactccggaggctgaggcaggagaatggcatgaacccaggaggcggagcttgcagcaagccaagatcgcgccactgcactccagcctggggaacaaagcgagactctgtctcaaaaaaaaaaaataaggcgctaatgtgcacacagctaggacttaacatcaagactctccatgtctaagctagtgctgttaactaccaaaccaaacagaaaatcctattacagatgtcagaggaagcactttcaacagaggggtaattgtagtcacaatccctccatcactttttgtttgtttgttgtttgttgtctgttccttccattagaatgtcagcttcatgagattttctttttttcactgctgtatctgcagtgtctagaacagtgtttggcattataagttctcaatgaacagttcttgattgaataagtgaatttctcaattctatgtcttcaccaaaaacttggctagaatcctctggttttttggccctgactacattggattcatctgaaccacaggcgacattctactgtcacctgtatttgctgaaaactagatatataaatcatatgaaatggcataaaatctttacaaagtattcagaatagctgtagccaaatgtggatttaattgctagtaaccaaacttggccatttctgataaatccaccaacagtttaacaacatttcattatcatttgctgatgggcttagagtcaaaggacttaatctgatctattctctctactaatttttcatgaaattgatcatttgaaaggatcatggggtttaaaagaaaccaagatacggattaatgtattgactctgctaaatcaatttaaataaacaaatattgagttgcagttacatcgactatggtagatgctggagaacaatgattttaaaaagaaaaaagactctgccctggagagacccacagtctgtactgtgtaattgtgtgatactgggcaaataactgaaaccctcttcctcataacctactctttgccccagttttcttatctttatcacgaagaggctggccagttattatctccaaggtcccttttagtgttactgttctataatccatacttccttgctttctttttctttctttctttctttttttttttttttttctctgagacaaggtctcactctgttgcccaggctggagtgcagtggcacaatcatagctcactgcagccttgacctcttgggctcaagtgatcttcccacctcagcctcctgagtggctgggactacaggcaccaccactatgctgggctaattttatattatttgtagagatgtggtcttgctatgttgcccacactggtctcaaactcctgagctcaagcaagcctcccgcctcagcgtcccagcgtgctgggattttaccctatatcatacccagccccttcttcagtggcagatggagggtataattaaacttaattttgatgattattttgatgatcattattctctaatacattagcttctcctgttccctctctcttattactattctccttcagtatcagctgccatttcgcattagtgactatatatgtgcttctaatagcacccttatcctccccataatgtggttcttaaagtgccctgagctagaaaaacaatgacatttattttaacggtgtcacctgtgagttaataggtggtaacaacgcaggggcctctcacagcatgaagtgtaagagctctgcgctatggtttggaaacccctttactagtctcatgagcctcttttctaactttggaatctacaagcagtgttctaaaaggttgaagatactagaagtttcatgtctgatgggtgtctgtgtgtaaacaaaatgcaatgatataagaactgtcgaatttcctgaagagtcaacaaaaacagtgaggctgttggagggggtagttgcagcagcttggagacttaaatggcagggatggggaggagaattttggtagcaggctgctgtttgctctgctcatgattccacattccattcaaatgcctgtgcagagaattccattctactgagagtattcagaccatgcacgagcaagacactgaccaaacagaactccggaaagacaaacataaagactttgctaaaaccaggcgaattaaccagaactgtgccagaggcttctatgggaagtaagctgaacctttatcacttcaggggaacatctcagaagaagttagaggatgccccaggacatttgaaaacttgggaatttcgcagctgcaaatgcccttccatacaacttcttccaatccacatcccttttattaaaattttacctcctccatgtggccttccctgggttccggcaagaaataatcatgttctttttggtgatccaatgacaccttaagcaaagctctagtagcactttctgtgaagtacagaaatcactgtttactctcctactatttccccactggaacagggaccaagctttaataaacattttgtccccagcacagggcactgcttagcatgctgcaagcaatggagaaagggcacagtggagaaataattgaagacttagagctatggtcctcaaagtgtggtccccagaccagcatcatcctcctcacccaggagtttgttggaactgcaaattcttgggctccatcgcaggcctactgaatcaaaaactctgggctgggacccaataatctgtgttttagcaagcccttcaggtgattttgattcctgctagagtttgaaaacctgtatcctagactttaaggagaacatgttacctttcatctctgactgtaccatccatctgacaagcacttacgtccctatcatctcccttctagaatggaagctactgagggcacagtctagggcctattcatctctatacgcctcaaggcccctagttcagaatccagtacagggcaaaactcaacaaatgctagctggatgaaggagcatctctgcagacattccccatggctgtaaatggaacaggcctttctgtaagtgatgcttccagcttaatatttccaaagatgaatcacgtctgagatactaattctaatggtaattaccatatggatgaatcatatcataatgagaaaacctggctgccaagggagcctctcgaaaagaaaaaatcaaatcaggacaaatggattatgtttttaggattgtgatgtcaggccatgaattaggcctacagaagggacttaatggcctgaactaccaggctccttgcagctctaaggagcaatgggtcaattaatgaattacatggggacaaattccctgcaagacaaaaccaaattttcacaaatcccgtagactgtgatccctggctcagaggatcaagggtaatgttctcgctaagctgtgcatgtgtgaagctgaaagggacagaaagttcctgacatcctgtggctccaggcttctgtgtgtccccaacaggtggaggggaccaatgccaacctataagaccaggctttttgcttcctgtgccccaaaccttcattggctgaactcctgctcatcttttcctggtttctaaccttcctctctctgcccagctggaaatgtccagtgtggcctctatcttcatggctcccagggccttggtcattgcttctggaccagcactgcatttcccttctcttaacctcctgtctgcctaaagatggcctgaggctgaggctgacctcctagaatatattgctctgacaaccagaaatgggatagcagagatgggacagcagagatgccatctctaatgagatgccttagggtagagtggaaagagtatggtctttgcgtcacactgatcatgtcgtacttagtgccaccatccagtagcatgggggaagtaactagtgtttctttaatggagatataacagagttgttataaataagcattcaaagggataagacatctgtgagttctgtttctagtttcaccagccctgaatacccaaatggtcataatagcataaatacctgaatctttagagctccaagaccatgcctgctggcctgaggacctcaggtaacttcctacccccaaaagccatcaccatctgccttcatccctcctagctatttggtagcattctgaaggtgatggagcccctcctatgctcagggatagtttgcttctgttcttccactcagctccccttgttgaagtacctggactgggctctgtggctggccaacctctgccctcctgggctgagactggaggtggagagaacaaccctctcctagtctcctgcatgtgaacttatgtgtagacatctaagtgttttctggtgcacagctccataaacagctcaactctggattccattctgggctagtgcccactatgctataataaatgcaaagcctcagcacagcacttggcatgtatgtggcatttaataaaagggaggttatcaatcctcttggtcaatatcagagttacagtgcagatcctctctctcatcccaggtttattcctttcactcacttctctgctctcttctgtctctctaggttgctccagcagctttcttcaacttcctcttagtccccatggtttcttcattattaagatttcttagccctcaccacttgcatgttccccatgttgctttcttttgaatctcatcctgttgttccttgctctgtcctgatcttcctaccttccccatcacccctctctctcttccctttattcacaatgtccatctttctcctgcatccttcatttctttccactgccttttgatcttgatcctttgagcatcacttccaggggcaaagggaggggatgagaatgaggacagagtgtgaattagtagggtctgcaagcagagatcctcctctaattattagcagacagttatttatccttattaaatgcactgtatttcttctactggaaaactgcagtgatttaattcttaaaggtttctcttccaatgggacccaagtgaatgaccaccagagaggagctagggacattcctctccaaatcccccaaggatcacgaactcagtagttgagctaacatggacttactctcagagacaggacccaacataagttggcttctggtcctgattaattgagcagctgcagagcctcatgcctgccaataagactgaaagctgtttaagacaaccagtacagaccttcaagtttcatccaagggtagagccatattcaacaacctgttagtgaacacacctcaggcagagcaaatgaaataggtagtggtgggtgaatagagatcaccagattcccaggagctagagctgtcaccaagtttaggcagggcaggaggacatggagcctggaagaggaattgttgagtctcccagacaggatggaggagttgagtaagggtagagaatagtaggaaagcccagcctagtggggaaaatcctgggccctacacccagagaaaggcaggccctgggaggtcctaagcaatagctaggacccacgctggggtgcctatccagaggaatcctctgagaagcttggactgacattcaatgcagacacaaagtagccgcactttaatttctgaaagataagccgtctatgcctaagaatatattccttgtttggactttgttcattcattcattcagacaacaaatatttactgaatgtctattttgtgcaaaatagtttgccagtagctagagataaaataatgagtaaaagagcttcttgtccttaagaaagttactgagcatcagggaaggtaagcaagataatgggcaattgtattacagcataaaattctacattggtgtgggcatacagtgtttcagatacacagaggagggtcttaggaggccatggaaggttcttctaggaggtaacatctaagacacaacctaaagacagtaagagttagctagggcaaggttgaggaagggtaagaaagggggaaatgttctaagcaaagggaacagtgtatgcaaaatagttttcctatgggtgaagctaagagattgagcagtgagtttggggagataaacaggaaccttttgagtccttataagtggatgcaattctaggccagaaccatttctgttcataaacatttcctaagcaaactacctatgcaagctatatggacatgcatacagctggagggttatatctcatatgcctgaggacatccattgccttccagaggtatttttttaagtattgaagatataacctcaaacaagacacagcctcttctcttaaggcaccaatggaatagagatgatgacttctaagatttcctatagcttggtggtttccttttattaataaaaaccaatgagaaaggacaaagtacacattacctaccagcctggaacaggagagagacgatatacttcatttgtactcacaaggtaagtaacaactttcagaagcatcccacagggtgggcgaggacttaggacttttcctgtctagttggaggtatagatcttaaaagagatggaacatcttataggaaatgtcacctttctctccacttttgtaagatagcagtggaaaggtaagccttcaaggaggttccaaaatattggggaactacaaaaaaatggacgggtcgtggcattaaaactgcactcaagttcatgaggatgagtcagggactttcaatctatccccagatagactacctctgtcctgttacagagactctcagctatgtgtgtgtagaagagcatacgtattagtccgttttcacggtgctgataaagacatacccaagattgggcaatttgcgaaagaaagaggtttattggacttatagttccacatgactggggaggcctcacaatcatggtggaaggcaaggaggagcaagtcacatcttatatggatggcagcggcaaagagagagcttgtgcagagaaactcccatttttaaaaccatcagatcttatgagacccattcactatcatgagaacagcacaagaaaaagacctgcccccatgattcaatcatcccccactgggtccctcccacaacacatgggaattatgggagctataaggtgagatttgggtggggacacagagccaaactgtatcagcctatgttcagggctaggattatcctgagaggttgagtgttgaacacaatatatttgaccttcagagggctcaggagtatgggaaagttatcacctttcagcttacctgggcctaccctatagtcagataagaaagatatggtcaccctgagctgcatgtcaaagaactccatggaaatcattaaaaaagaaaagagaaaaaaaatgctaaagttaatgaaaattttaaaacttataaaaacttaggttaaaaacttaagtttaaaaaaattgtaacttcttttaaagttaacaaaactttttttaaaaaaccttccaatttacattccaaaaatatggttttagcacttacattttgtaatttaaaaagcttgctctcatgtctctactgagcttaaggtttttcttggctatcaaaacaaagaggtcttttgttgaaacaatcaggcgacagtgttttggtgaaaagattatatacagaataatggtatgaagctctattgtataaaaagtagacttaagagctttccctgtctccagataccctgggcttcttgcaataatttgaaataatgttgtccttcactttgtgggagctctaaacaattgggtgcattcattattttctaagagctcataaaggacacaatgcaggtgtgactacacataattaaaggcagtgtcaacagcagtgtatatactaactacagcctaaccaacccactgggatcaactgcttatgggtgttccaaggattttctctcttttatacccaccatgatctagtgattcatggtatattgtattgtatacaggtggaactcctgaaatattccttgaactgatgttagctggtctttggcatctgcatataatggacattaccagtaatgtcaaagacggcacaaatgaagtcagtgcaacgagtgtttggcatgaatctgtgggctgggtaggctatagggaagggaagggtcactgagtctcactcccagcagagctggtaggagtcaaagaagacagtcaatgtgatgctgagctggaagaaaaggacttgctggggccacatctctgtttaaatcacttctgtagctactttggatggggttccttttcaggagcaaatgcacattcagctggagggttctgtcactcatggcccaaaagtcgggtcaccttttattcactgggaagctcattcctcacactcttctcaagatcttctggtctcaccacaagagtcccaaccttgctgagccattcacttgatgagagtgaaggagagaggatgggagctctatatgttgtgctcatgattggaggagaaagtccacatccagggatgaccatatcagatgactcaaccttgcttatctgttatccagtagagaccatgatacactataagacaggaggcagaggtcctgggagtggacagggaacagctgaaaaacagactgtgggaagtcagagatgcagggataatagcagaaactctttgtcttttcttttattgcactctctccaaattgctcctttccaattcttcaacatgaggccagggagaagcaaatgcacttcttttagaaggtgaagggcatggccattactggctgggtaaatttggggtttcatcagttcatccaacaggtttcatcatcagcttttttatgttttaccctgcaaatattcttaaaaaaaatttttttttttgagacagagtctcactctttcgcccagactggagtgcagtggtgcgattttagcttattgcaacttctgcctcccaggttcaagcaattctcctgcctcagcctcctgagtagctgggactacaggcacctgccaccacgcccagctagtttttgtatttttagtagagatggggtttcaccatgttggccaagctggtcttgaactcctaatctcaggtgatctgcctgcctcagcctcccaaagtgttgggattacaggcatgagccaccatgccctgccattcctaaaaattcttaaggcagacttggcaaccttttcctaccaatgccatggatccttttcccatttccaaaatcagtcagaggtcacacacagaatgttaaacatcattattatattcagacacaagacacagaaaacaagaaaagccaagttctatagatatagcaaataaaaggataaatgagatctaaattgtgagtagttaagaaactcaggggtatttgtggcaggggaggaaggtgatgacgacagaatcaccgaaagacagaaagatagaattttgaagaaaaggatggagagaggaaggagcaggaggaaggatcagggacagcatgtcagagatgagcaagccctggagatgcccgctgttctccccagtgtctgtcatcagaacagttatcgcctgcatcatggccctataaagtgcttgctgattaatcagtgactcatccctgttgcattgagtgtctcttgcatgaccaaggatggctggaaggcaggcaggtaagagggaaagttaacacgaggcaggaaacaataagtgagaagagagaggttcaggcagctggtgctccaggagtcaagaggaagccacagtcactgggaacaggctgacttcaatggggaatgaatggctactggcgcctagaattgtgcaagaaccagcaaaagaaactaccatcagagtgaacaggcaacctgtagaatgggagaaaatttttacaatctactcatctgacaaagggctaatatccagaacttacaatgaacacaaacaaatttacaagaaaaaaacaacctcatcaacaagtgggcgaaggatatgaacagacacttctcagaagaagacatttatgcagccaacagacacatgaaaaaatgctgatcatcactggccatcagagaaatgcaaatcaaaaccacaatgagatacaatctcacaccagttagaatggccatcattaaaaagtcaggaaacaacaggtgctggagaggatgtggagaaataggaacacttttaactgttggtgggactgtaaactggttcaaccattgtggaagacagtgtggcaattcctcagggatctagaactagaaataccatttgacccagccatcccattactgggtatatacccaaaggattataaatcatgctgctataaagacacatgcacacgtatgtttattgccgcactattcacaatagcaaagacctggaaccaacccaaatgtccaacaatgatagactggattaagaaaatgtggcatatatacaccatggaatactatgcagccataaaaaatgatgagttcatgtcctttgtagggacatggatgaagctggaaaccatcattctgaacaaactatctcaaggacaaaaaaccaaacatcgcatgttctcacttataggtgggaattgaacaatgagaacacttggacacaggaagggggacatcacacaccggggcctgttgtgggatgggggaaggggggagggatagcattaggagatacacctaatgtaaatgatgagttaatgggtgcagcacaccaacatggcacatgtatacatatgtaacaaatctgcacgttgtgcacatgtgtgcacatgtaccctagaacttaaagtattaaaaaaaaaaaagaactgtgcaagaacaacaacaaaaaaaaacatagggcataagaggattaacctatcatgaggtctagggcacaacaaaataagaaaagaacagctatactgtgaactctcgattatttgggggtaatgtggagattataatagtaggaaatgctacctacatgggaggtgctatgaggcttggtataaaaatccaagcataaaaggaagttagaacagagcagatcttggaaaaatcttcatgaatgaactgagccctgagagcacaaagcaaacgtggaaaggtcaaggggaatgtattcgtgtggatgaaaagttgctggctctgaagtgcagcatttggcttagagatcagactgttagcctgagatcctgggtggacacagtctccaatgtccctccctcctcctctgcccctgcacaattactgtctatactcatctgtctcactgagaaggaaaagaaaagctggggagcccaatttgctccactttgggggaagtgaggaggtcaggggacaatagacttttccttcccctctagaggtttaccttctagtccaggtttgatgccaaatgttctgagcattctgggctagtcaccttcggctgcgactttgcaaccattcaaagaatgtaaggttctaaggcaggtcctatggaggcttttcaatttccctaggtcattgtgacttctcttttagtaatttctccccagagcccaggtcatagtaagacccagggaacagacccagagagacactcattgagacatgcatgtatctgtgcatttagaaaactgaacttggccttcttaagccttgttttgattcaattatcttcaacgatgcccatctgctgcattttgtttccttagcatggtcaagggagttcctcagtaacccctcactgtccacccttctaccccctcctccattattaccctagttgaacacattgtgacagctatccatcccctcaacaagcccaagcttccctgcccactgccactcccattcccgcatcgtcacattgctattagaatacttccactctttaaggcagtcttaatgtcactgcttaactagctatatgaccttagggcagttacttctctgtgcttccatttcaaaatagtaaaatggagataactgtgtgataattgaatgaatgaatacatacaaagagcacttagcatagtgcctggcatacagtacattctatgaaggttcttgtctttttctcacctacggctcccagcccatccaccctctgaacactcaggtgctatttggaatacaggtggtaactaaacatctccaaccaggatttactttattttgccctcagttattgtccccattttattgtctattagttttgaaaggaatgggtgtatagtactgagtttcttctctgctgttcctaatttacttattcagtgtgaagtcctcatgccaaaaggaacccttggctttttttttttttttaacagcagctttattgagatataattcacattccatacaattcattcatttaaagtacacaagtcaatagtttttaatatagttacaccacaatcaattttaggtccttttttcacctccaagttaagtctcatacccatttaaagtcactccctactttcccatcctcactagccctaagcaaccaccactaatctaccttccatcgctacagatttgcctgtttgggacatttcatataatccctggcttctttaagaggcataattcttctttaactcagcattcatctgtttcatcaaagtccccagccctaggaccaggcacatagtaggtacccaataaatgttctgttgaatgaaaaccaaagcagggggttgatcgagttaaatatatttttttcacatttcatctttagaccttattggtccaaagcaagatagagaagtaggtgaggaacaaaggcattgtgtttttctaaggtatacaaaagctccattgagactccttaaaatgaaattctagtgcagtggttctcaaactggctgcaccttagagtcacgtggggaacaaaaaaatactgaggcctgagccctgccccactgcataccatatccaatgtactgatttatctgtgtggagccatggattatatcttttaaagtttccccagtgattctatgagcagccagggttcgttgggaactcttgttccaatggaaacaatcattcaaagcaagaataatttgttgaattccagccatgcccagcatgatacacagccaaagttttcaactctgtcttcagggaaatgaacctcaaaatttttaagaaagcaataaaaaacagaatattcatttcacaaaaattttctttatagccaacattactattacactgagccatataaaattgctgatatttgactgtttttgacctagaaaaatcaaaatttcatatcattcaacctaattgaatgcatttgtttcatgaaatgagatacatttaatattcaatctgaatcactatcttgttaatcacccattcaccttccttgtgcttcatgcatttttaaaaaagaatattttaaattttattaaatatgtatctctaatacaggatggaaaataaattagccatcaaagggggacaaaaatcatggaaattcacaacagataaaacaaacagaaactttatagatgacctctacattttgccacacattatttctggaaagcacgtcataaagtagattgtcataaagcaagatgtattttcccataggaaaaatttcatgattagggattctgttcctgtctaggcctcacataaatcaaagatacgatcaacaacaggtcatgaaagcaaaactgcgacagccataaacctttataaaccttcggcggcactacaaacatttaaaataataaacttattattcaagcactataaaatgccaaaataatatccaatccattgatcattatactggcatttagaaaggcaactgagtactacccatcgaaattcaaaaagtgtacattctttgatccacttctagagatctttcctataggaaaactggtttggcttctttccttcttccagaaccaagtgtaaatgcctcagtctagacccacggcccttcacagtaagtatcactactgagtgggcagtgccttgcaggggctctctagccacccactcttccaactccttatccaagtccccattccttccaccagcaagctgagggctgccctaggctctgaggacaatcctgttccctgtcaggaggaatttaaggagctttagttctctggtgcaggctccacaatgtctagtcaactgcatttctgctttcattcccatctcaggctgggaatttggcttccacctccttttgtgaccaaaactgctggtgtctcagtcctagtgagcctcgttgcttgccaggccctttcttcactccacctctgcccgcaaggggctgaattcctcccactgaatcccaccctgcagctggaaggaaccctgcttcctattgccacatttttctgatgccaaacacctttctggaaaataaatgtctcatgagtgagtgaacgaatttctagatttctacatactccattgctgtgtacaactgaatacccactgccacctcttgctgagtctcccagggagtgggtatttgggatgtatcagtgcatgattctagaacagcagttctcaaccagacgttattttatcacgaccacccacaccagggacatttggcaatgtgtggagacatttttgtttgtcacaactgagggcatgctacaggcatcttgtgcgttgaggccaatgatgctgctaaacattgtccagtgcacagggctgctcccacaactagctgaggttgagaaacactgttctagagaaatcaaaagcactttctgcagcactacaaaccaaatcaagctgaaaattaccaacagagaaggatgatgcttctgttttcagtaaaacacccttttcccattccaattttcaaaattcttgcttattacagaaaaactggaaaataaagaaaagcaaaagatcacctgtgataccactaccactgtgtagttttccatagttgtgatgtcatattacacaacatttataatctgcttttctacataatgtattaaccaagtttttctccatattactataaagttctttagacctcactttcaattctatgtgagattcctcctcatgatttcacaacagtgtaagtaaccattctcttattactattaatttgtttctgggttttcactattgtaaagctgttgtgatacacatatttgtgcataaaactttttctgcacatgaggttatttccttgacaacccttagaaaaggtctatccttggccaggcacggtggctcacagctgtaatcccagcactttgggaggccgaggcaggcggatcacgaggtcaggagatcgagaccatcctggctaacacggtgaaacctcgtctctactaaaaatacaaaaaattagctgggcgtggtggcaggtgcctgtagtcccagctagtcgggaggctgaggcaggagaatggcatgaacccaggaggtggaccttgcagtgagcagagatcgcaccactgcactccagcctgggtgacagagcgagactccatctcaaaaaaaaaaaaaaaaaaaaaagaaaaaagaaaaaaaggaaagggtctatcctcctgatatcaatttgaaaggcaaacgtgatttgccaaaggattctaacatcaaagcccatgtgaaatgttcctctgaaccccatctctgcactggtctaaaaacatacaacaaatctgcaacttcaagagtctttgtctgaggaacatcaaaggagccaggaaaaaaaaaaaaaacatcccagagctttctgaatagagaacattgcagtggatcatgagaacaagaataaaagttcttgtgatttttggcacagagagacaaaactgctatgtctttaatatggtagaatttgctggttgcagaggcaaaatattttatgtagaatacctttcttataagcctaatgccattttccatttattaaggaagtttagctttattgtatttaattttattttttggccatattttctcctttgagacagagtctcgctctgtcacccaggctggagtacagtggcacaatcttggctcactgcaacctctgcctcccaggttcaagcgattctcctgcctcagcctcccaagtagctggaactataggaacgtgccaccatgcatggcgaatttttgtatttttagtaaagatgaagtttcactatgttggccaggctggtctcgaactcctaacctcaagtgggtcacattttctttttatctcaggtatttatttagattttggggaatgcaataaatttgataaacatcttaacagctatttattgagataagtccagaacattttgaaacaaaaataggtcaaaaataatatttttttcattaacatctagatagtattcttatgttttagcagctgactacagtataactgcaaagcagaagttaaactcttaccttcatcctgctcccagattcacagggaaacctacaagtctgtataaatcaaagcaaaggccaatatatctagatacaaaaactcaaaagatggcaggaaatggtaaaaagaagttgggaatcagaggacctgggtttctgcttgtctatatcaactagcaagcctgcaccttaggacaagtcattgatatttctacatttcaattgcagaaaaggaagtctatcaaatatgaaacgacatatgtgaagtgctcttaagagacaaagttcttttttaaatgcagtaacatacaaagagggctgttactgggtatcactgtgtatgatgtattgtgctttgtgatgtcactgcaggtataatcaaggacagaaaatcagtattgatggggcaagccatgggactggaaggcagcaggcagatgtcagggttggggattactggctcagaagcaggtatcatagcagaagcccaagtctcttccaagtcacagggctaggaaccaagatatcagcaggggaagcagggggtggagggggtataaaaatgacccaactacaaccaccaatactaccatttactgaggcttcgccatgcagcaggcaccctgaaaagtgttttgtttgcattatcttagtcagtcctcctagcagcctgattagtagaagttgttacagaaacacagatgaaaccatgggttagaaagaggttgagtgctagagaatcttatggctgcaaaatgagtaagcagagacttcaaccactgtcttctgactcacagcccaagggaaagaccaggcaagagtaggggtgaagtaagtagctcggtgacagcacagaacctgtgagccagggctcaggctgaggctcctggcctccctgactcttccttcaaaggcacacagtaggcaaggcacttggggcactggctgcaggggagctcccaccttgcttgtgatagggtggaatggggttgggaggccttaccaatggactgggatgttctttcagaaacaggagcagttcttgctgctgcacttgccttctctcacctcaccaagtcctcacctcactgaggtcagggctgagctacaaggctgtcagactctagcttgtgctatggaattgagagaagcaatggtggagccttggtccatgagtaaaatttcctcccgttggttagatccacagtccatccagcccacggcttgtctggaatagtggagtcaaacaactaatgcaatcgtttgtagactttaaaaaaaataaataaataacaacttttttttgtccctcacaaaggaaatctcatgtagaagcccagaactttcaagagataagaagtagagagattctggtttaaagagagatgacagaagccctgaatgtcctctcttctgctcccccagataccttcatggactacagggctgtacatacggttagactccttgacctcaatgtgaatgtctaaagactccaagcatcctaactccaattagaaatccagcagcaatgtattaccatgcagttgtctaaaaccttaaaaaaaaaagctatttaaattgtccatcttttcacacttttggttacagagtccactgtttactagccccatttggaagtactacttactacctttctcttgtcctaaactcactctgctgtaacttcatggggtatctttgtagttttacactagaactatttatgacttcagaaactttgctcacatcctcctcctgtcttccagacagaccattcctaatctgtttagtctgttctcactgggggattaaatgcaataatgtatgtaaagcaccaagcaaggggggtggcatgaaggaggagttcagcaacgtcttgcctttatcttcctttttctcatctccgtcatcatttaaaaggctcttctccagttttgctttcctttgtaactctttgttcctttcttaatcacactcactgctgtgccctaaataacggataccaaatggggtcatctttaacaacacagccaaatactgaggctacaaacatcaacccaattggcaccacataaagcgtcgccactgccagcaacagtcagaactcactcttctctaggtagcctccgagactccttgatgtgaatattgtatcaaagaaactactatggttttatataaccaaggaagcagaggggagaggggaaggagaaaagggtgttgggggggggaggggagggggagagagagagagagagagagagagagagagaaacaagagacaacacgagcaccagtcagttaacaaggaggatttgatattatggggcagcaggggaagaaaaaatacattcactgtgcaaaaagagaggcatagaggcatgacaagcagagaatatgagctcccagagaggagaggactggaacggttaagaaggaagcattcaattcccaaatttgtgtgcagaggaaaagggaatcatggcaaactgcaagacactatttgtgggaggataaattggcaaactgcaagacactatttgtgggaggacagcattttgggggccatttatcagtatctatcacagttttaagtgtgtataccccaagactcagcaatcacattttttaggaatctgaattacagaaatatttagcattacacacatagatatataaagatgctcactccagcattgttcctaagggaaaaatcttgggaataactgaagtgttcatcaacagggactgaaaaaataaattatggtgtgtatccatacaagagtatactaggcaacaatgaaaaataatgtggctgtgatatatgtaagagatatgtgtaggaatatttatggaaatatctcaaaaatatagtaaatttaaaaggcatgttgtagtatgtataattttggttttaaaattatgtaaatatactagttaacataagaaaagcatctggaagaatacatattatctaaattctttttgaagtgggtgaaaaattgttactttttatgtacttccagactgttgaagtttataactaaaaataaaccaataggaaagctagccatgccatagtggctacatgcatgggatgtgaagccacacttcctgagtttgaatcccagctctgcctcatcttaaaagtgtgatcatagagaggtaacttaacttgtggctcaattgccttatttgtaaaatggtaataatgatagtaccaaccttataggtttgttgtgtgaattaaacgagttaacactcataaaaaggtgaaaaaaggcttggcataaacactcaataagttgagtatttattggtaaacaataaatttttaccttaaaaaagagctatttggttgtttaattagcagaggacagaagggaggaagcgagcaaaatgggaaaagattaatgccagatgataaagggccttgactaccaagctaagaaatggagattaatttctttagtaggaaatgaggagcctttcattcattcaacacatatttattgagtgctttcagtgtgccaacatcattctaaatgattgggatacatgagtgggagtgagtgaagtggacaatggcagcattttagaaaaggattaaggtaatcaacactactttttgagaacaatgggtctgtgccttaaaagtgttttgtgtgtgtgtgtgtgtttaggggagatgatcaggacgatggggaggcgctatcagtcaatgtattgtttgggtgagtggtgataagtgcctaatacacaaagcgagtacaggcctgaagcctgaagagatatctctggtctgagataactgacaggtgatccctggtgtctgggtgttgactgagactggaggggtcaggtggggagctgtggtgggcaggaacaccagcttttcagagtttacctcaacactgtccaactcagttggcctagagtcaggcaacctggttttaagcccatgttcaccacctttgattggaggaacccaggcaaactgcacttctctgggcctcagaatccttctataaaatgaaagggtctcctctgattatttccaaggccctccatcagctcaaacatgctatcattttcatggcatcacaaagaggcgaatgaatggggcttccttcctcatttccaactgattatattccagactcaaaagagaaacgaataaataaaacataggattcagatgtgcaggataatatatgagaagactgtttacatttgcttcctttttgagaaagcgcatgttgaattttaagccaaatgtatgtgtcaaggtttgaaaataggttactcagataatttcattccatatgtgcagctgctgttctaaagtataaaccacactcgtctagtaaaaccatcatctgttctataaggaatatgaacattcatctggcccttatttttagagtgagaggtcaaatgcacaagaggtgaactgtacttgagtccaccgtgccagatgcagatgggggactgaaggccaaatataaatcgtaatatctgaatttgtgggtatttcaattagatggcttagaagatcaaaagaaataaatcctggaatatcaaagtggcaaacagaagccgcaaaaggccatcattcatttggttcattcattcaacaaatcactctcacaaaatcaatcatcaaaataaacaggctctgactcatttcccattgcttattgtagttaggtttctttttctccccagggtcatgggatacatgaacttcaggcttaatctctgtgtgagaaaaacagcatgaagataatcaactctatgtcagaagaaattggcaacactactaaccacgagtaatgcacaccgaaggcaagctacctgagccctgatcccccacctgccactctagcgatgtgattttgggccagttaattagctcctttctgcctcactttccccttcatagggttgtgaagaggacgttactatttgtacactgttttgagcagtgcctgctgtacagtaaggaccatatatgtgtttataaaataaatcttagttgctataggcaacaccacgcagctgagagtggccgcacattgactctcttaaagaacacttcctctcttgctcatcctactcagctcataaaagttccagggaaaatcatacattggacaagacaaggatcagctgttcttcatttttacttaggaaggctaagaggaatttacactgaaaaacctcctgcaaggatggctgaaatcaaaatgacatttctctttaaaaaggagatagtttgttggtagacccgaaatgagaatgtcctggcctggtgcctactagccttgaagtctgtaatttcaaatgactttgcttgagttattcgaacccattttattcttagctgttttggtgtgtgagttgcactgtgtgtgcatgtgcatgcacacacaccgtgtgggtaaggatagaaggaggcaagatgcttgagtttgcttcattttagctcaacacttagaattgcctacagcaaatttctttcttccttttttttattatactttaagttctggggtacatgtgcagaacatgcagttttcttacataggtacacacgtgccatggtggtttgtacagcaaatttcttgagcctcaattactgaaactgaaacatagcactgatgttaatctaaaagaagagaaggatcttgacaaatggtcttttgcgtgctttttttctggatcaagaactattattcaaagtggctgggataatctgtttttacaatgattgctctcttgaaggccagagggctgctgccactcccctggcttagatgctttctcagggtgtctggtagcatcagtaattaacagcacaaacactggagtcaggcccaaggttcaagccctagctttgccatttatcttgtaaaaataagcctcagtttgcctatctgtaaaatggtgataatgacagtaacagtatctgtcttatcaggtggttgtgaggaataagtggaagactcagaaactcagcatgacacctgacagtcagcgcctaataaacagtagattcatagtaacagctgttcttgtccccaggtgccccagtgaaatttttggtatatctatctttagattgtgatgggcagtttattagttagtttttatattggcttttaaaatctccagcaagaactcttttaaaacatgccatctgcctcctccactgtttttcttctttgtatttttaaaaaatttcaaaacaaaccaaactattttaaactatgcctgagtggttacctattattcatcagaagagattccagggctttttgtagacggatttcacattgggatgctttggtcaaagagccgcctgtcccattctgtcttcctgctggatagcccctgggaatgggtgggcttctcataagacccgtcgtggcaccaggatgaggagatgggagtgcagcccagggctggggtgtggaggatgcagacaggatagccatgggagaggcgctggcatgagttctggcctaggcctctctgataaccagctgtgtgaccttggtcaggtcactcaaacacactggaatgtattgtcttcacgtgtgacatgagttgcctagcaatgggcaaagccaagaagacaatccacccaggaggcagatggcagacacattgttcaccttcactagttatcaacaaaatgcaaaaggggacaaaggtatcattttaatatttattaaagtaaaaactgaaaaacaataatactcaatgttgcttatgttttacattaccatgagcacagcattggtgcaactgcttgggattggaaaacacaacttagactatgtctctctcgtgaaagagaaattggtacacttgggtgtggttcctcatctctgcaattcactagtttgaaggctcaatgtttctgaagctcactggaatatggggcaaaatggggattaaaaacaatgccccctagacaggttgttgtgaggtctgtgaataatgtagataatgggcatagcctaatgcttggcatagaacagatgcttattgttgctactgatgtgacaatgctgatgcctgattcaatgcatctggctcatgttataatgccaaggagaaaaaacccatttgcccccctttctcagattccctgtcagaatctcacttctcaataggctgagcagagacctgcccatctgcagccccactcatccgagtggttctgacccatagcccctgtggtccccaggcaactctgggtacatgtcctgggtacatgtctcctatcacatgcccaccaccgcacaagagatgccagttctgcccagcccaggtggcattcactcagctctacaaatggccttccgggccagaccccttcagcgcctccacacagagcagggggcaacatccttcccgtgcccacaacctctgcctccaaaggcaagccagcccctccaaagagctcaggctctctgactcactcctgctgccaccatcactccggcacatcttcctgtgccagccactggccctgtatttaccgagtagctcaccccatggacaggaggtcacctgtgtcacttgttttcaaatgcccacttgcttctcaggggggttttctcctcttcctcacgtctctcctttgattcatttcttgtttgttggtaactcaagcccagtgtagactagaattgccataaattctttatctactcaatatcaaagatgtctcttcttaaatgcttctttgaattatttctcaataccaggttctgtctctgtttccattttgcaacctaataaggactgaaatctgttttcagtattactttatttttttttcctcagctttaaaaatattttcagagagccaaagagctgaggaactgaaaggacttcattaagtcctcatttcattcatgagaacaccgaagccccgaggggtgagccatgtgctgtgcacacaggggtgaggtgcgcaggtgaggctaggaagtacccttctagcgccttgctgtctcatgccccatttcctcataagcctcacgctgcctcggcagggcttctgacaaacaatgaccatatttcctctgtggagagctctgaggggcctgtggatctgcagaaatagctccccacaggggtcccaaatccatcatggactcactcctctctctcacttctaggcttctgtaaatgctgttccctctttgtggtaactacagctaagtcacactccatctctaaatgcttcctggaggaagccccatctgagcctccaattccagacagggaaccctcccctgtggcccctgcagaaacttgtatgccctccggagctggtattgctcaccagtcttccaacaggccattcctgttgcatccatcttccatagtggtctgcatacagtatgaggaagagcagacacaattaactcacaccaaagtgttagtgacttgaaaatctctcttatctgcaggaggacccggggaagaaccaagagaagacaagaactgaagttcttccattcccacctctgcatcaccttccctgctttctctttccccagaagagactcagtcaacatcccaaagaccaatgatttcattgttttacaccaaatatccctcctctaaatttttcaagaaattgggaataaacttcttacgcaagaaaatttggggagcaaaagcaagtaaccagcctagatgagcacatccaacctctctcctcttgattctcacatgtattacccagggtcctgtttctgcagaaaggagggaacccttgagaacattttcactatgtcactttagcagcctaactctgtggtacccctgatttagggagggtgagggggtggtgaagactgcaaccccaatagaagcagggaaggtgacatagaggtgagaatggaaggacttcagttcttggcttctcttggtttctgccctgggtctttctggcactatctttccctaaagtatttcatctaattcctcaaacatccctggatagcctatatcataaagtcctttatgatctctgttttacctggaaagaaagtgagatgcaaagaagtttagtaacttgctgagaccacagaaccagacagaggttgtgctgagacccacccagagcaccaggctcttcatcacaacctctttttgtaatttcccacacagtcttcttaatggcatcaggggtgcacatgtgtgttctccctgaccattaaaccctcactggcattaactggacaaataggaagtttaaagagggtatttaacaccccattcatctagtctccctgcctgagctgctcccccatcctagaatgtgcttttatctcctgtgataaccaaagacccactggatcctccctgccccctctctcaccataagggcctcaatgcaagttaatgtctccattttccacattcctattatgtttatagatggttctgtacaatttcatgttttacagacttgttcaaccattgatataataacaaccatgaaaacaaatacttttgagcatttgttatctgttgagtaggttttgtcttaatttccatgataattccataaagttgatatgatagctccctccttataaacaagaatactgaaccttgacatatgtgttcgagagaaataatatatcttggcagtttaaagtttgagctttgactttgtctgggtttaaatcctaattcactaagtaggtaaatgtatgcaaactgcttctctaagcctcagttttgtgatctgtaaaacagggttgctgagaggcctaaaatgaggtaatgtgtatgaagtactgagcacaggactggcatggagtaaagtgcccattgactgcaggcacttaatatcagaaggaagcagggtttaaagtctaactccagggcccatgatgcctgcttttcatataatcctgaagtaggcagagtttttcctcgctattttaaagaagaggaattaggttcagaaatataaagtgacttgttcaccaacacccagctgttaagagtcaaggttggggtttgagccaagtgtagctttacttgacttcccaacactgagctgcctatgttaatctgttagtttcatgcaatcttctttcttccaaattcgtgataagctccttggagccaagcaaaggcacttccactttgcctgcatttcccagatggcctggcacagcctcacacgtgctgtgctctcaatatacctctagtaaagaaaatccttgctgcccttgcacagcctggcactcagctccctagaaccacgaggagtatcagctatggaggactgagaatcctaaaacagaaggaatacaagataggtcattgcagaattacctaacaattttatgcctgttgtattcgtaagaagtaagcctcaaacagtaactcaaggtgttccaaagaaagctgaatgtcgtacaggtccatagccacagattcttcagtaagtaaagagtgtatataaagagagaataaaaagagataatctattagagatgaaaagattcacaagacatatcagtcaaatgtaatatttggacctcatctgattcctgttccaaaaaccaaatattaaaagccattttaaagacaatcagggaagtctgaatataggcttgtcattaaatcataattcggaaatatttatttaggtatgataatattgcagttctcttttttatgaagtctctatttattaaaaatatactaagaagtatttatgcatgaagtgatataaaatctaggatttaaatactccagcaaggtagaggggaaatactcctgaggggagattgataaaacaatattggcaatgtttataaatgttgaagctaggtgatgggtaaagagggggtcattatactattctctgtatttctgtgtttgtttaaaattttacacagtaagtttttgttaaaaaaggaaggaatggtgaatccccagcaatcttccattttgttctgcaactacttgtcttccacgagagttcagtctccttgacgacatgaaaagtcattctcttcctaagggtcctaaatgtacttatccaagtgagggctaagcagctgttgtgaggacagctcacctggaccattctccagtcccttccaaatcaggctacttcagactgaccttgtcactttccccaaatatccacactgtctccataatctcatctctgtcgcctgtccactgctgtaggtcagaaacctcagcaccacctttgtctctttcctctccttcaacccctaggccaggcagccaatgctactttggagcatgactcagatgacacatttcctctccattctgactgccccagctctggctaaaggctcagcaccacatacttggacgatggcagcaggctcctgctgggttcccttattttgacatttttcctttctgtgcaaatagctgaactttccaaaatactagaccaccaagcttaatgcttttacttggaatcacccattttgaaacccatttgttacatccctgtctcaaataggcctctcaggagttctcatggttaagctccgccttactacctttcatagctcactggataccttccttaatcatttcagaataagtctggtcacagctagactggaagctcaaagggaaggaggcttgtctgtctactctacatcctggcacttagcatcatgcttggcacactgttgtgggtgcacagtaaatattggttggataaaggaatagatttattaatgaataaattctgtgaaaaaaatcattttttcccccttgatgtgtgcctgtgtggtgctttcttcagcacaggtcctaatcttttcaacacagcatacctccagtgcatgatgaccaaatctttaagagcctctggagggagacataatctccctacaaagataattttcaagtaaaatctaaataaaagatattctagggtttcccttctcccatacacacagtgtaaacaaacctctatttataggtcaagtagccttagctttagctctgactacacatgaacttggtctacccatccatgtctctggtcctcagtttcatcatcagttaaaggagaggggtagttgggtaatcagtgtgatcctttcagttataaacttcttggtactttctttcatagaagccacaataccttgtgcccaaaatgtcattattacctaagtatagaaagtttccctttattacaattccaattgctagcctcatgaggaagtcagactcgctgatatgaatgtttctctctagaactcaccttcttatggagtcaccttcatccctctgctcagcaaacatgtctctcctataagcaaattcaataaggaatttttcccctttattgttgacacagtatctctttacgatggtaagttgtgcatcttttcagcctgtcttcataaccatcatgtgatttcgtgcccagggcaatcagttgagacaatcaggtagggtttatggttggtgatatggtttggttgtgtccccactcaaatctggggatttaatttctataatccccacatgtcttgggagggacctggtgggaggtaattgaatcacgggggcagtcaccttcatgctgttctcatgatagtgagtgatttctcacgagatctgatggttttataaagggcttttccccctttttcttggtacttctccttgctgcgaccaggtgaaggacatgtttgcttcctcttctgctatgattaagtttcatgaggcctccccagcccttcagaaccgtgagtcaattaaatctctttcctttataaattacccagtcttcagtatgtctttattagcagggtgagaatggactaatacagctggtttatcattttgcaaaacaatctgttagataagcaacagatttatttgttgcttcgtcttgagtgtgttagcaagtggaaggtagaggtacctagtctccatattttctaaatcctggttctggaatctttaacatcattccatactgccctaggaacaggcagtgggacagctgtgagggtaaggagaactggggtccttgcttttgaagccatctcagcaatctgggaatgggcaatgaagtcacggcccaaataaggatgtatgtagatcacaagaagcccccaataacagctgaagatgacagcctccctcaactccagatctgccttgtagcctgaagacccctgatgatattgtcctaatggcctgggagctgggccacaaaaaggcccactggcctggatagttcctccaaacacagaagtagaaggaacatgggcttcagggtctgacaaagggctcaaatcccacctgtaccccttaatagctgtataaaatcaggcctggtcctcatctgtaaagtgaggaagacaccacccattaagggttttctgggagtattaagggaaatagcttacttgaagtggctagtatggtgctaggctttaattttcttttcccctaccttttagtgcctctctctcctctcccatgcggccctgtggctggtgacacacagcaagtgctgaatgtcaatcattgttattaagaaatttccagcctgggaaacataatgaaacctcatttctacaaaaattacaaaaattagccaggtgcagtggtgcatgcctgtagtccctgctactcaggaggctgaggtgagaggatcgcttgaacctgggaggtggaggttacagtgagccaagattgtgccactgcactccagcctgggtgacagagagagatcctgtctcaaaaccgaaaccaaagcaaaacaattgaaagaaagaaagaaagaaagaaagaaattgaaaggcccctgagggacaaggggatcaaggagccaataggaaaaggcatgctgcagaggggatcctacgatgtgaagacacaaagtgcatctttcttgaatgtgcctgtcattgcatgagtcccgaggctgacccagtatgtggccaacgggtctttgctggcagaaatacagaccagtctctctctagaaaggagccagctataaagaaaatagagggaaaagggaggtattttaaggatgattacaatgtattctttgctaaacagttgccaaaatggtctgcagttaccagcagttggaaacagtttgtggagtagccatgtaagaaaagaagtttttttgctaataagtttttaatcttggtcaaatgaacttagatttagctaatcaaaaataggcattggagttgaaaggggcagttaatttagtgagaattctacttctatggaattagatatcgatttcctccccttttgcacccgagaccactaagcctaaggatctctaaaccagcatcactcctcatctagtggcagctacgtgcatgagcacagcctctgaaagcatgctgtcagatgccgggtgtgaaactctggcacttgggattgataaggctggcaccaaaaggagcgtccaccactggtaagagtagttacccatgactgacccagggtttcctccctctggtctccatgtctaatcattcccttccttgactgtcctcttccaactttcatgtgagggctactcaccctgcagatgtcttgcaggatatgacttcctctaggcagtcttccttcacctccaggtctgcattaggaagccctgctatgaactcccataatggcctattctttctccattcatgcacctgtcatactctcccacagtggttctcaaacagaggcaattttgcctctaggaaataattggatgtcaacctagtgtctaggttgaggaactctgctctactgtaattgtttactgtttctctctaacacggtggctgtcttgttcatatttgtatacctcgtacaatgcctggtacattctaggagctcaaaagaaataccgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaaataccgattaaatgactgaatgaccttcatctccactccacatctctggtttactgctagcttttgaccctgacaaaccctgtacttggctctctgtcttacccagcacaaatcctgtcttcccagaccaccatcactattctactctgcgacacagagtgcaggtcatgagtgatagaaaactagggccacctgcagtaaagcagagaacagagcacctgggctgcagacctaggcagagtcaagaccataagaaatggaagaaggcctgagataaatgggagcagggccagaccaccaggcaaattgggcagtgggactgtgcagctaggaactcaaaagctgattagttttcaaatccttcacatggcatttatttaattaatggacactgactgtctgtttctgaggctgcaggattcttttccccctttagtgaagtaacattgtatgatgaatactttcttgcaactgagtcactgcctatttgtttctttgtgcttttgctactgagttcacatgaattatgataagcttattttacatgattgtaaggggctggtaattctcagcaatttcaagaatgaaacgttcacaaagactttcaaaacagtgacatgacatggtttgggaattcaaaatcacagttattgaaaacattatttgatttattatattttacattttacatacagattataatttatgtttaaataatgtactgcagggagatggagctgggcaattttaccaggcaaccaaggtttagggggctgctagactttcaaaagtaaaaatgagttgcttttaacaacagctccatgatttcacccttgaattcctttagaactcttggatgaaggccaacctgtccctgtgatttatccatatccagtttgtcaactcagtctagaacattctgttcatttactactttttgatctagtacctctgcttctaaagatgattttgatatatttttctgaaaagaccaaggcaaataatttattgtgtctgctggctcccttttctatcgcccaaggagtattctgagcatctgcaaaggttctgctggatctttgcctggttccttcactttgattcctataaaagtctctcttatttttgctttaatgtcagtttcttatagaatgctccttaaattatgtgtgaacctttttactgggctttctaggtgggtttctctggttttccaactgaacttcctatttttttcaaagatgtctcttccttattgaagtctcttccttatctttgccttgctccttcacttcgattcctataaaagtctctcttatttttgctttaatgtcagtttcttatagaatgctccttaaattatgtgaacttttttactgggctttctaggtgggtttctctggttttccaactgaacttcctattttttcaaagatgtcccttccttatgaaggaatatgctcttccttgagcaattctctttgcactgtatctgtaaataataattatgatcccaacctccagagctataagggcaaaataaattaaggaacataaaggatttcacacaatacctgccacaaagaaagtgtttagcgtcggttgtttcttcttactttattggacaaagaaggtggggtagggaaaaaaacctagttcttctcacccgtgcctctcaaaatgattttttgaatcctgtcatattttgtgtttctgaaaaggtgtttggcagttaaccttttttaaaaaaaattcattgacaagattcttgaggtttattgactatttttcataattactattcatgcttttaaaattctcgtcaggtatacattatcttggttttccgttccttgcatcagaccgttaatcttacatttcttagggttattaaattacagtggctcacacacagacacctccctgtaccttctatggtatttctttttcttttctgctataaaatcattagcacaggaaatgatcatttgtcctagttcattccagggaggtattttgccaatctacaagtgaataaacactctcattattgctaattggcctgatttttttttagcttggccagtcctattccagtttccagctcaatctcattatccttgtcaggtggcccataacccccttctattgctatattttccattaactattgactatttccctatttccacccactgggcctctcctgatggcatttttatgctgaagctccttggatttcttcactactctaatactctgtttcatgaccctggcttcttactcttcattgccaactatctcaagagcattttcaattcctaagaaactcaacagtctttttttctttatacccctgtctcctgctgtcactagaatcctcaaattccacctgtctcttaggtactgtagactatagttatataatgaactatagttatctttctctcccctctcaatctactcctcacaccccaaagagcctcagaagctgtgttgtaaccaactctgcaggtgttgcttaggcatacgaaagtttgaaaagcacagatctaaagcattgtttactgctgagggaagaactgagtgttaagatgccatggaggaggcttttcattgtttaccctttttgtactgtttgaatttttttcaaccatgcacatgtcttaccattttaatagaaataaaaagaccaaacaagtaaaaccttcatcaagatcacattaagaaggaaaagataatccatggcgactgttcccagatgtttctggcaattgttcctcaattgtttacctgaacaattttccctctctccaaaatgacagataaggagaaaaaagacagaatgaggataatgtaatacactgacaaaaaattatatatatattttttggtcttctgaaaacatttgaggaaaagcatttgtaacaatagcttgtctagattcctctaaaatagaatggacacagcacaattaagagtctgcatgttttaactcttggaatgattttcttttcctaaagattacagctattctcacaccttctcaaattgaggctcaagccaaccttactattagccatcccactaaaagaaaatacaatggttaaaatgctagattaaagtaacacaaaacgcaagagactgctgccagtctgtttccaaaaagaaaaacaggacgacataggctgaaagggctcaccgaacaaaaacaagaagaaccactgagtgcatagacctcgtcccactcaaccaaagctggagagtcacagtcccctacatctaatgaaaacatttgatttccaataaattaaagtgatcaggagtccctgcatctatccatctaccacaaagaccacagacattcacttctaccaagacaccccgcaccttccataaggaaggagagatgccaaatgccccctttccacacaactttggacaggaaaaatgagcctgcgtcaggacacggacacaatttctcatgttatttttctgagggttgttatccatctctcagggttgtagaaggaatgaacacttaattgaaatttttaaccctaacactcataaaacatcatatgctcttgaaaaggattatggaaattcgcagatagaattatgtgagccatttcaagagtagtcttcatagcttgaattccttaaacacagtactttgggatgaagttagccaaatacagagaaacaaaacagttttcaagttttattctgggttatttttaactcctttttttttttaagaaaagcaacagaatttggaaatgagttggtggtgagcagaaaactactcctttcaatgacctcttcttcagctaatcttatcaaaggtctaatatccttttaatgtttataagtaaatgaccactcagataaactgcattacctttcccaaaactatggacatttacactgaaaattttttaaaaagcatatttgaaacaccaaaaaacatgtagctcattttaatcagggatgctatcaaatgtttgcatttaactcctgagtatagttttttcctcttagaaaaaaaactataactacttcaggatattccttactagtattataatcacaaaagccaaaaggtaaaaaagaaagcaacaaaccaaatctgcaaaaagaagagcaatttattcaaaagcgagtatcctgaagaatataagtgagacgttttcatcacattaaatgttgatacataatataccataggccattgcaaaaggaatgaaaacaaacatctaataaactctcaggatacctatcgagatcttgtagattaacatgcaaaaaaaatctcaaagctgaattgcacagcaagaaaaataatttgtatctctatagttaaacattttaggttaaaacattttagaaactttcttaacaaggaaagaaacttctctgatcttctttgtaaaatgtctcagaggaattgtattttggctaacactgcacaatggtgctagtaaagaaacagtccccaggattccatgcattaagaacactgggggatttcttagacaacaagaacccttacctggtcttctttaagcctccagcatccacatccatcctttaacaaggtaaaattgggtacctcagagagcgggaagagccaaccaaccttcaagacagctgagagcgtgcaaagccacagctgacagcctgcttccctctcctggggctctctgcctaagaggctgcacagaaaccaagcctggtgccaaatcttaatccctttgcagaatctcacgtggagctgcctcacctcttccattcctgcaaagtctcttcctgctgcacttccttctgaaaccattaatcaccacgacccactgaatgaagcccaatctcaaatcacagtgaaaaatcctgcaacgtgcagggtgatgagtgtttacattagctgaaatgaaatgatgtaatacccagaatcgagggagggctgcgatccagagtcagggcattgcaaaaacctctgtgaaacataacttttctacattacaaaaaaatgtccttgcgttttagtaatctggcttctgtaaatttaggattacttggatttttctgatctcatcaatttgttttccaaatagaaattcagaacttcccaattactcactgttttagtcaagtttaaaaaaaagggtagcaaatagaacccaaagtgtatacatgtgcaaagaacccagtatcaagggaataataatagaaggcagccatccaggtatgtgggcacctgccatgctgcagaatagcagagcctcccaagggtctaagtgccttcaaagtaaagacaactcctaagaaagacagtatttgtttaagccagtggccaatttttcttcctataactgatgatgaacaagaaaacccaggagttcctagccctattattgatgggcaactgctattgattactttaggatcttgtggtccatggttggggtgaaacaggagatgtgagaggtcatgtttgtgaagggaggggtaaaagtctgtcaacagcacctgcttggaagagagacctggtaaggcttcattgcagattagaggttagcttgagactagtggagatgccagaggcagaatatttggtttggatgtattactgatcataatagtaaattttaagaagtgtttatcctgtgccaggcaatgtgtaagcactttcatgcattatctcatttaaccttcacaacaaccctatagggtggattccattattgttcctatgctacaggtgaagaaggtgaagctcagagagatcaagtagtggtaagctattaggtaatggtaccaggtttgtcagcatgcttcctaaccaccagtttgtattgcttatgccagctttgtgagctacacaaccacagcagcatgctcaacaccctgcagagggacaaagtgttgctgcaaaagggtgtgcaaagcatgtgctgtggctccccaagtgcatatcctaaattcttggctaccattgtccagaagtgccagtatccgagctcctggcctaaatgcaaggcccttgcaaggaaggtggcacctccaaatgtaggggtaagtatcaaacgtcacatgaaaagagctctggcctggcccagttctgtcatgaaccaatgactttagtcagtccacttccctttttgaatctcattaatattaggaggttggggacaggcatggtggctcatgcctgtaatcccaacactttgggaggacgaagtgggaggatggcttgaggtcaggagttcaaggccttcctgggcaacatggtaagacccctcccccaccacctctacaaacattaaaattagctgggcatggtggtgtgcgcctgtagtctccgctacttgacaggctgaggtaggaggataacttgagcccaggagtttgaggttacagctgtgatcacaccactgcactccagcctggatgtcagagcaagaccctctctctacaaaagaaaaagaaaattaggaggttggacttagatgggctctagggttccttgcagaatacattttctatgataaatgatttttctttttttttttttttttttttgagacagggtctcgctctgtcatccaagctggagtgcagtggcgtgatcacagctcactgcagcctcgatctcccaggctcaagtgattttcccacctcagcctcctgagtagctaggaccacaggtgcaagccaccacacctggctaattttttaaaaaactttatagcaacagggtctcactatgtttcccaggctggtctcgaactcctgggctcaagtaatcctcatgccttggcctcccaaagggctgggattacaggcatgagccactgtgtttggccagcaaatgattttaaataatgtgacttctgggtgagttatttttttttaatcagaatttatgcatccaaacaagaattcgctccaatattacaagaatactaatcacctccatttaggcactgtgcttagggcactatgtgaatattccacttgtccttataatagccccagtaaggcaagtattattatctctattccacagatgaggaaatgaaggatctgagggaatgaatgatttgcatagggccacacagctggtcaaggggacaaatagggactggaggcagacctgtgagattccagagcccactgggctgcccatcattccaacagtgctcctgttactcagagcaatcctgagacacctcttggattcctttcaattcaacccatacattcaattataataaatacacattttgaacatgtgctccgtgctgggcactgcagagagtgtagacatatgggcctatcctccaagacccccaccctagtggggaaaacacaggcagaaggaggtaattcagctgcaagagagattggacagtgttacaacagagatataaaggacaatgggagcttaggcaagtgagaaattgcttcaaaattatccaaattactgctaatatgctcagtggtcataaatatccatctttaaagggtggatgtaattttggcttacaagcaaatcagagccaagactagaaaataaaatgggtcgtcaagctgggcaataccatttttggtcacaagctgggtgtggccgtaaaataaaagtgagatagattttactgtgtgacccaaatcagttctaaaggcaattcctaaagggcagctccaaaaatgttttgagcaatgataccatctccagattaaagagctacccaaagagattccaaaagacaaagcttccccagcacagcacttaaccacaccagaagtcactgcctgcagaataatcacatgcctgcctgctcactgtgagctcccaatcagcaggtccccaacgagcttgcttgctgccatgcccccaggatctggcattgtactgggcacaggggatggctcaacaaatatttgttgactgagagatattttgaacatgcaaattctcgattatttgttttttaaaattgtattattatttggccacatctagacatctgcatattgactgtgggcacattgccagttgagcacaatggccaaatgaagactatacttacccagtctgtcttccaggccaggccctggatgatcagcctgctcgtgacaggctactacagtttcccatcctgcccctgctagtggccgttctggcattcagtgctaagagaagtaagtgcagagcactgaatattccatgggaactatttaggactcatggtcagatgggctgactagttccccctttagtgccagccctggaagtcaggcaaccgctggggaatgtttctacaaactcatcaggtgtaggcagggtgcctcaatggacatgtggaacaccctgcagcccagctggcctcctaacagtcctgtctgcaggaactcgggatgactcctccaagcacagctctacccccaaacacattccaaaatatggactgcctctgagacgccacagattcctcaagtcagtaccggagttcagagtagatctcaggatagtcagaagccagagagggttttcctgccttctgtggtcatcaattctcccctcctcctccttgtctttttcttggttgtttgactttggttagcttactaattagccacataaacaagccagtaccagatggggcaaagcctctctaccactaggacccccaaagccaaagaattttgcagggtctaatgtccccccaaatcctgcctgtcctcatgtttaaataaatacaataatagtacccccaaacacaagattgttgaatgagaaaatatacataaactacttagaacagtgactggtccagagtaggtcctttatacattttatttgttattgttgttgtaatttcatactcactaggggcagagaaggagccagctgacagtgaggaggggtattcattcatttctgcatttatttactatgtcattctgcatgggtgatttttcctgtttaatgccacaaatggatttgatgtggcttctccattaaagtacataaaattaaacagcaacatacagttttaagatagattttgagacctgacttgtttgaaggaagccgcaattgctggtcactgcatttagctctgagattcttggcaaatgaaacaataacagaaataccctgaggtgtatcattggcattgtccaatcagaaacagtgtgaagatttaagcagcaagagaaatttttccctggctccaaattttaagaggaatttaaagctgggatgtatggacaccagacaagataaaagacaaagccacctcttgactcacatgaaagatgcggagacatctttccaatggcccagacttacaagggccctgagggctcacattaaactgtagctcaagacaagcgtttatggtttcacagaatgtcggcacaggaagggcctcttagtccagcgccctggttttacagaagaggaataggtggccggggatgggggcctgaagaggcagactaaagaggaccagactcagcttccagtccagttcttccctaccccaaactcttgccctctcccctcatttcttccaccaacaaaaagaagcttccctcaggcccttccttaggggaaacggcaaagctatggcagcccctttcacactgtgggaatcccttttctttaaacttggtcaaaaataaatttgaaaaatatttaaattttcaaagtccagactggagagcttccaggtggctttaggaggcttggctgcacagagccattctcagtctaaactgctggcagctactgctggttgtcgaagcgcactccttactccaaagtccaactttaaaggattgtatgttttagcagctaccattcttaaaagctttctaagcaccccatggtgctaagtgccctatgtgatagcctcctttaatcctcccaataatactatgtggaaggttctattattaagccaggacttgaaccgtgtccactgagtctggagtccaagatcttaactacaaactctcagttacctttacagaatgaaagtctttgctaggcaagaaaaaagtcggccaatcattactggcaacaggcccctgttgaagcaataaattttccgaggccaacacttggcaaatgtcattcagactgtacttggttatcctgaagttctgagggactctctggaaagatgatcttaaaattaggataattctttaattgtggcatactgagcacaacatcaaaatgaagcctccaaagtccaagcacacactatacctaacaggaaaaatacttctagcaaatcagaggaaactgctgttggctatctttaggccagaaatgagaggggctgcacagcagggcaaatggatgtctgggtgcaggttctggtctatcacatgctagtgtggaaccctgggcaaatggcttatcttccctagccctcagtttcctcttctgtaaaaggagatggtaacagtgcctcctttatagagttgtttagggaactgttaagcatatgttgtgggccccaaaaaaatgggctgatgaaaacgaccgacacctttatacatcagaatacagattaattattggaatcagtaatcttaagggtctttaattaggtactgctaaacatttgaggcagtgtatttttcacatacaccctgatgttattttatccaatacacacctttccaattcacaaagcaattacggaacatatgttatgggctcaccttaattcctaacagcaccctttattggcaacattcagattcttgaccaagaatctgatgcaatgcaaacagagaatgcaaactccaattctctgtgattccttcttatcaggagcttggttgcaaaaagaaataatcatagagaattgccaaaactatgttcaccttaaatattcctcttaaaattttaaattacaccttttgatcaagtcagatcatcagaaagccatatacctaaaaatctctgtatttttgcttcacatagaattgcttttaatgaatttgttcaaatgtttgccattggtttttctacaatgtcctgtagttttcagtggataagtcttgcatcttttttgataaatttactcctaattattttattgcttggatgatattataagtggaacttttagaaattttatttccagatggttcattgctaatgtatggaaaaaattattaatttttgtgtattgatcttgtatccacccattggctttcattgacagaaattacaaataacattcattcattcaaaaatacattatgagcacctactatgtctcaggcactgtgctgggctctgatatatgatgaagaacacacccctcaaggagcttgaggtaaagtagaggggaatgtagtcacatgaggtgcactcccaccactgagaagatgctgtaagcgctgtccctgtgattgcacagggcccctccctggggaccaaagcacaagcttctctccagtcccgggagcaggaaaagctgagtatccccctagcaaccattctattttcatctcgtgcccactgtgaattgtagagctggataggttttctttgcttcagttgctaggaagcttaggattatgtggtggccaaactctagccaatgacactaaggcaataattattttctgttttaccatattatttctctttgtcctaattttctcatcttcttatttcaccttgttttaggtcgatctttgtaaggtgcctcagctttttcatggagagaggctgggaaggaaggcattgcagttacttgttaattcctcagaatgttaatttactatgaagatctactccctatagctgaagttccactgagatgtgattatattacctgagtgaatgcttatattatctggaataagaactgtttcatacttataaggttctttaatctactcttggcaggtctaaattaaacaaagtctattagttttcttcagacacactggaagtgcttctctggcatcacttcaataaaatttcatgcctgcacaagcaggcaaggtggaaagggatacctttcccccaagtcatctgagaccaagaggcagtataggcagttggactctgaagttactgggactggggtttgaccccagactctgttaattacctcctagctgtatgattctggaaaggttacttaactactctaagcttcagtcacttcatctataaagctgatacagacctacattattgattattagtgtaatcaagttaagtaaggtttagcaaatgcctgaggacatgtctatttaatatcatactagaggtactaggcagtgtaataagacatgaaaaacaagccagtggtataaagatagcaaaggaagaaatatactcaactgcatactgcagcttggttaaaatagatttctacctaattacaaaaataaattccaaatgaatgaaaggttaaaatgtaacaaacaaaacatttaaaacattttgatgagaataccttcacaatctcagcataaggatttcctaaaatataaaaagcagaaatcatgaagaaaaatgttcattagatcacaaagaaatttaaaatttctacacaacacatgataatataaacaaaactaaatgaaaagttatggattagaagttggtatttgtaacacatattacaggcaacagaataatccaaatatacagagatctttacaaaccaagaagaaaaataaatagaaaaatggcaaataggtaaaatggaaaaagatataaacatgtaattcatagaagcagcccaggtagccaataaacattaaaaatgctcaactttactagaaatcagttaaatatttaaaaaaacaagattgagataacattttcctcccataatctagccaaaatgtcaagtttcctatttactttcatttgaggtgttccaacaattcatgtggcaattgtccacacagtggttagctctgaggggagaggagagagtaggagcttcaactgtttctgtaacattttatttctttgaagcaaatactgcaaatgtttccacctgcaagtctgggcagtggtacatggctatttgtcataagctccttgtgctttcccagtattcttgaaatatccataataaataaacacaagcaaacaaactatctctaaaacaacctgttgatattaagaaacaacagaatacagaagtgcctggataactctgtttttgagagtgcaggctgggcctacaatggaaacagtgtaaaggctggtgaagggggccagtgaaaaggacaggtgaatgatgtgaggaaacacacatatttcagtaagaatgtaggtctggaaaataaagtctaaaagcagagaagctgactcggaatccagagaagtacaggcctcatttgttcattcactgcacaaatagtcattgcactgaaatgaaacattttacttggtccctgggctaatagcatgtccaatctcatggtagagactgactcatgaaagaatcacaactaatagctgatcttagctaggagaaggggtgtggtggtctaggaaggcttccctgagaacataaactgaagttaacaaccaggtaaaaagaggctggtagctaggagagtgtgtcccagacagagggactagcacatacaaagggcctgaggcagagaggagtttggacctgtgaggtgttcatgcagaatctaaagacatctcaaggttcaggggtgctgtgagaatgggcatttaaatgagggactaaggggagtgtacttaggtctttctcaaagaccaaagtaccagagagaactcatcaaaggtgaaggacgatgggtaaaaggctgaaagacagctgaaagtaacaataaaaacctagcaagccaagaaataacaggagtagttaactgtcctgcacacagttcataccctgggattccccatcacaatagtaaaatcagctataaacttgaaatgttaaaacaaatcggtagattgagttgcagaggacacagtggagaaggaacattggaaactcctccaaggaaggaataggaaagttccttgcatatgctttttggagaaacctcgagagctaggaggcagcaaagggaatcatgtcagcaacagctaaaaaaccaacctagaagcatccttcctggactctaccccaggctaagcctgtcacataaaaaaattcagaagtcagaaattccagttggcttagggcaagaatttttcctgagggttcttgaactggctctgctataaagaatagaagataatatgtttttaaattttttatgttaaattaaatttctttttttaaattatactttaagttctgggatacatgtgcagaacgtacagttttgttacataggtatacacgtgccatggtggtttgctgcacccaacaacacgtcatctacattaggtatttctcctaatgctatccctcccctcgctccccaccccacgacaggccctggtgtgtgatgttcccctcccctttcataatgaaaaccgacatcttgggattaaaccaaaagaaataaatataactcaatgcttttccctaatttcatgtcaattccaggctccagagaggacattaatgttttctcatttcaaataatgcttagttctttggtgggagagcttcgtgacctcagatttgctccaatgctttctcttaatgttgtgatgaaaatatccacttgactcaagtgacattttcctatttgccatcaagtccaagtgtagccccttgagagaaaaagcaacttggggctattttttttctcaaaaattttgtaacggctaccaattacaatttaattaatttaattacagtttaatagaaatattaaaactctgtccacattggggaaagtgaattctaattacaccgtggagggatgtagcacctacagctgcagatttgggttctgcctcttcccagatgttactttgcacacatcctcaacttccagaagcccattccctgcagataaactaagacaaaaagactacctcctagaggtattgttgtggaggtcagatttggtaatgtttgctaagcatgaaacagagcaagcatgcaaaatgttgtagctattgccaatcttttaaagaatgagcaggccacacatggtggctcacgcctgtaatcccagcactttgggaggccaaggtgggtggttcatgaggtcaggagttcaagaccagcctggccaagatggtgaaactcgtctctgctaaaaatacaaaaattatccgggcatggtggtgggtgcctgtcatcccagctacttgggaggctgaggcagagaattgcttgaacctgggaggggaggttgcagtgagttgagatcgcaccactgcattccagcctaggtgacagagcgagactctgtctcaaaaaaaaaaaatgagcaaaaagtgattttcaagaccatgcttcatgttttctgaggggctaatttgtacggaaaagcacaaggcaagaattgcgacctgaaaacatgcaatttttcttcataggactaaaatcacctttaaaagggggttatagatgctgaaaacaaaatcactgaagtcaccacaacctgctcatttcaacatataagaattattaaggactaaatgctgcacatcactataatattaaattcccgaggctgccattctaatgcaaacaaatctatcagatggcaatgtttgccaaaaagctgaaagagctttagaattcaattcagatatttttaaaaagtcaataaggtgccatattatgtaactacatcatcagagactgagacagtaacccataatcaaataaagatttctgcaacagatgtctaaatattcacattaaatgtaataaataaagactagcctcacacaagttcaactaaggttttgccaccaaatcctgtgtttgctgtgaatttttaaactttgtttttaggtcttttgctttttggaacagcaaattagggattctgggtgtaaaagagtactttttacttttaaaataaagtccctatcctcagatattttaattttgtatctttatctcgcagaaacaaaatctcaaagtgcacaaagatgtaaaccaatatttattccaacactgtttttttgtttgtttgtttttttgaaacagtgtcttgctctgtcacccaggctggagtgcagtggcacaatcatagttcactgtagccttgactcctgggctcaagtgatcctcccgcctcagcctccggagtagctagtactacagatgcatgccatcatgcccggctaatttatttatttatatttttttggcagacttggggtctcactatgttgcctggactggtctcaaactgctagccttaagcgattctctcaccttggcctcccaaaggtctgggattacaggtgagatgagttggaaacaaccttaagtgactgccagtaggaaaacattaacataggatgagaaattcacactatagaattcagtgcaccattgcaaagaatgaggttacctagcaaagggtttctcaacctcagtactaaatattaggggctggataatgctttgtgaggtgctgtcctgtgccttgtagaatatttagcaacatctctggccactacccattagatgccagtagcatcccgtcaccccagttgttgacaactgaaaatgtctccagacattgccaagtgtcacctcgggggccaaactgcccccaactgggaaacaccagagcgaatcacattcataggcagccctgatacactcataagtgcacaaagcaaagaacaacacttgttacataatgcctgttttatttcgatgagatatataattgtttatgttatagaaaaagtctggataggtatgcaaaaaacagttaatacaatgagaaagtgagggaactgtgggtgggaggctttcctcttgtactttatccacttatgtgctgtttcagcttggtagattttaatttcagaaatgcagtttctgaaaataaacatgatacacaacttcacagtaaagacaaaggtttaaacgggtgggacgggaggagtcttgtaaaaggatgtgtggtcaggataggaaaagcccccctcaaggtgggtgtccagcagagctcatgggacacccacggctgccagcagctgcttccagcaccctggccttctaggaggctgaaatcattatctgaccatcagactggaagtattccagtctgcagaataacagtcctccaactgtacactccaaaattctcctgaggttttttatttttttccttcatggcagaaattaaaggaatcctgccaggattcagctgaaagagcaagtgctgaaagattcagttctatttccacctactggtaggaaaaaagacaaccatgcacagctcagaaaaggcggcacaacctccaatgctccattcacactgacccctccaaccctggaagacctttgtcctctgaacttgtactgcaacaaagcaacatctcagaaatcacctgacagtaatgtaagtgtaactagattcaaaacatcttgaggtgtcaatcaaatcaaccagggtacagtttttataacatctgtctttactctaagccaggaattctctcaagaaaacagataataacctcctactaaacactcttctctctaataaggatatcccgtaccccttttatttatttagctcttttatgaggctctctagagctaccgcagaagcagcttagcatggaggtaacacacacacacacacacacacgcacgcacacacacacaaacacacacacagggccaatggtcaaaaagacttgaatttgggtctcagacttttccattgactaggatttggccttgagcacatcacttaacctctccaaggtgccatttcctctcctgtaaagtaggcatcctaatggtaacacctcacagggctgttgtcaggattaaatgaactcatgtattcagcatggtacttgatgcataggaaataagcattagctgtttttattacacaataattccactgacttccacccattttccatctgaaaaactgaggcaaagggtgatactcaagagcaaggaaactctgaacagcagaacgcattctgaatgtgacccaggtcatgctgcaggtctccccaaactccctgcctttcccagttcactcaggaagaggatatcatctgttgtcataacagaagtgccagcatacttgtctcatgacatacatatttccagtcagatgatccaaatattcccttcattcaaacaaaggtagcctcagctcaaaacagctagacaccgataccaatgctttcacccaatgtcacttttactgtaaagaacagaatgccagcagtttagtcagtagaagtcagcagtagaattcaatctttcaatgtgaatgactccctaaatccacatttacaaatttgtcacctaattttacaccaattatgtgttctcaagtaaaccaacatggacattaacatgttcaaacaaaattaaaattctactagcccaatattttttcaatgtcttattgatgtcaatcatttggaaaggatgcatctgccacctacttcgtattagatggaggggagaagaaggtgacaaggcacgtgctgccctcaaggagctcccagtctagctggggacatgggcacatccctgactaactagccattctgctaaaggtgcaaaaacaaagcactacagaaccgagaggagagagaaactaattgtgatggtgaatgtggggattccagaaagatctcacagaaagataattcctgtgttagttcttgaaagataataattaggccaagaagagaaggggaagaaggcaggcagagaaaggaatccacaaagacaagaacagaaccccaggcacttgaaatcctactgacattgtagaaaacattatgtgtagacccacatttacaaggcataaattgtccagttgaggagaggactataattgattgatatggctgtctcacttaatattatacaagttattctttaaaaaatcaatactaagccctggaaaatggatcaatgcaaaattgggatctgaggaaataaagcaattaatatcattagtaactagaccaatgacaccttttaaaaggaaatatatttaagcattagttaagtgggttttggtttatcactatgaaatctatgttctggcaagatagtatcgtaaagcatttgagtaattatattaatgttgttctaaatggctgtttacattttggacttaataaagatactcataaagcagttccatttagagataaaaatcaccagatttactaaactcaggacatgaatagaaaatggatttcacattgcatgccaactctgatcaactggtagaactgtttgggatgggccctgtgttatggctcacacctatggtccaaccactttggaggatagcttgagctcaggagtttgagaccagcctgggcaacatagggagaccctgtctctacaaaaaataaaaatgaaaaatagaaattagccaggtgtggtggtgtacatctgtggtcccagctactcaggaggctgatgttgggagtatcacttgagctcaggagttcgaagctgcagtgatccatgtttgagccactgcactccagcctggctacagagggagactctgtctacaagaaaaaaaaaaaaaaaaaaaagaactgcttggtatgatacattatgaaaaaaattttaggccctgtctgaacttgaaactgacccagttttcccatagaaatgatatttatgggtcactgaataaacataaaaattggccctccatcttaacacttgaaacttgtatttgtcttaactgagtgccttcctcaggaactgaccctcagacaagggactgaaactcaatagatcaccacaaccagacagtgagatatcaaatccctcattgatcatgattaattccctaattcctgttttcccgccttctgtgctatataaacaccctaatttttgtcagtccaggagctggatttgaaacctcatctcccatctccttggttgcagcaccgattaaagccttcttccctggcaatgcttgctgacttggtgattggcattctgtgtggggagcagtaggacctaaaccaaacctctggtgttttggtaacaaattcatgaaaaacaagtgtcatgattagtagcatctgccatgggtgcagtgggctggaggtagcacatgtgcccagtattgccattcctgacttaaaaccctaaagtggaagggaagaggaaatgaactaaattgatcgattggcttctatttattgaatcataaaatgctgtcttctccatactggttttaactgtcttctctcaattctgcttccgtatcttcacccttccacctggaatatttccctgtctgacctccttctacagacccctctaggtctaactcaagccccactttccatgaagccattcctgacaatttccagtcctcactgagcaccatataactttagacataacatttagaagtttataaagtaagttggttacttggaattcaaaacatgtttgctcatggaaaaggtaatataaatgctgattagtatactatgctagtctataaaaatctaagtaatgacatggggaaaaacaatgtatgtgccagaatgttcatttaaaaagaaacgatcatgaactgcctggggttggtgggtggggtggtggggggagcagttacactcctagaaaatgctggaagtttggggtgggaaactggatatggaaggatgaagacaggagccaggataactggtgtgccctggggtaggaagtggggggcagagagggaaagaaaacaccctgtgctccctgacaaaagaggctctgcagctggaaatgctagaggaggggcccaagctgctactgagagggaaggtgtacaccctctcccccatcagcaccatgggctcttcagcgatctccacattgctcaccagtgcatctgtgtgggtgagtagacacttctggtgagagctcaaagaggaaggccacctggtgacattgggtcagactcatctaaccctcttcattacataagaaatgaagacagaaaactcttattgaaattctagggatgaaacataacaaaaaataagtaagtatcactattgatgcttgaaaataaactggtctatttgtaggagaataaagaaataaatgacaatttgaaagagacattctgaagagttcctatgctttcgtctgtataggtcacaaagtcaaatatctataggagccaagcaaataaaagaaatgggtagcctgtaatcccagcactttgggaggccaaggcaggcagatcacaaggtcaggagattgagaccatcctggctaacatggtgaaatcccgtctctattaaaaatacaaaaaacttagccaggcatggtggcgggtgcctgtagtcccagttgctcaggaggctgatgcaggagaatggcgtgaacctgggaggcagagcttgcagtgagctgagatcgccccactgcactccggcctgggtgacagagcgagactccatctaaaaaaacaaaaaaaacaaaaaagaaagaaagaaagaaagaaatgggtaattcaggcaaagtggtggaaataggaaaggtaaagagtagagactatgggccctgtccaagaacattcaaattcaaatgcaaacaataacaacagacaaacattaaaggagtatcatttcagcctcagtaacttctctcatgcacattttatagatgaggaaaatcagaaagagttttagccatttgcctaaggtaagaaactggcagaactgggagccaaatgcaggcagaatgatgctggacctcctgaacagtgccctggagcacagctcttactcaaacaccatccagggtttttcagctcctcaatgcaatgaaatgaaagagaaacgttaaaagagacaaaaatgggaagataagagttaatactaagagagaggacagggccaaataagagtgataacaaatagagggggaggggagcactgagggggaaagaaataggaaggctaggcacagtggttcacccctgtattcctagcacttttggaggctgaggtgggagaatcacttgaggccaggagtttgaaaccagcgtgggcaacacagaaagagctcatctctacaaattaaaaaaatattagctgggcatggtggcatgcacctgtagtcccagatactggggaggatgagtagcgggaggatcacttgagcccaggagttcaaggctgcagtgaactatgattgcaccactgcactccagcctgggccacagagtgagagtgactcaaaaaaaaaaaaaaaaaaaaacgaaaaccaaacacacacacacagacaaaacccgaggaagactttctatgtaactagacaaaggcagaaagagagtaaaggaggcttaagatgtgtgcatatatttcaggaaagtcagcctgaggtggaatgtgcggggagtaagaagtgaggtaatgaactcctcttcccagaggagaaaaaaagatgaagagcttcagtgatgcctctggtttggaggaaactattcctagccaggatggtgtgagagggacacggaagcaggatgtgagcaggacactccttccagcccttctggtccgtgcatgggtcaggcccaagctggatgactacgtcttggtggaataggggttaatttcacagtaactccaggatcagggctcagccgcagcacttactatctatcaggtcttgagcaagctgcttagccttcctgaacttcactttgttcttctgtgaaaggggaagctctcctcccagatttgttggcaagattaagcatgcggttgggtatgaagtgtctagcacggtgcctggcatgtacaaggtcgccatcaggagaagcggattaatgttggccagtacagccaaggaaagcttcatagcaaaagagggtcctaagatggggaggatttgaagaaaaaagagatatgggaattgagcctgtatgtagggaaaagatagaagctggggagacatggcttgaaggtatagaataaacaatgaacccagatcttctgtctgtaagaaccatggtggaaacttcccccaattaaagtgaatagcaggaatagtcaagaaaagtgttcaatgtatagaggcatcaaattgtggacaggcttggaagttttgctcaaaaagcgtatctccatgctgaaaatgccttgaaggcaattgacccagtaactgaacaattagagtctagactgagaaagtaataaaggaaagagagaaggggccagctgagaggcactaggaagaacaaactagcctgtgctgggggatcagcattcctgggaaagagagggaagcccatctcttcctccttaggatggagccattagcagagaggggtgggttcagtgagtggaatagcagatatttggggaccccttacactaatgttcttaacatatatgctgaacatttacttgttggggggcaaggataaaaactgatcctctattaataagaaaatgtatgcctccttctttatgtttaaaaataagggattattgattgattgcatacattactattccaagccaggcatcttaactgtttaaaatttagataagaagataagtcattatcatggcatgcatttttccattttaaaattggctgacagtacctcatagtgacagctgaccattggctggtatatgcctgtggctgtagggtacagcacattacctcactccttggagactagccaaccttgataagcacgctttaaaacagtttttaattgaaggaaggaggcttatataagaaaggagaaattcctctttccctattcattttaggagttgccagttgagctctgagttaactggtactttatttccaataacggaactggagcccccagagagctgtcctatagacctggctttggttagactccaccccgctcctcagaagacgcactccttaaatcctgaccaccctctgtttgctcaagtgatagcttcaaaaagaggggattgtctcagatgctgtcaaaataatccgctattcaaatgtctgtcctctgcttccagaactgtggttcttaaatcccaactctttggatattaacctgaattctgacctagaactttctttctgttccatatctctagtctgtttatttgtttgtttgtttgtttgtttgtttttagacagagtctcactctgttgcccaggctggagtgcagtggtgtgttctcggctcactgcaacttctgcctcccaagttcaagtgattctcctgcctcaggctccggagtagctcggactacaggcatgtgccaccactcctggttatttttgtgtgtgtgtgcatgtatttttaatagagatgggttttcactatgttggccaggctggtcttgaactcctgacctcaagtgatctgcctgcttcagcctctcaaagtgctggaattacaggcatgaaccaccatgcctggtccctcggtagagtttctgctttggatcttgacctcaattccatgaattgaacctatattttgccagcttgccatattttttatttggggacaactgtatagcattaaaattttgtgttccttttgaaagcagcctgatatggtgggcaaaaagatgtattgtagtgaggaagacctggactgaaattatagcataggctaggacttagggcaaattatttagcttctctgagttgcagccttctcaaccataaagaaggaatgtttgtaaaggattccttttctttcactcctcattcatttccctcattcatctattgaatactccctatttgccaagctgtgctaagcacaggggcagggcaagagggtagtgaataagaggtaaataaaataccgtcctgtccttggtgagtttgtggtcgagtagaggaagataggcatgtaacaaattaatacagtcgagtggtactagtgccataaagctttatggcagtgttgttaagcagactgcctggctctacatcctgtctctactaattattagcttggtaatccagtgaaacttacttaaccactctgcgcctcagtttcctcacctgtaaaatggggataatatagttattatgaggacttaattagttaacacatgcaaacttctcagtgccaggcatatagtaagcattccatacatgttaatacagtcattcctcggtatccatgggacattggttccgggaccccctcagatacccaaatccacatgcttaagttccttatataaaatggctatttgcaaaaatccacacacatcctcttgtatagcataaatcatctctagattacttataatatccaatacaatgcaaattttatgtaaatagttatgttgcattgttttatttgtattatttattgttgaattgttatttttcccccgaatattttctatttgtgattgcttgaatccgaggatgcataacagagggtcaactgtactattacaatggtggagaagcgtggagtatgatgggagcacgaaagaagcagtggtcaattctattgctgagaaggctaaagaggggcttcattgagatggtgtcacttgggcttacttttgcaggaagtttgggagtttttaggtgaacaaaagcagagtgggcatttcagacataggtgactgcatgagcaaagagatgggacagatgtgagcaattaaacaacctgggactggcagagccccacttctgccagtctgcatagaggttacaggggagggtgcaaggcaggaggacaaagcctgctggaagaggacattatgtgccaccatgggggttcagcccctatcttaggagtgctggttagaaaccatgctatgtaacttctgtttgcatgttccccttccccaagacccatactcctcccttctccacctgctccaagctctggatgctggaggctggcctgtaaacactgtaccagtctcccttatcctcatccaaaggccagcactaacccaggttcagaaggaggaagcagaggaagaaggagtatttcttttactctgtactttcctgccacttgctgcaggctagatgactctttccactaatttcacatctggccaagcagccctctttcattgcacaagtaattgctccctcctcttcccccttcaggccctttgctgttagccctggggtgttgctcaggccttatttgtgtcccacatcctgccacacttttgtaaatatcaccagcattaaactctcttcatattgtccagtttgatgtgccatgtgtatcctgccttgaacctgacttatttaaaggaaacaaaaactctggcttttaacaaggaatgaatgagatgatcagatttgcattatgaagaggtctttctggctcctgggttcaggatgtttgggggcagcaagagtaaaggcagagcttttaatggtgctttctgaaccaggaatcctggttaaatatgtagattccagggcccacctccaaaaactctgattcagtcagctagaaacagggtacccaaatctctatatttaaataagaagtccttgtgattatgacagagtctcatggttgtccgggtcactaaccagtatgttaggaagatccagcagagatcaagaagaaggagagaatatctgaggtaacagggtctggtcctagaggacctgagggttggggaggaaaatcagaagcagagataggggttttgttttgaagaggccaagggacaccttttcctttaagggtgaacaaagaaagcaaagtgagtgtaaaaaggaagttgaaggaattcacactttgtaacctcaattccccctggaaataggagacaaagtcatatatggagacagaacaggaaggcaaacgtgcgaatagctggagtgatgcaggtttggaataccattgtgggtatgggataaagagtgactacaagggacattttaggactgcttggtggagctgagataacaaaccatgaaattgtgtgtcatccaaaagtttagctttgtcatttctctccagcagtacttagccgtctatatctagaagtggagaagtcagtattagattgatcccagtcgggaagttgcagagcaggtgtaatggaaagacaaggggcccaggatgttgaaatcacacgcaagcatgggaatagtgcattaaaatgtgagggggagcgtccaaggaatgctgtccttggtcctgaactaacgcacagaagggcatggccacttcactgtgaagttgggagtgagttggtacatgtctccctgcctctccattaatacctccaccataccagagttagggtctcaaaagatcgtgctccaagccccataacactgtgaattgtgtgactataggtcttgtagtctgggcagcatcatttgttgaaggatacaattccaacagccacaaatattatttaaggaattaattgaataaatattaactgagagctatctatgtgccaagcattgtgcctgatgcaagggacagaacaatgaaaaagacagagaaagctaattcacaagctaaatcttttatttgcttttgttagagaatatcagaggggcccattcaccctttccctttcctctccaattccttttatcctttagctgctgcagaacactcttctgcaaaatgacctccccaaagtttgctgtctccacatagatctttgtgatttttgtgcctcttctcctccccctgagagtatagattgttttatagatgaacttagcttctctctctcagctagccaaaatactgcctctttaaagagaggacactgacaaagcaaacacagacttatcttttacaggttaaaggagggggaaaggctattaacacagcaatttttgtgccttaatggttatctagaaagtcttccccaagcagagaggttggccacctcactgactctgtcaaatggccatgggacattcccccaaataacttgaggctgagataccatttctggaattattccaaggtccctgctgccctctaacagccaatggtcctactcctccctgacgctgtgggttgaccttttctggcagagtgtcaatttccaattaatactgaaaacattaattaaaggccttcttttgtataacaggccctgaacaaaatactggagacacagagataattaaggacaactgctgtctccagagatttcataattttatgggggtaggcaaatatgatgcaataagcctcatgcctgcgatctgactaaagtacaacagagtgaggcctgtagaattcatgatgataatccacgggtcatgtctttctcatccaggaagaaataaaagcagcaacagcataaggttttgcacacagcacataaggccaagagaagattggccatgattctgggtctaagcttggaaaacaaggtttaagtttctccatagagcaagtgtcatacatgagctatggccccagagccgagaggtcaaagggaggaaaaggaataaatggtatcaccaatccagtgcaatccaagagtctgggaccaaattggtggacagttgaaacaaagacaatcaggttccagtgaccagggaagacaaaggtccagaatccaggacgggtgaaggcaggagttgggtgagaagctggggtgggaaataaaaatatggggagtcaggcttaggtgatgtgagagccagagacaataaaaataggaggaggcagacacaagctaacagaggaaaaacagatagtttccctaaggagcaagtgagaaacagaggctaggactaaacctggtgccaaatactcttgagtttagaacaaagaatgagaaaaagtttttggctcataccctaagaaagcagtcacagaataaaacatcaataaacctgaactcccaccccagttattgctcagggctctgccaggaaaaggtgggacacagctgaaaaagggcttgggctactctgtttcttactgcacagggactctgaatgctccctgaccctcaacaagcacagccatgtaatgaacaattcatgcaacccaggttctgtactcagcacttttaccacatttgtttatttaatcttaacaaatccacatggtaaagattattgtcctcattttcggatgaaagctcagagaggtcaaacttgcccaggatcacctagcagcaaggtgacgaggctgggacctgaaacccagctttgcctttgtaaggctcatggtctttcttttattatttttttgagacagagtctcactctgtcacccaggctgaagtgcagtggtacaatctcggctcactgcaacctctacctcctgtgatcaagtgattctcccacctcagcctcctgagtagttgggactacagtgtgcaccactatgcccagctaattttttgtagagacagggttttgccatgttgcctgggctggtcttgaaatcctgggctcaagtgatccacctacctcagcctcccaaagtgctagattacaagcctgagccaccacgtctgaacaaagctcacgctcttaattgtccaactagcctgacttattatgactaatttgtttccaaactcaccattgtgatcactcttgagttgaagataagacaaagagcttttacagggatagaaataaataatgtgtaaaaacatggagggcaaaaatcctttgtacacagtggatagccatgatgttaagaaatatcaaggttaacaaaatgagtgctgaagcccctagacctgaccccagtccacctctcagtaccctcacccactccccctactcctgctcctgcgtgtctggtcttttttcagccccttcaatgtgtaccatgctccttcactcctcagggcctttgtacgtgcaacatgctctgcctgaaaaactctttactcttccttcttctccaccctccttgactttaactaattactattgcctcccaagtacagatttgaacctcactccctaataaaagccctcactggctaccctcatcgcccgtaggttaggccgcataaaatcctgcacttttttcttcaaacacttctcacaactgtaattaatttatgtatgtaatatatcttcccctcactaaatggcatgctccaagagaagaaccacatcgtgtttgccactgtactcccagtggcaagccacacctagcatctctacagatgtctattcagtgaatcaataaataaggacaagaaaatgtgcttaggataggcaaaaagcagtgtggcagttgctaaaaccttttaggaagaatcaattattcactcgctcatttattatgttcacgtggcacatattagaatgcctactatgtgccaggctctgttgtcaatattccatctaggatggtggaaacgagatgtggcaatgcgatagcaagggccttggaagatgacatgaacatcccatgagagtcagggagaaagtggcagttcaatcatccactctcagaacagagcgacgagaaagtaaaattcccccctttcccacagaagaaggtgggacttccacatgggaatacagcagagtatgtgatgtcttcagttaaaaacaaaaccaccataaaggaaaagagtaggagggagagtggtgagtgaggcagaagtacacagagcttgcgcatagcataggaggtgttctgaagaatgggaagaagaggcattaggaagggagcatgtgggagaggagtccaggtgggaaaggattggggattggatcaaagacaacaggaagggaggcttggacatggagaccagcgaagagttgagaaggcaatggaaggtgagtgccagtgggtaaagagaggagatgaaaggatgtgagaacagcagggaagatggaacttagctagggatctgctaatagaatcacatgttttttatgaagttcagaggtacagattaaagagtcccatcatgattcatgtactttcccggaacctgatgtgttgccaagatctgctatagaacatcatggtctggagggtgaactcagaaagacaacagttgactatgtcattcagtggcaagcatacaaatctgggaacaatcttccagcaactgaaggtggagataagcccccaaaagatattactctcagattttccaacattctgcttgagggctaattgcattctctctgagatctaaaaaaaaaaacaaaacaaaacaaaaaaaaaaacaaaaccaagaaaccaataactaacacttattgagtgtttaatatataccagacatggtgtgaattatgaagtgctctgcaaattctcatttaattctcacataagtccaataaaataggcacaaaaagtctaatcatttgagctgggcagagtggactgctacttgggagattgaggcaggaggattgcttgagcccaggagtttgagcctgtagtgcactctgatcacatctgtgaatagccactgcactccaatctgggcaacttcatgagatctcacctccaaaaatgaaaaaaaacaagaaggaaggagtctaaccatttagcaaatataaagactaagaagttagataactgtgtgaagtcagctcacaagtaagagagctaggacacaaattcaagccatctgagtccagtaccaacagttttaaccaccaacctatcaaaataatagtagctaactcatatctagtgcttactatgtacatcaagtattgttcttaacattatacatttattaattcttttaatccttataactctgagatagatactgctattctgccattttaaagatttggaaactgagacacaaaggtcaagaaacttgcccaacggcatgtagttggaagaggtcaagcctggattcaatctcaggcagtttggctcaggagtttttggtctaactcaggttgctgactcctcccatgagctgtccctccaaatggtgttataagaggcatgtaacagcaaaaactagtttttgcacttgagctttcagtgtgctacaatttaaatatattggataaaactttcacttccttatttgcctgaacaaaaggtagacagaaaatcctaaggattaacttctttttttttttttaattccttttttagtaaagacaaggttgctctgtgttgcccaggctggtcttgaactcctggcctgacaagtcatcctcttgcctcagcctcctaaagtgctgggactataggcatgagccacacctagacagtgcattatcttcttgatcatgtaagtacaaaagtcagtttctctttggctaatggtatgcacatcataagaaagtctggctattgcttggtgtaatgttaatgaaaagccatcaaggagttctcatttgtcctggacaccttccttaagggcctagcccttagaacatttcagtccccatccacagattcatagtatgggtttgctattgtctttcccatttccatggactcctggggaactgtcagttgatcacctgcttaagctaatctttacatctccaatagaagagtttcagttgcagtacatcctgttataatcttacacaactggtttcctgagctttgtctaagtgagaaggaagttttgtggaaagttctctctgatcaggaagaaacaaaatacaaccaaaaagcaggttttgcttgaaacctgacatgcagagcatccagtgcccttgccccacagtttcctcctcgctgaacccctgggaggcagtacagtacctgcttagtctcagtacggagactaagaaatgctgaaaggtttcataagttaaataagggcaggctgggcgtggtggctcacacctgtaatcccagcattttgggaggccgaggcgggtggatgatcattgagcccaggagtttgagaccaggctgggcaacatggcaaaaccccatctctacaaaaaatacaaaaattagctgggtgtggtgacatgcgcctgtagtcccagctacttgggaagatgaggtaggaggactacttgagcctgggaggttgaggctgcagtgagctttgatcacaccactgcactctatctagcctgagtgacagagtgagactgtctcaaaaaaaaaaaaaaaaagttaaataatgtctaagtccagtaattgtgcctgggttcatgctaacgttaatgtatcacagctgcaaaaaatatttcctactttgcaatcagagagtctaggagttcaatataaattcactaatccttgcaattttcttgtaaggcaagccacacgagtactcattcaaggcacagggaagtaaagtcttgccaagctcacaaaactaagaaacagacatttacagcaagctaatcttgtttcccatactcttttatttttcatacctttattcttttctatataaattaaaatttctaaccagttctatcagttgtaggcctcacataattccatttccaataataataaaaatagtattcctaatgtattgaatacttacttggtaccaagaactgtgtgcctttagtacagtatccatgtatcacctcactgaagtcttagaacacataatgaaataagtagcatgagtatttccattacacagcttaaagagcagaagcttagacaaaaaaaaaaaacttgaccaagaccagcatgtagcaagccttaattaaaagccacactgcctctcacatcacctaatcctgacctacataccacatgccatcaaaatcatgcaagttaaagacctgtccatgtggatattgttttctgctgcctttttaagacagcaaacaaaaaacacaaaaaacacttccactataatttgatataattgaagggtgtaacaaatttaatcaaacccaggtaccttcttcaaaagccacaatagaaactaacaaacagaagccaccaaggaacaagcaagacgtgaacaccaagtgcttgggttgaaatagcaaccactcactacattcactaaaagagaaatagaatggggctagaaaagcagtataaatgtcagatgttttgaaacactaataaatttaccctcaaacaagttagaagttatgttaaatggagtacagaggtacctgcccagtgcaatagtgcatgagtaaataagattagcatgtaacacacatatttctaatatgcaaagcaactgtgattttctcagtcccacttcccatgtgcttgcctggccagctccatttgtctgcctcatagcccctccagatctcaatacatgtagtaaaatttagaggtaaaactttcactttacctctaaatcactatttctgcacacacaccccctccccgtatcatcaactgtaccacatccctcatctgagatctccacccaggtgttcccactggttcttcctctccctcaacaatcagaccttatgagtcatcatgttccaataacccttcctctacatttctctagacatcaacctggcactgtccatctcttcccaccatgttgttgtcaaggcctcagtcccagtttttgtggcaattctctcttctgatccatctgtccactacagcctaagcaactggtctaaaccataccgttcataatgttattcctatcctcatgaatgaacaagggctgccttttagccccaagtcattcaatgctctcagctctttcctttccacatgtctagttttctccttctccatcatgactgtgtctatccagtcaaacttcttttctcctttttctttgcacattaccaccaactttgtgggtctgacatataggaacatacacctgactgtcatttagacagatcatcacaaactatatgcccataggtacatgtgtttacgctatgtgactaagcaaaaattcatgagtaaagattctcatgatccaattgctcctgagaggtccagcaggtgatttttattttttggttttgctatggttttcgttattattttatttttggcaaggttgtgtttatgagaacttttttcctttatacttttataataaagtaaatgatagaatgccataatgttagaactgaggctttaaaatgtgtaattaagtccccatcaccattttaccaagggtgaattagcatcctagacaggttaggtgatttgctctaggacaccagaacccaggactttgagctcttaatcatcacccagggtttagatgacccactcaactctgcttaacctgaccaatgaagggagggagacacataagtcagcattgcccacagcatgctcattccatggtcaaggaaaacttgctctactaattgaaacaaattttttactgaagaacttttcatatgcctatgacttttcagaggggtgtggaaatgtgatgtttcccaaacttgattatcgtggaatgctttgctcaagaaaatactttccagggctagagttccacagaacacacttgtgaaaggttgttatcattattgatatctctgctgttgacatttctaattccagagacaggcaaaatcctgaaaggcgatgagagaaagactgcacactgctcccccaaaatatacatgccaataagagctaatgtttatggagcacttgacaatttaaaaaagtatttcaacatgcagtaacaagcaaaagaaatgttaactctctatttaaaaaaatgtctctttgacattgttaattgtaggagttcccctgaaggaccaccaattcagttaaggttgggtttctattgtaaaaagatggccacatagctaacaaactgaaaatattatacctagaaggttcttaaaattaatctagttcactggttctcaaatgtcaagcctgcagagcataggtattcaactactaaaggtgaatagaatagaagtgtgtcttttcctaattcacagaaaaagaaaataacttaatgaatagaaagtaggagaaggaaatgaaccctgccaacaacaagtgagcttggaagaagatcccagccccaagtgagaattgcaaccccagctgacaccttgattttagccctgagcaaagattacagccacaccatgccagatttctgttctacagaaactgagatgataaatttctattgtttaaagccactacacttgaggtcatttgttatgcagcaatagaactaatacatataagtttttgttaagttctctttagaaaaattagcaaaggacacagtttcgtggaagtataggttggtaattcttctgagagaaaagtgcggcatcaaagtatcaaggatattaaatatgtctataccctttggccccataactctacctctacatacttacactaaagaaatagacatgcatacaaatgtcattgtatcattgtttataataataatgtaaaatgtccaaaattaggaaaacaattaatttgcttatgtaaccagtggagtgtaggtcagctattaaaaatactttcataatctgttatgagcgttttaaggaaaataaatttttttgaagaaaatttaagacatatataaataatcatgatattatggtagatgaaaaaacagcctatgaaaacgaaaaagtgcagccattttttaaaaattgttgggtaatttctcaaaatattaaacatggaattaccaaatgacccagcatttctattcctagatatatataaccagaagaattgaaaacatatatccacacaaaaatttgcatatgaatgttcacagaagcactattcatacatccaaaaggtggaaacaatccaaatgtctatcacctgatgaatggatacataaaaagtggtatatccacacaacggggtagtattcagtcataaaaagtagtgaagtactaacatatgctgtaacatgatgaaccttagaaacattacactaagtgaaaaacgcccgtcacaaaaggccaaacattgcgtgattccatatatgaaatgtccagaataggcaaatccataaagacaaaaagcagattactagttaccagggacgggtgggtgggtggaaaggagaggatgggggtgactgctaatgggtatggagtttctctttggtgtgatgaaaatattctaaaattaattacgattatgattgtacaactccatgaatatggtaaattaaatcattgaattgtatactttaaaaggggtgaattttatattatgtgagttatctcactgtcattattttttaaaggctaagaaaaaaagcattatatatggtaagactcaaattttgtgggaaaaaaatatatatgcataaaatgaaaattgaaagaaaatttaccaaatattaacactaggcatcctttagtggttggattatagattttttctctctgttgtatttttaatttttttgaatagatacacaatatattaaaatctgaaaaatcaattactttaaaagaataataaggtatttagtacacaattatactgttagttattttatgtttcaaaggacagaattacacggtgtttgacaaagacaatcataaattctaggggctcttccaaccccatctgaaaagcacttatctaatccaaccctctctctgctttttttcaatcctctctttttaacatggactaaatctaagagtaatttgtataaatttaaacacaagaggctgcatttttaaaatgaaaccaaaataataaatctctagcttttagagaattcaaacaaactgacacagaaaagggtttgctaaaaaagatgatcttgctctacagatatccatagaatagccacactacagaaatctactggcatgtagactattcaactaagcagcacctcagaagggagtcaaaggtcctttgaccattcaaattaacatacgaccacaacagtgatacaagcactcttatttacatgaaatcacacaatgccttgaatggttatttaattcttgagcgtatgacagcaaggtctctctgaacagggatcttggagtatctctatggatcctaaaacaacttgaagtaaaaaggccataaatttgttactcattacgttgggccctgagaagggatccataaataactctgtaaagtatgtatcattaccatcaatactttatgggtgaagaaatgagaatcagagagattaagtacactgcccaaggttataacaagtaggaggcagagctgggacttacacctaggaagtacaactcaaaagtaagacaacagctaggcaccgtgattcactcctgtaatcccagtactttgggaggccgagatgggcagatcacttgaggtcaggagtttgacaccagcctggccaacatggtgaaaccctgactctactaaaaatacaaaaatattagccgggtgtgatagtgggtgcctgtaatcccagctacttgggaggcagaggcaggagaatcacttgaacccggggggtggggtggaggttgcagtgagtggagatcgcaccaccacactctagtccaagcgacagagcgagactccatctccaaaaaaaaaaataagacaacaaaaataataaacatttacaacttaggcaatgttctgtgcatttgactaatttattaatatatataattattattaggttatttaaaacattaacttaatccttagaacaactctgtcacataggaccaattattatcttcattattatactgcctccttataataaaataattcattttcctctttcagatcacagttgaaatttcaactccttaaaagtgactctgtaatctatttaggcttgcccttgtattgtgttactgaacagggcatttttctttttttttttttttttgagatggagtctcgctctatcacccaggctggagtgcagtggcccgatctcggctcactgcaagttctgcctcccagattcacgccattctcctgcctcagcttcctgaatagctgggattacaggcacccaccaccacgtccagctaattttttgtacttttagtagagatggggtttcaaggtgttagccaggatggtctcgatctcctgacctcgtgatccgcctgcctcggcctcccaaagtgctgggattacaggcatgagccactgcactcggcctgaacacggcatttttcttttgcctaagtaatttgggtgattactttgtatctgtccaccccaatagatgtaaagcactataagggaatgttattaatggctgagggaatgttattaattcgaacaactataagagataaaccctgaactctcccagaggcttcacaaagtagtttagttctcggtctctgagtcacctgcaggtgctcagattcagggagcaagctccttagatcttgccctccaactattccagaaactccaatccttccctttcagcaggctgatgggaagagggagggtataggattgcccaggaggttctgttaatgggctaggcctagaacatggtgtacttcacttctttccatattccagtggccaaaattcaggcacatggatgcatctaactgcaagggagtctggaaatatggtctagctgggcactgaagaggaagagaaaataggtttggttaaatagctaaccagtctccttcaccaagcagaccaccgcattatgtaccttttcttttctgctgtattaaaagactagagaaatgaggggctctccaactttccatgtgatgtgtttttgtgcctagggatgtgtctttaattgccgtgacagaaggaaggccccactagaccataaggaagactcacttccttaattatgtcaggagactctcagacttgcatttttcccttgatgattggataatttctactgacactcttactgcctgtttcttcaacctggattctggcagtttacaaatctgaatctcatgttctgaaccatttactttttaataattcaaaatatgcaatataaaaaaaataaagaaaaactaatctggtcaccctgaaaaatgaaataacttctgttttccaaatctgttctacttttcaacttcattcagcgactggaaggctggctctcactattgtgactagcatcttggcagctccaattcctggttgaaatgcgaaatcccaaaccctagtcctggcccttattcaactgctgcgaggatatttctgaggcagagacctcactctggagcaagctggatcccagccctccacctataacttcccagtgcattcaataagcctttcttgaggacctgctaagtgcaaggccttctgagtctactggtgcatgcaaaggctaatctagaagagctgctccctccggccagcaggcttacaatctaggaggggcaaccgactataaatgaccacatagcaaagtaaaaatgtcatgcgtgctaacaaataaagactgtggcaatgtgcaaaatatttgctcagacataaagagcacattcctgtactaaagatcttcacaattcattcttacgattagtagtcacagagatcataatgacaatagcagcagctaaaatctattgaacaatttctatgtgccatgttgctttttcagataccgaatcctcatgactctctagattaggtgttattttcatgattctcattatagaggtgagaaaaactgaggcttagggagattaagtaaattgctgaaggctccactgctagttaacggtggagccgggactccttccagagcccagctcttaactgctcactaggctgcctgtataacacattccactcttatgaaaactcaaagaaatgaagggcattccaaaagttttctcttcaaaaagcgttatttgggacagtacgcttcaggttcagtgggaggatttaaaagcatatccaaggcaattaatcagaaatggcaagtggcttattccactccagattttttcaatttgcaagcaccaaataaacattttgtcatggagtcagaggataatgaaataaaaatgaaaccatggggaaataatatgaagcacaccttaagactatatattttttgagtcttcaaaagtaattgctctttatatgtaaagggaactaccggttaactagaaatgagatatgatgctcactacctttattcccaaagccataattaatttttcagtccaaataggaaaagacactttggactttcctcattccttttttctagcttaaaaaagaaaaaaagaaaaagaaagaaagaaaagaaggagggggaaaaagagttccctttttgcttaaggaaataaaatacaatatgtttaaatttgcaatgtggagtctagatatgtttttaccagcataatttcaactttctccagaaacatctgcaaaagaaattaccaataaaaatgttccacagcaaattttacagtcaggcaatacagagtaacagatttatctactgcgaggacacctctactgtcttccccagcctctcctgcctcatgtccctcactctaagaaggagaagtagggaggagggactcacacttaccttttctcaaagatttgtttattatctctttgtgagttggtatttagggggaaggaggaattagaaaagtagcaattagagtgctcctttaaaggttattagtaatacttcttgtcaaatgcaactgaattgaactttgaaaacattgctttttggtttggttacaagcctctaggtttccatgtgggcattctcccctccaatccttattcaatcaatcattagtcaaataagttatgtactgagaacttgttttgtgcaaagcactattctggataaaaaggattacaaaattaaataagaaattcatgccccgaaggagctgaaaacctagacagaattcacaggaaagtgtgaaaccagaaccaatgaactgtttgttcacttggtgggagaaattggagaagaggtcactttaaaagttttatacaccgatttttctttacaaggagagtgtattacttttataattttaagtttaaagccaagttaggtaagattaaacaaatacaaatgaaggcagccaagtagtgagtcacatgatcacaagtaggtatgtagatgtgtgcttgtcactgttcaattttaatcacgttgatgagaatactgatgtttagcaggtttagaaactgtggactgtattcagttccagcgcatttcaattctgaatccaggcctattttactaacagccactttaagtttcaatcttagcagtaattttacaatgcccattggcctccaacattgccaagtgtttgaccacataatcagaaatttccggctagttttgggatgcatatacttatctacaaaattatttgaatgacgtatcctttggatgggcatgacttcttttttagatggatcagtttcttttacaatgagcttcgatgatgaagcagatgtttaatcatctaactagaccagagcagctggcaaaatcttcatgcacggttcttacacatgaaaaactgcaaatctcttctgcaatttccatttcttctaagtaactctgaaagtcttttttttttttttttttttttttttgagttggagtctcgctctatcacccaggctggtaactctgaaagtcttatttgtttggcttgaattttgcttttatcttaacattttctaattcagtgtattcagatatcttgtcccattggtaagaaaatgatgcacttcaaaccactactaagtcacatggctttttggtaccccaaaatccttaatctgaaaaagtagttgaggagatcttttcaagtttccattgcctagtgatctgacagcttcacaaactaaatattaatactctgcctcagctcttacaagtatcccatcccataaactggccagagttaggagcagaaccatgtaagtcaacaaccttgatcattttctccatcacttcatgctgtgaacctagcctatgctttcttctgaagaaagatgaaatgcaagttggttatgccaatcatctctttgaattgaacaaactcttggaagctgtttcttccctcctttccttgcatattatgactacaagtaaactcagtgtttacatgtttaggaaaaacttctcttaattcatatgtgctagataattatttttttgttttcttttaaatttttatttttttgcaaaaaaaccttccaagtattacacttatagttcaactcataagctacaaggttagatgccctgacagagaagaacttggtagattagggtagtctaagagctcttcacaaaagggatgggatgtacttacctaggttttgttaaatggccaggatcttaagtagtggagtaatatagtttggctttgtgtccccacccaaatctcatctctaactgtaatccccatagaccccacgtgttgagggagtgtcctggtgggaggtgactggagattgcatcatgggggaagtttcccccatgctgttctcatgatagtgaataagttctcataagatctgatggttttataagtgtttgacagttcccccttcacatgctttctctctcccctgccaccttgtgaagaaggtgactgcttccccttccgcctgattgtaagtttcctaagccctctgcagccatgtggaactgtgagtcaattaaacctcctttgtttacaaattacccagtctccagtagtatatttatagcagtgtgaaaatggactaatacgtggagtaaatagagatatgacaagaagagggaactagctcaggcaaggacttaaaggctggcaggaaacagactagcactattcatagaagccccaaacggtgaacaaaccaaatgactgttaacaggggaatgaataaagagtgggatattcatgaaatgaaatgggaaatagcaatgagaatgtacaaactataactacatccagcgacatggatgaatcttacagatataaggttgggtaaaaggagacatacaaaatagtaccaactatgaattcttttatataatgttcaaaaataggccaagtgaatggtgttagaagacaatattagtttgttttgtgggagggagagagacactgaaaggagatacaacaaaggcttctggggtgctaatattccatttgttggtttgggtgctggctaaatctgtgtttactttgtgaaatacattgacctgtacaccttatatgatttgcatatttttctgtagatgtgttatacttcaacaataattatgagagagagagagagacagacagacagacagacagacagggtaactaaagggccaggaatagtaaagacacttcttaaaaaatgttgttaggacttcctaatgttactggcacagtgatggatgaattaaccaatgaactaaattaaagggctcagagaaggcccacacatgtatggaattttggtatatgatagaggtgacatgtcagattagagctggaaaatgaatattgacacagaaaatgacaatggattcctgcctacgtcacaccatatacaaaatcaaagatttaaatgggttagggaattcgatgtcaaaaataaaactttaaagcttctagcagaaaatataagtgaatatcttagactttaggtagagagaaaacatttaataaacaaaaagcagtgttcataaaactttaataagtttgactataaaatttaagaattttgcttattcaaaatcttacaaaaaagaaaagacaattaaaatataggagaaagtattaacactatacacaaacaaaaaaagataatattaagaatatatctggccaggcacactggctcatgcctataatcccagtattctggaaggctgaggcaggagcatagcttgagctcaggagttcaagaccagcctaggcaacacagtgagatgccatccctactaaaaataaaaaaaaatagccaggcatgcatgcctgtagtcccagctactcgggaggctgaagtagggaggatcttttgaacacagaagtttgatactgtagcgagccaagatcctgccactgcactctagcatgggtgacagagtaagactctgtctctctccctctctctccctctctctctctctatatatatgtgtgtatatacatatatgtgcatatatacatatatatttaatatatatttatattatttataaatatattaaatatatatgtatatatgcacatatatatatttaataaatcctacaaatcaataaagaagcacaagcaacccaacagaaaatgggcattttacacacacaaaaactacacggccaattaaaacacaaaaatatggtaaacatcatcagtgatcaggaaaatgcaaaattaaacaaagaaatattttttaatccatttgattggcaaaataacaagttgaaacatataaagtattagagagagtgtagatccaaagaatattttgtacatcatagtggcaagggttggggggtgtgtaaactgatgcaaccactttagaaaacagtttactactatctcctaaatttgaacattcacataccctgtgtttcaacagtttgctttctagggatatatccaagagaaaattttggacacatataacaaagaacatatacaaaaatattcatggatggattgtttaaaataccaaaaacatagaaacactctaaatgtccatcaactggagaatgcaccagtaaagtatgatatattcacatacaggaatataatacagcaattaaaacaaatgaactacagcaacctacaaaagtataaatgaatcttaggaataaaatacagtgtaaaataagtcccaaaagattgtacacagtgtacctttatataaacttcaaaacaactaaaatttaaaatctgaagttttttttgacatgaattcacatagtaatcaccattttgaagtgtacaattcagtggcatttattaaaatatacagttcttaagaatacatgtagatgcaataacactgtataaaaggaaagtaagggaatgacagaaacagaattaaggaagatggtacctgggaagggagggacatgtagaggtttggggtggtcaagagcagggaaccatatggctaggcatagggtttgtcaaggttctagttttactattggctgttaagttcatcggtgcttatttcactactgaaaatgactaactatataaacaaaaaaacaaataaaaataaatacattggtcccctttgcctcacatcaacagatgctggcaacaatttctgcaaagtgtagaaggcaattttcaaaatagatgctttgaaaacacaacaggaaaatttcaattctattgagagcaattatatccctttaaattttatgtgaagtcataaaaggcgggaggaaaagaactggctaaaacaaaatggcaaaagggcctcagaaatcaatattatttttggaataaatcccatggactcctgtgaaagaaaacggtggtcaattttcttatggcggaacactttgccttctcactggtagggagacaagcaattctggcccctggcaggaactaatatcccacttctcccatgaagccttctaagactacccaaattaccctgccactcatatagcacttaagagacagtataccacgttttatagctattctgtcagggtccctagagaaaaatctttatttacctggaggtaatatagcattgtggttaaaaatcaagacaagaatcaaagaaggttggtccaatggtagtgggttatcagaacttattaacagtgtcactaaagttggtatacaaaacccactgctaaatttggctttttattttttaaaaggttttttattttaaaaaggttatttataaaaaaataacaaaattttaaaaaagaataaaaggaaacaacaacagctacatagtgccagctactgttctaaatgctgaaacatttgtaacgtgtttgttaacatatgttaacattcaacgtataaaagtctactaatctttacaacaactctaagaggtaggtacaattatttagaaataaatagcagcacagagagggtaagtaacttgcattaagcctcagagctataaatagtaagtgccaggtcagaatttgaaactaggcatgcccctaacctcatacctttaatcattatggagccttaagccctccattacttagctgttataatttgatcagttcagctccacacccaatgggtcagaaatagtgtttggcatccaggcacagggcaggaaagttgatctgagagcaacctgggctccaggcctggctctgaaactgatgcctgaccagacctgtgaaaggtcattgtctctttgagcctcagtttcctattctgaaaatgaagggttggacctgatggtctctaaggcccttgcagtgctgatgttttatgagcctggggttcctggctcaattccttgcagcccagaccatactggctcttcctgggccaggtctggcccctcctgctgggctcagtgtcttgcatttggctctgcttctcacaaataaaagaaaaagaacaacgggaaatatcctcctgagagactgggagggaccccatggctgctctgtatgctttgaagcactcacactcattaaccagagagaactacctgccaagtgaaggatggaaagaaactagactaaggggagaaatgaactcacaaaacctggctacatccaaattaaaagggcatctctgagcacttaaagaattgacaatgttattgcaacaagatgtgccagtttcttaaagaaatgaagacaggatcagccaagaaaaccataatggatcagagaaggcaggacaaacctgagaaactatgcaccaactaaggttattattactttttttttttttaccacgcctggctaattttttgtatttttattagacacggagtttcaccatgttagccaggatggtctcgatctcctgaccttgtgatccacccgcctcggcctcccaaagtgctgggagtacaggcgtgagccaccgcgcctggcccaaccaaggttatttacagcctgggaagaggatgaaataagtgagagacagacatgtctgcctccactatcccaccatgaactcttccagggctggtgctctgtttcaggaatgtatgcatcccaggaactgtaaaggcattagggttcagaatctgccaacatcaacagagaacctactaggtgacacagctatttgtatcagaaatgtattttttataatattttagagatgaggagagagagtctatagagaccttgattccagttctggatcttccatcattagctatgtaaacctgttcaagtaacttcacctgtctagggccttggccagtttatccataaagcaagggactgaacgtgattatagaagatgggccaggccagacaccatggctcatgcctataatcccaacactttgagaggtcaaggcggaaagatcacttgaggccaggagcttgagacaaacctgggcaacaacgtgagaccctacctctacaaaaaatatatatatatatttttgattagccaggtgtggtggcacgagcccatattcccagcttctcagggggctgaggcaagaggattacttgacgccaacctgggcaacaaaacaagacccagtctctacaaaaaaaatttttttaattatccgggcatggtggtatgcatctataatcccagcttctcaggaggctgaagcaggaggactgcttgagcccaggagttccagactgcagtgagctattattgaaccactatacttcagcctaggtgacagagcaagaccctgtctctaaagaaaaaataataataaaaaatttttaaaaaagatgagctagctcaagaatctatagttcgtaaagttaccaaataattattttatattcatgtagaaaagcattcacctgaattaatttaatgtcttcatattttaggccattggaactcaacagactccactgttctgagcatataatgtatgaatccaagaaaaaaaaatcgaagttttgggcttcagaagctcttctgcttctgttccatgtgcttctagctagcatgaccatgtggggctgggcaggttgtgccctgtagaagggcatctagccgaggaaggtggaagagacagggctaaattccaatctgccctttggcatgagctttgtgcccatgaggctcagtccaaaccaaagctgcattctgagtttgtgagtgcctctgaactgtccatcaacactgaagagagccatggccaggactgtgaagcaacggccaagtctgtgttcaagtttgtgttttgtatacaaaacatatagttttacctttgcttaaaatatttccagacatctcctttcacctccattcagtttttaagatctctaataaaaccaatcctgtcctttataatcacatgtcaatatggacccaaaccaccattagccaggatgcttgaatggattgtttctaaaaatctcaatccaagggttgagacattgtgcataatggcagcataaatggaaagtggggacaacctttcaaggtgattccttggaaagggacattatttagctgagcaagacctggagtttaaatctatttcattactttcacatttccaaaacatggtagctactaaatgtactcggcaaaaatacagaaaaataaaaactctgagaaaaacagtcactggattctcagggcatctaatgtgttttctttgcatgtagatggtgattctttgccaccactagcaagtcattcattttgaggctcctgacttttctagcaaccaattagatttgcactggttcattcacattctttttcctttatgctgtgatcaatagctaccaagaccattcattctggatttcctgggtcagtctcaatttcaaatattctgcccctctttcctctgaataaaaagttcccaattttttgtttggaaaatatggtcaccataataatggcattctcctcacaaaaatattagtcaggccagagtcataccatcattacactgcccatatttggtttgtggccatcaaaaggagaactggctggttcaaccagggtctgaagccattttcttggtctcattaaagagacaaataatgcatttgctattaaacaatttagaactcaaataaactttccccttgtcctggaagagagtttctcaaggctaaggagttactatctgatggaagggtacaaaaatctggaaaaaatgaagctatggggctttccaactgccaaactcccacaggctggctcccaatgcacatcacactcactattaaagtgtcaccatttataatttggtgctaaatctttctgaagctaagctactcagcatggtctaccaacaaattgattctctattccttattctattaaaacatagggataaaatgaagtaggtgttggtgataaaagttatctaatctcaagttgaaaatgaagttattattcattcatgccagcaccctgaaaggcaaaccaaagcgtcgggtttccatagcgggttcgactgcgcttgcagcatttatgaaaggaaaacagggtgcctctggttttgttttgttgcctcctctgtagttttgtgtctgtttttcctccaggtgcctcactctgaatcctttagagcatggagtaagaggagaaaagttatacttgcagggaggtttaaatagtgtttgccaagcactttaatatacaacacgcttagatctttttcctaccgcctcacaaccttgtgaagtaggtgaaaacttcattctaatggtgtgattatggaaagaaatgctactgagtcatgtctttcatacttaggtcggttggtcagaaccctgagagatcacagaaaactaaattaaaatggaaaaatactaacatacgttgccagtatttttgggtatctcagcatgattgtgaataagctatagattctgactcaagatgtgtgcagtttgctttggactttgctcttgcttacttacttataaaacttcttaactgtacttctaaattatagcaattctgtaaaacattcaaaccttggggcttggtttcctcctcctagcaggctgagtcataaaaaataaatcttagccatttcaatagacaacacacccctcgcattaagaattggtattgttccctgcatctcccatttcatccaaaagtcacacccagttcacatttgaagaaaaaaaagagctcagggactcatccagctcaacatttgcacatttaataagagaacagaatttctgccaagttataggggtaagttgcatcagaatcttccagaggaacttaggagcagttatgagtatggactttagaggtagccagacctgggttcaagtgctaacatggtgtgacattggtcacacaggacccaatgaaatgggggtgtttaacctcatagacagtcgccatgagaatgaaaggaaagaaaagataaaagacaagacatctgggaagcccagtgtaagacacagaaagcatccagccagtacttaccatcttacttctacagacatttccaggcttagccaaatcctctgcccttctactacacagcgtcagggagtgagtcacaagattcattccaaatcaaacctcaaggaggcattgctgagggaggtagaatactcaacctgaaactcagggtcaggatttaaatcaggaagccacagactggcacaattttagacttaagaggaagtgttaatttataatttgttaaattactatatgcaaattatagacacagtgcctgacatacagcaggcaatgaatacatgtctgccctccctctttttttaatactgaaaaatacctaaaattctcggccctaaagtgacttgctcaagtcacacaagcagccaatggcagagctggaattagtacttggctctttttagaagagaggggtgctgtttcaggtctcttaccaaaagtattggtgtcaaatggtttgaaggaactagacaaacaccttccaaaccccaggaatgaaatgatctccccaacttacaacgacagcatgctgtccctatccctccaccaccatgtccatccccgaacccccactgacagaagctagattccctccagtccatgtggaaaattctgtctaggaagcactgggggttctgaagagcagagacagagctctggggtcttgagatcgggaggcgtgtttccttcttggcccactgaagcacacagctgtctcaggtgttcccttgtaagcaaaaaggatccagaaactttctcaagggttctaacagccagttgaaatggggagccagggacaaggagatgcaaacatgacctttcaggccaagtctggggagatgacaagcatggattgctgggtttgcaggactgaaaaagatcctttcaaatttcaatggaaaatcctgattccgtcctacaggtattgcacaaaagaactggttccaagctctgagggtcaggcggaggacagctaacaagcctgcagtagttctggggaaggaaagaaggagacagcagaagtgggtggaaaccgcccttcttcatttataattcaaagagtcattcgagaaatacatattgagcactgactgtcagaaactctggcctagggtccagggtgggagttgggggctggcagagaagaccaccaagagaaagtgaaactaagctcaggcctgaaagctgaatgggagttagccaggtagcgagggatgttctaagccaaggataggcaaaggtttcatgtaaaggacaagataacaaatattttagtttctgcaggtcatacagtgtctgttgtggctatttaactctgccattagagggtaaaagcaccaacagacaatacataaaagaatgagtatggctgtgctccctaacccttattaatgagcaatacaatttcaattctatataattttcatgtcatgaaatagtatccttcttttgatttttttcaaccatttaaaaatgcagaagccactcttagcttttattttacaaatatctgtattgatgtacctgagggttcagtcaaggtcattcctgaactaggaagatggtattcatttctaaaccacagactctcttaggcccttgtaccaaggctaggactagagtgggacaagggagctgcccagcactcacaatttaaggaggcactcactaagaagtatatgggtggcacttctgagaccctgagagaaggtgcacaagggtgagacactcacttgtctcaccctagtgatggccctgcttgtacctgtgcataacggagtgcattattgtgatgtggcgacctcttcctcaaccatcactgtgttggatgatgtccttgtgcccaaggttgtggactgacaatctcattcccagccactgctctggggtgcagagtttggataataaaaaaaacaatttagataacaacatttaggcagaaagggaggagggaaaaaaaagaaaagctatgcagactggagtttgggagaatctggagaagttggaaaatttttaaaatcacatttggagccaggcacagtggcgcatgcctgtaatcccagtactttcggaggctgaggcaggaggatcagttgaggccagaagttggagactagcctgggcaacatagcaagatcttgctgctacaaaaaaaatttttaatcatatttgaaagttgttgctggtagaataatgtgagaaatattgagaaggagatgaatgtccaagggacatgtttaacaagctccactgtaaataaaattgtaaacctcctttgccacttgcctgatcttcattcatatatctatacctatacatatatctaaatctattttgcaaaccacatatctgataatgaacttatatccagaatatatatcaaaaataaaaaagacagctcaatttaaaaatgggcaaataatttgactagacatttctatgatatacaaatggctaagagcacatgaaaagatgttcagcatcatttgccatcaggaagatgcaaatcaaaacaatgaaatatcagtttacacccactaggatggctataaccaaaagacagacaataagaaacactgttcaagatgtggagaaatcaggctgggtgtggtggctcacgcctgtaatcccaccattttcggaggccaaggtgggcggatcacctgaggtcaggagtttgagaccagcctggccaacatggtgacaccctgtctctactaaaaatataaaaattagctgggcatagtggcacgcacctgtaatcccaaatactcatgcctcaggttgaggcatgagaattgcttgaacccaggaggcagaggttgcagtgagtctagattgtgccactgcactccagcctgggcaacagagcaagactccgtctccgggaaaaaaaaaaaaagatatggagaaactagaacccttttgcattgctggtgggaatgtaaaatgtgcagctgctttggaaaacagtctggccattcctgaaaagattaaacagagttatcatgtgacccagcaattccaatcctgggtatttatccaaaagaaatggaaactatgtccacacaaaaacttctgcatgaatgctcacagcagtattattcataataatccaaaagtggaaacaactcaatgtccaacaattgatgaacagataaataaaatggggcataatcatacaatgaaatattattcagcagtgaaaagtatgaatattgattcatgctaccgtataaatgaatatttaaccttgaaaagattatgcgaagtgaaagaagccagtcacaagaccaaacagtatgaaagtccattcatatgaaagtccagaatagggaaatctatagagacagaaagtggattagtggttccttagggctgggggagaggcacaggatggggcgatagagggtgatagctaaaagaaacagggttgctttttgagatgatgaaaatgttctaaaattgactgtagtgatgcctgcacatatctgtgaacatatttaaaaccactgaattgtataccttaactgggtgaattgtatggtatgtgaattatacatcaataaagctgttaaaaaaaataagaagacaccaaagcatttctcctccccttcaaggaaatctgctattgtgtttcaaaggactggctttccctatccttgaacaatgatagcatgactttgtattgctgaaggctgaggaggttttctgctgagctttctcagggtttgaggagtgatggcctaaataagaaggaagggtttggggttccttgtaagggactgagccttggggttaggggttcagggttctggtgcctgagctctagaagacctatatttaatgtgaagctctgaatgtgtttaagcaagccactagaataaagaaccactgaaaggggcaccatttggttgtcatggtgccagaaaataagcccagcaccgctgtctaagaacagcttttgagagagggcgctgtctgagccaccagttagtctagtcgtgggggtcagtgggtgcacctccccccactgatgcttcaaatccttgaatgctgaatcatttgatcaacagggtggaaacctcctctctaaccccaggactcccttaagctcagaaggggccacttctatgactcgtgacttttcagaggtcattcaaagggcagcttgagtctctggtctgcaaaatacaggttgtggagcagatcagggtttcaccagatggttttatccttgcccactggatctaattcttttcaggccacatactaccacggcccattttcagggatggggcctctccagctgctaattcccattatgtaggacatctagggaaaagaaaaataataataatcctaatgctgatactgtccaaagaatactatgagaataacagtggccaccagtgcatttaccttacactggaatccagagtcaaggtttttcattcccgctcttaccaaatcttagccaaagggctggtataactacagagatgcggggggacatttatcctatagtgcaccaatgcagctaataagggaaagcagtccaatcatcacaaagctggactctgacagccatcacattttccactgaggcactagacatgactaaactgcacaggagctgagaggaagctggattccctttcactgtgcccagcaggaaggggccagcatcatcctatacccatgtcatcaacccatcactacccttcgtaatgaaagaggcagcctggcaaatcaccaagcacaggcttccagctaagcctaagcaccccacgaaattttaattgtctcaaggtccaaactgtaccctagctccagggcaaccaaatttccagaccagaaaacaagacatgttgctatctcaacagcaatcccttacaacattgaacagtggggctcaatggatattttatcatccataaaaattacaactcagaagatgaatttattagcggttggtccctttgcacacaacagacattatctctcccctaaggttcaggtctcttcaatttgaaagagacaaaatatagaatcaaggacatgtataccaacaaaggcatttttgtgaaacactaaaaaaaaattgcctgttaggtttaattttctgttcttgagagtaaagtatgaagaagaaaggcaacttttaaaaggaagaaagcagaataagaagcagcaatacagaagctgcttttgaccttcctttttaaattatagcttttctagactgatgtaaaatttttttattcaatctttacatttttattctttgttttttactctttagtgtatctgagttttttttctattttgtcatacatattcttgtacagtaaatcttgtggaacaaagaagggaaataagtaaagtgataatacaggagccagtggaatttctgccctggcaccttcacattctctgagtgcacgtggatctcaggttacatgagcaattccagcaaggcagaagcagaaacttcttgtacttcacattcaagataactatatgtatctaaactcctcaaaattcaggcaggttgagaatttttttttaaaggaaaaacacccctaaccaatctttagcttggagactttagccacccatcaaaatatcctgtcttatttcagagcaggagagagggagtatgactgtaactggataagggatagggttttaatttcttatgaggaggagaaggaggataccagtagttagtatgtcagcaagcattaatcttcattaatgttttccattcaaagccaatcttctctacacagctgtgcaaatataaattaaatgggtcattctgaccaaggtatccaagaaaaaaaaatgtttaatgtgagggccaaggaattaattgtacaaacagcacattctttaaatgtgtgggaaggattgttcaaactacctcattatagattgagaaacatgaattcaaattcataccactgtaaacatccctgagtgagaagacacacagcagaaggtggtggaaatgtgttctcgacaaagcatatccacagtggccagagtgagcagagcagcactcactccttgctagaactgtgtggtgggtagcatctcatttaacgccacaataacaccattattctcagtttataaaaaaggtaattagaaacaaagaggtcaaactgtgtaccagaattcacatggccagtcagtgatggagtgagggtcacaatttaaattcaggtcgactgactccagagactgtatttgtaaccattacattgcccttattctctgtatacttggcattatgcttgcattatggagagtaaaataatgcagaacttatttcttgtccttaatcgatttacaatctgattgaggaaccagaacggacacatatgtaattaccaaaacacaggaaaaggagcatatcattaagatccgcatctttgaaggaagtaattcataggagctgggaaaaactagttataattcacctgtgcaacttttgagaatttctaccagattctaaactaaaaaacaagatatacagaacaccataccttagaaaatactgattcattgctgatatggtgtggtttgaatattcagaaagggccccccctttagaaatctcccttaagaaaggacaggacaaccagcctattccccagccgcatcttaatggttaataaaaatgccaatagcctcctccaagcctgctcagaccaaggggataaaagttcctggagtctactctgacaggtgtggcaacctctcccagcctccagagactaagaagcagggaagagacaatttgcatcatcccttttgtccttttcaattagaaattaaccatcccaggcctttgatgaacaagggcaggtttgagctggggaccagtgaacaagctcagaagaaacagcagcagggctatagaaaagaagaaactggaggagggtataggcataccaaaaattattctgaaatttacacccgattcacaaccctcatagggaaacaatgataaaggttctaaagcaacctatttccattcactttgctatatttaaatttcgattgtgctcttaatgttcgagtgtacatgattttttaaaccactgcatttttaactaagatgacacgttgctctcagcagcagtttcatggcagggagatgctgtgcaagtcatctagtgctgagcaggacaggcatgctggtgaggggctccttgtctgtgactcaggtttcatgtggaatcaggtcaagagacacagaaacacatccttagacactggctggggtgagtggtcaactgtatagagaaggacctgcaggctttcacttttcaggcaggttcccaggtcagcccaaatgttcctaagaacccaagcagtgtcttttttagggaaaggcaaatattcctgaaatgtcctgatcaaaaagcaaagagctctgtttaaactcctagccaatggttcccaactccatagaatctatagaatcaccaagggaactttgaaaaaaatattcatgctgtgccctaccccagtgattctgattcaaagggcctgaggaggggtctggacagtgactgtgacgtgtaagcaggtttacaatcaccatacctaacatggccaagtctgagataccgtgagcatcaatgaatggggtcactcaatcaacagatgctgaaacgaacagaattcttccgttcttttaaaagcttcctctgaattttattcctttctggatcttaagaaaccacctaggagtgtcagctgcctggattaaatcttagttatttcacttactagctaagtaaccttgatgaggtacataatttctcaggaaatcagtttgcttagcaataaaagtgttaattatcatatcaaaatcctaaggtagttaagatgattgtacaacatggaatatgtaaattatttagcccaatatctggcatttgttgaatgctcaataaatgttagctaccctgattgatgactcaaatggttgggctgtgtccctacccaaatctcacctcaaattgtaataatctccatgtgtcaagggcagggccaggtggagataattgaatcatgggggcggtttcccctatagttttctcatggtagtgaataagtctcataagatatgatggttttatacatgggtgttcccctgcacatgatttcttgcctgccaccatataagacatgtctttgctcctcttctgccttctgccatgattgtttggcctgcccaaccatgtggaactgtgagtccactgaacctctttttctctgtaaactacccagtcttgactatgtctttattagcagcatgagaacagactaatacaatgatgatgatgatgatgatgatgaaagtaaaaatatagcacttatatttcaataaaaatgatgtttctctagaccaggtgcttatttctagggtcaggttttaaaggacttatgaaaaattggaatgtgagagttctagaaacagtttcacatagagaatgactgaaggaagcaagagttttcaggataaaaaaatccaagatggcacatggcactgtcctcagatgtacagataaggtctgagagcaggcagcctgatcatgtgtatttccagagcaggattcttaaagaggggagactgtggatagaattcagaggacctggaaatctggttgaggaaaaaaaagtgattcattattttcattaatctcaaaaaggaaatttagcatttcctttaattctgaatataagcaacaaacttcagtagtagtaatagtaactgtgatcttgtcaccaatagaagtcacagatatttccatatcctattacagttgtgatagatatcctaaaatgttattgatatttagggtgatcgactgctctggtttggtctgaagggttttccaggacatggaatttacagtgctaaaattgagaaaatttcaagaaatccatactatatatacataagtatatatacataatccaatatatgcataagtatacaatctatacttatgaatataaggacttatattcatcactacaattatccctcaatagctcagaggaactggttccagaactgccccctaccccctcgaacaccaaagttcaagaatgctcaagtcccttatgtaagatggcctagtatttgcatataacatacatgcatcttcccgtatactttaaatcttctctagattacttagaataccttatactatgtaaatagtgttacagtgtattagattgtaaaatctgtgttattttttattgttatattgttattttttgtttcttacaaaaatattttctatatgcagttggttgaatctgtggatacagatgagggctaattctattttgaaattatgatagttatcacataactagatattattattaaatgtattaataaagaagcacctaaattgtcaggttaatttaaaaaaatcatgataaatgtatatccgcataacttgtcctttatgatgatttctatttcatctgattcatttaaaaacatcattctgaatccataggtttcatcactttgccaaaggaatccagggcataaaaaagtttaagagggaaggaagtggggccattagttggaaaatgaaaaaaaacagaattaagttctgttaggtctggagacctaaaaacaataatgaactacaccatagaacaggacccaggcatttatctcaaaagaacacaaacagataagcaacaaatggagccatttttccactaccaggaaatctccctaattcctccactcccaataacattattttctgacacacttttatgttgttgcagtatcaactcaatcttgatagctatcaattggagtatctgttttcaataaccacaaatgcttaacctaagaatcataatttgacagatcttaaaatttctcatcaattatgacaatggaaatttggacttttttttgaaaaaaaaagcaagtttaaagaaatggtaaaaagaaactcaaatgcttacaggataccactgggcttctgacagacgttggctcccatcttgccttatctccactgttgacgggggttccattactctcccacaaggcagtaagggaccatttctcttctgatctatgtaactccatgcagtcagcccaatgtggccagaaggcagagttctcacaattgctcttgttccagtatacacagatttcttaacttctctgtcatttttacagaatctcctgactaacaaagtggatcgctcctttttgcttttaaaagcgtcttcttctacatcatcacaattatcagggaagtcctcaaaatggctcaaaaaggtcttggcagcttgactgtcagtaaagtctttcctacaaaagctatcacctgaatataccatgtcaaccttctcacaagagccttcaaagcaaaagtatttatcattcaaggtgtcacaatgatcacactgcagctgctcattcttattatcacaatttttggccaattccatcagtttacaggtatatgccacatagtttttcttttgcttctcctcacccccaggtagtggtacacaatttccacaatcgtctaaaattaagttttctgatagggtacagaaagtgtctgacattcttctgtcaacttcataatgaaaatgaaatactgcccttctgctgtcagggtgtgctctgcctgtctctatgatcactgactgatttcctaaaggactaatgcccatggaaggtctgtctagttccagttgaattccagggaacacctttctttccagtggagaaggaattccagtttctaaacacaagtcttcctcagcaacagagttgtacatttcataaaattgtctctgaggaaggccatgctgatggtttctcaatatgttgttgcagttaatgttaaggtttttcgcagaatctggcatgattttctcccaacatttttcattactgttctcatcactcactattttctccctcgctattgagagaatctttggcaagttgcttccagaaggttcttctttaagtttgttcagttgtgagatggtatgagaagtctccccacttcgtctgacagtatgtgcttttgaaatattgatgtctgagaccttttcactactttcatctgcagccgactgggcagaaaccacttttctctgagtcacaggtatgagaacagaagctgtcatttcttcagaagtcatcttggactaacacacaggttttgactattgctctatttttcctccctggtgatcatgtcaaggttttaataaaatgactgattattacaacaatctcagatacacaagtcctcccaaagaacaaagggataattcctttcattcaggagcattaagaggcaaataaattttcttagttataacttcctatcatgaatatatattttttctagatcagggttttaaggtggtagatcaattttccttcctctgttacctgaagcaaaattttttgaagacttttactcgggattgcactctgcaacttctgatccatcactgatttgcaatgattttaaaatccagtttgaatgattcctgtttcctgtaagaaaagagataatgtcaaacactgtggcactcagtgagtttttaaaaaaatgatctcacaatcctaagatacagacaattttgagaaaaaaggtttttttttgcaatcagaagttggtttttatgtttttagtattttttttttatttaatgtttcagaacttctgcttccagccaaaatggagtaacaagggcaagatttattcatccaccttaaataactaaaaagaaaatcagaaaaaaacccagtggttttcagatattgaacaacgagcaacacagacattgatgtctgaaagaagaaaaaaaaaagaagtgagccctataaatgccctagcttactgcttagaaagtttccaggcaacaaggcaaggaagggaaactcagataaaatccaacaatttacctgagtagaagagaaatagttaagacttcagggaggccaaggaagctagagaaataaggcacattaagcaaagaggcacaaagataagaatgacagcagacttttaatcagaaacaatgcaatccagaagagagtggacaaatctttaaagtactgaaagaaaaactactgtcaacttcaaattctatacccagcaaaaatgtcttctgcaaataaaaattaagtaaaaacttttccaggcatataaagctgaaataacttatcactaacaagcctgcactgcttgtaactctgttagtagagagagggaatcaaaaaaatttctatccaatgtggaaacacaattataaaggatatacaaggcactataggactagaaggtgcccatgatgagcatatcattcccttccaggagaagcagttgctcccgagaaaactaatcagcagtcacgctctgctgccaacaccagctttgccttgcctttgctctttgacaaatagatgtctttcttccccttgcttctcccgtaccctcttttcccaaagagtcatcaactaccccttaatcccttctatatgtgttccctcaagcacaaacacagcctcaagggtgagaggctcccagtatattcatgtctctacaactactctgaaaaatcactggaaaccctagaaatcatattctttgcagggaataaaccagcccacacagagcagcagtgtcctagctcaacatcctaacaaatcctatcacacagcaataactattatcaatactttcagaaacctccttccagaacactccctatgcatcaacatacatagagatatatgtgtataactatgcaaataccagataatgttggtcattctgttctgtacctgcttttaaaaattcaaagcacaccatgaacaacttttcaggtcaagattatatagataattttagtggcatatggcactaacttgaattcaaatatctgctctattttttaaagagatttttcaggccaaagccttcagattgacagctaatatgtcctttcttacccatgaggtaagcaattcaaaggaggagaaggggaaaacatttttggtgatgcttaggtcctgttctaaggactttgtaattattgttgttattataattataaatatcatcatcatcatcataattttgagacagagtcccattctgttaccaggctgaagtgcaatggcacaatcactgcttgctgcaacctctgcctcctggattcagcagtcacatactgttccttctatcatattctatatgttagaaggaattactaagtataacccacattcaaggggaggggaattagggtccaccttttgaaaggagaaatatcaaagaatttgtggacatattttaaaaccagcctgggttcaagtgatcctcccacctcagcctcccaagtagctgagactatagcactgcgcttggctaatttttgtattttttgtaaagacagggattcaccatgttgcccagtctggtcttgaatttctgggctcaagcgatcctcccatcttagcctcccaaattgctggaattacaggtgtgagccactgtgcccggccactttgcaattattatcttgtgtaattctcactcaatactacaagatagtgtgatggttttaaaatatgtccacaaattctttgatactcctctcttcacaaggtggagcctaattccccgccccttgaatgtgggttatacttagtggcttccctctaatgtatggaatgtggtagaaggaacagtacatgactgctgagaatcagtcatgaaagtcattggagcttcctccttgctactcctctctcgcatgctctgggggtaatctgctgccatattgtaagaagagatccctgtggaaagtatggaggactcttgacaacacccatgtgagtgcgccatcttggaagcggatcctccagctatagtcaaggctttagatgattgtatctgcaacctatatcttgactgcaaccacatgacagaccctcagacagataagcctcgtcccaaattcctgaccacagaaactgtgagatgataaatgtttattgctttgagccactacattttgggctaatatgctacacagtgatagataactaatacaaataatttctgctatccacatttgaaagagtagaaaccaaagcaaagaaaagctaagtgaattgccaaagatccctccactggaaaatgattgagacaggattcaaatccaagaagactgactacagaatctcttctcttagccatagactatgctgttttatcttccatctagtctgaagccctatgggtttgggtttctgatgtcttctagctatgaagacccatggctgctaggagaagcctttcattttttattttttatcttatttatttatttatttatttatttattttgagatggagtctcactctgtcgccaggctggagtgcagtggcatgatcttggctcactacaacctccacttcatggattcaagcgattctcctgcctcagcctcctgagtagctgggactacaggcatgtgccaccacgcccagttaattttttgtatttttagtggagacggggtttcaccatgttagccaggatggtctcgatctcctgaccttgtgatccgcccaccttggcttcccgaagtgctggaattacaggcatgagccaccaagcccagccaagaagcttatcttatatgtggctttgtctctggaaggctgaggatatacacagacatcgaagcaatggtctttgctttgcctccagcttactatcatgaatcatggatgagcaacattacagggagcagactttatagagcactagacttggttcaatctcagaccattcctttattcagcaaatatttgttgagtacacaattaaataaggcagggatcttgtcctggatttccttaccatctgataagtcaccaaagtacagtgtaaatagagctataatctgcattaacacagaggaagaacatctaaagcagacagtgctgatggggtgggagtgatttccagggagggtttccttcacaagaagacaactcagttgagtttcaaaagataagtaggaagtagttagataaacaggtggggtggagttttcagggaagagcaaatatgggcagtcataaaaagaaaacagtcagacattggggtctggtatctcaggtaaaaattttaaccactttggggtttgatttcttcttctgtaaaatagaaataaaatcacctactccatcaggttgtgaaggaaatactttgaaatccaaaaattcaaggcaaatgtttattattctatgccttgaaatatcttggtaagaaagaacaaccaaggtctggcagctctgttgtatcagtgaaatggcattgaatttactgtaccagatacacacccttcactaggtccactccaattttaatttcagttctatatctgggatcaactccttaaatctaagctgcatgatcctgagctgattaaattatcaattttgagatatactttccacatctataatattgagatgaaatatatatatacattttgtatgtcagcagcagctgacccatcaataactgttaactttctatttactcactcttggtcagctctaggttgtttttaagggaagctggctaggttaggttagatttagagttatagtggcattcaactgttggctaaagataacctaaagcactgaatgaagaacatagtctagtgggtttgaagaagaaaaagatggaaaaagggattcttcttttcttagtgtgaacaggtttatgggggagattggataagtgccagcctgggagaggtcaaaggttgtgtgggctaaaaatatggcagaacaagagggtacctgtcaagatagtatgtccaatcttgagatatttggggataggtaatatgactaaagaaatgactggccaggaagtcgatctatggagatgcaagaattgctggaaattctagccaaagcattaagacaagaaaaataaatgaaaggtataagcagaatcaggagtgacagggtaagttttcagcttcaggagaggggactatgggccaggaataatcctgttgatgggtgttttcatgggctaaatcaagggctggaaaactacatactgagtcccaaatctggtaagccatctgtttttgtaaatgaaattttattggaacacagccacatctatttatttatgtcatgtctgtagctgcttttgcattataatagtagagctgaaaagtggtaacaaataccatatggtctacaaagccgaaaatatttgccatctggctctttacagaaaagtctgccagtccatgtactagataaataatgaattaatgaaatgcatggttagagcaagaaaactatgtgggaggcttgatagccatctttatttatttgaagaattgagatgaggaaatgggctcatctcatattctttcaaaagggaggatcaggactaagacatgaattataagagaggtaagctttggatccgtctgataaagatttccctaacttttagagcttttcaacaaagggtgggctatcttggatgatggccttctttcagttactgatagatttaaacagaggcacattattcagcatcagggatgctcaatatatgctgaacaaataaacagagagaatttagaatgacagagtaaaaatggatgactgtataccaagggtaattataaaaacaatgacctaatactgagcatgtattatctatcaggcatgttctaagcacagaatacatactatctcatttaatctttacaacattatcagtagggtggcagagactcctaatttccccccaaaatctgttctcatttcctcagtagtagaacctctgaatttgacctaagcatatggatattcctttattagcctcccttacagctagatgtggccatgggactaagttacagccaaagagatataagcaaagtggtttgcaatttctggaaagagagcttgaaggaatagagtctgcccttttcctgcccctctttcttctgctgctgattggaagaaaggcatgatagccagagctggagcagccatcttagattgtgaggtgaacatgagaatgaatgtcatgtataggaaaaaaaaaacaagatagaaacctgactgcctgtttccgggacttaggggagggaaaaaaaattctatcttgtttaagccaccattgtcttgggttttctgtcactcacatctaaatcttttcctaactaaaactaaaaaggtgggggtagtattattatcatacctattttaggaataaggctcagaatgcttgaatgacttgtccaagagtacagaagagtgaaataacaagaaacctctatagaaaattcctgcattggtgggaaagttatagtcactaattcctagaatgtttccaattttattctcctaagccaaatggaattctaaagaatagttaagttagaaaaatatgaaatacaagcatattaaaggtgtttaaaggaggtgtgacttaacaacaataacaaaaactaatttatcagttaactgcctattggttaagcacctgttgaattccatagagtttagaaggtaagatggctacaaaccaagagatcagtaaagtctaatgatagggtatttgagctaggactttatagtaaggtagtaattacctgtattcatgaaaaggaaaagagactttagataaagggaaccaggtaacaaaagacaaagtaggaaaacacaatgcataaccatgaattcatctgaagtcctcagaagaacatttcatccaatcaaagacagtaaaagttactcagtaatttcaccatcacggaaaagagacactaaagtaactgccaaaactggtaatagaatttaatatccctatttgcttctttagagttttatagagtccctttgagtatctgtatataacaaccaaccaacattggtcagttatttacttatgcattctcttccccaaggcccactcagcaaagagattaaagaaaacattttgcctaagcaatcctttcctcccttttcccttatcacgtgcacacggtgcacatggatttaagtgtgtatacacccacatgcaaaccctacataatatgagtcagtctttactttttcttctcccgaatatctgctgctccactccttcctgacctcctttctctgaactattatgatgaaaattccataactcacaaggaaacaaacctcttaaaacattccctaaaggcactggtgtactcatctgagttcttttccaagaccacaaagatttaaccctttgtgcctttaactccctttattagaaaagtttctgagtctggaatgcaaggctccagactcaaaaaacccagataccctaatctttatactttatgtatattacatattagaagttgactaataagtagatgagaaagctacacaaatatttttgaactaacacattgataaggctgccaatacagtaaaatagaggatcacaaaaaagtttgtccataacaggttaattcccaattgcaaatctcacaaggaaaggaaatcttccctgtaaagacagtctctaatcagcgtgcaaatcatcataactctcccagaaatatgggtcattgatgttagtagaatgtaactttaagccaagagtggaagtggatagaattgtgatgttgtgatgctcacaggactccctctccttcattgtataataatgtcaagattctggagttatgtgtgtgtgcaggcatgcacaaacacacacagatctacaactttgatgatatgaaaagagagaaaagtgggcaacacaagattttagatggcactagacccaccaaaagtcaatcctagtctattttttccagcttcatctctggccaacccccaaagaagagttatgcagtcacattggattttgtgcaatttattgaatcagcctagcacttaatgcctctgtgcatttcccttcccactattttctaactctgttgactccatcattcagcttaaatgccatctttgttctgcagccctccctgacacccacctgtccgcattaattgctctcatctgtttcctgtagctcttcctaccttccaccaccacatcatgtcatggcacattattttgtaactattgataatatagggccccctcacagattgagagcccctgaagaacatgcatctttaaactgaaagggttttataaatatgctacactttacatttccagcatagtaccaagacatatagttagtcttaataaacatttgaccctttcctttccttccatggctatatgagcccaatccttgtccattaagatctggattacttaagggcttccagtctctgaaactgacttccttctgtttcaatccattccatataattttcagaaaaatcttctccaaacactattttcatcatatcactttacctgagaaggaacagagttccatctagtagtgtgttaaatccaaaccatttaccttgatcagtaagaaaatcaatttcttaaaaaaaggggggcctatacagactctgataagattggcttaaatcaatatatcaattctgggaaaaataacatcttaactatatttaggcttctactctataatatagttagccagtgctagtacactttctgctttctctctctacatggatttacatatatatttatatatatatgcaaagaaaaatatatatgcatatacacacatagacagacatatgaatacacacacacatacatatgtatatatgcatatcttctttaatttacctaagcaatgttttttatttatctgtatagaggtctacacatcttttgttaagtatgttcctaaatattttatgttagtggtggtcttgtaaataaaattatcttaaatgttatttttcagttggttgttgctaatacacagaaatacaattgttatttatagacaacataaattataaccttgttaaattcaattattactcctagcaaatattttttaggtgacttagaattttctacatagacaatcatctcatcttcaaataaagttgtacttctttctttccaaaggtaaatcttttatttatttttcttgccttactctagtggctagaatcttcaattatgatgctaagtactaagagcatacatctttactttgtcctcattcatatggggaaaatattcaatacatcactatttaatatattagctgtaggtgtcttaataaatgccctttactaaactgaagattttatcttgtgttcctagtttgctgaaaatttttatcacaaataaggattttccaatgtttttctgcatttagtgagataatatgatttttcctctcttaataggttaacatcgtgaactatatcgactaatttttcaaattgaaacaatctagcaaatttgtggaaaacataaaggctttagaatggtcagaataattcttagaagagagaaaaattggagaagttaacctaatttcaagatactacaaagctccaataatcttgacaatgtgatactggcataaggatagaaatttacatcaatgaaatagaatatagtctagaaatagatttacatatatatggtcgattgagttttcaacaaaggtacaaatgtaattaaatggggaaagggcagtcaataaatggtgctggattcaaataaaaacaaaaatgaacatcaacccccatgtcataccatgcacaaatattaattcataagggattataggccagaatataaaatctaaaacaacaaaaatttctagaaggaaacagaaaaaatattcaagaccttgggatacagaaaattttcttaagacactaaaagcactaacaattaaaaacacaataaaatgaacttaatcaaaatttaaaacttctggtcttcaaaaaaaaaaaaaaaaaaccattaagaaggacaaaggtaagacacagaccgggagaaaatattcacagtacacatatctgaaaaggttcttgtatttgtacatataagaaactattattggccaggcgcagtggctcatgcctgtaatcccatcaccttgggaggatgagatgagcagatcacttgaggccaggagttcaagaccagcctggccaacatagtgaaaccccatctctactaaaaatacaaaaaattagttgggtatggtggtgcaaacctgtaatcccagttactcaggaggctgaggcacgagaatcacttgaagccaggaggtggagcctgcagtgagcaaagattatgccactgtaccccagtgtgggtaacagagtgagactctgtctcaaaaacagaaacaaaacaacaataaaaaaaactattactgctcaataataagcaaacaacccaagtttttaagaaatgggcagaagacttgaacagacacttcccacaaaataataaatgcaaatagcctacaagcatattgtgatggatcaacaaaacttctgcatgaaaaaaaatgaacctcaacccctatctcacaccacacacaataattaactcaaaatagataatagtccgacacataaaagctaaaattataaacttctaaaagaaagcagaagagaaaatttttacaatattggaataaacagaaacttcctaggctaaatacaaaccacagaataaaaaaatggtaaattgaattaatcaaaattaaaaacatctcctcttcaaaagacaagccacagaatgataaaaaatatttttaatacaaacatctaacaagggatttacatctagaatacacaaagaacctctatagctcaatcataagacaaattaccctatttttaaaaatgggcaaaggtttgaataagcactttattgaagaagaaatacagatggtctataagtacacgaaaagatattcaacatcattagtcataagggaaatagcaattaaaatcacaatgagatagcacttcacacccactagactagctaaaattaaaatgaccagccataccaaagttggtaaaaacatagagcaactgcaacattgctggtcagaatataaagtggtacagccactttggaaaacattttggcagtttcttataaagttaagcatatacttaaatacattttacaatccaaaaattctattcgtagaagaaaagtaaaagcatatatccataagcagacttatacaaaaatgtttatagcaactttattcacaatagcccccaactgaaaacaacccaaaagtctaccagcagacaaataaataacttgtagtatattcataaaactaaattctactcagcaataaaaggaatgatttccattatataacaaacatggatgactctcaaaaacaccacattgcatgaaagaagccagacactgaatgcatctatttatttgaagtttagatctgtgctgtctaatactgtgggcactagccacacgcagttatttaaatttaaattaagtaaaattaagtagaatttttaaattcagttcttccattgtgctagccacaattcaagtgttccaagagtcacatgtggctagtggcaaacatattggacagcggagatatagagaacatttccatcatcgcataaagttctacaggacagtgctgctctaaaacatgcaaaatcaagctatggagatagaattggatcagttgctgctggaagcagggtgggtgatggggagggtggactgggaagactataacatgtcccaaagccactttttgagaaatattggaaatgttctctcttgattgaggtggtggctatatagatgtatactttactccccataacatatcaacttttcaagtggaccacaggctgcatttcaatcccacttgctcctttagctgggcacctctgagcagcaaacaacttcctcaactgtacagatctgatgctgaaaatctcaaatgaattcatagcactggcatagcagtgtttgggttcatatcctgccttcatcacttaacaggtttatcttaaataactcaaccttgctaggcttagttttcatatctgcaaaatggggaaaaataagtttctcatgtaattctcataatgatcctatgaaatagcagtctctcaaaaagtagtaccttttattcttatcattataaaaacctctccagagtcatcaaatattatttcctgatataggactatgtctatttcttttaaatcaccccttcagcactataataataaaggctcaaatatctgtacacttactgttttgtgtaggatattattatatgttatatgtgatcattttccttatcttatccagtgcaggaagctaaatgattcttaacatttctacaagtttactgggtgcttagcacatgtgcaaggtaccagattagttcacaagaagagaaagacagaatccctccctacaggaaatcattacttactacagagtcataaagaaaaaaattaggatatgaactaataccacaaaatattcaatagtatagttcaggtagtaaaaaagttagagaatcattaaattgtaagcatactaattgtgcaacagaccaaaagtgcagatacagatggtagaaatcagcataaactcaagtcatcagtgaagactttccagagaatgtcatagtctgtagaagaggacctgccctgggaagtaaagtcaggagaaaacagaacagagagggaatcacagtcacttattggagctgggatggaaggtcatgggttggccttgccttctgtttagcaagggcagagtagcctccatcagcaaaagcagtagaactatcctgggcaagcccaggaaagttctcatagcaggtcaaagtagcatagcacatttcggaagcctggcaacgagggggaagagaaaagtgggaagggccctgagctgcttccttgaacacattgcatgacacatccatgcatcaaaaatacaagcttcctcaagcagccagttgcctccaattagctgggttaactcaagctcgtattataagcaattttaaattaattgacagtcaacatcagcacacctatttgctaaatgctttttcaaaccagtactctagaagtcattccttaattaaggtaattgtcttcaaaagaattaaaaactcgtaagatgaaaactcactctggacgagataaacataaaagaaacactctaccaccctcacacattcttacattacagtctttcagtaaaatgatcctgatttaatcaaaagaagatatgattcagcttctgcaactcttttcttcaggctctgcctcctgtctggatcccctatgtctgatgatcccctcatatctggatcccctacatctgatgtctagcctacattttatcatcacactaagcaaaacattttccagactaaataactctccagtctcatagagattcccccacaaagccgtagcagatgggaagcattttaaatccatatacttaatgtataagtattatgtcatataagatggtgatttctagccattttcttttttatatttgtattataatcaacaccaacaccaattgaaggccttcagtggccctccagttaacaagtttaaaaactattcctgcttctcatggatgcccatcaatgacatcaaattctgggtggatgcccaaggcaacagctgactcaaacacttgatgtcattctaatagcttgttttggatagaattaaaaatgcaaatagaatacctcgttaaaactcaaagttcattttagctgtgcctctgatttgccactgagaattcatcatccaaaggaaggacacaatattacttacacttcttacctaattgaaaagaaaaaaatgaagcaaacaagtttcagggttagtttttgttttttaaagtgcttaatctgcaggccaatactgcagcacttttgctatttttctggatggtgtaaccccaaataaaacagacagaactgttttcagagtccacaatctgaagcaagcagggtggctctgacctgtcccctcccagccttcaggccatttctgaggctctgatgggggttgggggtggggctacccaggaaggtcaagggaaatgcaggtgtgggggatggagcaaatcccaggacctgaatggtgtgggctcctcagcaaatcaactgcatcacagaacatgagtagtattagacttgactaagcataggaagcatgttaagtatagttcattttttaatatcattacgtcatcatttcaaatatcagttgtgattttatgggtaccagggattaaaaaaacaaagcaagctttggccaaagtgccgtaccatactctacactaactttttaacaaataaaacaggctattatatatttttctgattataaaagtaatacatacctacacatttactgtggaaaatttgagaaaggggctgataaacaaaagaaatgataccatcaataagttctaattttgttataacttcctcccagctttttccccatgaacatagatcttttacagaattgaaattatactatatattgtttttatcctgcttcattagacaaaacacaggttaagcatccctaactcgcaaatctgaaatccaaaaatgtttgaaaatctgaaactttttgagtgctgacatacctgatatcatgtgactggtcagagtcaaactgcagtcaaaactttgctttatgcacaaaattattctaaatattatataaaattacctttaagctatacatataaggtatgtatgaaacataaatgagtttaatgttttaggtcttatccccaagatagctcattatgtataatgcaaatattccaaaatacaaaaaagtccaaaatccaaaacacttctggtcccaagtatttcagataagggacactcaacctagtactattgtctaaatataataatatataataatattatactgtctaaaggaataatttttggacataataaaacctacataaatagcagcaattcctttcccaaagttctaaatgttatgttttaaaaggaggcgatcatggaaaatcatactgccttgcccctccgaagccacacatactctcacctgttttatgtatttgtaaacacatccttggacatatagcggcttccagattgctcaatgtttcctccaaaagctgatcaaccaacgggtatgattcattcactcattcaacaaataatttttaacacccactatgtggtaggtaccaagtaaaaatggtccataaaactactctaattggcctaattgatatttatcaaagggaaatttactagggttaggtgatagtttatatttcattcggccaaatagagctgggtttgaggctggtctgatcaacactagcctctccaacccattagtttgacactcatttcagttagggtgcgctagccccctattccctgaacctggcctattcattcccatttctgagtcctgtttatcattcccaggctcccattaccttcctttctcctgagccacgttctagtcaggaagcttttctgaccactgtctataagcctcactctcaaacgactggggcacaaaacatccagaatagtctttaaacaaccctgactgccctgttcccagtggggcagtggtaaggatctggttcaggcaccaatccctcgttttctttattatttcccacagctaaacaatagatgcaatgcatactactagtcacttaaccattcatctcaggaacttttctatctgaatctaactctgaaaagatttttcaagaaaagcattctaccctctcagttgctactggcatttttttttctatcctgactaataaccttggttgctttcctgcaatggatgacagctaagataaagcagctttgaggtagtaaaatttgattcattttacccataactcctcaagaaaacataactaccttgcacacagcagcccctatactatatcaagacctctgactccatgacctgtgctgagcacctcgtgtgtataattttattcagtcttcacaggaactgcggtgaggtatgtaccaagatgacaatttccaatttagagataagaaaactgaggttttgacagattaagtcatacagtgaaccacaggtgaagtgaagattcaaatccaggcagctgtctccccatactgtgagttaacccatccaccctggctaatagtcttcctcactttgtcttcccatgaggctgaggctagtgattctcacatttacatcagcatcagaatcatggtggggacttggtaaaactatccttgctagggtggaacccaagagattttgattcaggaaggggaaaagagatctgcatttttagcaggcacctctcctatcaccacactgccaggtgattcttgtcttcagcgtatacctaaagatattacattgagcataagaggatcctacacatcagagcagaggcttttgtaaaatttcctcattacccatgatccatcggggctttaaaaatggcaggaagttattgtttaatgggtatggagtttcagcttaggatgatgaaaaatcttgtgagagaggcaatggtaacaattgcaaaacaatgtaaatgtacttaatgccacggaactgtacactttattttttattttttagagacatgatctcattcagctgggactacagacatgcaccaccacacccagctaatttttttttttttttttaaagacaggatttctctatgttgctcaggttggtcttaaactcttggcctcaagcaatcctcctgcctcagcctcccaaagtgctgcgattacaggcttgagccactccacctgacctgtacactttaaaatggttaagatgatcaattttgttatgtatattttaccacaatttctaagatggcaggatcctaacctcttagctgccttagggaaggtgtctcttgacaccccctcctgttgacccagaggaaagtgaagtttaatcctaagggaccccttgagaaagggactactaaaaggcaacagatgaagccaagttggccctgtgtggcccctcttcagttttgagctggctgtgtatactcaggttgaggggacagggctgtgcttgtacgagttcccaagaaactgcatcacacctcatcccctgcctgcccaccgtgaaacaaaccaatgtccagtccctaacataacccataggtggccatggacatgggacagagggaagagaggagcccaaaggatggtagggaaagagccctcttcaggtttctaatgttagcccccccagggatcatctacaagtacttcaggccattccgatttcggctcaaatgtcatctccttagaaaggctttgcctgcttgaaagcagcccctcctccacacccattactttctataatattaccctgcctggttgtcatttgagcatgcaccaccactggaaattatatttattacttatttgcacactagtaacttgtttgcctccccagactagaactagaatttcctgagagctgagaatgtgctacttgtgtttactgcccattctcaaggcctcacttgagacacggtgggaacccaataagtatttgtagaataaataaatgaatcagcctcatttgtttccttttgtataatcagttctttctacctcacaaggtgatttgtaggaagggtcaaatgagatcagatatgccaaagtgttgcaaaaggaaaggtatcacatacatggtgaggttattgtgcttggcagggaggggggcagttcacaaaaccctgagtgccttacaaggcctccttctgtgaccttggcatggtgatatgctccctcctcacttcactcctcctaggtggagtggagatttgtctggaatctaaaaatgacagtgctccactctgcagatcatccaaacagaatgcaaccaaattattacaaggtgaggcctctcagagagttttcttactaaggggctcaaataacaagatgatacttatgaagttagggatctgccaggaaggcaaacttaggggaagaacacaaagatgcttcctgccttgggttagttgggctaaacaagtatgaattgagtgagtcgctagtatattccagttcctgggctcagtcccaaggatagagagagaggtgactgagattgttacagtggagttggggagacagttactaaacagaaaactcaaagtcagtatggtaaatctggcctacactagtcaaggaaggctttctagagtgactgatgcctaaatgaatttaaaatataaaggatagaggaaagaggggttggggaagagtgagtggccaaggtaagacacagaatagaaagactacacagagtttagggagttccaagtagtgaaagctttgggtatttattgctggagtatctatgttgtgaaaaggttggggtgcaggggagggaaggggaccagaagatgtacctggagaagtgggcagcagccactctcccactttgggctaactgcagcacctctgtcagcactgatgcagctgctgcactgccctgccctgtgaggtgatgaggaagctgcaccgtccagggtgagactgcctgatgcacagcttcccaggcaatcgtgaattagtgacacggccgatgttttccagcatgtgaggctgggaattccttcccttgatacctctctccagtttccctaagccttacccctccaaactcaagtcctccctgtttgcagcacagggaagtctagtttatcttttgagtgtcacctgtttctactcccagccaagcttgacttgccctgttggctactggaccaatgaatgggctcatcctgggcagaattccataggcatgtgtctgaaacaagaggcctcaaaagataaaccagagttccctgtgctgcaaacagggaggacttgagaccggaggggtgagacttggggaactggagagaggtatcaagggaagaaattcccaggttcacatgctggaaaatatcggccatgttactgattcgcaattgcctgggaagttgtgcaccaggcagtctcaccctgggacggtgcagcttcctgaacacctggcagggcaggacacctgctacatcagtgctgatgaagaggtgctgcagttagcccaacatggaaactcctctgagccctgagtgaaggcagcagaaatgaacagaaggagtagagccctggggttttagtaaaatggttatgccccaaatttggtcacctggtatgatatgattcagagcatgaaaggcggaaaaccagagggagagagggaaagaagagagagtagaaggtccctccatttcttttctctgttttacactggagctgcctcaatcccatgcacatagaaaaaaaaaggaagaggctaacagttgctcacctggggttatattttcaggggctgacaaacaagaattttaaattttatatattcatttggatatttgtaagaagaaaaatgttttcaaatccaacccacccgtccccagataaatcactccagctttggtcagaacctggggacagaggtgaaaatccttatctcactaggacactcatttttcccattcctccccatagcctccagctcttccagcttactggcactgacagcgtcctgttgtggttaagcatagcaagtggcttccctgtcataagaggtgagatggtttggatgtttgtcccctacaaatctcatgttgaaatgtgacctccaatgttggaggtggggcctagtgggagatactgtatcatggagtgtattcctcatgaatggtttaatgccatccccttagtgatggtgatgagttctctctcagttagttcacacaagatctggttgtttaaaagaatctggaacctcccccttctctctgtcttgcttgctctttggtaatgtgacatgcttgcttccacttcaccttccatcataagtaaaagctccaaagcctcactaaaagccaagcagatgccagtgccatactcatacagcctgcagaactgtaagccaactaaacctcttttctttgtaagttacccagcctcaggcatttctttatagcaatgcaagaatgactaacacagaaaatcagtactggggactggggcattgctataaaaatacctgaaaatgtggaagtggctttggaaatgggaaatgggcagaggctggaagagttggagggctcagaaaaagacagaaagatgggggaaagtttgctacttcttagagagactggttaaatggtcatgaccaaaatactgatagaaatatgggcagcaaagtccaggctgatgaggtctcagatggaaatgaggaagttattggaactgcagtgaaggtcaccttgttataccttagcaaagaacttggctccattgtgtccaagtccttgggatctgtgaaagtttgaacttaagaatgatgacttggggtatttggcagaagaaattttttaagcagcaaagcattcaagaggtagcctgactgcttctaacagcctacaatcaagtgtgatcagtctaaggaatgacttaaagttcgaactcttatttaaaagggaaacagagtataaaagtttggaaaattcacagcctggccatgtggtagagaagaaaagcctgttttcagggtaacaattaaaaagggctgcagagcaaccacttgctaaagagattgacatgactaaaagagagccaagtactaatatcctagacaacaggaaaaaggccttgaaggcatttcagatcttccaagctgcccctcccattgcaggctcagaggctaaggaggaaagaatggtttcagaggccagaccctggacactcctgccatgtttagcctcaggacacggctgccccagttccagctgtggctcaaaagattccatgtacagctcaggctgcctcttctgagagtacaaactgccatatgccctggtggcttccatgcggtgttaagtgtgcaggtgcacaggatgcaagtgtgacacaggatggcagcttccccctagatttcagaggatgtatcagaaagcctgggtgcccaggcagaagcctgccatggagggagagcccccacataaagagactctactaggacagtgccaaaggaaaatgtggggtgggagcccccacagtgttttgtacctagtggagctacctagtggagccatggaaaggtggctgccaccctccagaccccagaatggtagagccaccagcaacttgcactcttcaagcctggaaaagatacagatagcagactccaacctgcgagagcagccatgggtactgcaccttgcaaagccataaagcaccagtgtgctctgaatgtgggacatggagtcaaggattatattggagctttaaggtttaatgcctgccctgttttgtttcagatttgcttcgggcttcttgcccctttctttgggccaatttctcccttttggaatgggaatgtttaccaaatgcctgtaccaccattgtgtcttggaagtaaataagttgttttgattttatagactcatgggtagagggaaatgagtcttagatgagacttaggaattggtacttgatggtggaatgagttaaaactttaaggactattgggaagggatgattgtattttgcaatataagaagaacatgagatttagggggccaagggcagaatgacatagttggatgtttgtgccctccaaatcccatgttgaattgtgacctctaatattagaggtgggacctagtggaaggtgtttggatcatggggatggatccctcatgaatggcttagtgccatccccttggtgatgagtgagttctcactccattagttcacatgagatctggttgtttaagagtctgagacctcccccttctctgtctcttgcccctgctcttgccatgtgacatgctggctcctcttgccttccaccataattgtaagcttcctgaggccctccccagaagcacatgccagtaccatgtttcctatgcagtctgcagaatggtgagccaattaaaatctctttttaaatttttaataaattacccagcctcagttatttctttatagcaattcacgagaagactaacacaagaggtcaaaggtgtgttactagttgacccctgggaggtgatgggaccagagcagtaaggagcagtacttagagttcacctctagcacccatccatggttccaccctgcaaaacccatacacacggctcagcctctctcatctacttctgagtccccaaaatgaataggtctccttcctctaagccatggcagcaacactaagaaggagcattttctacctcctttctccttatgtgcctcttgttgccccagatggcttgttacctcctggctgactatttaccaaagtattccagcctctggggcacttcagcagtctcctagaagcaaattcctgtaggatggacagatgtaaaagttggaaacaaggcatattctatcaatagtggaatgattaaataaaacatcatacattcaccaggcatgatggcttaagcttgtaatcccagcacttttggaggctgaggcaggcagatcacttgaggtcaggagttcgagaccagcctggccaatgtagtgaaacgctgtctttattaaaaatgcaaaaattagccgggtgtggtagcacgcacctgtaatcccagttactcaggaggctaaggcagaagaatagcttgaaccagggaggtggaggttgtagtgagctgagatcatgccactgcactccagcctaggcaaaggagcaaaactccatctcaaaaacaaacaaaacaaaatatggtacatttgtacccagaaagcaggttttattgtttttgtgacttagatctagataaatttacctgaagattttcagagcatattgttactttttttttttttttttttttttgagacaaggtctcactctgttgtccaggctggagtgcagtggcacaatcaccactcactgcagcctcaaactcccaggctcaagcaatcctcctacctcagcctctcgtgtaggtaggactataggtgtgtgccaccatgtccagataatttttctttttcctttttcttttttttggagagatgggggtttcactatgttgcccatgctggcctcgaactcctagcttcaagcaatcctcccactttggcctaccaaagtgctgggattacaagcataagccaccatgcctggccatattcttaaaaataaaaataaatcgaacaaaacatagtatgaactcatttatagaaaacaaaagaaaaccacacacgaaaacaaaagtatatctttatgtgcatgtgcatgtgtgtaactatgtaaatacatagaaaaaagtctataagaatacccaccagaccaaataactccaaaaaaaaaaaaaaaaaaaaagaaagtaggctttgatggggactaacagggggcttttaacctatatgcagtttacattatttagaaacaagaatgtattcactcttctggaaacaccagtagcaaaaaaaaaaaaaaaaaaaaagagagagagaatgtatttgtatatcacttctgtaattaaaaatataattttttaaacctgaaattgttaggagattcttttcatcctgcagaactttgctttaacaagttacatactagcaccaggaaggcagtggaactagttcccacttgggcaagggtttgtttacactgcttatctaaagttacagccaacaatgctaatgattctgaatagcaccagccactccttggccatcccctcccctcccacccacagattcaactatcacctctatgtggatgacttccaaatgcctctttccagacacagcctttccttggagctacagtcctgatttttcaacttcctcttcagtagagccaacacacgatgtagaaaaccagactcctgtcctctctccctctccctaatccagctcttctgcctaacttcctccttcctatgaaccggtacctcttttttcccctagaaacccagaaaggaaacttcctaatcatccatagtcctctttatcaacacacccacccccaaatatccaatcagctgtcacattctaataagttttctaaaaggttcttcccaactaataactccctgtattgccactgacaccacctcaattcagatcctttgcatacatcatcaggactagcagaatcaccctcagtggtctccctgctcttaactgctttgacccactaactagatgtcccatttggtaaaggaccaacattccagcctgccacagtcattttgagccttcattccatcacctattgtatcagctattttcccagctttgagtcatttgccaatttgggaaatacggctttatgccttctccaagtatctgataaaaatgttaaagtgagcttagccaagaacaaggttctgaccgcagatctgtttccaaggaaacctagagcttagtactaaagtaaagaaagtaaattttaaaaaaaacaagtagtgttggatgtttttgacaccatctcattcataccttacaacaatcccttgtaggaggtattgttaccccaaattttagagactttgaaactgaggctgagaatggctaggtaaacatgtgaaaaagtctcacagttattaaatggtagacttgtcatttgaacttgtctgttgattccatagctcacggtttttccaccacacagtagaaacctttcatggatccttaccttctaaaaggtaaagcacatgtctcttaatctgcactgaacgtctttcacattctagctccaaacttatcttcgtaataacagatgatattacatgtcaaacacagtaataagctttacatgctctatttcatttaatcctcatcacaaccccatgaagtaagtgctatgactatgtccattttacagattcagaagctgaggcatagagagattaaaaatagcttaatctgtaaatcagaaattatctaaaaataatttcttaagaatagcttcatcaaggcccacccagttagaaaacagcaaagctggatcaaacccgggtatgcctgattacagagatatttagaaggcagaatgggcaggaattcccatttgtacaacctatcaacatgtatttcttgagacctttgtcacatgttcaatattgtgtgagggctggaaataagagaaatgaacaaccaacaaaagtccctggccttggcttcatagggcacacatacactctattgggaaagacaaacattagaatggaaggcagcagcgtgtcatgactgggaaggtgaggccttcagtgctaagaaaccacagactcaatcaggtgagggttttggtctcagcaagtggtttgattaaggttctactcactacgatggagaactcaggagaaatgggtttaggaaaagatgcattcagtttgggacacgagttttggggagatgctacccagccaacccgatatgcagctttggagctcagaagtgagaattaggctgtggagaggcttagaatcattggtgtaaaggtgcaactgcactcacagaggtggaagtccttaccagacatttcttggtaaagatgctgagaagttcaggtatttgtccatgtctctctaactgactgaaacatctttgatggcaaatcctggatatagaatgaggaatgcagtaaacattctagttacagaatgaaccaaagtccttaatttcaaaacgagtaacaaagccataaatcaatagtagagcatttatgtgaactagttactctagattaacctgaatggcttcctcaatacaagagcaaccaatgtcctgggcatcctcccaagtttttgctgagtcttcccactgaatagaactggtcacaaggtgagcatttgctgtctctccttgtacattctagtctgattccttggaatgtgctacctcagtcccagcagcccttgcttccagaattcttcaaattaaaaataaatttctccaaaaaggaaggaacgaggatggaaatgtttagcaaaagaaaacaccaggtaacagcaacagaagtctctttcccatgagtgaagttagagttttaactaagcccctttaacaaaacatcgtcaaaatttacaacttacaaatgattcctcacttataatgctttgttctatccttccataaataaataactgttggaaacactgagaaacagagagagtgagcaacatcttgtttcacaaatgacagaaagtgtcaggtccccacctgcatgatcatctggctcaggtaaactcagatgggcagttgctgtggggaccttgctcaccattgtccccaccagccagcataatgcctgacacaggggagtgactcaaaataactgctgagtggatcagtgatgaatggatgagaaaagatggttgaaaaaaagtccaaaattgtgggcaaaaaggagacaaggatgaggggcaacacgtaagcaacaagaatgtgaagaaggcaaccaaccaccttcttacatcttgggctcagattctcctcagcttctccacaaagacacccatgcagtagctaaatctctgggtcagtttctgagtcccacaggtgctgtcaaacgcagagttaaagtatttgacctttaatttttaagttttatatctgctttctcttttcatttctatatgccttaggaacactttttccccccttaagctttcacctaaactaaaacttgacattgaattagactattactagattctaaggtcatgatttggaccaagcttcatcttgcaggtttgctgctctgctatttaatgttttactccagaaaaggaagtccatactgtgtgtccagaatcctcaaggatggtgtctatccatctgataatagagttccaattctgcctgtcttgggaggaacataaagaaatgagagtatccttgcttacaattttttttttttttgagatggaatctcgctctgtcacccacgctggagtgcagtggcgcgatctcagctcactgcaacctccgcctcctggcttcaagcaattccttgcctcggcctcccaagtagctaggattacaggcgcccaccaccatgcccagctaatttttgtatttttagtagagacgggggtttcaccatcttggccaggctggtctcgaactcctgacctcatgatccacccgcctcagcctcccatagtgctgggattacaggcatgagccactgcacccagcctacaattttttttaaaaggcatttcattttcatctcacaggaaggccattttagaggctacccttgatttaacaccaaaacttcttacaagagcacaagccccaattacccaatccatggtgtgcacttcattctccttatactcgcccacataaacagtgtccctagctccttaccacatctgaagctgcacctgtcactcttaggaaagcacacggggtctccaggaattcaatctatgcacactcaggagcagcaaataattttaattctcgcatttgatgaccatggctaaagtacagctaattttttaagttcaaagtaaaatccaagtggcttctagattaatatctctattttagagatacaactgattaacaaacagataatgaactgccacagcagaattgcaaatgtggtttaatgatgggaaatttgtgaacctgatagaacacatgagcaggtcaaatgtgaaaaagcataaaatcatctccaagattacctttttggcatttgataaaattcaactgcctttcatcttttgcttaaatcccggaatataaaactacttcttcaaagtaatttaaactattttaaaccaaaagccaacattatgccttctagaaagtatgaaaagcatttccattaaaatcaggagtaaaataaaacagtctattatcttcactcagttattaatgttctagaattactaatttaaaagagaagtaatcattatttgtgggtaatataattctctacctagacagtgcaggagaatctactaaaaagttaagttgattaaataaaaaatataaaacctttagaaaataatgagtaagacacagaacttctccactatggaccactgaccccattcatttcagaactggtattcctcgagtggtcatctgcaagctttgtgctcaaataaactctatacttaatcatattttctgaatctcatttgttaaagttgacaatcttcatgatagaatgttaagcaaggaatctaggatccaaaattgcgtatgatgtatttatcatgtgatcccaattttatttgaaaaaacaaaagttccattctactgctccccagctaggtagcttaggacaaatccatgagtctcttaggagaccggttccttcaactcctccaaaaccaagagggccaagcttggacccttctcctttcttcccctcaattgtaagtattggataacagcatataatcaaaaattaataaataaatataaacagaagtatgtctgtgttaataatttaagataaaatatagaattgtagttgttaaagcaaaattatttttggattaaagatttttttaaaaatgagtatctcctaaatgggtgatatattttatatctgactccttagatagtgatagttcattagaaatagacagcatggtgagaaatgagcacactctcttaacttctatgactaatttgatctgggcttgcatgcctgcaacaggaacgccctccacctgttgtcagccatcccatgacttggcattagagacgcccggaccattctcagccagcaaaaggcagtcaaaagcctatccaagagtgtcatgggagagcatgcaaggttgcctgatgtctgtgttgcactgctggtgcaggaaattgatttttggagttctttttgcaaacttatatagcttctatgcatagctcaaaagttcctgccttcttctcttagattcaaataataattgagctttttttttttcacaactacctctagatttaccaatccctaccactgtaaattttaaaactgtgcccaagccatgatgaaagaaaaacctcaagcacagtaagccagaccgagttagaagcaaattaggtctaagtgaatccactcagaccccgacagttaaccaaactgctcaagctctgctctgtcatccaaattcattctgcctttgtggagggaaaaggaatacaatttcatgcccagagtatttagcttttgtgaattttatccacctttctgagattggcaaaacaggctactagagagggcttcaattcttccaggcaaacatttcatatgtgaaaaacacgctgaatcaatgaaatctgagtttgtgttattaataacaacaaatgaattgaaactttctttagaaatcacagtaacttgaaacaactcctgtgatatccaaattaagccatgttatgtgatattttaatcccagatttgtatagcatgtacttggtcacaggcttttttcccaaatgatttttttccattctccagattttccatagtcagtaatattatatagtttaaacctaaagtgaagtcatcaaaacagagtctctctttatgtctgtctcttccttaattctacatatagcagccttactgttttattattattatgtggctattcctataaagcaatgaaaatatacaaatgctagctgagttttgttatagctctgaacttgtgtgcacccatcatcagcccctctaaaggagacctttcattatttttacaaatggagcacatttccttgaggttaccatacaaccacacagccagcagtgatgccactactaagaagagagagataagaggttttgggcaaacatcaccgatgacactggccagtactgtttgactaacagccctgtcaagattaggcaccctatctatgttttgttttattttccccagatatcttcctccttcctcttcaagcaagtagccctgtactcactgcttcagaggagggatatggggggctgagggcagacctatgagcctttttggcttttgttttaaaaacttaaaccccaagagcacagaggaaagggttaaagggcattaagtctgtatcatagacccagtattgagcagaagcagggaggagactggagctttactctgacccttgcccccgttccaactcctactggctggtagtcaggggagaaaagacaaaatgtctcataggtcctgaaagcagaaggaacctcgcttcctggcagaaggcaatgagacttcagagacttcagggcgctgcggctgctgcacccatgagaggcagctcagtggcactgtatatgaagtcacctatggacaaggacagtggctatttcagtggcagctggggagagaggaagtaagacctgcagctgcaacaccattcagagagcagtagaagggatgaagatatgaggctaaatcctttttctgccattcaactgggagactcagtaacaacaataaaaattatcaaagaaactaatatttgttagaattcttattctagcccatgtacagttctaacaactataaaattatcaaagaagctaatatttgttagaattcttattctagacaatgtacagttctaagcctccgacatgagttatttcatttaattcttacaaaacctatttgataggtactactgttacccctctataatgtagatgaggatgcttaggcccaaacaggccaagtatcttgcacaaggccatgcagatgataagtagtagaggccagatataaatgaacctaagcaacctgactccagatcccaaacttataaaatgaaatgagggaaaatacagttatatttcttgtacatccaagtctatggcaagtctatttagttcttctcaaacttgtctctttgtctaacaatagagcccctctttcacgcaaaatctcaaacagagccccagtatataagacaaataagagcaggactgctcggtaaaagccgaagtaaacgatagagatcttcattcctcagcatctccctcaccctgaagaggccccaaacactcctggaacatagtttgaaaacccctgttcccaaccaatatcactctggattatgtgcttgagagacaaaagcagcccagctagaacaccaacaacagccagcataatcaaaggaaaaaggcaaaaataatcccccactggcagttacagagggccattccaatctgggccctgacactaaccagctcaagtttgagcactggagggcccagaggtggtggaattccgggctggagcaaagagtcaggaatgaggcaaatccaataaacaggcagaggcgggagcagagccaacagggcgctggggccagcggtctgtggtgagcgaggcggctgcaggaacagaggtgggagcgagagggaggccagcccaggaactgctcccacggcttcgggctgtccagatgcagtctaggagatggcaacagtgaaaacttacgagtatttcaataaccagtgttctggggaagaaaaaaaccaactacactgccctctttctcaccaattccaacattgcattttccccacgtacagtcacataccattcagtggctgatagtgtcagactcaacagccagaaatgcctgcctttgggagtagtgtgggtgacagttaagagtgccagaatgcttggactcacatcccggatctcctgcatactagctgtgtgaccttgggtaagttacttaacctctcagtgcctcagtttcctcatctgtgatatgcagataataaaagtacctacctcagaaagtgggttgtggggattaaacaagttagtacctataaattgcttagaacaatacctagtacgaagctcttactaaatgctagctatattatcattctcttattttgatagctttcttctcactcctgactgctttctctttattcttccatgctgtattagtttcctacagctgctgcaacaaatgaccacaaacttagtagtttaaataataccaatgtgccaccctacagttctggaggtcagaagtctaaaatgggttagtagggctacattccttctggaggctctaggaaagaactcattttctctccttttccagcttctagaggcttggctcatgaccccttgctcacatcactcctgtctccttcttctaagaacactcgagattagactgagcccacccagatcatccaggatcatctcaagagctttaatttaatcacatctgtaaaagtcccttttgtcacgtaaagtaacatattcacaggttccaggcattcagacttggacatctttggtagatcatgatctagcctaccatctccacctccccaaaacctaacactgcagactgggaagacttgaggagccctgggggaagaaacagtaatattagtagttaactttgagcactcaggatgtgtctgtctctatgcaaagtgctttaggtgaaccatctcactttggcctcaaagcaaccctgtacaattactattgctattttacgcaaaggtcagttgctcatccaaggttgtactaggtaaaccccagggaaatttgattctagagaatcttgtatttacgaatagagtgtccaggctctataccttaagccatgataactggattcagggagtcaggtggggaaagatcattaggggcctcagagactgtgccgcaagaggtatacatgccccctggctgcaaagagacagggggtcctgcagaggccacgctaaactacacacaaaaggtcaaatgtccagaacatctcctcctactcaaaggagaaaccttggggttactcaataatttcttcaaaggcaggtttggaccaaaatctaagaagagatcactgaggcttgccactacttgaggaggagaaatgaaatgtccattcttgcccccagaccagccttgcagttccagtcgaactcccacaagaaaagaggaattcaatttccctagaaagacttccgactgagtcagattgatgcagaccctccaaaaacacgccaggagggcttacaatcctggtagtccaccaaatggccctcgcctgtaacagttgatctatactaggaccaaaccaccggccaccctccaccccataacagttatgaatatgtaagcccccacatgccaaagatttcaacatgagcccaatggtttcaccagtacccacctcttttcctaccagttcttacacagtgaatgctcaaaaacaagtgtggctgacacagggtggaaaggggcaagctaaacaattgctaagcacgtctattacggtggttgaactatccatggcatttcaaaacctcaactgctaaacaatttagccagatcactatctgaaactttctaatgagctgagttaaagctattaggtttcacctaaccaaaaaaaaaaaaaaaaaaaaaaaaaggatggttatttgttttgggtcatgagcccagaggttaatgtaggatagcacagtgatcaagagaacagactctggagacagcccactttgactggctcctgacactggcacttccttgctgtgactttatgcaaatcacttgacctttcgttgcttcagttttcccatcttcaaaatgggcataatcatggaagtccacactccctaatccaaattctgagcagccagccaactgtgattcagaagctttatggattttgtaatggtaaaaatgcatatgccatatcttacataacactttcaatggtatctgcagcaaataaaatatgcccataatttctgaagtaaaaatatatgtgtagttctcaccaagtgagaaaaataaagactgtcataacctcacgtcacttcagaccaagttttgtagccaaatttatgaaaatcacagtttttagagcttttttgattttggaaatacagctaaaggataagatctctcacattgactgagtaatatataaaaattaaatgcgttaattgataaaagttcttggagtggtgcctggcatgtagtaagcaccatagtgttaccaacaacaacttctattattttcatgtaaaatttggaaactttaaagttatgactaaatttcatttggaaaccagtacactttggagattaataggaattacccctttgaaacaatcctctagggaaggattttctgagatgatgaaaatgttctatatctgcactgtccaatacagtagccactagctgcatgtagctatcaagcacttgaaatatgggtggttaatttcatttaactaatttcaattcaaatgtaaatagccatatgtggctagtgactaccatgttggacaatgtagcctccgagggcttggttcccaatctggcccacgaaaatctatttaagccataacacagatgaattatagcctcggtaaaaaccctgcattctgcatccagggagcagagaggaacacatgatgctagagagagttctgcccttctttgtaggccacatggttggcctataacaaaatgcatctttgatatcgtcttcctctctttctccattccctactcctccatctccaactctcctctttgggccttacataactaaatcacatgcttccctaaaaccctatcagaaccttccacccctcttccagaagcaccatgtttcctaatcacctgtcttccctcgcctcaaccaaacccctacttgctcaatgccacagatctcaactgaacgttgggaggaaagcaacttcagcaaacaaattcacactcttagctgcttctactgtttttggcttttcctctgcttctccttctgaacccagaagctctgttttattgttcttccaccgcagaagtagttccggcagagagagaaggcattaagactaaagcaactgtcctatataggcgcctgtcagccaggtgtgtggaacacacacgcgcgcgcacacacacacacacacacgtgcagcaagcctcactctgtgcaaatccctcctcttgcccaggcatgggaaacgtcccctgctgtctactttagaaaactcttccaccatgcacagtattttttcaatcttcttttattcatttagaaagttacaggtaacaaattgcacatcaaacagtttttttaaagtatacaacaaaagcccagagaagaatgtgactaagaatggttgtaaatagaaaaacaaaaccaaccgccttcattggaatctagcttctaacccactggagtatggaatttttaatgacaggtcaaacttggaccacatcccaggagtttatgttactaagaggactggaagaatgtccctccagttcaatctggcttcttacctggtaagacatggctcctgggtataaagggaatttcccccatggggctgtaaataaaggatagtgttaatggtaaacattatacattcctctagctcctttcaattatattatctccttctccaaagtagatatttatgttgtaaaaccaaagtcttaagatttaatactggcccacaattatctctagagtcttctaggtgcaagcattttgccatgaaagccacagcaaatgccttcagtagggaaaatgagacatctacataaataactcccagaaggtagagagcagaaagggccctggagaaaaaatgctgcagaaatcagagcagggggaggttggctgtttcaggaaaagcctcacaccaccagcaaaacacagtttgaaggatggttagactttagagtggtggatgtgggggaagatgtgccatcagatggtctagatgacaacaccatcagacattcttcagaaaagtatttatgaagacatcgatgcatacaataacctagagatagtccacctctctcctcaatgacaactgggcacctgtacaagcacctatggggtcacctgcttccacctcccaagtcaggctctcaaaaattctccctagtggggtcaagcattcttggcctcagtagtgcccattctgtggcagcggccctgccctacctctacggggggtataagaaacatgaaaacataccaatcctgcagagatctaaaagacctacgggcaaattttgcataatgcaactgaaattatgaccttcgtgcaaataaaacttttcgaagacgtgaatcctacttaacaggtattcagggaactcactatttaaaatgacactgattaatcactaaatgagtcttacactgaataattggttaagtcggctgaactcagtgtctgatggcttaaatacagagcgaggggcgaaagcttccacaaatttacgctgtgcacctaacattcgccacgacagaagacttcttgctctagtgtatttattactgtagcattaaaggacttgaaggcaaagctagctattctagttatcagttagagcgggacctggtccaatattgtattttctaggacttgatgtacacaaatctctccaggaacaatctcttgagcactttccttgaaataccgctgctaagtaccgccacaaaaagagcttacgtttttctttgcactggccacctccacaccgtattcacaacacgaaggggcgacctgaggcaggcgtctggagtgaaggcactggcagggtgtcctttagcccctgcgagggcggcctgcatgccctggaggaccgcccgcctcgggtcccccgggagcgcgaggacacttttccgccaggtacgcggagtcgggctgctcccttaggcgggtcgactgccttgggagagaaccagcccatccttccctttctccagtcctcaggaaccgagctacagagtcgcttcctcacctcttggctcctggcgagtctcgccggcgtccccaagcgcagcgtccctctgggaccagccgtccgcgcgcctgtcgctagcggcgtcgggtgtccccgctactgtgtgtcagctgcagagccgatgcccaggaacgcgcaggagccaggcaagtgcccgagaggcagagcccgggaggcagagcccgggaggtagagcccgggcgcgccgccgctgcccctcccgccgcgcgagcccgccgcccgccgcgttgcccacgttgcccagcgttaccgtgtggacccgcgccgttcacagtccgctcccgccgagatgtgcgcgctgcccggacagcggcggctgcgcgggcggcagcggggcccccgccctgggccgggctttcccagaactcgcccgccccgggtgagaggccgctagcgccaccgcgggcggccgggcgggggagcggcctgtgccgggcccgcccccggctcctgccgcgcggggaaggcgggcgcggagcgaggacccggccgcctcccccggagctggctgctggcggcgcgaccccttcccagacccctggccctgacccctaggagccatcctttctggcgggagccagagagagcgctcctggggcgcccggctccgggaagggcgggaactctgcacacctcaggcggcgggaatttactctcacactaccccagggaaccacccctggttgacagatatggaaactgaggttcacggcagataaaggacacgatcaaggtctctgtagtagatggcagcaccaagtctcgaatctgttctgtcactcgttcatttaatacatattcattgagccccatcaatgtgcccagcgttgtgccaggctccggaaatactccttttgctggtaatggtggccatccaggactgcggactccaaatccagtactctttcattgctcaagcaaacctgaagatcttcacaactagaaactacaggctttgcacagaacttccttagccgctggagcggcttttatgagtcttaggagagccaaggacctggaaaaaaaaatcaaatcatcatcctcctccctttcgcctaaacctgtgcctcctccctctacctgttctaatggaagaccgttccctaggcctgacctcttctcctacatccgatcaggacccattcctgtggcccatatcgcctcccactgtcctctcccttggaccaaatcaatccttcaaaccaccgctgtattattcttccttttttacaactttaatctatgcagaaaacttcactggctccctattgccctccaaactaactctccatggctgtgtaacccagcatgccctggctaataaggatcacccaacagaatgtctctcccactctagctctgtacctgaacttaagctgagccttctacctggagcatctcctcccacacactttcctcctgctcatgtttgaccctttctttcgggtccctcttaaaagtgatctctccttcttggaggctccagaacacaggagaggttggagcaagaaagcacaggaggcccaaagaatcctgctgttaagaaaaatctgccagtctggtccttaaactgtcttgctgttttctcaccactaggactttaatgaaaactaacatgattgcctccctggagagctgatttcagaaaggtctctgcagagggctctaaagaaattctttgttccttaagatcttggcattttagcactaggacagtgagaagtggtaatttactcaatccctgaggctatgttatcctgaacaagtaaataaagggctgaggaaagaggtagcatcactgacaataaacaaggtaggctatttatttaatatacagtattatattatggttttataattcatttaatgatcaaataatatcaaacttcatccatcacctggcacccccaaagactttttttttttaatttggcacatgggaatagatagctacaaactggtagatgcacaagcagttaacattgaatcctccaaatgagtcattgcatgattagtaagcaaggcaaatctaggtccgttgagcaggaaagttatccaagtgtgataatcactgtggccccatccctagaaaggggcgccttcctcaaatctttgcaaagagagcaggtccagatcagtgtcctttgctcgccccatggctccctctctaaacgagattggagggaagtcgtgtccccgaggctgcctcaccacattggaatgtctgagctaacagtacttccagagtgttcattgctcctctgaacagcactgcccagactttctggagattttaattcactccccaacctcgccaacagttgcacacaaggtgccttttttacaccctgctctctgttcagtgaaacacacagaccatctcaggggaacaatggctccattcaagactttttcagaagtgcaccatataacctccactctgtgggctgctgccagccattatctagaggaagaaagactgtcagataaagcgcctgagaattgggaaagcactggataatttccatggaaaattcagcttcagtaaactaagttatgcatctctttatacaagaccattctgcatagacaacaacaacagccccaagaaacaatcctgtggagactttatttcagtaaagtgcatctatgtttgaaatttcagaagaaaacacacatgtcttttgagcttattacattacatactggtctccagtcaatggaaattgatttaaatacatgataaacatagagactagggaatttaagtagtaaaattattttaagaaacggaaccatcttccctctttctttctgcctcccctatcctgtaattttcagaaaggaggtgggggcagtggtctctgacttcatggtggtggttgccaacaagaggccccacaccctctactgcacatattacagaagaaggattggcgctttgccacactcaacaagccagccatcagttaacccgttcataaacaaaccattagtttgggaactgagtagtcagtgtgggcaccattgactaatgcattgatctttgtcaaacagctgctgatcgtcaaacagaggaatttgccaacagacatctgggtagcacaaaggccaaggaaggactgaaggaacaaggcagccctcagcttttgcagttgccattttctccctttcaaagtcactgcatcaaactgtaccgggcttactagctgtctgcaaatagactagcaagttcagatggtgagcagagagccaaaaacacacttcctagagttgtcttgtatgtgaggttagatgtactaaggcagtttgaggttgatgaaaaacaaccagcttgttaaagctgtaggtatctctacctgtgtgacatggttaggagtgagggtccccagggaacagtaagcaaagcagggaaagatgatcttaaacatcctctctcagcgcagccggtgttaggggaacagaatttggtgtgggaccacttgagttggatgctcagatccacccccaagttgtgagccctcggacaggttacttatctcactgtgcctcattttcctctagataaattgtacctacctgatatggtttggctgtgtccccacccaaatctcaaattgtagttcccataattcccccgttgttggagggacccagtgagaggtaattgaatcgtgaggatgggcctttcccatgctgttctcatgacagtgaataagtctcacgagatctgatggttttataaaggggagttttcctgcacatgctctttctgtcttgcctgctgccatgtaagctgtgactttgttcctccttgccttctgccatgattgtgaggcctccctagccaagtggaactgtgattccattaaatctctttttctttataaattacccagtcttgggtatgctttatgagcagcgtgagaacagactaatacagtacccctcagcgtaattgtgaggattaaatgagccagtgtatatgaaaacacttagaacgtataaaggtttattacttaaataaataaaactcagatttttattttcatttagacttatggtatttaaaggccataaacccctttgaatattccaaaatcttgtcaatcttttgacagaacatttttttcttcttgaaacattcaggaatctcattgtaatacctggttcagagttgttgtcagcaaaagttgggaccagctcaaattgtttcaaggagccataatgaaaaattataaaagcacaattttttaaaaaaagttttagcaacactggaattccaaagcatagacattagaaacttcttgtttttcttctcgaggtagggtcttgctctgtcacccaggctagagtgcagtagtgtgatcatagctcactgtaacctagaactcctgggctcaagtgatcctccctcctcagcctcctgagtagctaggaccacaggcaagcacaaccatgcccagctaatttaaaaaaaaattgttttgtagagatgatgtcttgctatgttgcccaggctggtcttgaactccggcctcaggtgtggagacttctctagatgtagtttttaaggttttatgttgttcttagtggccaaaatgcacagtttaaagaaacaggagagaatacagaatgtatttttcaaaagtagatgcagctatatttccagtcccacatcctcttctagaaccttgccactgatatcaggtgaagtctaattccccttctcttgaatatgggcagccccttaactaatagaatgaggtagaagtgatgctttgtggctagagtacctatgtcatggaagttgagacagcttttgtttgcctatcttgctccagaactctcacccaagaacccagatgccatgttgtaaggaagcccagaccacttggagaggcatgtatgatcccagctgacagccagcatcaaccttgaacatgtgggtgaatgtgcctccaagggattccagtcactaaccttcaagccattccagcaatagtaagtagagcagatcaaagctatccctgccatgccctgcccaaattgctggtttttgagccaaataaatggtcagtcttttaggccataagtcttgggatagttccttacataactttcataactggaacaataggaacgaatgttgggaggtaggtagagttagttgaagctcgtgaaagttttcttctgcttgcctgtattttcacagtggaatggtaaacaaagtcagctggacgtggtggctcacgcctgtaatcccagcactttgggaggccgaggtgggcagatcacgaggtcaggagatccagaccatcctggctaacacagtgaaaacccgtctctactaaaaatataaaaaattagctgtgcgtggtggcgggcgcctgtagtctcagctactcaggaggctgaagcaggagaatggcatgaacctgggaggcggagcttgcagtgagccgagatcgtgccactgcactccagcctgggtgacagcaagactccgtctcaaaaaaaaaaaaaaaaaaaaaaaaagaaatggtaagcaaagtcatcagatgagactgagaatggggtaggacatgcagaaagtttgagagaaaaggtatgaagtaatcatcctggaaagtgagagagcaaatggaatagggaaatgcaatgccaggtattaaatactcaccagagtacagtgagcccagtcacaatgattgtacatttttcttcagccaggtttagctgcataggtacaggaaaagaaaaaatggagagttggatttaagtagggttgttaacaaagcaagaaaaggtcaagggcttaggatacactcaaggactgtttataatgattgatgataacattaaaccaggaaaggaagaaagtgaagatatgaggatggtcagaatcctcatagctaaaggtgaggtttactgtgctaaaagttttgtacaacaatatgttgtatttattttcacaaaacctatgagtggacacttatcatttctgttttaaagataaggaaatcagaagctcagaaaggttaagtaacttgcccaagtttacacagatacctagatttgaacttaatctggtcctaaagccatcctcttaccccagccttccctggacatctgaaatagcttcttccacactgagttcaccttgctgaccccaacaccacatcattccttgagtcttctacagaggaagctagttactagggtagaaagaggaagggctgcctagctcctgctgtcccaccgccacttttcccatggccttcccgagagagtctttctgctttcaaaacttaggacgcttgcatattccactttcttcctgtcttcactgaagacttaccaatgtcctacgtcttagcttcctctccaggctatttctggcattattttaaaggagttccacctccctgcccccttccatattgagactatgtggtgtcttccatgagggcagggacttgtgcacactttatcttaggctggaataccgtacctgcaaaatgatagtttctcagtcaatccgggaacctcttgcctcagtgctcttatttctattcaaactcagcggagagtttgcaagtgaggttatacctgagccctctagggtctcccttctgaaattcccttcactgaccacaatattcccttcagcttccactcttagtctgacacgtctttttctttagccttattttccagaagcagcttctcaccctatgctatatctgtctcaccctgacaaagacattgcatgcagtgtataaaagaattacttcatcaaccagagcccagtgttcgtgaaatgtgtcccaaacctgtgctcccgagcatctaaaatctgcatttctattctgattcctttctcccttctgtccatctttccctcctaccctccttctgatgtcctcctatcagcccttctgatgtccttcggatctctctttttaccttgagatagctacctctcctgctaatgggtcttgttcatgccacatgtttttataactaaccttttggcctgaatttgttcatgattttggcatagatttttactaatataacaaaaaagtggactgggcacagtggcttatgcctgtaatcccagcactttgggaggccaaggcaggcacattgcttgaggtcaggagttcgagactagcctgaccaacatcgtgaaatcccatctctactaaaaatacaaaaattagccgggcttagtggcgcacacctgtagtcccagctactcaggaggctgaggcaggagaatcacttgaacctgggaggcggaggttgcagtgagcggagatggcaccactgtactccagcctgggcaacagactctgtctcaaaaaaaaaaaaaaaaaagtgaagaaacaacatctaaactctttataacctttacagtctacacagagataatatatcttctcttccaagtttcatgaacatttacaaaaatgggttcagaaaatctcaaggaattccaggaaatatataggccatattctctgactaaaatgcaagaaaactagaaattaatactaaacatttaaagccaaaaagcatcagctgctcgacaattaagacacagtgtcctaaataattaatggatcacaaaggaaacccaaattataattagaggttttttggaacataacaaaatgaaaatattgcataatccaaattaatgaaatatggccaaacagtaatcaatagcaaatgtgtatcttaaatttttttattattaaacaagaaagagtaaaaatatatgaactgaaaatttaaattaaaaacaccaaaacaattctaagaaaaaataaaacaaaaatagtaaagatgaaagccttaaccaactagaagataaatccaagagctggttcttcaaaaaaacataaaatgcttcttttttttttttttttggcaggggcaaggaggaggatggggagtggtgtgggcattaaaaaagaataacgcttctagaatatataaccaaaaataagaacaccagcaaacttataaaagaaaaagagaattctgcatagatatgtaacactttaattataaaagaatactaaaagtctaagctaatgaagttttaaaatctggattaatgtataatattctgagaatttttatcacagttgatccaagaaataggaaaatatgtattttgaacactattgctgggtttggagaattttttgtaattttgttttcccaagttattagccatgaactacctttgcccagcctcctttgcagctaagatagtgacagattacccagcaccatcagccaggcatacctgtgtgagatttaaattcagaactgaagtatttggacttgtagctgctgctaatcaaagtgtatattcagggcaatttgagtttatgctccccagtagcagtcctcaaacttttagcccaaataaattctctctctatatatatatacacacatatatatacgtatatacatatatgtatacatatacatacatatacatgtatatacgtatatatacatatgcatatatatacatatacatatatatgcgtatatatatatagatatggaaaatatatatatatatgtttttgaagttttttggtttttttgtttgtttgtttttttgagacggagtcttgttctgttgcccaggctggagtgcagtggcatgatctcggctcactgcaacctctgccttccaggttcaagcaatttccctgcctcagcctcctgagtagctgggattacaggtgcccaccatcagcctggctaatcttttgtatttcttttcagtagagatggggtttcaccacgttggccaggttggtctggaactcctgacctcaagtgaaccgccagccttggcctcccaaagtgctgggattataagtgtgacccgctaaagaagtgaataggccaggcacggtggctcacacctgtaatcccagcactttgggaggcctaggcgggtggatcacgaggtcaggagttcaagaccagcctgaccgatatggtgaaaccctgtctctactaaaaatacaaaaattagccaggcacggtggcaggtgcctgtaatcccagctactcaggaggctgaggcaggagaatcgcttgaacctgggaagcagaggccgcagtgagccaagatcgcaccactgtactccagcctgggcgacagagtgagactctatctcaaaaaaaaagtgaacaatttgaaaattacaaaatacattttgctgttgagaatgacagcagagacactcatgagcttttgagagcaaccataaggctggatttttggtgccaaggtggcttcagggctggtagcaggagactccagaagaaagagctcctggtaacagtgctaaaatatacttccaatgtctaggacgtggcttgaggaattgttcttggaagcctgtctccaagctactcaaattcctttgggaaattgctttctagcataaattactttctgttgctttcagctgagaacactggcccaataatcagtgaaataaatgaaaatatttaactcattaattaaatatttactgagtgactcttggggcataaattatgcaagatactgagaaaacggcagtaacaagtactgacataatctaatgaagtatttatcaaagaatcctcaccaaaaaaaagctttagtgtgattgaagtattttcacccaatactagttcgtcaatataaggaactctgtgaccaaataaatttgaatatgctggaggtttacaaggcacaatgacataactatgagaagtaccagagtaagtgattatttaactgcatttaatccagaaattccctaatttataaagcattgcacagaactcttgttgtgaaatgctgcccatgggccagataattttaccatttggttcttccgaactttcaattgacataaataaaatgcttataaaatatctcccaaagaaaaaaatatatttcaaaattattttaagaagtgacataaacctgattccagaacttattaataacaaacatagcacaaaaagcgctaccataaatccttatcatttatgagtctagacatgaaaattccatagtacaatcaagccaaattcagtaacatactataaaatcatgtactctgaccaattaagatatatcacacattttaaagatagttgaatattagctaatctattaataaaagaattattaccaataaatcaaagaatcaaattgtcaaacaactgaaagacatttcataaaattaaatgtcactttcttcctgattttaaaagccttattaaaacaaataataaaagtgcatgctcttaataaaattgcaaataatagccatcaccatacaaatggtgaactacttagaagagaacatattaaaattaatgccagacaaaaatgcccaattataactattattcaatatactctggatgttttattcaatatagtaagacacaaaacagaaaatagaaatatacctcctgaaaagggggaaataaaattataattacatgcagaaaatgtgattatgcacctaagataatccaagacaattatttaaaaaaaatactcagaattaatgagatcttagtatagagcctagatacagacaaatattcaaatatcaatagcttttctacacaacactgctatctacttagcaatatattgggataattcaaccaaaacactaaaacatataagcaatggtagcaacagaaatttaaaaatggaaattaggaataatcataatgatgtatataattgtgtgtgtatatgattaatttggagaaattagggagatttgaataaatagggagagatacaatatgccttcatggaaagacttaaagattaaaaatgccaatttctattaaattaatatctaacatttaacaaaatcccaatgggattttttaaaactcaccagaaaatgcaagttggtttgctgaaactaaggtgattacattgaatttcattataacgaaattttctctatttttgcttttgttaaaaaattcccatattaagcatttttaaaaacgtgactgaaaaatttttaaaaacttagaaaataaatgattagttaaaacaatgttataaaagaaagacaataaggtgggcacagaggtgacatttcagcaccaccagtgactgtccactggaagagcccatgtggtggcagcgagtgtccagtggaggctgggctgtcctctctagggaccttcccacacctatttaggcttcggtgtatttggtatcctttcttcatgtacttaagagagagctgagggctagggatggtggctcacacctgtaatcctagcactttgggaggctgaggtgggcggatcgcttgagcccaggaatttgagagcagcctgggccacatggcgaaacccagtctttacaaaaaatacgaacaaacaaacaacaacaacaacaacaaaaacctagcagggcgtggtggtgcatgcctgtagtcccagctacttggggggctgaggtgggagattatctgacccagaaagtcaaggctgcagtaacccatgatagtgtcaatgcactccagcttgggtgacaaagtgagaccctgtttcaaaaagagagagagacagagagagagaggtatctgaagccagccttaatttatttattcttttagattatgtgatcattttcctgggtgcctaaaggactgtttagttttctttgaggtctgatatacaagagccactcttgcactgtggataataaaggaaggagacatactgtaccaaataaaaactttacaacttctagacaaaaatgtaagatactatctctgtagtatcaggggagaaaaggagttcttaatgattttttaaaagtctaattaataagagaaaattggccaatttggctttaaccatataacctgtataaccataaggattattaacaaagtttaaaaaaagtccaaaatcaagagaagaaagttgcaacatgcataacagacaaatcatccgtatccttaaagaatggaagtaggaaaaatagaaaatgggcaaattatataaacatatcaaagcgtgtttaacttcatttataatctgggaaaaacaaattaaaaattgttcaatgagatggctttttacaccagctacttagccaccccccccccaacaaaatttcaagtctggctagaacaaatgctagaattagaaaatatgggaattaatatactgtgggtgggagtgtaaattggcaaaccactctgaagaacagttaggcaatatctagtaaagctgaagatattcttatactacaaactccagttccacttctatgtctgtattcgatgcctacatatatgcataaagagatgtactataaatcctttgcagttttgttggtaattgtcaaaacaaaaaccaacagattgaaacaagcctgaatgtgcatctattgaggaatgaattaatgttcgtttctgtttacttgtgatagaatgcaatgcaattgcattttaagtaggtgaattagatgtataagtatcaacatagatatatttcaaaaatataatgttgagtgaaaaagaaaagttgcagaataatatgcacagtataatgccattgctatacattttaattaattagttaattaattaattacattatttttagagacagggtctctctctgtcacccaggctggagtgcagtggcatgatcatagttcactgcagcctctaactcctgggcccaagtgatcctcctgcctcaacctctcaagtagctaggactacaggcatgcaccaccacacctaggtaatttttaaagtttttgtaaagacaggtctcgctatgttgcccggactggtcttgagcttgtgggcttaagcaatcctcctttcttggcctcgcaaagcactgggattataggtgtgaaccaccatgcctggcctgtcatggctgtaaattttaaaaataaacaaaataaaattttatctggttcatgggtatatatgaaatataagtgtaaaaacatgaatggtacgtgcgctcatgagcttcatgacagtgattcacctctagacgagtaaggaaataaaagggtgtgagaaaaggtacaaaatcacctcagttatatctgtagtgatcttggtctttaaaaatatctgaagttggatttcattacaatttaaaacttctgctttcggaaagataatgtcaagagaatgagaaaacaacccatagactgggagaaaatattttcaaaagatacatctgataaaggactgttatccaaagtatacaaagaactcttaaaaccaacaataataaaatgaacaacatgattttaaaatgcacaaaagacctgaacagacaccttaccagagaagacatatagatggcaaacaagcatgtgaaaagatattcaacattatatgtcattagggaattgcaaaattgaaataacagtgagataccactatacacttactagaacagccaaaatcccaaacaatgacgacaccaaatgctgatgaagatgtggagcaacagacactctcattcattgctgataaaactgcaaaatggtacaaccactttggaagatggtttgccagtttcttataaaattaaacatgcttttaccatatgaacaagcaatcagaccattcatataaatcaaaaattatgtccacgcaaaaactcacacgtagatatttataattcaaaaattatgtcattataaattatagatatttatagcagctttattcataattgtcaaaacttggaagtaaccaagacatccttcaataggtgaatggataaatacaccgtggcacattcatacaatgaaatattagtgctaaaaaaagtaactatcaagccatgaaaagacatgtacgaacctgaaatgcacattgctaagtgaaagaagccagcctggaagactacatactgtatgatcccaactatatgacattctggaaaaagcaaaactatgaagacagcaagaagatcagtggttgccagggattcggggcaagggaggggtgaataggcagagcacagaggatttttagggcagtgaaactactctgtaagatactataatagtggatacatgtcattatatacttgtcaaaatccatacgatgtacagcaccaagagtgaaccctaatataaactatggactttgggtgataatgatgtatcaatataggttcattgtgtaccactctggtgggggatttttttttcttttttagagatggggtctcgctctgttgctgaggctggagtgcagtggccctatcataggtcactgcaacctcaaatacctgtgctcgagtgatcctcctgcctcagcctccagagctatggagggggatattgctagtgaaggaggttatgcatgtgtgggggcaggcagtatatgagaaatctctgtaccttctgctcaattttgctatgaaccaaagactattctattttacactttattaaaagataaagtttattaatttaaaaatatctgaggtacatatgctaattatttgttaattctgggagttaggcacatagtgttcattactttctgtattttgctatatgtttgaaaacttgcacaattctacaaaaacaaaaaacatatgatatgatcgcaagaataaaccgaacaaaataatcaaaaagttgatccaaatacacacataactggatatatacaatacgcatggatgtaatacatgatgatataggacaaggcaattggaaagggatagattattaaacaatgacatggggaaattggctagttatttggaaaaatatcaagtaagaacttcaccttatgcacatatacattaaaaaaattcagaagaattaatagctaaatgttaaaataaaatcattcatataaaaaagtaaaataaaatgaaggtgaatatttaacttttctaatagtggggaggggctttccaagtctaaagcaatagaaagaacttgaaagtttaaaatacataaataattaaaacctctgcatattaaggcatcaaacaattaaaaatacagaaaccaaaccgtgtaatgaactaatatgatttttatagtccaaaaataaaagcaaaactgacaccatggaacaaaaccttaaaatgtcccctagttagccttatcctgtctcctcatccaattaatgtcactgcacaatgtctcctaatcaccagactaaaaatttccaggaacctttgactgttcaaaatccttctcttcatccccatcaataaattggcaaaaatatttccaactttatgtattgaatatgcactatatgtcaagctctgtgtcaggtgctttaagtgctgttttatttagtcatcagctctatcagactggcattacctcttcctcatagataaggaatctaaagttcagagataggaagtagtttttcttttttctttcttttttttttttttttgagacagggtcttactctgtggcccaggctggagtgcagtggtgtgatcatagctcactgcagccttgacctcctgagctcaagtgatcctcccacctaagcctcccagatagctaggactatgcctggctacttttttttactttggtagatatgctccaccatgcctggctaatttttaaatttttggtagagatggggtcccacactgttgcccaggctggtcccaaactcctgggctcaagcgatccttccatgttggcctcccaaaatgctgggattacaagtatgagcaaccacatgcagccaggaagtagtttttccaagattatctaattcacctgtgagatacagcccattaatggatggtgagaccaatttcgtgtccatagctagcagctttaagaaataaagtagaagagaaaatatcagagtatgtcatgcatacttagggtaaaaactgtttcattcacctttgattcacgggtgtgtgtgcatttgtgtatgtgtgggcatgtgtcctggaacacaatgtaaaacatttttcttagtgtgtgccatgttcaaaaaaatttgaacaccattgccttacttagtatgatgtggaacgagaattcacactgagcccatgggtctctaaagcccatagcctagcattttcaccacttgctgttcaccctggcattcaaggctctccacgccttccctttcttatctttccaggcttattctccacttctttaactcagccatgcactactttctttacacattttctcagggtgttctgtgatcaagccttggatcagaccgtttctgccacttgtaacctgtcacatctaccaaataagtgacctccataaagtcactgcatcgtcttttacctgaaccacaccatcccacgtttttccattttgattttcaagaatgaggatcccactcttataatcaagatttatgaagttcatgctttatgtttcattatgctctagtggaaaattaggcactcttggatgctctaaggtcaccatgatgccattgagtcaacctgagctaaaggaccaggagagggcagcagtggtggctcacatttagttactatgtgccaggccttggacatcacctcaccgaatcattgaatcattagccccattttatagatgagaaggtagtgccttagagggggtcattttcccaagtttgaatagctactaggtggaagatctccttttcaaagctgtgctttgaacttgcatggttaacctctactactatactgcctttggctaatttgtctgagaaacactctctgaatgtttagttttcaagctcataaaatgggatagggaaagcgcggaagctgggaggctgttcatatgagtagtccctggaaaaaaaactgctgcggaagggttaacatgaactcagagtggggatttatctgagctgtgaggcaacagcacagctaggatggggaacaagaactgttgctgaaagatctgaggctattgctgtaaaagtggtcctgaaggttaattgcaaagttgaggacaagaaccaaaatggaagagtgagcagccaggagaaggggctttagaactaaggtagcaaacagtgagttcatatatggaaagctccctactagtacttgaagacaagggacttgaagggcttctgcagtcatagggccatgtctcccctgtgccacactggggggacaccagatgccttttctgccaagcagctcatacataccaggcagacatcttggggccaggcaggtgactgtgtgcagcagccttcctctgaggaaggaacacttctcaatgttcctttccaaccctctgccttctaaacacgaatacttggagcagaccattgtcctgataagtgagactaattgctgtgtatttgtaacttcacttgcccagtgaactgagaacaccacagagggctgggcaataacaaataaggaataataaaaataaatatttactgtgtatctgctgtgtgagggtcttttaacactctcttcttttaccttcaaagggataaataagttaatcttcagagttacagggggagaaaacgctccaagctccacccagattctctctttgagctacactaagggtttcacagatggaaaggcatttctcaagacaccttcccacgtgtggatcaccacaaggaaatcagtaatgagtttttaaagcttatttcaattttaccacatcaccctattttagtttcttcatagcctttttaacagcctaacatattttcctgagtatttgcttattctctggctcctttcattatcatactgttttcctagctcctaggatagaggctggcactaaatggcatctccacaaagaggggttggaagaatgaatgcataaatgagtgaagatcataagtggaatctacagtttaaagatacggtgcaaaacaagtctgctcccaattaaacaaatcaaaatcttgatttagaaaattgagaaagaatgctgttactaacatttcaaaaggactcattgtaggatatttttaaatagttccactaatccttaaaaacacgacttaagtaccaaaaaaaatgacttatttgacaaacattgatttacactttttttttttttttttgacacagggtctcactcagttggctaggctggaaggcagtggcacaatcacagctcactgcagcctcaacctcctcggttcaagtgatcctcccacctcagcctccccagtagctgggactacaggcacacgccaccacacctggctaatttttaaatgtttttgtagagatgtgggggggggggggtttctccctatgttgcccagactggtctcgaactcgtgagctcaagcgatctgcctgcctcagcctcccaaagtgctgggattacaggcatgagccaccctgcccaaccaatgtatacttttctttccattgaacatagctgctgcataaacaataacacccttgaatatactatgaatacataattttcttcatttaatcagttacatttttgggctatggctccagaatatagatctcttactatatgatccaatcaatggataaagtaaaacaagcatcatcctctgtgactgaagtgacaagaaacatgcaccaggaacggcaatccctgcttggacagagcttgctgtagtgatttaggaggctgactctgtgttatcaggaactatcatccccgccccacagaggcaaaatagaagtactgatacctcactgagttttaaggactgtattagtttcctattgctgatgtaataaattaccacagacttagtggctttatttattaatgtggctaaatttattatctcacagttctagggggtaaaagtcctagttcaggtcaggcgcagtggctcacgcctgtaatcccagcactttgggaggctgagacgggcaaatcacgaggtcaggagattgagaccatcctggctaacacggtgaaaccccatctctattaaaaatacaaaaaaattagctgggtgtggtggcaggctcctgtagtcccagctacttaggaggctgaggcaggagaatggcttgaacccaggaggcagagcttgcactgagctgatcgcgccactgcactccagcctgggcgacagagagactgcatctcaaaacaaacaaaccaaccaaaaacaaaaagtccaagttcaatctcactgggctcaagtcaagataccatcaggactggttccttcaggaggctctggggagcaaccgtttccttaccttttccagcctcgaggctatctgcatgtcttggctcatggccccagtcaatctgatctttgctttggttgaaacagttcctcctctgaccctttataaagggtctcccatctccctttataaagaccctgtgatgagcttcaggcttcctggtcaatctaggataatctctccatctcaagatctgtaacttaaacagatatgcaaagtcccttttgcaacctagggtaacatagtaacaggtcctggacattagcatgtggatgttattagggggccactattcagacagaccttaaccagggagtcttgggccttccttggtaaaataccaattttttttccaatctgatcccaatctgataaggagctgtcctgacttaccttgtctttgttcatcctttagctaagtaattactatcatataataacgcgaggtgccgggcactattttatgtacttcatacatttttactcactttaatgtaggcacagaaagattaagtaatttaccctagctagtaagtaacagaatcaggatttgaagttaggaagttgcttcatggagttaacaaatatactgtcttgtctttgcaatcacccaccttcttctgagctccctggtgctgattgtgtcacatcagttaagctgtctgacacctcacaacatcctctcagactctggctcccacagggatacaccaatgtggcctctgctttgagtcacatataccctcagctaggacaggagcctccttctatccctgggtggcttcaggtcaagtgaccacattaaatctccgacccctcgaagtcaaggatccacccttgaccatggtaaccccagaaggaatcatttcttgaggtctagccagacacatttctgcagcctttactacagtataaaaaagtattacttttataaatgggaatgtgactcatgcttctgttttttattgagaacatggaagcaacagttaatgcaatttggtctgaactctgagcataatttcactattggaagagcatcatgctcagatctattagaagctggaggtgctgccatagttcattaaagtttttcattattcatctatattaagtaaatacagtttggtaagtcagccaacatagagctgctactcagactagatacttcccttaacccatgagtttctaatctgactatggacacttgagaaatacatacgtaggcttcacataacctatacatgcacttactggtcagtgatgggtttcaagacttaagagccaccaggaaacaaacagtgaggctcagttatgtgctgcaaagatgatgttcatttcttaccacctctgttagccaaagccattgtcttagtctattcagactgccataacaaaataccttagactgggtactttataaacaacaggaatttattgctcacagttcaggtggctggaaagtccaagatcaatgcatgcagatgtgatgtctgatgagggccctcttcctcatacatggacaatctaggtgtcctcacatggcagaacggacaaaccagctccctcaggcctttatttttaatagccttgttatgaaccaaaagactgtgttcccccaaaagtcatatgttaaagccctaacccccagtgttatgatattcacaggtgcagcctttgggaggtaattagttttacatgaggttgtgaggatggggtctctgtgatgggattagtttttttataagaggaaagatgagagcatgtgtatgcactctccctctctccctctctctctctctctctctatctctgtctctccctctccgatgtgaagacacagtgagaaggcagctatctgcaaaccaggaggagggtcctcaccagaagtgaaatcagccggctggtaccttaaccttgaacttctcagcctccagatctgtgagaaatacatttattttgtttaagctacccaggctatggtaaaataccatagcagctaagacaaactccaaactggaaacaacctgaattccaattaacagatgattgaataacaaattgagatatagccatataatgaaatactattcagcaatgaaaaggaacaaactagtgatataggcaacaatgtggttgcatctcaaaacaatgatactgagtctaagaagccagacctcccaaaagaaccaccataaaaagagtatatacggggttattgcattaatatataattctagaaagtgtaaactaatgtatagtgatagaaaggagatcagggttgcctgggaagagggtggaaaggggtaggagggaaagattacaacgagaaacctttgggggtggtggatctgtgcattatcttgattgtgttggtgatgcacagatatatgcacaagtaaaattttatcaaattttacatttttatatatgcagtgcattgtgtgacaacaatacctcaataaagctgtctagaaaataagcaacgtgcaagaaaatagttaaataatgctatctgttgcatagggagaaaaagggaaacaaaacttgtgggtttaaaattttttttaagtgcgctgtaaggaaggagagaatgaaatggaaaagaaggaataggggacagtgcagcagattaaggatggccacaaattctttgatatcttcccatcaaaatgtggggtctatgttcctggcccttgaatataggtagattctgcgactgctttcactaacaggatacagtggaagtgacaccgccggttttcaggttagaggcttaagaaaaagagagcttctacttcttgtctctttgaacacttgctcttggagccctgaaatatcatgtaagaagcaatgagggtgaagttcccatgctgggaggaagcttaagatagttgtgtggagaagctattccctgtctgtggattcaaccaaccttggattgaaaatatttgaggaaaaaggaaaaatacaaattaaaaaaaaaacagtgtaacaattatttacatagtattaggtattattagtaatatagagaggatttaaagtataaggaaggatgcatataggttacatgcaaatactttgccattttttttttttcttttaaaagaaaagtttattacagtttccaagagaaaggggcatgtcacaccatgaggggccacacagggaagaacgaggtcaatcaggaagcagcagaatgaggaaaaagcctgggcaaaacctttactgttgttttcacagaaggcatgggtgaaacagagtaagcagctgagcaggctgaggattggatagtttctttttttttttttttttttttattattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtcccggggtacttgagattagggagtggtgatgacttttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctctttctacacagacagggcaaccatccaacctctcaatcttttccccacctttcccccctttctattccacaaaaccgccattgtcatcatggcccgttctcaatgagctgctgggcacacctcccagacggggtggcggccgggcagaggggctcctcacttcccagtaggggcagccgggcagaggcgcccctcacctacccgacggggcggctggccgggcggggggctgacccccccacctccctcccggacggggtggctggctgacccccccacctcccccccggacggggtggctgccgggcggagacgctcctcacttcccagacggggtggctgccgggcggaggggctcctcacttctctgacggggcggctgccgggtggagggtctcctcacttctcagacggggcggttgccaggcggagggtctcctcacttctcagacggggcggccgggcagagacgctcctcacctcccagatggggtcgtggccgggtggaggcgctcctcacatcccagacggggtggcggggcagaggtgctccccacatctcagacgatgggcggcccgggcagagacgctcctcacttcctagatgggatggcggtcgggaagaggcgctcctcacttcctgtatgggatggcggccgggcagagacgctcctcattttccagactgggcagccaggcagaggggctcctcacatcccaggcgatgggcgactaggcagagacgctcctcacttcccagacggggtggcggccgggcagaggctgcaatctcggcactttggggggccaaggcaggcggctgggaggtggaggttgtagccagccgagatcacgccactgcactccagcctgggcaccaatgagcgctgagtgaaccagactccgtctgcaatcccggcacctcgggaggccgaggctggcggatcactcgcagttaggagctggagaccagcccggccaacacagcgaaaccccgtctccaccaaaaaaatacgaaaaccggtcaggcgtggcggcgcgcgcctgcaatcgcaggcactcggcaggctgaggcaggagaatcaggcagggaggttgcagtgagccgagatggcggcagtacagtccagcttcggctcggcatcagagggagaccgtggaaagagagggagagggagaccgtggggagagggagagggagagggagacggagagggagagggagagggagagggagagggagaaggagaaggagaaggagaaggagaaggagaagtatcactcttaaaagcaggatcactttgccattttttttgtttatttgagatggagtctcactctgttgcccaggctggagtgcaatggcacgatctcggctcactgcaacctccgcctcccgggttaaagcgattcttcagcttcagcctcccgagcagctgggattacaggcatgcaccaccacacccagctaatttttgtatttttgtaagagaaggggtttcaccatgttggccaggctggtatactatgccattttatataatcagtgacttgagtatcctcagaatttgatatccatgggggtcctggaacaaatcccctgtggatactgagggatgatgatatagagacagaaagagagagatacctaacagcacccagctctttagcattccagcactcagagaatcccagctgcgacttcagaaattgtagaacagggtcaaggctttcctgctgtgctcttactgcattcttgacccgttaagttatgagatatagtaacaataaattattgatttaaacctctaagttttggggtagttttttttttttttttttaattttgaaatggagtctcattctgttgcccaggctagagtgcagtggcacgatctcggctcatggcaacctctgcctccgggttcaagtgattctcctgcctcagcctcctgagtagctgggactacaagcacatacaaccacgcccggctaaatttttttgtatttttagtagagacgggatttcaccatgttggccaggatggtctctatctcctgaccttgtgatccacctgcctccgcctcccaaagtgctaggattacaggcatgagccactgggtccgcccggccttgggatagttttttatgcaacaatatccaattgaaatagatgaggttgcacgtatttgagtgtatcttttgttttacttatctattacagtgcagcaaactatcccaaatttagtgccttaatgactataatttctcaccattctggggtggtgcttgtcctccatgtggtgtcagctggaatcactcatgggctgtctgcagctggaacttcagctggggtaactcagttctcctccccttggcctctctctgtccacatgctgtctcattctcccagatctctctacccagcctctgtctcctggagaatagcctggattctctacagctgacagctgggctccaagagggagaattcccagaagacaagcctcaatgcaagagctaatcaagcctctactcgattatatttactcgtgtctcattgaccaaagcaagtcccgtggccattccagtgtcagtgggagaggagactacacaaggcgtgaataccagaaggcatggctcattgacagccaccattataacagtgtatcatactttatatatagtttttcacctttgaaccacatacgtggtctacattttcaaaaaataaaattacagtggtggaaagagcaaaccataaaaatgaatacaaacagatacaaataaatacaaatagatatcaaattgatcatatacccgcacacaaaaagaaataatccaagaaacttttgaacataacaatccaatagtataccctttgtaggatatatcctattttatctttttaattttttaatttttatttattttttctcatttcaggtgggattggaggatatattctacagacaaaaaaagctttaggaaaatctcgaattttacttactaggttttattttggtgtattattgacatagtaactatgaaactatttcatgtatactgtatgagagagtaaatatattgatattttagagatccaggactctcactgtagtaaaagggaaatacaaatgtggagtacgggaaggtaaggaagaaccttgtgacattatattgaattgaagggaattggaggtatcagtgtgaagtcattattttataaatagctaaacacacacatacacacacacacatactcacgcacatgtatacacattagctctttccagacaaggcctagaagcaatagtacccagtagcaatgagcataactgccacccagaccttggttactattaataaatatgatttcccacaaaaaggaaccaggttttccttggagaaattgctcatttcagatctagggtagtaaaagtagaagcagagcctggaatatcttattctgctaaaaagcaaagaattgttgaaagactaatgaggacgtttcaaaaggacacagcagtcagctcgaaggagcttttattggaaggcagctacgctcaccattataccaccaacgtggcactaaaggagctgttattggccaaagtttggacaatttgagcttcaaaaagaatatcagtgttaatggattataatactgtatctaaaagagaatccatgagttcatgaggccggaagtccagatattttaaaaggggaatatagctgacttatactgaagaatatctgctaatatataaaaaggaatcataattaaattagaaatcatcactttgtagccaacaatgtaataactaattaggaagaatcatcaatggacacaaaatcctctgagtgaaatgttggggaacatgatgttcacagcctccagttactacctccatacattactgattaattacaaatggaaaatgtgtttttacaacagacactgctttaacccagtgataaaactcagccctgctagtaattggacaacctgacatcatgtgcctcttgatggggtgcagtgggaagtacacatcatcacatatacagtgttcttgaccaaaaatgtttaacttaaatatagttatgaaaatataatgtggcaaatccagaatgtgggatatactgtaaaacaattagacagtactcttcaaaaagattcagtgttatgaaagagttaaaaatacatcaggaggccaggcgtggtggctcacacctgtaatcccagtcctttgggatgccgaggcaggtggatcacttgaggacaggagttcaagaccagcctggccaacatggcaaaaccccttctctactaagaatacaaaaattagctgggcgtggtggcatatgcctgtagtcccagctactcaggcggctaaggcacgagaatcacttgaacctgggaggcagaagttgcggtgagctgagagatagcgccattgcactccagcctaggtgacaaagcgagaccctgtctcaaaaataaataaatacatacatcaggacacttttctaggctaaaagacagtaaagagatgtgataaacaaatacaatgtgtgaatcttgattgaatcctagattttaaaaaacagctgtataagacattttgggattattagggaaatctgcatatgtactgcataatagatactattttgtatcaatgttaaatttcttgtgtatgtgttgtttgataatggttatttggattatgtagaagactcatggtggggtatttaggggtgaagtgtcatgtctgcaactttcgaatggctcagcaaaaagtgtgtgtgtgtattaagagaaagaaatcacatatggcaaaatattaacaactgcatctcggtgaagaggatatgagactcaatttctctgtaagcttaaaaattttcaaaataagttggggaaagtaataatagagaagtaaacagttcaagaaaaacaaacactattttatgcttattaaaccagttcctcccacctcactgtagtttgtgttttaaaataacttccagtgctgccaaggtcatggggaagctggtacagtgaattaccagtggcatgaccatggctcagcctgcataggccagcatgcagcaatgcttatcaaacatggaaacacttccatgctggctgaggcaggcattgccctaaggattcttttcaaggaattaggttgacaaaagtaaaaaaactatgcctgaaaactgaaaatgaaaacaacctaaatgtccagtaataagggttaggtttaggaaattttgcttcactactggatggactattatgcaagtattaaacatgggttttaagacttccaaaaaaaaaaaaaaaaggcttatggctattgcttcgttctttcaaaaaaaaaaaaaagaatgtgaaaccacgtgatttcaactttgaaaataaaagcataaatatggcaatatggctgggcacagtggctcatgcctgtaatcccagcactctgggaggccaagaagggcatgtcacttgaggtcaggagttcgagaccagcctggccaacatggtgaaaccccatctctactaaaaatacaaaaattagccaggagtggtaacacgtgcctgtagtcccagctacttgggaggctgaggcaggagaatcgctcgaacccaggaggcggaggttgcagtgagccaagatcacaccactgcattgcagcctgggcgacagagcaagactctgtctcaaaaaaaaaaaatttttttttggaaatatgacatatctttcaggaatttacatctcatattactatattaaagattaactcaaactcattttactgttgattggctaaaagtgcaagcttattttcttagcacaaatattaacatatcttcctccacaatatttccaccctaacaccaatttgggtagctctgagagagagtatagataaactgaaatacttgtggaatttcaccctcgctcatcatggcagctgaaatttaaattctgttcaagtacaatttatttctttgcccataatgtatcaatttttattttttcaattttattatttatttattttcataaggccttttcccaatgttatctatttttaaatgcatacgccagtacttctcaaagtatggtctcaggaccagctgcattagtatttcttgggaacttgtttgaaacaccagttctcagaccccacctcagaactactgagttagaaactctggaggttggatccagcaacctgtgttttaagaagacctccagctgattctgatggaggctaaagtgtgagagctactgcatgagacagtccaatggccatgcttataatactgaattcaaatgggtctcttattgcccatgaaccctgaataaaaacagctggcttagagtgttcaactgtcctggtttgcctgagactaaggagtttgcaaggatgcaggacaaggtgtgcagccatcaccactatctaattcaagaacatttcatcaccccaaaagagaagctccagcattctctagcagtcactcaccatcccgcctctcccagcccttagcaaccactaatcaactttcaacataggtactttcattctccatgtaaaagtgaggaaagggagatctagacatttttgtgacttttcttaaggttttctgatgaggctaaaccttggatttgaactcactaaatgattctctctcctttctagacatatttatgccctgtttatttcctcaagttattatattttcttgttactgtagatggggaggtgtcaaaacaaccacttgcaaactattgttgtcatgtagaaatagctggtttgttctgagagaccaattcacccagatgtgagtgctttaattttgttaaccttacactttcttaatcaaagagaatggcttttgtttacttctttacaactgaaacatacttgccctccccaggaaagaaaaaatttaaaagcccttgaaattaaccaattaaattgaaattgactttattttaaatctaaggaagaaaacaagttttagtccccttcagagccatatatcttaaatatagtaattccagtttagtctattaagcttctgatcaagatgaataaaccttatacaaaattaagacagagttcaataggattagaaaagggaggtcagggaaaaaatgtggatattatattttgaataatttggagttcaaaccaacttggaagctttccttttagcagatattattttaataagtctaattgtctacggactgctttaatctaattctagaaaccaataaattgtaatctaattgttagatgatgaaagacagtgatttggggaaactaatgtgtttacatgcagtttttgtccaagtttagctttgtggaaagcagtcagaaatatccgatcttgactttagcggtaaaaatgcatctagggatacacacccatgtagctgggtatatgtcttcctttgtggcgtctctttatatgccagaaaatctatttcagttgagacagataataccaggcctgcacaccccaggctccagaggccctcaggggaaagagctggagaacagcaagtccccggaacaattggggagcctgttcacaattttggctgtgtcgctgccctgccagtctgtctgaagcatttggggaacacccagtctttgcagaagcttgaacttggccctaaagaacaaaaatgaataagaaattttccttgaagctgagaacaggggccttcactctcctgtctagtgttcctgccattcagccacatctatatcagaagaccacagctctcgagcacccagcaaacgtatgtgctgggaggaggggaaaacatagattccttcccaccccagccctggacatgctcagtcctgtggtctctctacccaccaacagttagcatgttcatcttctgttggtttcacaaaaccacggtgatggtcatgcttctgtgcctggtccagggtgttgctcagctggaagattcatacctcacttctgtgccaaactgactctctgctggtccttctagacttggcttgtgttagcctgcttggaactctctcctgatccccctcatctgcagtctcagttcagtgctctcctcagaactcctcctctagtgttcacccaattcagttttgtatcttcctattatgttaactgctgtactccattactatctttttaaaaaataatttggactcccttgttagatggtttgttcaggagctgacctatcatatttatctctgtatctccaggacctggtatcatacttggcttatagcaggtgtgatggttaacagtaagtgtcaacttgattggatggagggatacaaagtattaatcctgggtgtgcctgttttggtgttgccaaaagagattaacatttgaatcagtgggcccttaaactggtgggcacaatctaatcagcttccaacgaatataaagcaggcagaaaaacgtgaaaagaagacacgggtctagcctcccagcctacatctttctcccctgctggatgcttcctgcccttgaacatcggactccaagttcttcagttttgggactcggactggctctccttgctcctcagtttgcagacagcctattgtggggccttgtgattgtgtgagttaatacttaataaacttttatatatatatgtacatatatttatatatattgtgtatatatatgtatatatattatatatatagtatatatatgtatatattatatatatagtatatatgtatatatactatatatatagtatatatatgtgtatatattatatatatagtatatatatatgtatatatatatatatatctcctattcgttctgtccctctaagagaaccctgactaatacagcaggcatttcatccattcagaaatattcactgggcatctcctgtgtgccaggtacagtgtaaggtgctgcaggtaaatagcattatagtgcttgctgaatgaacagtctctgatatagttttgatattcccccccccaaatatcacatcaaaatatgatccccaatgttggaggtggggccttatcagactggcaaccatcaccaccagtcagaggcttattagactggcaattctcaaactctataccagagaaaaacgggaactttttaaaagcacagattgtagggccctcaccccagacttaaataaaaattggggggactggagcacatgagtttggattaaattacaagtgccccagatgattctgatgtatgggatccactactcagaaaagaaatcctggccgggttgggcgattaacaggcggtggctagggaggacggagagggggcgtttgctcctctgggacttttcatgcctcgttttttttttcagatgtggcttggtctggacgcaaggtcccagcagccagcttaagcttactcttctgtgaaaggggaaagtatcccctgtggaaagcagttaaacttgtggagggggtgcgagacgtgagttctcccccatgccaggcgaatggtgtggacttgagctggtccagcagccggctcgacttgtctgagggagccctggagggggcggggagggggcccacagaacgtgggttctataaagagacattgggaagattcgattccgagaagaggaagagccggattgaaagagagccaggcccttgagggggagggggctgccaagatggcgtcggcctcctccgggccgttgtcttcggtcggtttttctccgttgatcccgcggtcccttcctgtacctcgtcctcagcatctggaatcaagagtcccatggcatctgaggtgccttatgcctctggcatgcccatcaagaaaataggccatagaagtgttgattcctcaggagggacaacctcatcagccttgaaaggtgccatccagttaggcattacccacactgtggggagcctgagtaccaaaccagagagtgatgtcctcatgcaagatttccacatggtggagagtatcttctttcccagtgaagggagcaacctgacccctgctcatcactacaatgcctttcgtttcaagacctatgcacctgttgccttccgctacttctgggagctatttggtatccggcccgatgattacttgtattccctctgcagtgagccgctgattgaactctgtagctctggagctagtggttccctgttctatgtgtccagcgacgatgagttcattgttaagacagtccgacataaagaagcggagtttctgcagaagctgcttccaggatactacataaacctcaaccagaaccctcggactttgctgcctaaattctatggactgtactgtgtgcagacaggtggcaagaacattcggattgtggtgatgaacaatcttttaccaagatcggtaaaaatgcatatcaaatatgacctcaaaggctcaacctacaggcggcgggcttcccagaaagagcgagagaagcctcttcccacatttaaagacctagacttcttacaagacatccctgatggtctttttttggatgctgacgtgcacaacgctctctgtaagaccctgcagcgtgactgtttggtgctgcagagcttcaagataatggattatagcctcttgatgtcaatccataatatagatcatgcacaacgagagcccttaagcagcgaaacacaatactcagttgatactcgaagaccagccccccaaaaggctctgtattccacagccatggaatccatccagggagaggctcgacggggtggcaccatggagaccgatgaccatatgggtggcatccctgcccggaatagtaaaggggaaaggcttctgctttatattggcatcattgacattctacagtcttacaggtttgttaagaagttggagcactcttggaaagccctgatacatgacggagacactgtctcagtgcatcgcccaggcttctatgctgaatggttccagcgcttcatgtgcaacacggtatttaagaagattcccttgaagccttctccttccaaaaaacttcggtctggctcatctttctctcagcgagcaggctccagtggcaactcctgcattacttaccagccattggtctctggggaacacaaggcacaagtgacaacaaaggcggaagtggagccaggtgttcaccttggttgtcctgatgttttacctcagactccacctttggaggaaatcagtgagggctcacctactcctgaccccagtttctcacctctagttgaagagactttgcaaatgctaactacaagtgtggacaacagtgagtatatggggaatggagacttcttacccacccggctgcaggcccagcaggatgctgtcaacacagtttgtcattcaaagacccgcagcaaccctgagaacaacgtgggccttatcacactggataatgactgtgaagtgctgaccacactcaccccagacactggccgtatcctgtccaagctacatactgtccaacccaagggcaagatcaccttctgcatgggcatccacgtggcccatctggctctgaagcaccgacaaggcaacaatcacaagatccgcatcattgcctttgtgggaaacccggtggaggacaatgagaagaatctggtgaaactggctaaatgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttttccgattttggctggtgaaggtggtgccatgatgggtcttggtgccagtgactttgaatttggagtagatcccagtgctgatcctgagctggccttggtccttcgtgtatttatggaagagcagcggcagcggcaggaggaggaggcccggcaggcagctgcagcttctgctgctgaggccgggattgctacgactgggactgaagactcagacgatgccctgctgaagatgaccatcagccagcaagagtttggccacactgggcttcctgacctaagcagtatgactgaggaagagaagattgtttgtgccatgcagatgtccctgcagggagcagagtttggcctggcagaatcagcagacattgatgccagctcagccatggacacatctgagccagccaaggaggaggatgattacgacgtgatgcaagaccctgagttccttcagagtgtcctagagaacctcccaggtgtggatcccaacaatgaagccattcgaaatgctgtgggctccctggcctcccaggccaccaaggacagcaagaaggacaagaaggaggaagacaagaagtgagactggagggaaagggtagctgagcctgctcaggggactgcatgggaagcacggaatatagggttagatgtgtgttatctgtaatcattatagcctaaataaagcttggcaagattttttccttctttgcttcaaaaaaaaaagaaagaaagaaagaaagaaagaaagaaagaaagaaagaaagaaagaaagaaagaaagaaaagaaaagaaaagaaaagaaatcctgatgcctaaatctgaccccttgaaatgctgatgagcttcatctgagctgtgtgatctctcatgtgcagctaaggttgagaaccactaacataaaataattcacattaaaatcaccaggaagctttaataacatttcaaatacttggacccaacccctaaagattctaatttaattggcctgggactcaggtactgatatttttcaaaagctcacaaggtaattctgaaattcagcaaaagttgagaaccactattcagactaagtgacttgtccaatgtctctgggtgcatcagactttacggccttccttacacaggggttgtgaatgaaatatggctatggaaagcaattgttgagtaatatgttataaagtatggtggtgatgatgatgatgacaatgatgacaatatttcttgagtgcgtcctatgcaccaggcactatgctaagcattttatgagcttaatcttattgaatcttcaacattagcctgctggtattattttcccttttccttgattataatatgtcatcagttgaggatgacaatttaataacagttattagaggctgttgcttgttaataggaaaatatttattcagtcctccagagacaaagatttgctttgatcagaataaatgtaaattttgatttatttaacatgaaatgcaaataaacatgtgtgctgctatcaatgcaaatcactcatcccatgtgatatcaaataagcagataccttctatgtagccctccaagttcacctacattcacaaatgttacttatatctcatactggggtatccatactgggcctggaagctggcaagtttatttagacacattccatttcaggaataataaaatgcagggaaaatgtgtatctttgagtcacagaatcatggtattattcttattttcaggtgagactttaaaagattaagtgacttgcctatagtcccagggttcattctacagccaagccagaaataacaacccagtgcccctgatgctggaattctccagaagctcctctactgacatagtttccactgacaaactttccttgacaagaataaagtagtctgtcagaacaaaattttgccagctctgtctactgccagcacttggaaataggagtcccatggggtttgcaaacaaatgaaagcagtggtgggcttgcaagacctcaccagtccttagagttcagttgatatgtctctcaatacaatgcaggaactaattttaaagcattttgaaacaagcacaataactgaaaattctgagttcaacaagaaacaaatgcatttaatctttgaagaaaaatcaagtcaattaagaaatgaaaataggttgagactagacgaataagaatggaaatgatcgattggagaagttttcagccttgaacaggccattaccaagtggtcagtatgaccacatttatctgatattatttggtccttttctttcttttaaaagtactatttagttataagaatcttaaatgctggctggtgcagtggctcatgcctgtaatctcagcacttagggagactgaggctggaggatcgcttgagctcaggagtttgaaaccaacctgggcaacatggtgagaccttatctctaccaaaagtaaaaaaaaatagttggacatcgtggcatgagcctgtagtcccagctacttgggaggctgaggtgggaggatcacttgagcctggcagatggaggctgtggtgaactgtgatcttgccaagaccgtgtctcaaaaaaaagaaagaaagaaagaaagaaagaaagaaagaaagaaagaaagaaagaaagaaagaaagaaagaaagaaaagaaaaaagaaaattaaacaccactttttaaaaaaaagcaacaaagaaaatttggacattaagagaataaacattcccattaatcccatctccactctcctaagagatcatcagtttagtgcctgcttttccaaaaatatatgtcaaaaatgatttctctttcttaaagagaaagtatatatctatagtcttaactttccttttttttccaactatataaatatagtggccaccatacattattttaagcagaaggtaaattaaacgatccactgcgaacactttggatttcttttgtagctcccaatgtttgtttggcaagatagaaatgcccttaaatgcagccttattgtcccagctttagtaaaattctatttataaatcaaatccaaagtaaccagagacgttggcataatctttggtattctctgccggtacagagaaatctcaatttgtggtttccaacatttgtaaggtggtaaatagcaacctccctccactgttcctcccacctcaagtcagcagggtgctggtaaactggcttgggtgggagtgaggggaacccctggtgtgtcgtatttactgacttccattgggtaaatgctccatgattggctcacaaaatttcctaatatttaacaattggtgttgaactgttctaacacatcagtgtcaagccattcgatgaccaattatggcacatatatgacccttttatcttgatataacactcatgcaggcttatttcatacatgtagtcactgcacctacaagaaacgtataacagaatgaatgacccaaagccaacaactgtggggaaaagtgaattagacaacatctctctcatatttctctatttatgagaggaaattctagcatataacctccaagtatgatgaagttcttctgtagacatgtaggtatcagtattatgctaacattttttcttttcctagataaaaataaagtagcccacaagcctggttttatgttatgttaacattcattaggtattctttgcaattttcccttttgcagctattaaatcacttattccttcaatattttttcctgcataatgatttttttatagaagctaatacagtaagcattttaaagtcttaccagttgtgacattgaaataatgagactttaaagtccaaccacgtatctggaaatataggaacaccattcatttattttttagaagaccacacactcatgctaatgaggatgccattgcttaaaatgttttggaaattctctttaggaattgtttttggcacaagattatgcagtatggatgaatattagtttcactgccctaatagtggtgcttcatatttttctaattaaaattataaaatacaacctctgataaagggtaaagagcattggatgttgattcagaagatctggactcaagtttaacctctgccacctactcgttttgtactctgcatatcccttaactgctcctaacctcactttccttctctgcaatttgagaataaaagtacactcgtgcgttgcttaacagcggggatgtgttctgagaaccacattgttaggtgacttcattgttgtgtgaacatcgtagagtttacttacacagcctagatggtatagcctaccaaacacctaggctagcccctattgcttcagagctacaaacctgtacagcatgttctgaatactgtaggcaattgcagcacaatgataagtgtttgtgtatctaaacatactcagtatagaaaaggtacagtaaaaatatgtataatcaataaaaaatggtacatctgtatagggcatttattatgaatggagcctgcaggagtggaagttgctctgggtgagtcagtgagtgagtggtgagtgactgtgaaggcctaggacatgactgtacactagagtaaactataaacactgtacacttaggctacactaaatttatttttaaaaattcctttcttcaataataaattaaccttagcttactatagttttttactttataaatttttatttttattaactttttgactcgtaatcacacagcttaaaacacaaatacattgtacagttgtacaaaatattttctttatatctttattctgtgatatggttaagctttgcgttcccacccaaatctcaccttgaattgtaataatccctacgtgtcaagggcggggcgaggtagagataattgaatcatcggggcagtttcccccatactgttctcatggtagtgaaaaagtctcatggggtctgatgattttatacatgggagttcccctgcctaagctctcttgccacccccatgtaagacaagactttgctcctcattcgccttccgccatgactgtgaggcctcctcagccatgtggaactgtgagtcaattaaacctctttcttttatacattacccagtagcaggtttatctttattagcatcatgagaacagactaatacattctgtaagctttttttctatttttaatattttttattttatttaccttttaaacttttttcttaaaaactaagacacaaatacacacattagcctaccagggtcaggatcatttatatcactgtcttccgcctccacatcttgactgactggaaggccttcagggacaggaacatgcatggagctgtcgtctcctgtgatagcaatgccttcttgtccatacctcctgaaggacctgcctgaggctattttacagttctaaaaaaaaataagtagaaggagtatactttaaaataatgataaaaagtatagtatagtaaatactaggtgataagaatttttcagctccattataatcttatgggaccactgtcatatatgtggtttatcactgagtgaaatgtcattgtgtggtgcatgactgtacctgctccaggagttgtcctgaagattaaataatacaaggcattgtgataacaccttgtgaaatgaaacacgctatccaaatgaaagtcatcattggtctagcttgattagaattgaatgggcttggctatttccaaaattcagatgtattccctgaaagcataaatgttccatcatcaaaaaaagtgtagtgtaaaaagaaatatgcttggactttgtctcagttcttggctcagagctcataaagcccttggaatttcctgaatgacaggagtgtctttggttctttgcaaggagcccctttcgaacatgcctgagtttatgctaatgaggtgatttagagtgggacccagatagtgtcatgatggggccagtcaccagaaggattatagaaatttgggactttcatcccagttcacctacccctcagcaggggatgaggaatggaattcaagctgttaaaaacacatatacaccatggaatactatgcagccatacaaaatgatgagttcatgtcctttgtagggacaaggatgaaattggaaatcatcattctcagtaaactatcgcaagaacaaaaaaccaaacaccgcatattctcactcataggtgggaattgaacaatgagaacacatggacacaggaaggggaacatcacactctggggactgtggtggggtggggggagggggagggatagcattaggagatatacctaatgctagatgacgagttagtgggtgcagcgcaccagcatggcacatgtatacatatgtaactaacctgcacaatgtgcacatgtaccctaaaacttaaagtataataaaaaattaaaaaaaaaacaaactctcaaacaacaagatttgatgactttccaggtgggtgaacacatggaggtgatgggagggtgggcacctggagaaggtgtggaaactccacactcctcaccttgaactccagaccttgccctgtgtagctcttccatctggctgttcctgagctataccctgtataataaactaataaatgtaagcaaagtgtttccctgagttctgaactattctagcaaattatcaaacctggggggaggggggtcttagaaaccctcagtttatagaggattggtcagaagtaaggaaggcccgcactttcatctggcacctgaagtaggggcagtctgtgggactgagccttttcacttgtgggatctgaggctactcatctggtagatagtgtcaggattgaattaaattgtaggaccccactccctccccgaccccgcctcaccccacccccatgtcgggagacttggttggtgtggggaaccctccatgccccacatttggtgttagaaatgttgtgtgagtctagagagtatttttttcagagtattcaaaataatttggaagacacttacatggatccctcaggtcagtttattgaacccaaatgaggactcagggattatgggccctagatcattttgagatctgagatccagagaaagcgtatcctgtactgaagccctcctcactctccaggtccttagtgttctcatttcttcctgattctctgcttcccacccactccactggatgaaagcaggatggctgcatgagggcatttatgataataaatttgaaaagatcctggccgggcttttgacaagaacatcttcatctctctctcacgccagcagcctgggccagccagctctcctccttttgaatgcctcactcagtattgctgctattcttgccattttaagatagctttgacctgaggggcaggatcacaaattccacagtggagcacagggcatgaagaggttgttctgtcatagtctgaggctatgagggagaaattaacctcaggcccagcagattccaaccagcccacccctaatcagataggtcatatgaatgaaacatttaaccaggttatccagtttcttgctgtaaaactagccctttgcagtctgctggagcaattactgaagtctgtcatctgcaatgctcctttcacatctaaaagtgttctttcttttcatttttcatgttaatcaaaacaataaatagcaaccacttaggtatcccaacaatgactgcactacatatagtttacaaatcagaacaacagataaatacatatcattttactgcatgctatattttttttcgttgtagatttaaaagtgtgctttgtttgtaagaaaataagtaaagaaaactgcttcacattctaaggtgaaaagaaatcctctcacgtgtcgctgtaaaattttcatttatggtgatgagttgtcctgtgtcaaaacatccttattaacagacattttactgtgagcgctctctctttattgtgttgtctgatagtgcagggttttgtagtgaatacaagtaaagtatgaactgtctaaacaaaaaagcaaacacaggccaggtgtggtggctgacacctgtaagcccagctacttgggaggctgaggcacaagaatcacttgaacccgggaggcgaaggttgcagtgagctaagatcgtgccactgcactccagcctgggcaacagagtgagactctgtctcaaaaacaaactagcaaaccccacaaatctaataatatttgaaaagacacaacagtttcagtgacagattaaacacaaaaaatacactggcccatgatttggttatccttggttagagccactgtatattataaaaatttaaaaacaaattcttggttttttaaaggaattccttgagatgagggaattttaatgagctacttctattggtattcttcaaccatcagtttagaagctaagtatttgatgtttcaaggtaaattagattttgaagcagcagaccaaatattcagttctcatccaccagtaaacaatacttcacgcccattttataaagctttcagttatgtttttccttatctgctgctgctgcctgtaggcatttgcaaaacatacatcatggctcctggtcattagtcccatcaattattagtttctcaaattcaagcacaacctccaaggtcttagtgttaatgttaaattacttaattgaagaataagaaatgatgagactaaaccttctgtcttgtctcctaatggagacttaatagtctttcccaaggggtattttaaatataaatatttttaaaatttaaaggaagttcattttacaacttaaaggtgatttcccttcagaatgttaagcacttttccttgtttattttcttataaacaaagctcacttttaaatataaaatgcaaaaaagatacagagtacagtaaaatgatacatatttatctgttgatctgtttagtaaaccatatgtagtgcaatcattgttgaaatacaaaataaagactaaaataatgaacataaaagtaacctgtagtctcaccatcaaaagaataatttaacattttgatgtatatcctttataaaatattgtatttcaactgcaaatgtatttattaagtgtttagtatatacccagaactgttctgggtgctgagagagagataaatgaacatagtcttcatcccccaagggcttacaaataaggtattcatcttattgataaaggcctagtttgttgatagaaaagttagttgatagttgttaattttccacattttgagtatttataggctttaagctcaattgaaaagagttctctcccaggtatgtcaagtctgttacaacctctttttaacttactgccttttgtgtcttgttcactgggcccagattgtacttaatggatttgatggtatccagacatatttagttacactgattcctctaataaaacagtcatttctcagtgtacattatgttagttccttggaatggagataggtgttatatagggaaatagattttatggccagaaatgtttgggaaattctgtgttaaacaatcatgtagaatacaaaatcaattgtttgatgagtgatcaatctaaatgtggaagataaatctatccagcctgtagaagaaaatgtaggaaaatattttcatgaccatgaagtaggcaaagatttcttaggacatcaaaacaggacaaatttgacttcaacaaaattaaaaacattaatcaaaagatgtagttttccttttttaaagaaatagttaaattgaaagacaattcatagactgtgagaaaatattcacaatacatatatctgacaaagtactcacatcaaaatactgatatcagaatatataaagaactacaaattaataataaaaaagacaaaactaaaaaagatcaggcaaaaggcttgaagagatacttgacataaaaaatatataaacactcaataagtgcatgaaaaggtgcttaacattaacagtaatcaagaaaatgcaattaaaaccatgatatagtaccacttcacatcaactgcaatgagactaactaagatttaaataccaagcatcagaaaatatatgaactggctgtgatacactgataacaggaatataaagtggtatgatcactttggaaaagagtttaccgctaaacagatagctactggtagctataattgcactcctagttgaacttctcagcatctgtatatttatatatattatttgacacacacacacacacacagtgaaaaccttgctgcacccaagaggaataagagtatgtccacaaaaatactggtataaagaacgttcatagcagctttatttataatgggaatgaactactagttcacacagtgtacatgaactagtgtgattcacaaaacaacagaaacattgtatcaagggaaagaagcaggcacaaactagtacctactataagaatatgtgaaactaagctatggtgataaaaatcatttaggatgattgcctctggagaaggtcttggggtaactagaaaggaataccaggaactttgtggagtaatggaaatgttctctctcttaatttaggcggtggtattacaagtgtatactttttttagcttttaattttgatgtacataattttcaatttacagaaaacttgcaaagccaggacaagaacttccgtattctgtatctaggttccccaactgttaggcgtatgtatttgttgaaattaattgaaccatatgcttcaaatatggatgtaaatgttaccttaataaataaagtggggggaaaagctattttactgaataacttctcagaattagttaagtctccaaaaaatgtatactttatgtattacctccctaatttttttggatgagaaacctagttttcaacaaaaacctgctgggccaatgtctcaatgaatgctcattgggacccaatgctctagtacagcacttctcagccctgagcgctcattggaatcacctgaggagcttttcaaaccttctaaagtccaagctgcacctcagtctaaataaattacactcaccagtggagccaaggaagcaatctgtttatatcccaggtgagagctgggcgtgacacttataatcccagctacttgggaggctgaggttggaggatcacttgagcccaagaatttgaatccagcctgggtaatacagtgacactcccattttaaaacaaaacaacaacaacaaataaatctcagatgaatccagtgtgagccatggctgagaaccactgttttacgaaaatatcatctcacttttaagaattgacacttgcccacggtagggtggccgagtggtctaaggcgctggattaagaattgacacttgcccaattagacagaggctcacacttaataaacattaccaagaccagcaacctggtgtcctccctcgatggatatctgcattgggagcagggatctatcgtactgattagtgcccacctggctggctctctgactgtaggaccctggcttctccccttcagacctctgtttcctgcctgcagttcacttcagtggatgtcctctctggacaaggtgcccaggtagacctagagtatttgcctatttttttccaacccagctctatactattaagtggtctgattggttgcctagccccctgtcatgtgaccagcacccaatgagaacaaggctttggtttcttgggcagttcagtttgtatactgaactttctcaagccatcctacttcccactgtgtttctagacctgtttcttatcaaagcttctggtctcttgcctcattctttaccacagtctcaaactgacctcttatatctggtaattcatattgctgctttgccccagctgttggctccaaatgagactgcacttcatgcatctatcacaggagtttcctctaccctctctggtgccagcactttctgcctcaacgaggacccctctctgttgctagccgggtaagcctccgcttaagaaagagaatggggcagtttctctgtgcctcagctaacctccctggtctcacctaaatgtgcagttcggccctgataactctcacttggctggtcttactctctcacatggcctggccagcctcatatttccgttcgttggacaccacagggaattaggcatccggctgaagccactatatcaggtttctgtgtgcttccgaggggctggtgtctgccctacattccattctactgaccatgtggtacattctcggtgcaggcggctagatgaagtgcgtatcagaaaatacagctgctcacacctcagaactccaagtgccctctctgtcatccatctctcctggctcaggcctgccccttcctgacctgggccacagctttgatccagcatttatctttatttctattcatggtttatatctgcccctagcctcaaacccatgtcatagatccctccaaggggatggagaggccacattcctggcaccaggttcatggacatctgttgttttgcccgcttggcctctccactcccttctcctgataacaacacccagctttcgcttaagaaaaccaatactcacctccagtcagaaataacatagattcagcatacatgtcaagtgtccctcccttgaccacggcatgggcagaagtcccaaactaaatcattccaatattcactctctgaaatttgagtggagtagagcacgaaaagttttaaaatggctgaaaatcatcaaacctacttatcttgaagggtaatgcttgtttctattaagggtctctgaaccccttagttcctgctgttttctaagatttattctttcatcgtacattttcttcaattcccaggcttgtttatttacttattgatttgttttctctagtaccaagagctggttccattgtttgtgaccagtacatataactagtttacagtcaactcttttttatctttaaagtaataataaaatactaagaaatattttaaagaattatttcataagagtgacttatttcctaggatctccttggagttccatagattttgtctattacctttataatcctagctgaggtaattgtttaacatctctgagcctcagtttcctcatttgtaaaacaaagcaagccagtgatcctcatctcatggagaatcagggcaggttagatgagaaaacattaaccaccacctgctcagagcctggcacatcacaggtaaacaaatgtttgttgaatgaggcatttgtgtattacttcccaggttcgttttgctctcccaaaatgctttcttaaaatcatgtagtgggaagattatgtaaaactgtccttgggacttaatcatagaaaattctcctgacaaagtacattttggaatatttggtccaggaacatagccagcaatttggcaagcataactctccagcaaaaacaaggccgttgtacaaaagaacctctcatgcctttggcctctctgctttggtttgctctaacttctgcagatggtcatgctcaacctagtagacagtggtatctaaattctaaatccactgtcttcctaaggaggaaacgaaggtacgagggagacagagtgtacagcttacccattggcatggtgtcaatagaagaaaaaaactcttcagctctcttactccccctgcccctcaacacttgaggaattatgccaaattgaggaataaactccatggataaagaaataatagagaagctcacctcatttcagacaaaccttcagtatatgaagactatgagaaacacaagaagaggtagcagctgtgaatggtgagtgctcggaatgtagactgtagtcccatagagcaaaagccacagccactgagtctgacctagacgttttatccctcaccccacttatcccctctccatttctgcacatggatgcattttgtatctgcatgaaactggaacatactgaagcaagaaacaataataaacttacattgtgttgatactaatttttttttagttccagtttatgcccatgtctttaaaacttaaaataattaagagatagttttcatttttaaagagcccaacccagctatatttgatgaaatttaaaaaagaaatttaaatcagcaatggtataattattatccaaattgactataaatattgatatgcacagtgagtcacctgaagagtgtctggctcatgaaggcacttaatatttttgggatgaatgaatgaatgaaaaataaatacctgtgtgagcaaatcaagtcacttattcatttttatgttaccactaaggaacatggagttggaaggagccaggaatactagttctaccctgatattttaaaggggaggaactgaagccaaaaggaagtcacttgactaaggcacaggctagtggcagttctggaatttttttacttccctgaaagttgttattccagacttcttcccacaagtggaattttaatgtacacatgattggtttattgaattaatagttttttccccctaagtttgctctgattttagcattctttgactcactcatataacatatatttgttgcatggttactctgggctaggcactattctaagcagcaaacaaaacacgtcaagatcctgcatttagggagcttatattctagtgggagcacggcaggcaataaaacagaaaacaagtcaatatataatacctcagttggtaacaaatgctcaaataaagcataacacaaatgatggggatctatctctaggtatgtacccaagagaaataacatatgaccacataaaaacttgctcacaatgcctttcacagaattatacacaatagccaaaaagtgaaaacaactcagatgttcatctaccgataagcagaggactaagatgtggtatatccatatggaatattatctgccaagaagcagcaatgaagtactgatacatgccacaacatggatgaatcttaaaaacattatgagaagtgaaaaaagcccatcacaaaagactgtatattgtataatttcctgcatgtgaaaagtccagaataggcaaatatatagagactgaaagcagattagtggtcagctagggctagggaaccggagtaattggtgtgtcagagggtaatgatgatcaaaaggtgcagactttctttttggggtgatgaaaatgttgtacaattgatagtggtgatggatgcaaactctgttaatactaaaagtcgttgaattgtacacttcaaatgagtgtattgtatggtatgtgaactgtgggagcgggctcctgctgttttatgaagtatcttcaagaaaggtctcactgacaaagcgacatttgagcagagactgcaaggaatggagaaagtaagcctgtgggtacctgggggaatagcattccaggcacaggggacagcaaatgcaaaggcccattggtgaataaaagattgagatgctggaggaacagcaagagggtcacatggctgtagagagaccaagggggaggtggaagaagaggaagttagagagttagccaggtggggtgggtatgtgctggtgaggcttgtagacccctgaaggacagtagtagcctttctctgagtgagatgggcatttgctggagacttttgagtagaggcatggcatgatttttgtgcaaatcactccactgcccttataatagatctgaaaattaactggtttcacaacagcatgcagaagacatttggctttacttctgggcctaaagttcagaaaataaacagaatcagggcaggggtctccctcacccaggcctgctggcagcattgccctgtcattgctgtcagaaccagagagaggtcagggaggagcctggagctctgagactagatctggtctagtcttcacctggtcttggcaagttttgtaaaaactttcttcatgagaggagacagccatcaggttaaccagtaattgtatttgacactaagaatgccaggccataaaaggattatctaatataactggaaggttccaagaccagtgatagagaggcacagtggaagctgactctgagtccctgcctaaacaaaaggacaggcagagagaagataagttactgagttcatggactttaaaatgcatttctctatccttagcttctctctgtgtacagtgcttttatttttccaagagacactgcagaatcaatggggtgaaaaggggaggtgagaggaaagaagtaacaaagtttatttactttaataatgacttataattgccttattgtctttcagaactcatttttaaatattttcccttccttggcacttcaaatcaaactattttaaaaatgtacacattctaaaacatcttattttctgtgggtgaagtttaaggaatagataattctccctgtaagatgtattctgcttggctaacttcaccatgggcaacttgcatttacttaagtaaaagaaatgatagggccacgtacaagatattttgacagaatgcctaatggtctggttactagagaattatgttggaggaggtgagaaatgccatcttgagtccaatagttctcagtatctcagagggcattcaacaggaaaacaggaaatgctggttgaatggatgcatttatagagagctggtaatatactttttctggactcttaagaatgagccatccaaaacacaataaataaaattgtatgcactctgggaaaagatctggataattaagatgaataacctattgtaggaagagttctccttgagcgtgcttattattcttcagggaattgagacaagtttggggaaacaaggttggttttatcagggcatccaggtgatcaacaacccaactgaatagaccaagtgtgtggaaggctcaaggaccaagctaaagagctgtggcatttacagaattaggatgtaaggtgagtttagggaccaaggttgtttggagtggggagtggtctgatcaagggatcaacttttatcctctttcttcccatctttgaccatacactctctatcctcttttctttcttgtcctttttctctccatgccattttctctatgtgtgtactattatactgaactgaagcctatttttattgaggactgggtatttactgaagagaagtattaggttcccgtgtatatttttcatttattcttccgcagtttgcctgggaaagaaaactaaaacaagaaacagtaagctctatgcttacttgtaaaagtggtcaactgaaaaaaaaaaaaaaactttacaagtggattccttctttttcatgggttgatggtttttgacaggggaaagaaaaaaaccttccccactcactccaaatctacacggaagtgctcaaaaagattccttcaatcaggaaaaaaagtgatgaatttgaaagggagaaaggctatcctatttatgttatttaatagatagaaattgattttcgataggaaagcaagcagctgcagacactgtgttcagctctcacgagaaatggttgctctattttagggttcttgccaaagctggagcaggtgctggctttttttccttctttttaactcactcctagctctcaagggtttaactggccagaaggaggctgacagtcaatggacctatgcccaaatgggctgcagctcaggcagcacaatgctgcgaccagctcgatgctctgatacaactttcaaagcccttctgaaatagttggctcggtggactcccactcacattataattagaatcgcacctgctacgtccagcatgtgttaagtttctgaaaatactagagaaggaagacaacaaaaatattcatactgatgtccttaaagggactgtagttctaggactttgcgggtgtgggtgagagaggaagggggtaggaatagtcattcgcctttgcttctaaagtattctagttaatgcaggggtgtgggaaccctttgaggcaaactgtggcaaaacgtttttttccacctatttattttgtagttttcaagtataaacttagttttgccaaatttctgagcccctttacttcttttcaaaattttactgaaatctttattcaaaattttgctgacaatagaaacctggaaggaggagaatgcaagaggccacagggaggtgctaagggctaagtgggttttccaaagagcctgctaggagttcgcgagctccccttcacttgtcacaggcttcagtgcccatagagcccaccggtcacgtaaatgagagacttgggccaggcatgagaaaattgggagtgagggggatgccgttctacggaggatgttctttctttaaggctactcagctccagccaattgttcctgtgtgagaatgtgaactcagtgttgccagatcttcttgagttttcaagagtagccagaaatctggatgctataaaaaaaagttcccagtttttaaaacaggaaataccttattataacaaaaggacctgaggctgggtaatttataaagaaccagaaattgattttatcacagttctggaggctggggagtccaagatcaaggcactagcagatttgggtgactgctgagagctgctgtctgcttccaagatggcgcctggttgctgaatcctccgcaggggaggaacagcagaaggcgaaagggcaagtgagctgagtgctgcatgaagcctcttttataagggccttaattccattcacgaggcaggggccatcttggcctaatcaactcttaaagataccccttttaatattattgcattggccacacctgaattttggaagggacactttcaaaccacagcagggagttcaaacaaaacacatctgtctgctgtatttggaccatgggctgccaacttgtgaccactgccgtaaagggcttgttatatgtgtaccacctactgctcactcacctccccttctgtgccagctacgaaacatcattggttccaacgtggcttggctttgcctcattatgccacctgatttccttagagaactacacttacccttctcttactcacatggattgggtgaaagtctcaagtctcagatatgctcattagcatttttcatcctctctggcaactcacatcaggtcaatgagattagtagtggaagtttatgaaacaactggacaaaagaatgtttatttctgctgaactagagagctatatggtgccactatatgaagagtcagtttgagagagtgtcttggtccattttcggttgctataatgaaacaccacagactgggtaatttataaataaaataaatttatttcttggcagggcatggtggctcacacctataatctcagcactttgggaggccaaagtgggaggatcccttgagcccaggagatcaagaccagcttgggcaatatagtgagacctcatctctacaaaatcatttttttttaattagccaagtgtagtggcacacacctgtagttccagctactcaggaggccgaggtaggagggtgacttgagcctaggaagtgaacacaagtggaggctgcagtgagccaggattgtaccactgtactctagcctgggtgacagagtgagactttgtctcaaaaaaaaaagaaagagagggagagaagaaagaaagagagagagaaagaaagagggaaagagggagggagggagggatgaaggaaggaaggaaggaaggaaggaaggaaggaaggaaggaaggaaggaaggaaaatttatttcttaaattcaggaggctgggaagtccaaggccaaaggatccacatctggtcagagccttcttactgcatcacagcatggtggagggtatcacatggcaagaggacaagagcataccagctcaagtctttcttcctcttcttatgaagccactggtctaccatgggagccctaccctgatgaccttatctaatcctaattacccctaaaggccctcaccacctccaaatatactaacatatgaaatgtgggggacacattcaagccaacacaaagtaaagccaacacaaaggaaaatagggctgagagagaaagaggagtccagatcgtgatcacatcaagtgaacacctgaatctggctatgccaactgctataccctttgattttgcagtttaatgtactgagttctattacgctcaggcagtttaaactgaatgtcttatcacttgcaagtaagagtcctgatcagattttgtcatttcatttaagcatttaatgaacatatattgagcatctactatattccagggcaatgctaggagatgctgaggatacagatttgaatgagataatttcttttctttataaattaaaaatttgaagacttcacattttattagcaccttgacacatttgtgctttctttctccacctctcccactctctctctcatgcacacacatacgcttcttttttttctctctgaaacatttgagagtaagttgaaaagatcaactagaattaggacagtctgattatcaaactcagaaaatttaacattgatctaatattacccattataaagcccttattcaaattttactactatactaatattgaatatagcaatgtttaggccagatacagtggctcatgcctgtaatcccaacactctgggtggctgaggcaggcagatagattcccttgagcctcggagtatgagaccagcctgggccacatggaaaaaccccatctctgaaaaaaaaatacaaaaaaaaaatttagcaggttgtggtggcatgcacctgtagtctcagctacctgggaagctgatgtgggaggatcacttgagtcccagagactgaggctgcagggagctgtgattgcaccactacactccagcctgggtgacagagctggggaaaaaaaaagaatatagcaattttttatacatttaatgtaggatttaatccaggatagcacattatatttctttatcatgtttctttagtgtcatttaatgtgcaatgatttatcagccttccatggtttttcatgactttaacattttgaaagagcacttgcctattgttttacagaatgttgattagtagaatgtagaaactaagatctgggcacttgaggttagtccgagtgccttcttgtgatttgattatgagtatgccttcttggcaggaatacaatgtaaatggtgtgtgtctcttttagtgcatcatggcaggaatcatctgatgtcagttcatcccatcatgggtaatgttgactttaatcacttggctgaagtagtatctatcagatttaggtaaaggtaccattttcccctttgtaattaataagtaatatgagaagatgctttgagtttgtataagtatcttgtttctcaacaaattatcacccagtgattttaggatccactgatgatttttgcctaagtcagttaacacagtggttgaaaaatagtaatgtttaaaactctattgttccttatacattttttcagttggctttctactgtaaataaaaactttctctctttttctattccctttctatgtttgtttttagtttaagtgtggactcatggaatcttttcttttcacttttgaaataaattcaaacttaagaggtgcaaaaatagaataaagagcttccccactctctgaaccatttgaagaaaagttgctgacataatgtctaatatccctgaatactttagaatattcctacaaacaaggactttctcctacataaccatgatacaaccatttagatcaggaagttaacattgataattactatcatctaacccacagaccccattcatttatccagttgttccatcaatgtcctttattgcaaatggatccaatacaggaatacatgttgcatttagttgccatatctacttatctttctttggctttatgaccttgaccctcttaaaggtcagttattttgcaggatgtccctcagtttgcctttgccttatgcttccttgtgatcagattcatgacttgcattttggtaagatatcacggaagcgaggctgtgtgtcctcaatgtatcctatgacgtggtgtatgatttcaatttgtctaacatgctgatgttaaccttcgttgtttgattaaagtgctctctgcctcaagttactgcttatagttactgtctttctctttatactcagtaagtattttgtggagagttattttgagaccatgtaagtatcctgctcctcatcaaacattcacccactaattttatcatttattgatatttttagttgaatttattattactgtgatgattgccacatagtgatttttctaatttcatcattgtgtttactattatcaattgactttctttttcttttttttcaagatagggtctcactctgtcacccaggctggagtgcagtggtgcgatcttggctcactccaacctctgtcactggggtcaagcaattcttgtgcctcagcctccagagtagctgggactgcagtcttgtgccaccacgcctggctaatttttgtatttttagtagagacggggtttcaccatgttggccaggcggtctcaaagtgacctcaggtgatccacctgcctcggcctcccagagtgctgggattacaggcatgagccaccgtgcccagcctcaattgactttccaatgtaaagaaaagttttcctatctatcatctatccacctacttacttattcatttattcgtatcagtatgggctcatgaattcccattttatttaatatgttataatctgttactaatgatatttatttatttatttgagacagggcctcactctgtcacccaggctggaacgcggcagcgtgatcacaactcactgcagcctagacctcccaggcttaggtgatcctcccacctcagcctcccaagtagctgggactacaggcacacatcaccgtgccctgataattattttgtattttttgtagagacaaggtttcgccatattgcccaggctgaatgatatctattttgatcctcaagttgttcctgatttggacaatgggaatcccttcagagaccttttgacaggtcctcatcattttttaggcactccttcacacaagatattcattctgtattccctggcccagtgctggaatcagctatttttttttctaagaagcactgattcttattaatgggaaatgaaatttagaaaccaagatctgggcactaagtgtggatattgctactgggttgtgactgcttttaaacacttttggccaatatagacccacgtatttaaaatcatgactttatagtgattccagcacagggttgttcatctctagcccccatttcatatttgcatatcaaatgcaacagcaaaagctgtggtttccatcagcaaaagctctggtttccaaaaatttcagtatatatatagtcattgactctatcctacaatattcagaaaatactttcagaattcctatgcccatagcactgccaataacaaaactactaagcaaagttcaagatttatttgcagttctttctgtcattaggctgtttatatgtacacaatcccttttttccccttctgtgtttatagcattcatttgatatatagctcaattcatgtttttgttcatattcaattttttctgccaattttgttaatttaatttttttttgaatttgtaaaaacactaacatggttccaaaagtcaaaattatacaaaaaggtttaatcagagaagtgacactacctctccttcccttccacccttttcacactctccctctgtagggaacattaacattaattctttttttttttttgagacggagtcttgctctgtagtccaggctgaagtgcagtggcacaatctcggctcactgcaacctccacctcctgactgtaacctctgcctcctgggttcaagctatcctcttgcctcagtctccagagtagctgggattacaggcgtccaccaccatatggggctaatttttgtatttttagtagagacggagtttcgccatgttggccaggctggtctcaaactcctgacctcacgtgatccatctgccttggcctcccaaagtgctgggattacaggcatgagccactgtgcctggccttatcattaatttctgatttatccttcctgtgattctttttgcaagaattagctggcgcatgaacattttaatataccccccttttcaaacataaattatgtactcttttacaccttgccttttttggttaactttatatgacagaaaccacacctttcagtattaaagagcttgttcttatttgtttaaataacagctttatgaagatataattcacaagccataaaattgatccatttaaagtatttgatgctttttagtatagtcagagagtcgtgtgaccatcattacaataaattttagaacattttcctcacccccaaaagaaatctgtaccattagcagttactcagcatttccccctattccagcagccctggggggccaccaacctactttgtgtctacagatgtgcctattctggatttttcatatatgtggaatcatacaatgtgtcatcttttgcccctatcttctttcatttagcataatttcaaggttcatccatgttgtaaaatgtatcagtacttcatttctttttcttgctgaataatatgccactgtgtagatgtaacacattttattgtttcattcatcagttgctgggcactcaagttgtttccactttttgtctcttatgagtaatgctgctatgaacattcatgtataagtttttgtgtggatgtgcagttttaattctcttgggtatgtatctgtgttgtaggactttctccttagttcagctaaaagccaggtttttgtcacacggccattaaagattaggttcgcagacactttgaagggtgagaaggggagggtttattgcatcaaaaggggaaaaaaacggaaacagggactctcagcaaagcgagggtcctgctaataggcttctagactcacagattgaatcccagataccacccggaaccggagaggccaggctcctcccgcctgcaaactggcaaacttccagaggctccacccccagtgtgcactcctcccagtgcggaggccagttggaggtcctcctgcgacccctttatacttggctgtctcatttggaccggaattcctggatcatatggctactctgtgattaatcttttaagaaaccaaaaggctgttttccacagctgcagcaccagtttatagtcccattatcaatgtatgagggtgccgaattctcctcatccctgtcaacacttgttattatctgaccctttcagtatagccatcttagtggaagtaaagtgatatctcatggtggatttcattttcatttcgctgatgcctgataattccattttctcttttactgcagcacagtacttctttgtgtggatgtaccaaaatgaacaaggcaattcttgcagtcttttaccctctgggaaggctcattgaccagtgagagagacagactcttttttgttgttgttgtcgttgttgttgttacaggacttttagattttttttttaaatagtattagtagtttctgtgttttcttttctttttttttaattattatactttaagttccagggtacatgtgcacaacgtgcaggtttgctacatatgtatacatgtgccatgttggtgtgctgcacccattaactcgtcatttacattaggtatatctcctaatgctatctcttccccctccccccaacccacgacaggtcatggtgtgtgatgttccccaccctgtgtccatgtgttctcattgttcagttcccacctatgagtgagaacatgcagggtttggttttctgtccttgcaatagtttgctgagaatgatggtttccagcttcatccatgtccctacaaaggacatgaactcatccttttttatagctgcatagtattccatggtgtatatgtgtcacactttcttaatccagtctatcattgatggacacttgggttggttccaagtctttgctattgtgaatagtgccgcaataaatatacatgtgcatgtgtctttatagcagcatgatttataatcctttgggtatatacccagtaatggaatggctgggtcaaatggtatttctagttctagatccttgaggaattgccacaccgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcattcctctgatggccagtgatgatgagcactttttcatgtgtctgttggctgcataaatgtcttcttctgagaagtgtctgttcatatcctttgcccagtttttgatggggttgtttgatttttttcttgtaaatttgtttaggttctttgtagattctggatattagccctttttcagatgggtagattataaaaattttctcccattccgtaggttgcctgttcactctgatggtagtttcttttgctgtgcagaagctctttagtttaattagatcccatttgtctattttggcttttgttgccattgcttttggtgttttagtcatgaagtccttgcccatgcctatgtcttgaatggtattacctaggttttcttctagggtttttatggttttaggtctaacatgtaagtctttaatccatcttgaattaatttttgtgtaaggtgtaaggaagggatccagtttcagctttctacatatggctagccacttttcccagcaccatttattaaatagggaattctttctccatttcttgtttttgtcaggtttgtcaaagatcagatggttgtagatgtgtagtgttatttctgagagctctgttctgttccattggtctatatctctgttttggcaacagtatcatgctgttttggttactgtagccttgtagtagtttgaagtcaggtagcgtgatgcctccagctttgttcttttggcttaggattgtcttgggaatgcgggctctttttggttccatatgaactttaaagtagttttttccaactctgtgaagaaagttatgggtagcttgatggggatagcattgaatctataaattaccttgggctgtatggccattttcacgatattgattcttcctatccatgagtatggaatgttcttccatttgtttgtgtcctcttttatttccttgagcagtggtttgcagttctccttgaagaggtccttaacatctcttgtaagttggattcctaggtattttactctctttgaagcaattgtgaatgggagttcactcatgatttggctctctgtttgtctgttattgttgtataagaatgcttgtgatttttgcacattgattttgtatcctgagactttgctgaagttgcttatcagcttaaggagattttgggctgagatgatggggttttctagatatacagtcatgtcatctgcaaacagggacaatttgacttcctcttttcctaagtgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcgatgtgcatcagagatattggtctaaaattctctttttttgttatgtctctgccagactttggtatcaggatgatgctggcctcataaaatgagttagggaggattccctctttttctattgagtggaatagtttcagtaggaatggtaccagctcctctttctacctctggtagaattcggctgtgaatccatctggtcctggactttttttggttggtaggctattaattattgcctcaatttcagagccagttattggtctattcagggattcaacttcttcctggtttagtcttgggcgggtgtatgtgtcgaggaatttacccatttcttctagattttctagtttatttgcgtagaggtgtttatagtattccctgatggtagtttgtatttctgtgggatcagtggtgatatcccctttatcattttttattgtgtctatttgattcttctctcacttcttctttagtcttgatagcagtcttgatagtcttgctaatggtctatcaattttgttgatcttttcaaaaaaccagctcctgtatttattgattttttgaagggttttttgtgtctctatctctttcagttctgctctgatcttagttatttgttgccttctgctagcttttgaatgtgtttgctcttgcttctctagttcttttaattgcaatgttagggtgtcaattttagatctttcctgccttctcttgtgggcatttagtgctataaatttccctctacacaccgctttaaatgtgtcccagaaattctggtatgttgcgtctttgttctcattggtttcaaagaacatctttatttctgccttcatttcgttatgtacccagtagtaatttaggagcaggctgctcagtttccatgcagttgagtggttttgagtgagtttcttaatcctgagttctagcttgattgcattatggtctgagagacagtttgttataatttctattcttttacattttctgaggagtgttttacttccaactatgtggtcaattttggaataagtgtgatgtgatgctgagaagaatgtatattctgttgatttggggtggagagttctgtagatgtctattaggtccgcttggtgcagagctgagttcaattcctggatatccttgttaactttctgtctcattgatctgtctaatgttgacagtggggtgttaaagtctcccatctttattgtgtgggagtctaagtctctttgtaggtctctaaggacttgctttatgaatctgggtgctcctgtattgggtgcatatatatttaggatagttagctcttcttgttgaattgatccctttaccattatgtaatgtccttctttgtctcttttgatctttgttggtttcaagtctgttttatcagagactagaattgcaaaccctcctttgttttgttttccatttgcttggtagatcttcctccatccctttattttgaacctatctgtgtctctgcacatgagatgggtctcccaaatacagcacactgatgggtcttgactctttctccaatttgccagcctgtgtcttttaattgcagcatttagcccatttacatttaaggttaatattgttatgtgtgaatttgatcctgtcattatgatgttagctggttattttgctcgttagttgatgcagtttcttcctagcctcaatggtctttacaatttggcatgtttttgcagtggctggtaccggttgttcctttccatgtttagtgcttccttcaggagctcttgtaagggaggcctggtggtgacaaaatctctcagcgtttgcttgtctgtaaaggattttatttctccttcacttatgaagctttgtttggctggatgtgaaattctgagttgaaaattcttttctttaagaatgttgaatattggcccccactctcttctggcttgtagagtttctgctgagagatccactattagtctgatgggcttcccattgtgggtaacccaacctttctttctggctgcccttaacattttttccttcatttcaaccttggtgaatctgacagttatgtgtcttggagttgctcttcttgaggagtatctttgtggcgttctctgtatttcctgaatttgaatattggctgccttgctaggttggggaagttctcctggataatatcctgcggagtgtttttccacttggttccattctccccatcactttcaggtacaccaatcagatgtagatttggccttttcacatagtcccatatttcttggaggctttgttcatttctttttactcttttttctctaaacttctcttcttgcttcatttcattcatttgatcttcagtcaccaatatgctttcttccacttgatcgaatcagctactgaagcttgtgcatgcatcacgtagttctcgtgtcatggttttcagctccatcaggtcatttaaggtcttctctatgctgtttattctagttagccattcatctaatcttttttcaaggtttttagcttgtttgcgatgggttcgaacatcctcctttagcttggagaaatttgttattaccgatggtctgaagccttcttctctcaactcgtcaaagtcattctccatccagctttgttctgttgctggagaggagctgttttcctttggaggagaagaggctctctgatttttagaattttccgcttttgtgctctagtttctccccatttttctggttttatctacctttggtctttgatgatggtgacgtatagatggggttttgatgtggatgtcctttttgtttgttagttttccttctaacagtcaggaccctcagctgcaggtctgttggagtttgctggaggtccactccagaccctgtttgcctgggtatcaccagcggagactgcagaacagcaaatattgcagaatggcaaattttgctgcctgatccttcctctggaagcttggtctcagaggggcatgtagccatatgaggtgtcagtcggcccctactgggaggtgcctcccatttaggcccacttgaggaggcagtctgtctgttctcagatctcaaactttgtgctgggagaaccactactctcttcaaagctgtcagacagggacgtttaagtctgcagaagtttctgctgccttttgttcagctatgccctgcccccagagttggagtctacagaggcaggcaggcctccttgagctgtggtgggctccacccagccactttgtttacctactcaagcctcagcaatggcagacacccctcccccagcctcactgccgtcttgcagtttgatctcagacagctgtgctagcagtgagcgaggctccgtgggtgtgtgggaccctccaagccagtcatgggatataatctcctggtgtgccattcgctaagactggtggaaaaacacagtattagggtgggagtgtcccaattttccaggtaccatctgtcacggcttcccttggctaggaaagtaaattcccccaccccttgtgcttcctgggtaaggcaatgccccaccctgctttggctcatgctccgtgggctacacccactgtccaacaagccccagtgagatgaacccagtacctcagtaggaaatgcagaaatcacctgtcttctgcgtcgctcacactgggagctgtagactggagctgttcctattcggccatcttggtacaaccgagacagactcttaaactaataattagaacacccactagaacaattactgaggtaagaacagggcactccagaaggagaaaaggggaagaaactcactgtaactgggaggtgaaagttttttgctttttgtttttttgagatggagtcttgctctatcaccaggctggagtgcagtggtgcgatcttggctcactgcaacctctgcttcccgggctcaagcaattcccctgcctcagcctccgaagcagctgggactacaggtgcccgccaccatgcccagctaattttttgtattttagcagagatggggtttcaccatgttggccatgatggtcttgatctcctgacctcgtgatccgcccacctcgggctcccaaagggctgggattacaggcatgagccactgcgcctggctgaggtgaaaggtttcaaagagaggtgagtctgaaagaataacttggaggtggagagaagagcctttgccaagcagagatgcttcaaaaagcttgtgtgcttagagactcggctctccccctctgtattcactatgcttacgacatcacctgtgggctacttatgagagtgaatctttacaacggcacatatgggctacttatgaaagttaatctttttttttcctatacagctaattttcattcttcctagcaatacaggaggtcagggagaaggactggcaggaaggttaaattttctgtggtcacactggcctgtcaatacatgaaaggtataataaaacaaaacactgagtgccataacatgtctaaattataattaaataccttgtaatccatgccaagttcttccctttatgggtataaatacataatgatgatctagatttattttgctggcatctgaccataatgaaatcaacttgcatcgctctcatttccttaatccacttctaaattcctgctaggtaagtcacaagttggctggcatgtctatgagaagaatagattcctggcttgttctgggtttgcatgtggctggcttggctgggggaaacctgtaccccagtaggtggtctattcctatctttcttctcaaggatctgtctgggttctaggtctggaccattcacagctgagttcattctctcaccatcccaggtgcctggttgtgacaggaagaatcgggttcctggtctgattttcgagccttgctccttggacgagcggtgggcatttgtctggtttgttaatggccctctgcttgctctacccaggcactctggggatggctgtagaaagatgtaaactgaaaagttcttctggcccccctggcttctttgatcatcatctgctcatttattcaaaatttcatttttaaattctgcaaggatgatgtctgctaatgcctagtgctgacactggcctcaaccaggacacagaatcctcttgttcccttaggttcaacatacactgactcaggaccctacaagtgcttggaacagagtgttctcctcaaattcacctacaataaaggtgatccccaaaagcccagaaaccagtaattaaaaaggagcaagaaactgggactggaattgtttgggacaggaaacttaacatttcatttgtctgtactatgcagtgttttgttttgttttttctaaacaaagcatacctattaattacatgaaaaagaaaaaataaattcattctgaatttttagcctggaaatgaagtcctttcttcagattaggttagcatcaaagcccctctggtggctttcttcagaggctggcagcaggactctttttctctgactgtcgtcacttgccttttctcatacttaactctaagagcttcttttctttttccatgcagatgtcagaaaggaaaaaaaaatgtataacagagggcatctccctactggaggtgagtactcactgggagtgagatcatgcagtgaagtggctgagaacacaggacataggggttaggctgatgtgacaaagaggtcctgacaagctacttgtggctcagcaagacctcagagaagagcatccttcaccttggccctgagtggcctttgcttttcctttctttaaaacaataataatctctaacacttattagggatccgccattgtgctaagctctttaactccatgatctcatttaattcttgcaatgttcctgtaaaatggagactagtaaagccatttcacagatgaggagactgaagctcagaaaggtgatattatctgcccaagagtcacctagctagttagagatagatagagctagaattcaaacccagcatggtctgactccagaactgaaactgttaaccaccatgccagactgttttttccagtataatgcactttttacatgtgtactgaaacattatgaggtgttcaataaatccaatttgaaaatattcattggcctggcgtggtggctcacgcctgtaatcccaatattttgggaggccaaggaaggtggatcatttaaggtcagaagttcaagaccagcctggccaacatgatgaaaccctatatctactaaaaatacaaaaagtagctgggcgtggtggcacatgcctgtaatcccagctacctgggaggctgaggcaggagaattgcttgaacctgggaggcagagtttgcagtgagccgagatcacaccactgcactccagcctgggcgacagaagaagagcctgggtgatgcagggggactccgtctcaaaaaaaagaaaaagaaaatattcattagctggggggcatggtggtgtatgcacctatagtcccaactactcaggaggctgaggcaggaggatcacttgacccagagtttgaggctgtggtgctagctgtgacttcgccattgcactccagtctgcaaaacagagtgagactctgtctcaaaagaaaaaaaataaaaataaatcagatacttggtgctatcacagtcaagcatttacttaaagtttcaaaaccatcacttttcatttgttttacaggttaagtaaaataatgttatatttaaaatttcacccctggaattttatctgcattgtaaggttggtacaattatgtttctgcattgccatattaagctcagttaactcaatttgaagctatttagattttctgattttagtaggatttgttaggtaattatacatctatatctatgcctgtctagctgtctatcaatacaccatttggcttctagttcttagcttacttattttacttctactgaaatacagtaacatttataaaattaaaagctaggccaggcatggttactcatagctgtaatcccaacactttgggaggtcgagatgggagaatcatttgaggtcaggagttcaagaccagattaagcaaaatagacctgtctctgcaaaaaaattaaaaattagacaggtgtggtgatgtgtgtcttggtcctagctactctggagcctgaggcaggaggatcacatgagcccagaagtttgaggttaaagtgagctctgattgtaccactgcactctagcctgaaagacagagagagaccctatctgtaaaaaaaaggctgggcatggtggctcacgcctgtaatcccagcactttgggaggctgaggtgggcggatcacaaggtcaggagatcaagaccatcctggctaacaccgtgaaaccccatctctactaaaaatacaaaaaattagccgggcgtggtggcgggcgcctctagttccagctactcgggaggctgaggcaggagaatggcatcaacccgggaggcggagcttgcagtgagctgagattgtgctaccgcactccagcctgggcgacagagcaagactctgtctcaaaaaaaaaaaaaaaaaaaaaaagtaaaaataaaaggtaaaccataagcactcaaactttataaaaactctcttataagtataaggggtcagacaggcaggacaccaaaattataagagctaaaattatatataatataatataatcatggcaaagcagcttgtatgttctcttgctattgtacagtttgtcattacgatgtcatgagcacctgcacaaagcagatggacctgaacattatccaacatttcctgcagggcagcccccggggctgtgagagcatgcttattttaacaatttgttgtgagtggtcctgaaaagttcctgaattttttgaatagtttagaactacaaccttcataatcagtttacaggaagttcgaataattgctctaagatggcagaagtttcactccacattgtttaccaatatgatttaatctggccgtttaaattaacatattgatggtctgaaatatatatacatgttgtttttactattgttttcaaatgaatgaggtatgtctttatcttctgacatgaaaaattttcgtgatatactgtctagtgggacagaagtttcgggacagaatgtaccatatgattccattttgtaaaaattaatcaatcaattaaacaaacaaatctatatgtatctatcgaaaagagaatccagctaggcatggtggtgtacatgtgtagtcccaggtacttaggatgctgaggcaggaggatagcttgagcccaggagttcaacgctgcagtaagttcatactactgcagtccactctggactacagaaggagagctcgtctctaaaaaaatgggaaaaaaaagaggagaaaaataaaagaagaatccactctactacttaaaggtcaggggaattgagccttccatttatattttacatttctgtgttgctaattttttaactatatggaagtttattaatgatgcaatccctgatttaagatacaagaaatgcatcagaaatccagatgtcaatgtcctatacagattcttgctttgaaaatatgttctgagagcaatgtgattgcagtccttggaaaatcttctctgactgttgctgcaactttacttatttattttaaatctgtacatatttaatgcatacagcttgatgagtttggagataagtatacatccatgaaaccatttccacaatctatgccataaacatatcaattacctccaaaagtttcctcccaccctcattataatttgtgttaagaacacttgacattgatctaccatcttagcaaatttttaagtataaaatgcaatattattaactctaggcactatgttgtacagatgtctaggacctattcatgttgcataactgaaattttttgtgccctttgaccaatagttccccatcttcctttgccatatggccctggcaaccaccattctactttctgattctacgagtttgactatacctgatacctcatataattggtatcatgtagtatttgtccttctgtgttaggcttatttcacttagcataatgtgctccaggttcattcatgttgtcgcaaatggcaagattctttctcttttaagtctaaataatattccactgtatgtatatatacaccacattttctttatccatttgtcctttggaaatttaggttgcttgcacgtcttggctattgtgaataatgccgcagtgaacacaggagtgaagatatctcttcagtatactgattttgattcctttggatatatgcccagaagtgggattttttaatcatattatatttttaatttttcaagaaacttccaaactgttttccactgtggctacaccaatttacgtttccaccaacagtgtagaaggattcccttttctttactttctcgcttgttgaatttttaaagtatcacctttgaaagataaatacagtattttttaaaacaaaaatatttctccaggcatggtggctcacgcctgtaattccagcattttgggaagatgaggcagatggatcgcttgagcccaggagttcgagaccaacctggccaacatggtgagaccctatctctacaaaaaatacaaaaattagctgggctggtgtcatgctcctgtggtcctaactactcgggaagccgagatgggaggatcacctgagcttgggaagttgacactgcagtgagctgagatcaagcccctccactccagcctgggtgacagagtgagaacctgtctcaaaaaaagaaaaaaaaatcaagaaacgcaagccactggtttccacagcaagtcttgaccatagctccacaccacaagggggtgctgtgggattctgaatgagtcacatcactggcacctcagtttcccctctgtaaaacgaggataacacccccctcaccgggaggtggcggagctgaaaagatgtggctgtgaaagcgagtgggtctgagtgggttctgggagactgcctttaattttcctaaatttgaatgggggttgggataaggtgagaccaaagaatccctgttctggtcgattatgtttctaaaactagaactaagaattcagtgcttagcttcctcctctgacctaagtctcttctcacactcctattcaaagtgctggggtggaaggaagcttgaagtcaccctgtcctcaaagaatctgacaaaagttatgcacctgaatcccagaaaactgcatggaaagctgaattttaaatataattcctggagattcccaggcccacgtgaaggatccttcattgatttaattcaggcaccttattttacccaggagaacaaaatttagaaattaaggccactgaacctggctgttaatggctcacagattccccatccccaagaattgctctgggtataagacccacctacaatgcagtggtgtgatttatgctcctgaaagcacatcctctgccaggtgcagtggctcaagcctgtaatcccagcactttgggaggcccatgagggtggatcacctgagctcaggaattcgagactgacctgggcaacatggcaaaaccccatctctacaaaaaatttaaaaagtagcctggtgtggtggcagctacttaggaggctgaggtgggaggattgcttgagccctgaaggcagaggttgcagtgagctgagattgtgctactgcactccagcctgggtgacaaagtgagaccccgtctcaatacatacataaatttaaaaaagtgcatccttgcttgcctctttccccctccctggtctgttttcctcatgagcttttcctgaagagcatatgcccagtaaatcacacacacctcaacctctgtctggggctctcctagggaatctgacctcatactagtaccaagtgtcactggcatcattttatagattccagacattgataacatgtgatgacaatacactgataagatatctaactgctctcttcactttataaaatcatgcttgggacctcagagatcatttagtcatcttagaggtgaggacatgtattatatatatgtagatatatactttatattatttatatatttattctcctgctttttccacttaatatcataacatgacgatttctctttacttctttttttgtggctccatttggtaagctttgtaaaaagaacttgtatttggggccgggtgtggtggctcacacctgtaatcccagccctttgggaggctgaggtgggcagatcacctgaggtcatgagttcaagaccagcttggccaacatggtgaaaccccgtctctaccaaaaatacaaaaaaattagccggacatcatggtgggcacttgtaatcccagctactcgggagaatgaggcaggagaatcgcttgaacccggggggcagaggttgcagtgagctgagatggtgccactgcactccagcctgggtgacagagcgagactccatcacaaaacaaaacaaaacaaaacaaaaacaaaaacaaaaaacttttaagttcaggggtacatgtgcagatttgttatataggtaaacctgtgtcttgggagtttgttgtacagattatttcatcacacaggtgttaagcctagtacccattagttatttttcctgatcctttcccttctcctaccctctaccctctggaaggctccagtgtccactgttcctcctctatgtgtccatgtgttctcaacatttagctcccacttataagtgagaacgtgtggtatttggttttctcttcctgtgttagtttgctaaggataacgagctcaagctccattcatgttcctgcaaaggacatgatcttgtttttttatagctgtatagtattccatggtgtatatgtagcacattttcctgacacagtccactattgatgggcatttaggctgattccatgtctttgctgtgaatagtgctgcaatgaacatatgtgtgcatgtctttatgatagaacgatttctattcctttggatttccctttacttctgtctttataaagatacttgtgaaaagatgcataatattctaatctatgaaggtagcttttttaaacctaatatactcaaatggaatagttatttgtatttttattattataaattataaaagggaatgtctttatgtaaatatttgtttctgtgtttcaggggttttttcccttaggaaaaatcttctagaaatagttactgggccacagggtatgatatgtattgcaaatttttcaaaaaatttttaccaacttaacattcccaaccacaatgctgtctggcaatttgaaccctcttgccaatatcaagtgttatttttataaaaacaaaccccaaactctgacttaaagtgaaaagaactcactgctccattaatttatctttatttacagtaaagttgattttttcatatatttattagccatttatttttcctgtttgggggcgttttcccccttgtgtagggctttactaatgaatttgtacagtttttgacagccactctgaaaaaatattatactagttgtggactttgttactaagcccttgatttagagatatttatgctataatttctccagagcaacattttttacctgttctgtggcaaagtgtatggggaaagatttgagtctggagaaattccattagtaattaacactcaaccaaatttacctccctcgctacaggcaagacggaatgtctttaagagaggatttctaaacataaaatgtaatgtgataattaaacaaaatatttaaagtggaatggaggcagaaatgaaaacaaccagaaaacacttacatatttatgaaaaaacacaaagtgggcagatgacattgttcaaaatgctagggttagggcaatgtaacccatgtgcctcgaagatactaacaaattcagacatccctaatgttaggtttgtcttaggatttcaacttgtggttttaaaaatgtttctcatttggttgttttcttatttcagaaataaagttgacactaagaaaaatccaattggatagataatcaacactgcaagtcaagcaagtgttttagcctccttctcagtgcagtgttatcatttatctgttttcatgattaaaaaaattaagtgctgacagtttttcaagagacaagattaaattctgtactgaaattcttcaagcttgagctctagccagaggtgaactttattttggaaaatctgagaaaataagctccattaattctgaggtgtggaaagaaagatcttgaaatacccctcacttctccagacacattatttaacctagcacattccttacagcagctgttccaaatcttttccactttccccaaaccctcctaagccgtatggagaaggcagatgctgggtgaccttccttgtccaagctcctcccatctccaaatgcccccatgtctactcccactgaatcataaattcttttaggacagcccactgtctttcctttacactccccttctcctagtccaaaacggagtgccctgttcataagaatggttcactaagagtttaaaaaggaatgattggggcaaaatcaacttaaacaacatggatcctagattttgctggtagtcagaccctgactagagtcagtttccttggaataatgaactaaggcaggaacacagcagagtgccccatacaggcctaagttagaacctggtcctaccactcattaactgggtgatccgggacaaattaacctctcaaccccactccccctcattcttcagatacttcatctcaaaaaatgaggaacatagaaattcctggctcttagagctcttaggaggattaaatcagagaatggagttggtgcagaatgtaccagttaataagcgctcaaaatagctgtaatacatgttgtcatatatcttcaatatatcaaacctctgaataatttgccaggtttgcaaactgttttcctaatctctttctgccttatgcaggcaaacctcagtttaaaaaaaggaaagagggtgttgaaggagagctgatgggaattgtttctcagctccttcaccctgattttagaactttgatctacctctgaagccaggaaaacctgcacctcccccactccaggatggaggacagaacacatgacctctgctttacttcgccatcggctctatgtaccgcgactccctctccgattctagtagtccctagctcagtgcctggcgtagggtggcgcgcaacagtctgcacagttgagttgcttaaatccccacgtcccttctcacgaatggactctgggcagagttgcttacttctgtacctgcctgcttgcatcttagagatcatttttgttctgcagactctaaagctcttcctctgattcctatcagagcataactcaatcacaaagatttcagggcggactattccatatgcattgattatttgtcggttcacttagtaaacatttattcaatgcctactgtgctttttaaaaaaagaagagcacatgtttagctatagaagaacttgtttgcttttttccccctcagatcctttaaactccggtgaggttacctttctctttttgaggctttaaaataatgtctgactatagtgacatctactggtaaaactgagctctaagccaagggaatcataagcacctagcctgttattttgacagttcttttttccctaagtgtggtccaggcggatgtccaaatcaacattctttgataataagaactactaaaccacttcattaaagtcactttcctgctaatgatttctgaatcttaaaagctgttctgtttaaaatactaccgctatccttgctgaaaaatcacagaccaagatgccaggcagccttttgaaaggaccatacttaagaaagtgcacagaaccttagaaagatattgcattaaagtaactcatattgaattgaatggctgcaagccctggctaacacagcattgctatgaactgatggattccaggacatttcagttcacgaatgaattattatttaaaagttaatttgtatgccatgtggcagatacgataacaaagagatgaggtcaccggattcttctattaaagaagtcattggtcaggtttaggattttattttacacataatgaagtattcagttgttaaattctcaaggtatccatcaacaggacatttaacacaacataaatactgtgcatttgctgaaaagaaaagcaggaaggaataagaaataatgcttttataatattagtaaattatattttctaaaatggaaaaataaagcttttttaagaatagatttttaattaccttgaattctgggagagaaacaactatataattctccagtaatttgttgctagcttgcaaaatgttaactacgtctgctggtgccaatgagttttatcaatcaagatgcgtttggctagatgtcctcatggcagcaagaggctgaagcagctctagcaccacctccttacacaaacagaaaacactcttcagaagcctcattgtgagaacaagcaactctttcccagaggtgttgcctgcagactgcctctcacgtatcattggtcagaactggttactttgcccctttctaagccaatcactggcaagaggattggaatgtttggtttagagactaattgaaattcacccctaccttagcccctcctctgggtttgggttgggtgcactttcatcagcgcgtggcacgagaacttaaaactggggagattcaagcaaggaaaaagggaggaggttgaatttgggtaaggaaacaatggtgtctactacaatcaagaggtgaatgtgtggggaggataatgaggcagatgtgggtctctagaaatctgcgtcggatgggaagaacgagggtgccaacccaagagaaatgctggagcgagagaaatgtttgtttgattttgtttggtgtgaatatagaagagatctgaacatatctataagcagaagaggggtcagtagaaatgaagagtttgagaactcagaaaaacaagttcccggagcagatgagaaagaatggaatctccagtcaggtaccagactttgggatttggaagaccaaatttcaaaaaaatggctgagtccatcagaaaattgccaacttttaatttctttgatcaggggctttaaaaaaaaagttaacaattcttaattaaagttactttcgattacaattaattgaaggtaatcacaattaatttccatttatttatcagtttctggattttaaacatttttcttgttaactttctccagttttttttttttggctatcaattacgttattgtgaaaatctgaataaggttggcataatagatgatagcactgtattgatgttaatgttctgattttgcacattttactatgcttattgagagaatgtccttttaaaggaaatatacactgcaggactgtagaagtgcgatggtcaattttatgtgtcaatgtggctaggctaacggcacccagtggtttggtcaaacaccaaaatagatgttgctggaaaggtattttttagatgtgattaacatttaactcagtagactttgagtaaagcagatggccctccgtaatgtgagtgggcttcatccaatcaattgaagactttaagaacaaagactgaggtttccgaaagaaggaattctcctcaaagttgcaacatagaaaccctgcttgaatttccagcctgctgctctatggaattcagactcaagattgcaatattgacttttaccttaattttccagcctgctaggctgccctatggatttccgacctgccaacacacacaatcccataagccaatttcataaaatatatgtctactttccttcttctcctcctccctgtacgttcttctttctctttcatccattcatatatatatattttatatatatatattttatatatattttatatatatacatgttatatatatattttatatatatactttatatatatattttatatatatactttatatatatattttatatatatactttatatatatattttatatatatatatatatatatatatatatatatatatatatatatggagaactgtgacccccgactatacaggggtaaatggcttcatgttttcaacttactctcaaatattaactctaggggaatctgggtaatgggaattctttgtacaattcttgcagtgtttctgtaattctgtaattctgaaattatgtcaaattaattatgtcaaattaaaattatgtcaaattatgtcaaaataaaaagttaacagcaacatttatttgaaagccagtttggaacatagcttttctcttatatataagcatataaacttggctacattcctgaggtagctgacaaagtccaatttaacacataatgtagctgaaatactgtgccctcccacagggattaaataggaagaaagcaagaccgttttaacggtgattcaaccagaagggaaaacactgagattgagtaacaaattttaattcatctttacttgggtggaaaaacgattgcacagtttaatattcaactgccaatgtggaaaatgggggaaaaaaacaacagctggtgggttgaggaaagaatggttgataaagaagaaacaagtgcttgggtgtacctagagaggaagggaggagagttttaagggaggttttgtttgatttggtttgatctgaagaaatttgagcatatttatacacagaggatggagctagggttgagtgaatagttgaaataatatcagagagaaacaaatgggatcttaagcaagcagtgttttttaaaattttatataccatcaatttgttttaatagtaaaactggaggaccaatataaagttgttgacttttatatttgccaagtgaagactttaaacacacacacacacagccacccaaacaatgactatccactattaccataatttcataaagggtaaacactaatacataaaggcaaaatgtaaacacttactagatttagcatggtgttcttatttcactgaggactgttttatggactctggctttttaagttagtcttggctgagcatctataagcacctgtgtctatcctggtaacctgtgtgaagcctgctgaagagggatgttctcaaacacacactttggatggtggtacatcctcatctcctccattgtggctttggttcttccgagggcttgcttccccttacctccataggtgatccaggtaagccctgaccttggctctaggttccggttcctcctcctccaagggcaaccttacaagtggaactgtggcactcacctccactggctttactgaaattgcatgtttatcttcgaagtttttgaatactttttatcaccaattctgccctttgttaatgttcaaacccacttatctctttctggttagtggagctttacttgtgttttcgccttgctcatcacctcaccattgcttctcatagaattttttggctggagaaatgtattagcacttgtttctgtttctctaattcatgttagatgcctcttaccttaacagggaacagctggtttggctacacaccttactggtgagattagtgccattcccctgtgctttgtttaggacctttcctgatccacaacctttagggtaaaactccaaggcaattcatgtcctcttacctgtaaatgaaaagcatgagatcaattagaaagtgtttgctttgggtcagacagactgtgtgtgttgtgtgctttgtcctctgtcctttttagcaatgtgacttcacacaagtttcttaaactcgctaagtcgtctttctcatttgtaacatagagaaaataagaatctcaaaaggcttttccagggatcaaatgagagaaatatgtaaggagctttgacatgtgctggcacatggcagggctcaagaaatagtgcctgctgttataaccctcctttcttcctagcactttctagaactatgctgtcaaacatgctaactactagtgtcactgaaacaccaggggttcggtctaggtcctgctgcttgctgcacggaaaggcaatgactgagacaatgagtattgccaaggaaaaaggctttaattgggagctgcacccaaggagatgggggttcagtctcaaattcatctctcttactgattaaaattaggggtttatatagcagggaagacatgttactatgtctgagaaaacaggaactcgagaggcgtaaggaagcaatcatgatgaatgaggggcctggcgtttcattgtgtggatgcaatgacgtggtttcagttctttgatacttcgtgagaggcctggggatcctttcctgaggaaggaactcagatacaaacaagggtcaatttctatgtttatccaaaaacaactgtctatgggactgttagtcggtgtcactagctagtggagatggttgccacaaattccacctgtagttgctcttgggaggaggaggaaccaaagcctggagccaggtcagggctgacctgaatcacctatacagacaaggggaaaagaactctcggaagaaccaatgtcatgatggaggagatggggatgtacaaccatccgaaacaacttacagctctaagtttcaagctttaagactagaagggccaatttctacatttatccaaaaacaactgtctatgggactattaggtcatttcactagccacatgtacccactgagcatctgaaatatggctggtctcagttgatatgtgcagtaactataaaacacacattagattttgaggcatggtatgatggaaagaatgtatctcactaataattttttatattgataacatgttgaaacagtaatattttggatgtattgggttaaataaaatatattattaaaatcaatttcacttgtctgtttacattatttaatatggcttccagaaaactaaaaattatatgtgtagcctgcagtgtaattctactggacggtgttattttagaatcctgatttttgtctgtgaaataggttgacaaattgatgtatgggatctttcttcagagatcactcctggatatgaccccatcgtccacctgacatccctgcagaggatggcatgttgactttatgacttctttggccttaaacatctgctttgtactgtttcttgcttttctcatgcacttagaagattaaagatcttaataagatagagagatgtcatctgaaaaaggttggccagatagcccatcatatccccaagggtcgagtcatgaagagatgggaaatctgcttgttagcatataggtggcaaatattgggtattaattaagattaataattaatacttgcatttgggtacaagtaagagaaacactgttttttggggggttttttttgttttgttttgtttgtttgagacagagtctggctctgtcacccaggctggaatgcagtggtgccatcttggctcactgcaacctctgcctcctgagttcaagcgagtctcctgcctcagcttctcgaatagctgggactacaaggtatgaccacaatgcccggctaattttttgtctttttagtagagacggggttttgctatgttgcccaagctggtctcctaagctcaggcaatcagcctgccttcgcctcccaaagtgctaggattacaggcgtgagccactgcgcccggcccagaaacaaattctaacttaatcacaagtagggaactaattggaaggatagtggggatctcacagacttgatggaagagctggacaactgggcatcaggagggacaggacccagtctgtctacaggatttctacagccggcacccacggcccttctctctgggcactgccactggacagctccttctgcgcttgagaccctgctcatgattcaaattacagagagagataaacctgacttggctgagctcaggtcatgggcctgcccacttcctaggccattgggggtaggattctgaattgccagctccaccaaaactagagacttagatttcagcagttccccaaaggaagggggttatggcagaaacaatgctttaggttcaccaaattctgttgctattgttcttttcctcttcctgagcacaaaggaagacttatttcctaccctccttttaagttaggttacagccaatggcatttgggtagaaacgatgttctccgtcaagactgttgatgtaaaatgttggtaaacttggaggctacctgtataagaagtcaggatcatcagggggaaggagcctggagcctaatcaccactcaaaggagagatactgtagagaccttgcaacttacatcagactgtgagggaatcgagatataaaactttattttttaagactcttgagatttggggtgttgtctgttatagcagccagcataattactctaatacagggatattattttagaagaaaggggatgagggaagctgggaatacattctatctctctaggaagagcaacaataaccaaaaacatagagtcttatttgtgaaacgatacaaattttattaatatacaacgggaaatttgacagtttagggaatcaggtactcaatcttttgattctcttctgcacttatggtatatgagaagccagattataatcacatagttatttgataacacaaatatacaaagaacaaggagtgctgattttgtaatgcagtgttcagggacatgaagacttgactgtgtactcattgggccatgtttcttaaaatgaagttcaagagtccctcaaaccagaggtacataaagcccaggataaatatgacacatctgcctagggtaccaaagatttggggaataaaaagctaaataactgaattggtaatttaaaaaaaaaaatttacactaaaacacacagatatattattaattaggatgcaaaaaattgcatggattttttttttttaaagcatgaagcctccaagaggatttgagcttgaagtgggcagctttaggcttagggtaagcagaatagtggagtcaggagcacaggcttgtagttggacagaccagggttttgagaataagactcttgacacttattagctatgtgatcttcgaaaagtcatgtaacttgtccaagctctataacctcatcaatataatgaaaataaacaggcttgttgcagggactgaaggagccagaccacaaaactagctaggacagacacctgaaggatacagtaaagtatggtggttagtgtagctgtgatggtagctatgcctccagattcttctcagctattaggggtgctttggggagaaaagctgggaagtcactatcttggtgtatctcatctctacaatggagcaagcctgccagagtcactctcctgtcctttctcctgagcctggccacctttcttctgattggcacactgcacctgtagaaacagtctggggaagttacggctgaatgtggctggcccagggttcacttctgtatattcagatgactgtgtatagctccattctttcctgcttggaggccgtaggaagccagctcatgcctaggctcttgggcaacatcttgctgtagcccacgcaaactgattatatagtccatatatgtcatgtttgcttccagttatgaccaatgtgagggcttgacaatatttggtgtttccttgcattggctaggattgtttatggctactgcccaacaaatgttaattagtagatcggaagaaataaaactgaaatatatgcagtgttgtcatcaccttctattctttcgcttctagctcttgctctaggaggggaaggaggaaggaggacatatgtatccctaaatcccaaagtcaaaaaccaactctttctccaccacagtgacaaatgactccctgttctgcattctaccaccctcaattatggaggcagcatgaagtattggaaagggcaaggtctttggagtcaggcagacctcatggcccaacctcatcatttactagtgaggggactagaatttagcaggtaggtaaccccattcaacctctttgaacttcagttcccaatcagtctatctcccaaggttggtgagggaatgagacaaagattaagaagctcttggctgggatgaggtttattcaataaatgttagtgtcctttccaagtaaaaattgttttggtgccataggaaagcagacatctgaatcagggccacacaacgctttctaggatcttggaggatatagtcctattaaaaaggtgaacttcagtttcatctttatattcccttcaatcatggagatgtgggaatttaagtatggtctgcagactctatgaggcaaaagaggagggagcaaaaggaagtccgtaaggtgagtcagggtgacagcccagattaaagcagtaaacatctctctatgcatgtatgtatgtatgacataatgtatatatgtagctccctatgtcttttactccttttctttctcctttcttttccatcaagtcacctttttatttttgttccaccaattttattttattttattttattttattttattttgactaagttatttacccacctggttcaaaattcaaaaggtgtaaaaggggattcagtggaaagtctcctctcacctcgcccttcagctgccaaaggcaaccaatgttaacagtttcttgcatatcctcctggaatattctgtttaccctctttttatacaaatgagcacatactcaaccatgatatgaattttgctttttcacttaacaattttggacattattccacacccatatatggaaagcttccttgctcttcttaaatttatttttaattgcattacattttattttgggtatataccatgacttacttaaccagtactctattgagggacattcaggctagttccatttcttcttgctattacaaatcaggctggaataaacttgtacatatcattttgcacataagtaaatctgatagatggtgccaaattgcccttcctagaagttgtaccaatgcacacatgctgcaaagtaccaaagacttctgacttttctaaaatgcacatacaaaggaactaaagcacataaacaggaagtgtgttcatctgttgtatctcgtactgtcacccaggctggagtgcagtggcgcgatcgtagctcattgcagccttaaactcctggactcaagtgatctggccaccttggcctcccgaaatgctgggattacaggtgtgagccactgtgctggccttgaaagataatgtaattatatgttaatataaataacactttaataaaaaataactattttccaaaaaaattagtgagaagagtggcattgctttttatttttgcaaacctggcttgatagataatagctgtattctcctatctgcttctgcattcaagctgttgcaatttcatgtctaatagcctctggaaagctccactgtatacttatgaaagaatgattgtgaaacagactaataacattcttagtattattattaaaatagttttgacatcgcaaacactttgaaagggtcctgaggactctgaggtatccaaaccacactttgaaaacagttggtttagaccaactttattatattttattattcttatcccctatatatctaatttttgtgaattttatctgtcacaggctaaaaaaaccccatgaaaatgtcctaccttttgttgatttttgttcttttgaggtgttttgctttatgtaattgtgattgtgtataatgtggtacatacatatccaagacaattttatcgtttatattttttttttagtggcttaaaacagtaataactggtttctttttctcacaaatctgcaatttgagcagagctcaggaggtaggaggagggcttgtctctgctccacacagcatcagctggggcagctcacctgagagttggaggatccattcccagtgtgcacactcacctggctggcaggctcatgctggctatcagctggtagtgcagatggggccaagtgtcagggcctcagttcctctccacatgggcctcttcatgtgggcttctccatgtagcccaggcttcctcacagcaatgtggctgatttcccagggggaatatcagaagaaagaaaatgttagtccattctgaattatgctattgctttgaattcaattctaatattattgagctagtacctactataatcatagaaaaaatcaaatatagttgtattattagtttctctctttctggtatgttcttggcacatacagcttaatcttaaatcatggtcaagtatacttggaacagcggtaagaacagccaggttcttataacctcagatacaggccttctggttagtaatgcactcctctggcctggcctttccatgtacttctgctgcaccatggagctcccaaccctggcatggtactttcatgctgcaccattcacctgaacacatttcctcctgcccaagtctacttctgctcaactatggttttatactttcctgaccccaccctggcaactaatcatgaatctaggttacttcctttgcttcatcaggcttactggtattaatctcacatggtttctagaatcatgaaagtttagtggaagagacccaggctctttctctagtaatgacatttcctgagcccagtggaacgttttcctgtgtactgggcatctctgctacatttactgccctcccttgataccaagtatgtcttctccttaccctcttgctataaagcccacccctgaatttccaggagatgagaagtgccaaggttcatgggctgtgaattgttttcccaggtccagctccaaacttaatgttcaaagaggctaaaccgtggatccatcaatgtggatcagagtccctgataggttatcttgcagaattctaggtgaatatggtagctgtattagatctgatataaggcaccaaacggggcataaaacagcatgcttagggtagtgtccaggattcatatatccaaccttcacccatataaccaaattctaatgcccattattgaccatggatccatacacacctagatcagagaccagggtgatatcaagaacatctggctctcttcccactagaatgccctcaagagagtaaatatgcttaccgagtgcaatacgtaagaggctaaaagaaccatgctgagtacacagtgcatgggaaacacacataaatcaggcccattccccaggtcagagccaagcataatacccatataagatcagagctagggccagaactggaaaggtggtaacacctgcgcatgaaaggactggtgatccttggcagccctatatgggaagatcagctaggaagtgaaagctggccaacagcacaattctgtgctagcaggagggggccgaatggagtttgcattctgataggcatgttcctacggttcctggtgaggctgctcgggagtaaggactctggtatacgcctcattttgaagaggagagtgaatactcaattctacagtcttaaccacagttcaatacttaatgttttcatccttcttaatagtctataagcccttctatggcactcatttgcaagagggactgggcaagtgaggaaaacaggctcaggtgcattaggtgatttgtccagctgaaaagtgataaaaccacactagaccttcagatcccaatccagtgctttacccactcttccaagatggattatgtgggtaggagaagctagagtccagaagaaacaaaagcctaagctgagccattggaggctaacaggccttagagggtaaataagagaaggtaaggacaggggggaaatgcagaggaaggactctactggcaaacatgggagctagtggtaagactgatctgagtatcccatttgtgttgggatgtagaaatcaggtcggagaagtgggagtagggccagatgaaaatttgatgtgatatggtgtgtaataaggcatcactgtggtttcatgagaactagagtaacagtgaaaacagggctttaggaacattaagctggcactgagacaggaatcagagtggaagaaagagtcttgaagcaggtaaccagtaaactgttgtggtaattcaggtgtaaggtgctaagtcttgggctaagatggtggcagtggaaatggtgaggaaagaataaatccacaagacaataagaagacaataagaagaaagactcttcaggatttagtaacggattagctacaggaacaaaaagtacagagttcaaagctactttaagttctcaggatctagaagaatgaaggtctcactaacacagaagactaatgcctttattttggagagataaacagattacactgttcatctgaccctcttgatagtacaagtgggtcagacagtttaaactttgagattatatcccagctgaatggctagaggtcaatctcctacagaaaatatattttgaagcatagggttgaaagggaaataagttatatatttgctataatcataacaaccaacatatagctttctttcatattattttattagtacttataaaaacaatttatgaaaatattttccttttcaagatatagaaactacgctctgcaaaatatacatacccatagttgttacaatacatatccttgtatacaccttggacattgtgtttaagaatcacaccctgtaagggctagaagaaacattttctctaacctcagttatatagtgtgacattcaagtacttaaactacattgttcaaacaaaacatgtctctagtgtatgggcctaaagggatttaactttctaggtgccactgattctttcactgtgcaaggtaaagaactggaagagggttccctgagagttaattcaccttaggtagctcaagtagtggtttactgtccatactttatcatggaactaaggaagggaggaaggccatggaaattcaacttgggcaggtctcctctctatcatccctatctacgaagcatggcccctatgtgatgatttctgagacctctagagttctcaaatgctcctgattctgtaattatctaagatatttgcagaatgatgtttttgcaagtctaaattccaatactgtaaatcaggtggaacagagatgactcacctacatagacttcatttagggtttgtcaggtgtcaaggcaattgataaaatcagcaagccaaaaattcccccattggaactattggaaaagattctttctcactaaggcacgaaccccagaagccaagttcctctttgctttggaaaaattatgatgagagggtaggaaagagcctataacctttcaactctgcaggcttaagataatgacagatgcttcatctgacacagtaagagctggaagctattgcaacctcaccaataaagggctcattacaacaagtaaccatttatgtatactccctaagtcctgactaacctcccaagcttttctagatattaaattctctctaactgcaaagtattggtctgatgaagttccaggtgtaaaacgtgctgtttgaattcatggcgttagtgtcatggtgctgcatcatggtatggcactgacatttaacatcatgctgataaactagaattcatagtgattttatttcaatgcaggaaactatgaaagtcaatcaaacatggattcacaagtctttacatttaatgtataacataaagcattattacacataatttcataactataaaaataagtttaatacattaccatattttaaaaaattactttaaaaacatatactccaaagtcttctatttcatttagagaataatggaggtatctattagggtgaatcatatgaaacgatggtttttctaagttaaaatagtaaaatcttggcaattacatatggttcaacctaataagatcctgagaaaattttatttggcatcacactataaattcaaggggaatttatagaaaatcacatttctagtgaagagaaaacacttcaggatggaaacgtgcacactggtcatgccaagatttctctttgtgatttagagatctgaaatcttggaatgttaagaaaaatttagtgcagtttcaaaaaaaagtgaggacaattaaaattatagtatgctagctgcagttgctaatgccactgaaacaaaactactagccaaatttggcaatttaagtgttttagaggtgacataataaaaattccagcattaaaatgaaaaggcacaaatatgagttacaagtatgataatcatttataaaatccttgaaaataaggccaattcatttgtattattaacaccattaagcaggcacctattctaagcttcaacttcatcctcctaaatagaataaggttgcaaatgaattatcaacataatactaattatagcagcattatcaattgtctggaaggcatagtttataaagatcatggtagtagaaccaagtttcttaggctctacactgctaaaagaatatctaaaatagcctccccacccatatcccatcagtaccaaaaatacattttaaaaattacataaatattactagccataaaatgttttggtttttcttcaaacaatgagctctcctctcaccaacttgaccccaacaacaacaacaaaaaaaaccaaaaccaaaaccaaagctaccaaaaaattgttacaccaaacagactagctattcttaactaaagacatactatattcaaaaatggtactttaggcaatttattaaatacaaccaatgaagaaaatgcagattttccagatgtgtgcgtatgctgtatgtgaattaggtgatggtgtacttgaaaaaaatatgtatttcagcaatgatgcttcatttggaactttggtaccatttacgaatggccgctccaacattactggctactacgcagagagcaccacccactgtccaccacgttggcacattattaaagaaaataatctgaaagataaaagcaaagaccacatccattgtcttcattattgctactggccctgctttttctatttgaagtgcttttgtgataaatatctgaccccccaaaccaaagagcccaatgaatatgagaaatagcctgtccaacccacagtaaggcagactccactctcctaatacagagaggatgatgacactttcaacgaggccaagtactacataataccaaatgctcagaaagtagtccacagattttcccatttttcttaggataactagagtcgatgcagcaaatacggcacttccaattgctgcgaatgttcccttaaggtggcctgaatagctttcttccatccccgaagtgtcggaaccaaacaaaaatggtggtctcacgataaggatcactccagtgattgtgaacacggtgaaaagagcatcccaagggctatatttttccttgagacatatccaagcaaatatggacgtaaacactggactgctaaacgtgataactgtggcatcagcgagggacattgtctggtaagcatagtatataagcatcatggcggtagaaccaaggactcctctgagaatgaggaaaattcgttgaccttttgggcctataaacccagttctgtaaattcaaatgaagaaatgcatattaaatgaaattaatatttgtttttaaattacaatttgtaattaaacattattttaaaagtactaaatatcaaaaaatgagggaatagtaaattaattataatatccacaaatgaatattatatactttttaaaaatagtattttctaagtatagttaatgacagtaaagtgttcacagtaaaagcaaaaccagtgcaagtgaattacatgcatagtaaaattataattcaattaatatagatatttatcccacgtatatgtatatatatgcttgcaaaaaggacaaaaaggaaaataaactaaatgttaatcatgtttatatcttaatagataaactcataggtaattttctttctttatatttattttctccaaattttctataaacatatcacttttatgataaatacaatgtcaagattcagctgccctgtgtaaggaaacttagacccagctaatgctcattctcaatctcatgaatttttctataaaacttgaaactgctaaaatttattttagtcattgaatatgagacaagttttcattgttctcatgaggaaagagtcaaaacacactgaaaaagaacatgtagtgtttggaaaagtatgattactgctattcaaattctttttcaataaatatttactaagtacccactctgtgtaggttcctggctaggtgcaacttgctgacgtgtgccagggctagacttcattagattatcatctaggctaccccgggtatcttggagttaaaatgaaagcacggtcacatttggcccatactttgagaagcaaagagtcttccatgataataaaacataaaatgggtcaaaacagatgaggaccaaggattttaacaacattcttccagtgtccttcccctgacaatatctttatttcaaaatgggggagatgattatgttagcatcggtgttctgctgctacccttagaaatttctaaagccctaccatcatttcttaaaatagtgtgacttgtccgcattgacagaaatttgcaggtattagcaggttttcacttttcccaccaaatcatcaggatatggagtgaaactattctaagtgaatccgcaccatgttagagatacaaggagactttggtgacaagtgactaaagcttttcatttggggtgtagccttttttgcccaaagagacaaagagccaggcagccaccaaggacccaactggtctcgctctcagggttctaaatacactgaggtatatggaggttacaatggttgaaggaggcataattttaacccagggagggtagggagttcaacagggaaggaaaagaggaattgggttgggagagaacagagagggcggaatagagacaattttcatatactgttacactctacacaaggcactccaccctataataaatcttatttgacccttggaatcaccttgtagggcagaagtcacacagtatcattccctctagtttacaaaagaggaaactaaatacgaaagtaaccttgctcagggttaccccatcaccttttgaggaatacctaaatattattactataatcttctatttgccctggtaagaaagcagcccattctaaaaaaacttctgatactaggatacactattacttcttttcattcatttttttaacttccaaacagtagttatgccaaaggaaagaagggagggtgatacaagacaagaggaattatacaaagaaagctctgttttcaaaaggggaggtggtgaaaaacaaaatttctttctccccactttgttgggtatgtggtttatgctcatggtagaatcttctgtgggtagatgcttatgacttttcattaagcagagccaaggggcataggaactggtaagtatatgagatggataaagcagatagagtaattataggcaggtgaaaagatatacacacatttattaatatcttctactttgcagttaaaaaatacttactttctgtatattaagcaagggataacaactagcatttggaacacacatcgaaacgcactaatctctacagcatggacgtcttgcacttttttaacaaataaagagcccactgagaaaaggaaggcagacaataatgtgtaaaacaagccaagtccaggacagggtgctttcttcttggcttctgaaaaagattaaattctggttagtccttgcttccaagtgtatgtgttatcattttcacttagaaactgagaaaaatggaacagtgtcaaaggtcaacaggctttattacctcctaagcatatcatttctctgggcctgtaccattttccccatcaattatgaagaaccatagatgaggataacaatttaaacctgcatttttaaaatgccgtttcgccctatcaaatggatttcctatggctcactgaagaatcatcctcacttacaagtcaagaagtagaacgcttgccaagatggtgagagaaatctttaagaaacacttgtcaagatggcaagtaaaaaatccttccaagtgatatcttacgccacacctcactggcgaaattggctttatgaagaaagtgttcttttctggaaaatgggttataattgggttatacagttatctgttgattatttgacttcctcccacaagtctgtgagctcttccagggctgggatcttgctgtcttgtacatgcctggcacatggaagacactggataaatattcagtgaatgaaagatgagagaacttcagggaaagactcaagagtctaacactatcggcaacagcataatctgggaaggttctccattttgttattttgaactgttaatcaaatctatatttaacttttcatgctttcacgacttatcttcccattcagagcacaaactcctcaaggggagggtgtgggttatctagccctttggatcccaagtgctttgtacagaactgccatctaatccctactcttggctcgatctgaacgaggaaaccagtgctttctccagggcatcaagtattcagtcattaatgacaatctgtgtgagctttaaacttgtttagccacttactatgtcttagtttcctacacaggagtagaacctgctttcagtcttactcctctgtcattcagagagcaaaagcagcagggtgggcagagaatgccctaaaacaaaggtcacacactgcgggatatattcttttttgaaattaacacaaaaacagggttgagggtaagaaggaaacacaagtggccctcattgattaagagcacagtggaactgaagggtgagtggatatgagcaacttgtaggaaaactcgtattatcattccaatctaggactttataatgtgatagctataaaacagtattgtgtaatgttttttaaaatgcccttctctgataaatgtaaacaccaggtaacacatttacacatcctcaggttagtgagatgactttgcaaactgggaccaaagtatgctgatgcacaggctttctggggcattctacagcctggccttgtggtcaaaggcacccttctctacctcttcctgttctaggtgcacagctgaagatactgctttggaactagcagtagtccttcccttaagatgccagaatcctcattctgttctgtatccatgtgcttgtatactgcagaaataaactgcacacacgcagcccacgagaaggaagctttagaagacttccaagtgaagcaccacaaaatacatgccttggctgtggtcagccttagggtctggcctctgaaatttcagaattcagttccaaataaaacagtttttcttaaaagaaactcaacccctacatagaaactccaccctcaaacagaacagaccgagaagatcaaggacagaaaacatctccctgctctgtttcaagtatcttctccaacataaacttgctaatttttccccaggaatattttaacttaacattaaatattttaactctttaaaaatgtaattgcacccccttggccctagtgacctttccccttaaaacacatacacatgtattttcttgcctataaacacttaaggctcatgctttccaactgggaagggacagacattagaaggcctcgctgcatttgatgatttgttaacgagggtgaggactggctccactcagacaaacctcagtttcttactaaatcatttcaatcctgtcaatggagatgagcatgactagcataactgaaagaggcatttgtttaggttccatgttcatatctcactgcaagcatatctaataatttggtaactcaaattattcaaattaggtaagtggccatggtgtaatttcctcacttagaagaaaactgaaaaattactcagcttctctatcctctgctttcagctggtgattcgcaatcctggttgggaattagaatcacctgagtaacacttaaaactttaattcctgggtgcagtggctcatgcctgtaatcccagcaccttgggaggacaaggtgggaggatctcttgagctcaaaagtttgagaccaccctgggcaacacggggaaaccccctcatcaatgcaaaaaatatttttaaattagtcgggtgtggtggtgtgtgcctgtggtcccagctactcaggagacttagatgaaaggatcgagtaagcccaggaggttgaggtcgccgtgagctgtgatcacgccaatgcaccacagccttggtgacagagtaagaccctatctccaaaaaaaaaaaaaattaattctcaagccccatctcagacccaccgaaatagaatctctgtaactctaaaaggctccactagtttgagaaccactgctacactcgatcactaactccctccagaggatgtgaggcacaggcctaagaaactacttctccttgcttcagtgtaagacccacactgtccctgaagaaagtaaggagatgtcttgggacagctgtatgtgtctgttaaggtcatccaagaatgtaagacatatgggtaacagttccaaccagaacttgaaaaaagctttgttgagataagcagttagaacaagaggtgtcacaaagttcaatgacaacagtaaagtgtttttatgtcaattttctttccaaaatattatcttgtcaccttacaataactaagtcttactggtagaaactttctttgaagttaaacacccacaagattcttagatacactcacgtaagtttctcatcttgccatgagctgcctgggagtagagaattcctcttccattcacaaaaaggggaaactttaagagtttgcatggactgattcggcatgccaccagaaggacattcacccagagggtgataggtgagaaactgaccttttcaaaggctgcttatctgttcaattcagcctggcataacccctgttctagaggcaccagcccatttataaatgatcacaagtctgatcatttcggtttgcctttaggacagaaatggagcaagaatagtcttcctagagtctgtctctctaacttggggaaagtgcacaaagggaggaggggaaagcgcagtgagaggagaggaacagaaatccagggtcacacttaggggaggtgacccagaggacaaggtggtgcaggccgtgtaactgtcctaaaaagagatctgcctattcccttcttcttgcaggaagctgctcctggtagatggtcgacttctaagaggaatgtgcttgaagcagcacttgtggccagtggaaagggccctaggccggtatatggcaagctgggatcctaaccctggtgctccctggacatgcgccccatctcacccccacgttccacatcttggaggagacaaagcaaacgaaaacccaaaagccctcaccttcctgggcctcactttgctcatgtgtcgaaggagggggactgaacataaagtgttcttcacgaggggtccctgactttggggacggggctgtgagcttcttaacaagatatgccttgttctgcatcgtttgctaaaaagtccttgtatccctaaaggttaaaaactagcggtcccacttatctctgcctttccaagattctaaaactctaggacgaacattttttctagactcgatgcttttcagcttccttttcggagagaacccttaaccaccgggatcacttttcagggtcagcttcctcgcaacgtcgccccactgcaggatggcctctctcgctgaccccccacctacgacctaggggagggtacgccaaactgcagtctgactccacagccctgccccgacactaattacaggagcagcctcggaatcccaaaaggactgctaacaatcggaaagtttcttccgtcttagcgccggctggggcgccgggaattccgctttgcagccccccagctgacagctcgaggggtttcccgagccccgggcagggtggggacggaggcgcggcgggcactgtgcccgggttgcggggaccccaacccgccggcgcccgctcgggacccccgagcgagaccagagcccgatccacaccgcgcactcacccggctcggtgcgggagcaacacggcgaggaaaggcagagccagcacctaccgcggtctggcgccccagctgcctcggcggccgccggctcctcagtggcgcccgggggtgcatcgtccgttagcggcagcccgggctcctggagctccgcgaccccggtgctgtcctgaggccgcatctcgcggcacgcgctctaccagcggccggtgccgtctggcgccagcagcagcgcctgggctgccgctcttccggcgggcgatggcgcccatgcgcatgcgcgcccggcccacccgcaccctcccccaaggagaccgcgcgcgtcctccgctggcctcttaacctggggagacccgctgcctccctggtcgggctgtggtgcccacagctggctctaaggcgtccaaccctctgctgcgttcaggctacatggcccagctgcttggagccatccttggcaagtcacactgaacctgtctgtcatggcacagacaaggaggggcgctgggttcccaagccctggcgcccgggggtcctgtggcctccttttcaggaggctcaaagagtgggcgttttttcattgatgtaaccacgcattcagcacctctgtgataccccgaagattttacaaagcaccatgcttgtctttaaatggtctagggtttttatgttttgttttgttttgttttgttttgttttgtttcccgtgttgtccctttgctgcttaccaaggagggtagaattttgctgttttgggaaatatttttaagaaagaattagtgtgtaattataggaaaatatatctataagactgaccagaacccatttatatgttctttgcattctttgcaagagtaggcatgcattattgatctttggttttcttttcttaaatggaaatatcctaatttggccagatgtaagattcaagtaatctgatgtaattagacctggtaaaatatattctttggcccaggattcactaacagcctctttttgtttagctaataattcttcttccatctctttgcttgctttatatgtggaagaacagtctctgtgcaaggatgaacgtatctaaacttctaagtccagtgccaagcagatcaccaaaggagagtgaagtttgcctttactcagacatttgcacatagtgatccacagctgaaacagttttagacttgaagtcaggaatcctaggttctggccctgagtgtgtgacctcagtcaccactgtacccctcgaagccttgattacctcctttatttaatagcgatcaagtatttcccttcctgcttcgcagagtagttatgtaaataaaatgcaatgatgtgggcaaaagcataatatcacctggaaaacactatgttagaaaatcaaagtgtgttttaaactagggtcagcatataatttatcctccaaactggacctttttttttttaagagtaaaaggaggagctcttttaaaagttacacaagggaataggcataaactgggactgtcctaggcaaactgagacaaatggtcacctgaattctaacttgattaacacatacttttgccttgtcttaaaagagaatttaaggctgggcacggtggctcagcctaccatcctagcacttcgggaggctgaggtgggaggattgcttgagcttaggagtttgagaccagcctgggcaacatagaccttgtctctataaaaaaaataataatacttttaaaagaatttaaggctacttacaaaaatatctgtaacaggttttgttgtcgttgttttagatagggaaatttcagggaaggatggtaagggtggtagatcatgattataaagcaagaaccaggaagcttcctcaaatatctgggaagtcaagtgcagtttcacaattgcattctaagatttcgatatggaaagggtttgaagagtcccctcctcttaaatggtgaagattatggctaggaagtgtggtaaagaagaaagaagtgtgatgatttgagaaggaagtaccctgactgctccactttcaacactttcaacaccatcctcgaaaagggagaagaagaagagaagaaaatgggtactacaccagttattaaaggtggtgagatgatttcatacctgctgtttattccctttaacttccttcccctccactgctgaccttcatatataaatggtatcagttatattcattctcccatttagctgacagccatgctgacataaaaggcaaccaatgagaaaagtgcggaccaagctggcctgtaatcccagcactttgggaggccgaggagggcagatcacttgaggtcaggagttcgagaccagcctggccaacatggtgagaccccgtctctactaaaaatacaaaaattagccaggtgtaatggcgggtgcctataatcccagctgctcaggaggctgaggcaggagaatcacttgaacccaggaggcggaggttgcggtgagccgagatcacgctgctgcactatatcctgggcaacatgagcgagactgtctcaaaaaaaaaaaaaaaaaaaaaaaaaaagtgcggaccagactagaagtcagaagacatggctgtcctgaagctccacccagtagaggtgtggggctgttaaggtctctcctgaacattgttatttcaggtctttggtgatgatagtgatattgagctggtgacagatagatctccataatgtgcaggatgggccagaaatcccgactgtagaggagactagttcagagcctattgaagtgacccagatgagattctgaccccaggtagagaaggcaaggaggaaagatggattttgaggtggctaggagatggaatgtgcagaactcgttgactagatgtgaaagagcattgtttctgtatgcaaaattgtgctgtgttccagcacacactcttctgcttctgaagtgattcaatcttccagtgagaacaggagctctcactgtgatgccaggtagccacagcaaggatggcactcccatagttctggtgtcaagaaggaagatgaaaatggagaagaggtgggttttaacctgtccctgctaaccactgaaagtccaagatcctcaccatccatgtggcagcaggtggagacttccaggaggagtcagattcctggtttccactggtctttgcatgtcagggatgttcctaagtgagacgtttgtatgtcagaaactgtctttcataacaaactggtaccttggtactgatttgaaggactgcttttttttttccaaaaaattcatggattcttaccttttaaactaatgcaacttatgacttgggaaatggcagtttgttccaaacagccctaatgttttgttttgggaaaaatcagtactgtggaacataagatcatatttctaaataatctttgtaaatgaaagaagggaccagcaaaagagaggtcatttaggataaatgtaggatagaacactggagaggcaaaataaactgttcaaataagtaggagctgactctgataatataacagaaaaaaatgccaggaatggctcctcaaaaaattagacatagttactatatgatcctccaattctacttctggatatatattcccagatgaagtgaaagcaggaaattgaacagatatttgtacattcattttcatattagtattattcacaactgccaaaagctggaaacaactcaaatgtctgtcaatgaatgaacagataagcaaagtgtggtataaagcatacagtggaatgttattcagtcttaagaaatgaaattctgacatgctacaacatggatgaaccttgaagacattatgctaagtaaataaactgaacataaaaggacaaatattgtatgattctatttattagcagggcctagcatagtcaaattcatgagacagaaagtagaatgatggttccccgggtctgggatgtggagggaatgggagttagtgtttaatgggtatggcatttcagtttaggatggtgaaagagttcggtggatggatggtggtgatggttgttcagccatgtgaatgcacttaatgccactgagttgtatatttaaagtggttaaaatggtaaattttatgtgtattttattaaaatttttaaggggttaaaaatgccagggaaaacatttctgagagtttgaactttaatctctgtagacagtttaaagcccttaccagatttttgaagtttctttgaagtcctgtgtttcatctttaaaaaggcatgacaattttccattctgatccctaatatgtttatctttatcttcataccatttttcatgtaatgcattcagctagtgttgtttgagtgcccactttggaccacgtacagttcttggcagtggtggagttgggaacaaaagagacaaggccgaggacgtgatcgggatggggagggagatgatggagaaatgaagaaatgatgctagcattacctagcatcctgcaaaatccatgagccaggggtgtggcactcgtttagttcccagctttctgttctctcctgttggacagattgggctggaagtcaggatgctccctttcaagggagctctgacgatggggccaggacattctccagttcttccttgctttcctactctctgatctgttcccatgctgcaaaaggcaccttctgtataaacgatttctgacaccccagggaacttgtatttttctatgagaactttctgtttatagattatctgagagtgaggatgcctgagctttagagttggccctgggtgttgctacagaattcacgttaaccccagatttgtcataacttgggatctggattgcactcaactctcattttgataattaccatttatgaaagaatcaaaatgtgccaggcactattgagctcatcagcttatttgatactcaggagagctttatccagcagttttgcttaatagttaaaagcagggctctggaatcagaatgcccagggtccattcctggatgtaccacttaaccagccttgtgacttccgacacatgacagcccattgctctgagcctctgttttcacacctataaaatagaataataatagtatctagctgttgcgaggataaaatgagataatacttgtagagtacccgacagtaagtactcttttttaaacagtatgcattttatcatcctcattttatagatgagaaaattgaggctcagagatgttaaaccagttgcccaaagtcaaactgatagtgaagggcccaggtaggattgaaacccaggatcatcagacgcctaggtgggtggtcctgatgactctgctctattatttgcccagagagctgaattgccaggattgctggtttctgagaggacctcattagagcatagtttctttcactcaacgttctcctttgaacgctgagaccattgcgatggcaatactcatgatgactttccacacaactgtgtgatgtgcactaggcttatggtgtctctctagcatcttaactttcctagagtaaaatgctgtgaaataaataagaaaaacaatttttataatgctattaacagaatccaacctctgtcctaatctgctatgacagcagtcgtactccagtgtctacagctctgatctcttcctaactcaattctgctgtccaaagtatgggtctcagctgggtcccacagggaatggaggctgttcataggcaatttgcaacgtgaatacctacatataactcagacctaatgttagtcccttcctgaatcgtctgcatgcctcaggcactctgttattctccgtcttctccttctttctccctgctccatttctgtgtacccattactggatgttcttccaactcctgattctgtcgaacaaaaagggcaaacattaatttctactaagatgagacctcagggagaaagaaggcttaagccaagtgtcagtaagcagagaattccaataccaaactacaaagtattatttatcctacagacaaacatatgtacacacacacacagtgcttggctaccacaatccaataagagaagccagttctagtccgctaaagcagcagcaatttcaccttcagtggtagtaaggatagaaagcactcaagaggttccatttagatacaaagccatgtatatttgctttgtatatttgtatattagctgggactacaggcacatgccaccatatctggctaatttttcaattttttgtagagacaaggtctcactatattgcccaagcccgtctcaaactcctggcctcaagcaacccttccacctcagcctcctaaaggggctgggcatgagccactgtgactggccactgtgactggccccaagcccaagttcttaaccattactgccctaaaacaacgaatgcttttaggtaattctagtttgccaaggtcaatatttcctgcagcctccatagtgtgtgtgtattcatatttgtaaaacatttagataaaatgtatgataattgtaacaatagcttacttaaaggatagagaggaggaaataggttataagtttctttaaatatatgcattgttagtattttgtttaggacagtcaattacctcttaaggagattaaaaaatgaggagaaaaatcttttacgtatacataaatgtttaccacttctgaaactcttcattcctttgtctaggactatgtctctatgtgatacatgtgatatcattttctttcagcctgaggaaattttaaaatatttcttgtagagtagatctgctggcaacaaattctctgtttttgtttgtctaaaaaatgtatttctattttgtgttttgaggaatatatgtgttggatatacagttataggttgacagtttttttctttcaagaccttgaaaatcttgttctattttcttctggctgacttgtctctgatgataaatcagtgttaatattatctttgtcccactgttttttctggcaactttttttttaaaggtgatcaaccttatgtcatttatattttattttatatttttaactttttttatttttaatttttatgggtacatagtaggtgtatatattgatggagtacatgaggtattttgttacaggcacataatgtgtaataaccccatcagggtaaatccatcactttaagaattcatcatttctttgtgttactaacatttcaattataccccctcagttattccaaaatgtgtaacaaattattgctgactgtagtcaccctttagtgttatcaaatacgaaatcatattcattgtatctaagtaatttttgtacctactcaccatccctttttcctacccctgcccacactacacttcccagcctctggtaaccatcctcctactctctgtctccatgagttcaattgttttaaatttagctcccacaaatgagtgagaacatgtgaagtttgtctttctgtgcctggcttacttcacttaacataatgtcctccagttccagccacgtcattgcaaatgacagaatcttattcttttttatgactgaaaagtattccactgtgtatatgtaccacattttctttatccattcatttgttgatgggcacttaggttgattccaaatcctggctattgtgaatagtgctgcaataaacatgggcgtatagatatctctttgatatattaattttcttccttttgggtgtatacttagcagtggggttgatggatcatatggtagttctattttagtttgttgaggaacctcatactgtttttatagtggctgtactaatttacattcccaccaatattgtatgaggatttctctttctccacatcttcacccacattcattattgcctgtctttttgataaaaaaatattttaactggggtgagatgatatttcatagtaggtttaatttgcacttctgtggtgatcagtgattttgagcgcattttcatatacctgtttgccatttggtgtcttctttcgagaaatgtctattcagaccttaagctcattttaaaatcagactattaaatttgttttgtttcctattaagttgtttgagctccttatatatttgggttattaatcctttgccagatgggtagtttacaaatatttccacccattctgtgggtcatctcttcactttgatgattgttgcctttgttgtgcagaagttttttaatgtgatcctctttgtccttcgttgctttggcagcctgtgcttttggggtactgctcaagaaatttctgcccagaccaatgtcctggagagtttctccaaagttttattttagtagtttcatagttttgggtatgaaatttaagtctttaatccattttgattttatttttctatatggtgagagataggggtctagtttcattctgctgtgtatttattgcaacatttattgaagagactgtcttttccccattgaatgtttttggcaactttgtaaaaaatgagttcagtgtagatgtatggacttgtttctgggttctctattctgttccattgatctatgtgtctgttttaatgcaagtaccatcccgttttggttactatagctctgtagtataacttgaagtcaggtaacatgattcctttagttttgttctttttgttcaggatggctttggctattctgggttttttgtggttccatatacattttaggattgttttttctatatctgtaaagaatgtcattggtattttgatagggattatattgaatctgtagactgcttagggtagtatggacattttaataatattgattcgttcaatccatgaacatggaatatctttctgtttttattgtgccctgtttaatttcttgcatcaattttttatagttttgattgtagagatctttcacttctttggttaagtttgttcctaagtattttatttgtagctgttgtaaatggaattactttctcaatttcttattcagactgttgctgttggcatatagaaatgctactgatttttggccgggcatggtggctagcacctgtaatcccagcactttgggaggctgaggcgggtgggtcacaaggtcaggagatcaagaccatcctggctaacacagtgaaaccccgtctctactaaaaaaaaaaaatactaaaaaattagccaggcgtggtggcaggcgcctgtagtcccagctacttggaaggctgaggcaggagaatggtgtgaacccgggagttggagcttgcagtgagccgagatcatgccactgcactccagcctgggggacagagcgagactccgtctcaaaaaaaaaaaaaaaaaaagaaatgctactgatttttgtatgttgattttgtatcctataacttcactgaatttgtttatcagctctaatagttttttggtggtgtctttagtttctttaaatataggattatatcatttgcaaacaaagataatttgacttcttccttttcaattttcatgccctttatttctttctcttgtctgattgctctagctaggactttcagtcctatgttaaataacagtggcgacagttaacatccatttgtttccaggaatttttcacttttcttcttaatttcttcattggcccactggtcattcaggagcatattgtttaatttccgtgtgtttgtatagtttccacgttcttcttgttattgatttctagtgttagtccattgtggtcggagaatatattttatatgatttcggtttttttttttttaatgttttaagactttaggctggatgtggtagctcacgcctgtaatgctagcacttttggaggccaaggcaggtgggccacttgagtccagagtttgagaccagcctgggaaacatggtaaaactgtgtctctacaacaaattacaaaaaattagctgggcatagtggcttgtgcttgtagtcccagctacccaggaggctgaggtggaaagatcagctgagcctgggaggtcaaggctacagtgagccattacagtgagccatggtcacaccactgcactccagcctgggcaacagagtaagaccctgtctcaataaataaattaattaaataaataaatattggctttacatatctgggtgctccagcgttgagtgtatttatatttataatcgttatatcctgttgttgaatcgatcctttttccattatataatgaccatctttgtttgtatttatagtttttgtcttgaaatgtattttatctgatataggtatagctactcctgctcttgttttgattttcatttgcatggaatatctttttccatcccttcattttcagtccatgtgtgtctttgtaggtaaagtgtgttttttgtaggcaacagatcactgggtcttgttttgttttgtgtttttaatccatgtagccagtctatgtctttggtttggagagtttagtccatttacgttcaatgttattaatgataagtaaagacttactcctaccattttgttatttgttttctggttgttttgtggtcttctcttccttctttccttcctgtcttccttttttttggaagtgatttttttctggtggtatgttttgattttttcttttttttgtgtgtgtaactgttgtaggtatttgatttgaggttaccatgaggcttgcaaataacgtcttgtaacccattattttaagcgaatgacaactctgattgcaaaattgaacaaagaagctaacaaacaagcaaggagaaaactaatacaaattcaatactttaacttcatctcctctcaagtttttgttgtttctgtttatatcttattatactctctgtcttaaaaatttgttgcagttattattcttgataggtgcatctttttagtcttcctacttaagatagaagtagtttgcacaccacaattacactgttacagtattctttatttgtttgtgtacttgttgttacttaccggtaagttttgtaccttcagatgatttcttattgctcattaatgtccctttctttcagattgaattcccgttagcatttcttataggacaggtctggtgtttaaaaaaaaaatcactcaatttttgttagtctgataaagtctttatttctccttcatgtttgaaagatattttcactggatataatattccaggataaaagggtttttttcagcactttaaatatatcatactactcttctggcctgtaaggtttccactgaaaaatctgctgccagacatactggagctgccttatatgttacttatttcttttgtcttggtgcttttaggatcttttctttatccttgacctttgggagtttgattattaaatgacttgaggtagtcttatttgggttaaatttgcttggtgttgtataaccttcttgtacttgaatattgacatctttctctaggtttggaaagttcttcgttattatctctttgaataaactaccctattctctctctctaccacctctttaaggccaataatttagattttcccttttgaggctgttttctagaccatgtaagcatgcttcattttttttattcttttttcttttgacttcactgactctgtattttcaaatagcctgtcttcaagctcactaattctttcttctgcttgatcagttttgctgttgagagattctgatgcattcttcagtttatcaattgcattgactagctccagaatttctgcctgataattatttctgctttttaattatttcaatctcttcgttaaatttatctgataggattctggatttcttctttgttttatcttggatttcattgagcttcctcaaaacagctattttgaattctctgtcagaaaggttacctatctctgtcactctgaaatttgtcactgctgccttatttagtttgtttggtgagatcatgttttcctggatggtactaatgcttgtgaatgtttctcaatggctaggcattaaataatcatttatttttttctaatccttacaatctaggcttatttatacacttccttcctgagaaagctttccaagtattcaaagggagttgagtgttgtaatctaagtctttggtcactgtgtggcaactttttatcattagttgtcatcaatatgtgttgatataatttatagttttctctgtttttattctgcctgaggatcattgagattcttgcatcttcggattggtacttttcatcaaatgtagaaaattaggagcagcaatgcctccctagtctcacagatgctactaccgctcccaccccttcactcctcagttgtgcaatgggcacctgcaacaatgagaatgactacctctttaatgttatccttattggagattctggtgttggaaagaataatctcctgtcttgatttactcaaaatgagtttaatctggaaagcaagagcaccactggagtagtttgcaacaagaagcatccatattgataggaaaacaataaaggcacagatgtgggacagagcagggcaagagtaatacgaagctataacataagcttattatcatgaagatataggtgccttattggtttaagacattgctaaacatctcacatatgaaaatacagaatgattgctgaaagaactgagcgatcacactgatagtaatgttgttgtcatgttatcatggacaaataagagtgatttacatcatctcagggaagttcctagagttgaaggcaagagctttggcagaaaaaaatgatttgtcattcattgagacatctgctctagactctacaaatgtagaagctacttttcagacaattctaacagagatacctcacattgtttctcagaagcaaatgtcagacagagccgaaaaagacatgtccccaagcaataatgtggttcctgttcatgttccaccaatcactgaaaacaaaccaaaggtgcagtgctgtcagaacatctaaggcgtttctcttctgccctggaaggcaatgtataacccatttctcaagtccaatatttaaatactgaggagaacaaaaaccacccagtaacaggccctggagacaaatactccttatgtgaggaatttagaagggagcaaagaccacctgttgaccacaaaacaggcaaaactccttatctgaagaatttagaagtaattaaacttccctagtatccaaagttggcatctggttccaggcctcttttcaacttaaagtttgtaaagatgtatagacgttctatacgtctccagaatgccatgtcaaaactcattgtgcaatccttgctgacattaaggcaccaaaagtactacaaatgtaatcatttattatgacctatgtggctagtatggtcccaattaccctcaagctcctgccttaaagttcataactactcctaaggaaaaatccaccacggtgcactccgccctctcattgaggtgccctgatgcactctctggcaacgttctttctttctaatagtactttcctttttcaaacctatactgttgtcagtaaattcttaccagcctgtgagtcaaccacttctagatgctggggctctgataccttgcctggcaaatatttttgtaattcttgtgtcattttttttcttattacttcatacttatgaatttttccatatcttcagtgttttgattttagttttataaaattatccacttatcccaaatgattgcaacctttttcatgctatggcttcactagacttagtttaataggtggaatgtttggattcctcaattattgtttacttttcattctggaagcccatcactgtaggacataatagaacttgatcactagaagctcagacctattggtcttgatcaaatcaaactaagaccttagaaataagctatcattttgccacagagcagcttataggttatatactcttctctcagtgcagtgtatatttccacaaatgtaaggtgaccctataaacatagcaggattttgagagctgaaaaatgttccattattctggaagtcaatttctaaaatgccttaataggtttatgtagtttagtaaattttgttttttaatttttgtaagcatcagagttgattagagagggagacatgttttttttctggagaagaattatctaaacaaacacaaaagatttgttacggttttgttagtagtatgtttatggggccatatgttaaataatgtttcccatcaggctgggaactggtgagactggtagaatcccatctgaggtgcctctgttgcaatgatcaggcagcccaaaccatttaagcaatctcattttccagccgtagataacgtggcgttttattactcaggcaataactggtttaatactggtagtatcaaattttgaagtgttaattttgtcttaaaaccttccagtaagtgaaatgaaaccagttttatgaccatatctaccagcaggcatggataattattttgacaatgctgatatttgagttttgcagtatattatggaatacagttcagttaaatctttggtttcagtgtgtctaaagaatacaatgaggaatttctgctcaaatggtaccacttaaaggcatgcattcttttagtatatgaaatgaaatagcaccttgagtttaaatagaatgcacttaggcattgcagagactggatataattttcttccactacattattaaaatcaatgagacaattagtttctcattcagaaatgtgcatactaatatttagttttgctttcttgtggataatattaagcacttactcagcagttttctggaagttgtgtcagctgtaatgatactgctattcaggatagtgggatatccccaaaaatatatatatgtgggcttgcttagattactgtgtttcataattcatcttttgtcttttgctttgctcatgatgtgtggtgaacatggaaggcattgctgtagtcagtcacctgggttttcttctgtagccattttattattttagtgtatggattatgaagatactattatctgttggtgaattgctagtttgtatttttgcatgctctgtaacttgattttttagttattaatttggaacacattcacattctaataaacagttatggggggattttaaaaaaagaaaattagtagtcatttcctgaagcattttctttgctgcctccttccatcctcctaatctcccttctaattttacaatcatacaaaagtcagactgctaattttgtttcacagatcactgagacactattcattttttaaatcctcttttctctccatgcttcagtttagatagtttctatttcctgtgttcatttcaggtattatattctttaactctagaacttccatttggatctctttttttgatttgtttccatttctctctttattgtgtccatgttttcctttagatcattgaatatatttataacaacaattttaaagtcctcacctgctagttctagcttctcctccatttttgggtctctagattcactaatttttctccttgttaaaggtcatattttcctacttcttttcacaactagtgaagtttttttaaaattggttgctagatagaatttagattttattctcttcctttaatgagtgttgagctttatcctggcctgtagttaatttatttgtggatcagtttgaccctattaaagcttgaatttaacctcttctaggataggtctacagtggcttttaccttaaagctaaatatttttatttataagacctggaattggggccaggcatggtggctcacgcctgtaatcccagcactttgggaggccaaggtgggtggatcaccttaggtcaggagtttgagaccagcctgactaacgtggtgaaaccccagctctacaaaaaatacaaaaattagctggacatagtggcgggtacctgtaatcccagctactcaggaggctgaggcaggagaatcacttgaacccgggaggcagaggttgcagtgagccgagatcccaccattgcactccagcctgggcaacagagcaagactccgttaaaaaaaaaaaaaacaaacctggaatttctctttgtgatgattttgtgataagtcatccaaaacattgtgagctccttagttcatagctccctggaagttgttcttttctcagtaggttatttatttatttattgcctagactagggaattttgcttaccctatactgagtacagcttagtatgtagagacaaagactcaagaggatcttcatacatatttctggagccttttcgctataaagcactccagaaatatgtatgaagataccctcgagtctttgtttacttattcctctccctctcctttctttctctctctttttttttttttttttttttgaggcggggtctcactctgttgcccaggctggagtgcagtggcatgatctcggctcacagcaatctgcctcccatcctgggttcaagtgattctctgacctcagcctcccaagtacccgggactacaggtgcacaccaccatgccctgctaattttttgtattttggggggagagatggggtttcaccatgttggccaagctgagttgttcttgaactcctggcctcaagtgatccactcaccttggcctcccgaagtactaggattacaggcatgagccactgcgcctggcctcactctccttttttatcggtagattagtgtcgtttcaactacttgcttaatgctatactcctactttacacatagagcttattcttttatgttaaaactttctcttgtaggattatgtttcattatttttgtaaagtaaatttttacactagtatagcaatcatacagaaaagtgcacaaatcctgtgtatggctcaataagtgttcataaagtgaacatgcccatgtaaacagcacccagatcaagaaatagaacttacgaccagttccccaaaagtccctcttttgacccttcccattagtgcaccccctccaaaggtaactactaaccagacttctaaaactaggtattaaatttgcttatttttaagctttatatgatgggaattgtacaatatgcattcttttttgtgcagcttctttcactgattgtgagattcatccatattactgtgtgtagctttagttgattcattcttttatctatatgatattagagtgtatgaatatatcatgcatctttatcgatgttgaccattataagggacattgccaagttaaaactatagtgtctcttggccatttaacaaatttccattgcaaaactttggaaagactgttggacctgagttccaaaaactgttgtatcacactctgtatatattgaactctaaaactcaaatttatgttaattcacaaatatttatcaactgtatactatgtgccaagtacaatgctagacactagggctgggggcccttgaggatttaatagtctagtgagaaggtgtagacatgtaagtagataatcataatatactgtagaaaaatgttagagaaaaccataactatggcttcattaaaagtactttaaatgatgtaattttaaaaatattcagtttcacaaaaggcatcagcctgtattagttgactaatcttctggaattcccagagatgattttaaagatcatttagacagatttagaaagattacagagtcactcttttcaaacagtctcagtgttcagtcagttgggaagatcccattatgcatcaaagaaatgccaatgttatttcccacaggctttccctcctctgtgttccccttaaataccctcagcccctttcatttcttaattatgtcttctctcaacaagctcatctgttctcttggctctaacacttgtatctgtccatgacccccgtatctttaactctactccagtcttctctctgagcccatatgtaatttccctggcatttaaccatctatcaggtagcttcactggcacatcagttcaacaagaccataacagaactgactgctgtctacacagtcctccccttcctctattttctatcccagtggggccactactagtcactcaagctgggggccattttaaactctgtatcttccttcaccctccacatccagtcagtcataaggcttgttaattctaccttaaaactatctcttcaatctttccactcttttaatttcacagccactattctgatttaggcttctgccatctctggattgttgccactgcctcctcatggatctttctgactttaatctagtttttcatactgatctagcttccaaaccatgatttagaatgcaaatctgatcctattgttttcttgcttagatatcttcaatgactctccattacccatagtagtaattaccgtaaggtgtgccctaatttgctgcagtggattaagatgtgccaaggttggccgtggctggacaggtgtgttgcagcccagtgtgcccgatgtgttttcattttccatgtatagtatgaatggaatggttagaaaggactggctacaagatttggtccaaactccagactcctgccaacttctctagtccatctctagcactagtccatcttcatcgcctcacactctattgtctgatgactggcatttcctgtgacgtgccaggctgtttcatgtctgtatcattgcacagagggcaagctctttcatcaatctggggagaacttctccctttctctacttggcaaacttctacacacctttttaaaatttagttcaaccttttccctcttgagtacactcctctgagtttctaggccattccagcctttgtactttcattgtaactcataatctacctctattatggcaccatcatgcttaagcgcatcttttggttaacatatgtatctctcttgctagtttcaacttcttgaagcttttcatctttgttttcccagtgccttgtgcaaaggaggatcgaaaaaaggttaggtgaaccaagtgcaatataataacttacatcagtcaagatgggctagtttatgctgctgtgacaagtaacttaacacaataaaactttaattctgagtcatgctataatcagtcaggctgatggatgctccatatcaactcatgcttctgtggtcaccctggagaattatgagtgcttgtgtgtgtgtgtgtgtgtttacatgcacgtgtgtgcacatatattcattttttaagtctgtggtataatatatataaaatttagcaatttaaccaaggtgtacaattcagtgtcattaagtatattcacagtgttatgcaaccattaccactatctagttccagagatatttcatcacctcaaatggaaatcttcgactcattaaacagccacttctttttagtacataatataatgtagccaaataccacccaaactaataattaagcttctcctttctttttttttttcaagcactgggatgtctagggataagctttcatactagaattaatctctcaataccttcacaagtaactgctatagtacattttgttaaatgaattaactaagcaatcatattctgttgaagctacaaaatcaattttaaaaataaggaaatagaaatgtgcgtggaaggattttccttaaaaggagcacttgatgtaaacaagcatctcttgtcacccagcaactgctcctctggagttgtctttaatggggtaatttcagctggcagctggtgcaaccttgaaatgatcctgtttatttttcctcctccccgatgtgtagaggtcactgctgataataatgtgattgctattcattattatctggatatgataacatggcagaactacctcaaaatgctctttttggaaatcttgacattgactgtgcagatacagttgggtcacactagacatacattttgaagtcaaagatatttacattttagaaataaaaatgacccatatggtgacattttgggctgtatgatttaccaaaaacagaagaaaaatgacctacatgggtggtggatggagaacaagcattgttatgctttttccattttgtagctgtttaattgaataaataaacattcattattcaaactgcctgggtttgaatcttggctctgcctctgccagttgtgtgttctttgacatactcatctctctgtgctgaacttgaatcatctacaaaaatagggctagtaatagtatttaccacactaccatgtgaggataaaatgagcttatgtatgtaaaatgcttagaacaatgtctggcagaccgtaagttctatgtaactgatgactttgaatgtttcaggattgtgttccctcttgacaaatcgcttcctttcctacccctctgacctcccctgactgagttagccaccctctgccatgtgcctctctgacatcctttcttcccccaaggctaaacaacacttaaacagaattgtgtctttaattaactgtgtcgtccaagagctagaagctctgagtggacagagacttggtcagtcttcatcattaaatcctcatgtgttcgatgacttactcacctgtgtgtgccctaagcaaggcagagtaaggctgcagaagtggccaacctaatttaatggggaacacagagagggcagcagtttgctgagatttactaagactttgcaggaactcttgagaagaaaactgctgagtcacaggcatgcattttgaacagagaataatcttaacttgagatcttgcaacattgcttgggcacgtagctgttactggctgccccacctgaaaacaaaggcgtacaaatactaattatcttagctttaaactctttcattggaagtaatgggactcacttgaacaataatataatatatagtttcaagtagctacaaggaagatattgaatgttcccacattcacacaaagaaatgatagatgtttgagatgtggatatgctaattaccatgacctgatcgctctacatcatatgtataaaaaatcacaatgtaccaccaaaatttttacaaatattatatgccattaaagaacattttttaaaaggttaaaaaagaagaaaacagtgggtttgtagacaaaaatgttaagattttatgtagtaatctatgattctggtttccaaacacaatggacttgggaatatgaatatattcatattgtaaggaaagggggtgggtggacagggatgtaagtaaggacatacagggtgtgtcccagaagccaagggcaggaatacagggtctgcctgtgaggaaatgtctggagctgagccaccctctcagtctcttatttctttctggggccagatggttccttgatgctagggctccctgaccatctgtttcttttttcactctcttcaggctgcctctctttacttatctattgagtggaagaaaaacccccagctcctggagttatgtgcacctcacttccagctgcacgctgagaataactagccattgcttagccactaaacttggcttctagggagactctgattggttaaaatagagccagatgtctctttccatcttattcataattgccaaggttgtctattacaaacatgattgccaggtgagcaattcactccgaacaggctcactgaagaacaggcagagactccagtatctaaacaatgtaatttaaaatggtccccaatgttatgcaaggttgagtcaggcaaataacagcatagagtacagagtttgtcttagccaaccagaaaccactgggtttcaatagattgtaggaattgtccctgtgatggcattaaaaacatacaaaccaaccaaccctcttggatggggtgttattcagatgtactatgtaattctctgaaaacaggaattcctccctttgtctggaattctcttcctctccttatacattagactgatccctaattattatacatctttcagatcttagtttgatgcacaaactcaggcatgcaaaatacaaaaatgtagttttctacaaatgaacttaatttctctgatgagccccctttctgatttcagtggtagccatttaatcttagtcaatcagggattcccactttcccagggattcccagtttcctagtgttgcaccagagtttagtatctagcactggtaatggtggtggaggtgggtagtaggggggcagctggaattcctgattggtgtttactggcatctcctagcaagtcctcattcccacctggtctttagttgttaatacacataatcccagctgagtcattctgttatcaaactggacttgggtctgcctgcctggtatagcaaagccaagcactgacataaggattgcaaaaaaagaaagtgaagcatttattgcagggtgccaagcaaggagaattgggaagacccaaactcccttatggcttacaggtaaagggttttaaaggcagggaggccgaggttacaggagtcattaatcaatatatggtggttatacattggtttgacctaaagaggtggggtatcttgaagcatggggcttacaggtcataggtagagtcgaaggttctctgatatgtagctagttaaggaaggtgagctttgtttaaacatttggaatcagcagacaagaatgttagctctggcttatggatgtgacttcctccaggccccttaggaagaacttcagaacaaagaacggccatctacatgccagtgggttcatttgtcaggtttctgaagaacaactcacggacatatgttaagatgttattttttggccgggcacggtggctcacacctgtaaccccagcactttgggaggccaaggcgagcagatcacgaggtcaggagatggagaccatcctggctaacacggtgaaaccctgtctctctactaaaaatacaataaaaaattagccgggcgtggtaaagggcgcgtgtagtcccagctactagggtggctgagggaggagaatggcgtgaacccgggaggtggagcttgcagtgagctgagatcacaccactgcactccagcctggatgacagagcaagactccgtctcaaaaaaaaaaaaaaaaaaaaaagatgttatttttttatttctatagggaacaaaacatctcatgactctaacttccttggctatttatttattactttcttgcttagcaagttgcttatgtacttcttaaggctagctagatgcctggaatttctcttgaaggaactcagactttttttatttccaggctcaggctggggtgcagctgcaggcctctaagaggagtccctgttccatctcaatccctcctcctgaacactgcactctgttgggtctgaggctctcttgactcacccgggcaccttcttaggagcctgggattcttggtgctccacatcataccagacccacaggaactctatgaggtgtttgctgtcctgcaccatgtctggactgtatttgttctgggagattatctattgtccctatacttagctgggtatagggaacccccagtgaagatgtctcaggcccaggccaccatagctatttatagtctgcagtctagccgatagtcccttccctgagctcagaatcccaaatagagtttctactgtttgcctttcttgggctcttctggagagaggcagcttaaatcccacctgcatttagaaccccaaacctatctaggatttctgttcttcccctctcctatgattaggcatcccaggagagaagcagggtgaagtttactcttagaaccaagcagagccaatctactcactagctcaggccagaaaaactttatctagtctgggggtaacaggtagaggagggaggtgggatgggataaggaagtatgaaagagatggacaaggaataaacaaagaaataaatgcaagaatgaaaaaataagctttgcatagctttctatggctttgtctatccatgccaaaagtctggaagtttcatttaatgaatcttttacccacttgagaaatcagtggtcactgggagtcagcaagaattcactagctgaattaattttattccttttttgatgaattatgaagctggaagatcacggcaatgctggagacaattaagacaattactggatttcaatggagcaagtagggaagcagtggtcactgggagtcagtcagaatccttagcattattagttcttttcgatgcattctttcatttaatcccaaaacaacccaatgactggaagaaaattaaatgtatcctgaatgtcaactacagcttttgtacagctaaagaaactgaatcgcaggcagatattataatttctctaagactacatgggtggtgtttccgttaaaaccctctcagcagcaaatgacactggaatcctactcaaactgagtattttaactatctattgctatataccactccataacttagcattttggaatataccactccataacttagcattttgtttatttgcaatttgggcagggttcagtggggaaagcttgtcaactatggctggaagtctcacttccaggggggctcactcatgtggctggtggggttgtgctgggagtctcagttcttgctgtcagctggggtccttggtccttcacaaggcctttctacatagttagcttgttctcatagcatgatagtctcagggtagttgcacttctgcagtggttggtttccaagtgtgccatagctgaaatctgaaggctgatgcccagaacttgcacgccgtcatctttatcacaatttattgtttaaagagaggcaaggggtcagcccagattcaaggacagaaggctacacaaggtatgaataccaggaggcctggttcattggaggtcactaaagtggtaatctaaccacattggactaaggattttactgattcacattaccagcaggtccaagaagtatagctggtgcgggcatgtcaatgacaaggcactcaagtgagatcagcaagaatatgctactctttgccttccactcctgcttcctgtggagacatcattctcagacaggcttcttgctaatggtggcaaggtggctatcatatttctgatgttcaaggagccatgtgggattatgtgtccacctatgcacccatgctatgacttggaggatagaatatgctaactaggtagtctgggccatatcttcatctatggtatgttctattaattatctacctacccaacagtgtttcctggctctcttctcctttgattgaaagcctgaaaccaaattttcagtttctcagtttctctcccagctccatgtgactgagtctggccaatgaggtgaaaggagatgtgatttttctggactttcagggaagatttttcttccctagttaaaaaaaaaaaaaactagtctccttatacatatacctcttctcccaccagcaacttcctgctttgatactaatgtgtgagaatgaaaagactgtagtatgacaatgaggagaagaccatgagaatctcagatatgcagacctagagtctggtatcattcaaccactggtcaaatgcagaaatctcctacacccaaacaataagtatcttgacagtttaaggcacttatgattgagttttcccttgcatcataagtaaacaccattcctggggctgggaaggtggatccaaacttgcttaaccgtatggactgtgagtgtaggaggggtggttccccaaaggaaaataggacagttactagaggaaggggggaatgagtagatgctgtgcaggtggaaagtgtccctttcacctggaaagtcctggggagaggaattggtgtcaggttagtctgctctcagagcctcatgaaatcagcattgttatactcagtttgcacattaagaaatggaagctgaaggaaattaagagaattgttcattgtcactcaactcattcgctgcagatctgagaatactacccaattccttgcatttttatgtcattgctgcttccatgaagcagcacaaagcaatagggataactaattaccttgaaagagaattaaactcccaaaggattttgataagctggaacaataggctaaatcttggcggaacatgagagaaaaagattgagaagtattacttgattataaaatcaacatgaatcattggggtaacatggcagccaaaatagtcaatgtgagcttgaattgcattaattaaggatgacatttaattgttatactctgtttactatattaattacctatagccacataacaaattatgctcaaaacttagcagcttgaaccaaatatttatcatctcacagtttctgtgggtcaggaatttgagagtggcttcttgtgggtggcaggggcttggggaggattttggttcaagatctctcatgaggctgcaacaaaactttcagccagggattctgtcatttgagggcttgactggggctggaggatccacttccaagctcactcatgtgactgtctgcagggagtttcagtttctcactgtctgttggctggaggctcagttcctcaccaaatatgtcctctccgtagggctttttgagcttcctcatgacaaggaagctggcttcccccagagccaagagagagcaagcaggaaacagcagtgccttttatgacccagtctctgaagttacattctgtcacttaatgctttttttgtatttgttagaagcaagtcagaagtctagtccctacttgagggaaggactccatcttttgaaggcagggtcaaagaatttgtggacatagttaaactacccagtgttcctactgacaagaccacacatgaagcattttatttgattctggcaattaaatttgagagaaacatataaccctgtagttttcctttgtaacacctattacttctttgtgggtgtagtattcatataattatctacctcatctacagggctatatgctccattaagcagaaatgtaacctatttttctcaccatctccttcccaatatctagtttactaattggtatgaagaaagttcacaagaaataattgttgaatgttgaaagatttcactggataggtccaaagggatgtaaaccccttgccacatgagaaatagttggagtagattgagatttagcctgaaaagaaaagactcactcaggaacatgagagctctcttcaaacatttgatgagctgtcacctgcaaaatggaagggattgattatggacacatccaaggtgggagctgccattgactggtggaagctacaaggtggcagagtttacctgactatgaggaacaactgtgtagcaactaggactattttacaatggaatagaatgcttaaggaggaagtaagtagtttaaatgcctgctggaagatccttgttgggaatactgcaaaaaaacaaacaacaacaaaaaaaaacacatgattaatacattagataggatgtgggttagttgacttttatggaactctgaaattatgtgtttctgtaatctcaggtttatgctatttacctaaatttaaaatgtcaaaacagataaacaaaacactatcagtctatcccctgtggtggtcattggatggtttatttatccagcatgtgttcccattcctttttgaaaatgtatccctttgttttgagggactgctctacctgccaaccctgtaattttagtaggagctgctaatcagagtaccctgcccattctacaccaactacagtagatgtgggacactgactgatcattcagaatactccttgggacttttcttatctatgtatttatttaaaatatatattttcaaaaatgagagatgggtctcactatgttgcccaggctggtcttgaactcgtgggctcaagtgatcctcccgcctcagcctccccaagtgctgggagtacaggcatgagccactgcacctggccagggacttttccaagtggaactaagcaagcaagttctgtcacctctggtgtcagagtggggaggatgtgagcctgggagatgttggcagtggtagttccagctttatgaatgaagcaaggactgggagccttattttgtttccaggcaggactccagggctgcgtagccagatttttcaagtgaaactggaaatcaaattttttaaatctgccaatgaatcacatttatttttattttatgagacacagtctttgttgctcaggctggagtgcagtgatgtgatcatagctctctgtagctttgacctctcgggctcaggtgatcctcccacctcagcctcccaagtagttgggaccacacacatgaaccaccatgcctggctaatttatttttatttgttgtagtgatgggacctcaccctgttgtccaggctggtctcaaactcctgggctcaagcaatcctcccacctcggcctcccaaagtgctgggtttgtaggcaggagccaccatgcccggccctgaatcacatttaaaaatacattgtgcaggctaaacaagacaactctgagctgagtctgtcctgcaggcttcccatttgtgacttttgccatagagaacactgcctaccttctccacttctacatggaccattcctgctttctgggccattgccttagtgaaaaggctagatttcatcaatattattatgtacaaacctggttttaactgccagtaattcatgtctggacatactggctacatttgcttcagcaaggtgggttttctattaacacatttagtattcctcagtccaagtttcctttttataggatcaaagaattaatgagtctgaagggagtttacggggtagaggggggaatgccttctctttcagtcgccctctcttctttggcatgacacatggtcatttaggctcatcaccaggactgctacaggcaggcagatcactgcctgccagcaatgggtccacacatgaatgagcgggtccccctagatacacaggacactgtgtaacccttgcagctcaacacagaggaatcctgaacttgttcttctgaacagcgcaaaataaggctattttcagtcaaaatcatagagacagaaagtagaataggtagttgccaggcactggggcaggggagcaggaaatgggaacttagtgcttaatgggtacagaggtccaggtgaggaagataaaaaagttctggagatgaaaggtagtgatgatcgcacaacaatgtgaacgtactttacgcgaaagaactgtaattttagaatggttaaagtggtaaattttatgttatgtatattttaccacaaaaaacaaatggcttttatgaatgagcagaacagtctcctagccatgtgatgctattttggggttcagtaacaattactttatctaagacacgctctattaaaatgctaatactcctaggataaaacaaaataaaataaaatgaatctactttctctttcacatgccatgatggtctgcaagtgattgacaggcaatcagatattagatctgggaaagtgtaataggttatggtggcaccatattccaggtgcaagccaggaaagcaggaaaaggagaggtatggactaaaaaggaagaaaagaggaaaaaggatatgaaatagttaagaatgggagatgctaggggaattttgcccagatagaggaagaaagagaggcttataagagtttcactggggcagttttctgaggagcaaatgatgcaagataaagggacaagactggagttctagttagaaagacctgaccaagaaccaggttgcagataaagcaggacagtcttggggagatacaagctgcaactatgtaaatcagactttatagactaaactagtgaaggaagacatgtaaccataatccactatcctgtatgtcttatggatccaagatttcatcattctaaagcaaagttgctgtgcatatgctgataaagcatgccattatgagaacctgtgataccagaaaaatgtatgaggctagattgtgggttgaaatctcaatgaaataatacctcctaaaaagaatacacataaaagcatatttatagggcaccatgtaattgtaaggtgttagtatcagttagagttctggcagataacagatgatgtattaatctatcacgtctgggttaagagaatctgcaaggcatggtgacacctccaggcatcatcaatagtagagaggcattactatcccaggcctgaagggataagggggaggatgacattaatggatatcagtaggagaaggactgcttgatatgccttcagtagaggagcagaacttctgctaaaccagagcctcccatcctccataaccactgactgaaccaaatggtaaaccagaggacatgtaggcctgtgtactgatgttcttagagaacaggcttccggaacccacatcaggataaagaatgggaagaagggatatggaggggcaaatggagactatccagcacagaattaatatggtatggccgggcatggtggctcatgcctgtaatcccagctctttaggatgccaaggtgggaggatcacttgagcccaggagttcaggacaagcctgagcaacatagcgagaccccatctctacagataattttaaaaattagccaggtgtggtggcacacgcctgtggtcccagctacttggaaggctgaggcagggggatcacctgagaccagaaggtcgaggctgcagtaagctgtgattgtgccaccacattccagcctaggtgacagagtgagaccctgtctcaaagaaaaatgacgtggtgtttaggaggtatgttagtccattttgcattgctataaagaagtacctagggctgggtaatttacaaggaaaataagtttatttagctcatggttctgcaggctatacatgaagcatggtgccagcatctgcttctggtaagtcctcaggaaccttacaattatgttccaggaaggggagccaatgtgtcacatggcaagagaaggagcaagagagacagggggagattccaggctcttgtaaataaccagatctcatgtaaactcattatcatggagagggcaccaagccattcatgaaggatccaatttcatgacccaaacaccttccaccaggccccacctccaacactggggatcacaatttgataagagatttggaggggacaaacattcaaactacaccattcctcccgtggactcccaaatctcatgtcctccgcacattgcaaaataaaatcattccttcccaacagtaccccaaagttttaactcattccagcattaacttaaaagtccaaatctcaagtccaaagtctcatctgagactcaaggcaagttccttccacctatgagcctataaaatcaaaccaagttattttcttccagatacaataatggtacaggcgttgggtagacattcccattccaaaatgaagaaatcacccaaagaaagggacaataggccccacacaagtctgaaactcagcagggcagatattaaacctcagagctccaaaataatctccctttaccccatgtcctgcatcctgagtacaatggtacaaggggtgggtttccaaggccttggatagccccatccctgtggcctctctgggtgcatcctgtgtggttgctctcatggattggagtctggtgcctgtggcttttccacactatggttgtaagccactagtggttctacaatttggggatctgaatgatggcaggtccttccccacagttccactaggcagtgccctggtgggaactctgtgtgggggctccaactgcacatttctcccatgacattgccctagtagaggctgtctgcagagacttctctctggacacccagactttctgatatatcctgtgaaatctaggtggaagtcacgaggcctccctcatgcttgtattctgtgcacctgcaggattaacaccatgtggaagctgccaaggtttagagcttatgctctccaaagtggcagcctattcattgttttgttgttgttgtttatttttttattttattttatttttttggtagagacagtgtttcaccatattgcccaggctggtcttgaactcctggactcaagtgatccacctgctttggatcacttgcaaagtactgagattacaggtgtgagccactgtgcccagcctcaaagcagcagcctgatttgtaactgaatgacagctggagctgaagcagcagggttggggaaagcagccttccgagttggtgcagggtaattgtgcccagggcctggcccctgaaaccattctttcctcctaggcctctcagcctgtgataggaggggctgtcccaaagacttctgaaatgtattcaaggccttttccccactgtcttggctattagctcttggctcctgtttagccatgctaatctctccagcaagtggttgctccacagtcctctcgtatttctctcctgaaaatgctttttccttctttaccacatggccaagttgtgtcttttctaaatttttgtgctctgctcctttttaaattgtaaatttccagtacctgatcataggttgttagaagcagccagatcacctcttgaacgtcttgctgcttagaaattttttctgccagccgggcacagtggctcacgcctgtaatcccagcactttgggaggccgaggtgggaggtcaggagatcaagaccatcctggctaatacagtgaaaccccgtctctactaaaaatacaaacaaattagctgggcatggtggtgggcacctgtagtcccagctactaggaaggctgaggcaggagaatggcgtgaacctgggaggcggagcttgcagtgagctgagatggcgccactgcactccagcctgggcgacagagcaagactctgtctcaagaataaatgaataataataataataaagaaatttcttctgccatattccctgggatatcagccttcagttcaaacttctacagatctctacagcctggacataatgtagccaagttttttgctaaggcataacatgggtgacctttattcctgttctcaataactccctcatttccatctgagcctggccttcactgtccatatttctatcaccattttggtcacaaccatttaaccagtctctgagaagtcccaaactttccctcatctcactgtcttcttctgagccctctaaactcttccaacttctgccctttacccagtcccgaagcctgcttccacattttcaaatatctttatagcaacaccctacttctcagtaccaattttctgtgttagtccattttgcattgctagaaagaagtacctgaggctggataattgataaagaaaagaagtttatttggctcgcggttctgcaggctgtacatgaagcatggtgctggcatctgcttccaatgagttctcaggaagcttacaatcatggcagaagggaaggagagccagcatgttacatgggaagagagggagcaagagagagagagggggtaggtgccaggctcttttaaacaaccagatctcttgtgaacttgttaccatggggagggcaccaagccattcatgagggatccgcccccatgtcccaaacacctccctctaggccccacctccatcaggcatcacatttcaacatgagatttggaagaaggcataaatatccaaactatcaggaggccagaagccaggctacctgggcttgaatgctgcaccatctctttgtagctatctgacctaagcaaatgatttatcttctctttagtgtggcaggtgccaatctctggctgacccagtggtcattcccattcccttcccccttactgccttctactttagagtctggaaaggttaaatacccactttcccatgcccctttgtagtcacgagtggccaagtgacacatttcttgccaatagaacataagtagaagttaatgggacagtttctgggaatgcttttacttttttaatagaagggcagatgaacagatatgatccctggaattgggataatcctcttatgaccatgagggaaagaccttgaaaatatctgagacactggccctggcatcactgagccatgagccagtgccagcagccacctacctctggactgctcgttaggcttgttataggagacgggggaagggggaagagagagagagagacagagagaatataatgtaagccaccattagttaggttttctgttatttaaagctgaaaacatttccaactcatataccaagactgttttctaattttacaaaataacagtgtttacttcagttttattgtaaagattaaataaggtaacaataccaacatttgtatggcacttatgatataccaggcactgttttgagtaatttatgtatgtgaacactttaaaatctcacaagacctctgtgtggtagacattatcattatctccattttagagataaggagattatcatttgaccaaagtcatagaacttgtattaacatatggcagagccagtgtttgcactcaggtagcctgactccaaggtctgaccacttataatataaagacttagtgcagaagtacaaagtaggtactcaaaaaatgtcagcaataatattgatgatgaccaggtgtcacaggaatgcccagaaaatgatgcaggggcacatttatttgagttgacttggagggtagttcttccgcaaagttcagtctgaaaatagagctctacacctagaaaaaaatcttagaagcagatgagaaactccaggagaggaaggactttaggttggcaaggctggaattctggagccaactatctgatggcattccagaacttaccccatgattcttttcctgagtcctttttatcatccttgagtcttcatttcccagtggctatgctcccaccatcctggggccaggatgccctcatgcccttgcccttccaaacccaagattttacctttcaagaaccaggaacatttcatttctttttgggggccaaaacatatcgaacatttaatataaaatctgcccagtaggtgtcagcatctatcacaaaatgagccattgtttaacccatcctttatgtttaaactttaagattcaaatcatatggaataaagctgtttcctactgtattaatgcttagaaggttgtaactccacttccagccttccattttgctggacatatggtcagaaattacgtttcaaacattttaaaatgtagaggaaactttgaggatagaagcttgcttgatgaaaagattaagaaaataatttggggggagaggcaaaaaagaaaataatttttctataaaatgattgattctgttatcgattgacatcattattctgtgtattcaatgataaagaagacacactggaagcctggagtaggacctccccctagagtaggataggctcctgcatgctataggatactgaagtttagaatgatgcatttttgactactggtgtctttttttggtaaatgttgtcttaattctgctgttttctccccaacctatagatattctttacaacatacaagtgtacctgcattttaagaaaatggaacatggaaaaatctggatgtacttaatagctcagtgtcattgaaccaatatccattaagtacctattttctgttctttaatgacatcttggacagatctcaaagcttcttagtcacagtcaggtattaaaaatctagcctagtccggtgagaaacttgaatttcacatccaattcaatgctctctccttcttccttaacttgggtatgaccaagggatctgcatggaaggggacatggtctactatctaattccttcccactctgccgcttccgcgtcctctaggattaaggaaggaggagaggccaaagagggaaaacaaaaacctctctagggaaggagatcctgcaggatctcttaattgcacaaatgctgcacatctcattggccataacttgcacacctacgtgcaaggggggatgggaaatgtagtctttgttctgaatgaaggattctgtatccaaggcgagatgatttcttccagcataacgttttctgaccaccaaccaccctaagccccttccatgctggggtcctctaacccagaaggcaaatgcctccagggtacctatgagaaggctcaagctctgctaatctttatgggttctgcttgcaccacaggaaatgtaaatatagtagccttcctcatccataggggatatggtccaacacccccagcagatgcctgaacccaaggatagtattgaacttgattgccatcagttagaatacatttttattcatgttttctgcccatatatctaacgctttttccatcttaactaagcacttgtcacacactgtggccacagcttttgctgtttgaagtgcaacagcaaaactagcatgaatttctttttttccttcttctcttccttcctatcttcatggataggtttgttgtataatccaaagaccatgaggatggctaaatagtagaaaggagagcttttttgggaatattggtttgcaaaccacaaagagatactctccagtgtggaccagaggtgctctccctttgaagagggaagaacaggttgggttttatacctcgcagggcctgtatcacacaatagagtcatacgtatttggcgggtttgagggaaaagccatacacgtttatgaggggagctgagcatgtgcaatgagtaaacatataagtaacatacctcccatgttcactttggttggggggagggtttagcattaacacaaggtgaaatttggctctttacatcaaaaggtgaatgatagaacacaaagtttgtgcacagcctctataaactgactgaaactggcttaaagtctgtaatttcttatcagaaaagaatgtttggtgcccctccatccaattagagttgtaattaggcctgggttataaatcagagttaggaaggatctgatagctcctattgttaggacatttagaggtggaggaaattagaaatttgccatgctagccaggccctgaatcggtaggcaactcaacccataggtaactttatttccttaactttaaggtctgtcttagctaacaaaggggcatctattttggtctctcagataacaagtcttacttcagatctcagcaacctcagcatatcatttttttcttttcgtattaagttgagaactttcaccttttcacttacaggaagcactttatggcttttccttagcatatgtgaatagccagcattatgatctttgctctcgtattctggggccattattaagtgagataaagggttacttgaacataagcacggcaataccaggacacttgatctgctactaagtgcctaataggtggatagtgtatctagcatagatatgctagacgaagggatgagtcatatctcaggtgcagagccagaaggcaagagttttcatcataccactcagatggcgcacaactttaaatgtattggaattgtttatttctggaattttccatttgatatttttggattgcaattgactgcaggtaactgaaaccatagaaagtgaaactgtgaatagatggactactgtatccgtgcttgagaagcttcagcatcctttttctaggacaattttgctaccctgggaacatttctacttttcattaggctttggggaatgctgacataatggtggtacacctgttgagttaacttttttgtttgtttgttttttgagagggagtctcactctgtcgcccaggctggagtgcaatggtaggatctcggctcactgcaacctccacctcctgggttcaagtgattctcgtgcctcagcctccctagtagctgggataataggcatgtgccaccatatcccgctaatttttttgtatttttagtatagacgggttttcaccatgttggccaggcttttctcgaactcctgacctcaagtgatccacccgcctcagcctcccaaaatgctgggattacagtgttgggttaacttttagtcagtcccatggctgtgaggcaggagaatggggaattagggtaaccaagggtaaaggcataaacaaaagagcagcaggtgcggacagttctaggcaagattcggcagcataccggccacatccttgccctgtgataacaagacagaagtttccacttcagcctctgattggtcactggccaagccttcctagggtgtaaccaattggaggcctctaaagggcacctagggttgttaccaaattctttcagcttaataaaaaccctaattggggtggaggggcactcttgagttgcttgctctaatctgctcctactctggagtgtcagtaaatctgtgcttttgttattgttctcttgttgctttgtctttcgttgcttcattcctttgttgctttgtttatgcattttgttcaattctttgttcaacatatcaagaacctggacgactcagtcaagaccttccatccggtaacagctgtacttagtacctaagaactcagcattatgactataatgacaattccaaaacaacggcaaaagtcccattcagtatcttgtgacccaaggtcctatatataaatgtcaaatatggaaataaatatgtcttcttctgtatcatataacctcaggaataatggctgacaattgtttatgtctgcaccttagcaggactcaggttccgctccatcccccagcctgagaaaagcaaaggctatttattcagagctgctatagcaagagaaacagccaccatcattgagttttagcagaaactcaaaggtgggcagagaagtgtgaaagctttatagtggggaaaaaaggaaagctttaggtatggcctcagggaggctattggcctgggaaagctgtaggaggctacctagaagcggggaatcctgtgtgtttgattgggaatgcatatttggctttccctagttggtcctaagttggaagtggagaaaaaaacttacagaatctgttagttattaatcaagtcctggccatttggggccgattgtgacacaagttattatttagcttcctggcttgtcactagagataacaagtgagttcctgaaagtctgatttataacaggctaccttcctgtgctggttattgtcaaaaggggttggttttctggataggttgtgagtcaaaatactatctttatatatagtttggcaattgtccatttgtacatccagtatttcaatagtaagcagtaaacttgactctgctttatcaaatacgatagtacctcacattttatcatggtttacaatttataaagtacatttttgtgtatctccatgattagtaaggccaaacactgtcattttccttgtaaagtgaagaaatagcctcagaaaggtcaatggctttaaaaagtcacaaagctgctaaagagcctgatttaattaggactgtccaattctttatgcctggcaccccattcagtaaacactcccttttactcttgttaaaactttagacaaattaaatttaacagtttggccaggtacagtggctcacacctgtaatcccagcactttgggaggccaagacaggtggatcacttcagcccaggcgttcgagaccagcctgggcaacatgacaaaacccaatctctacaaaaaatactaaaaattagctgggtgtggtggcgtgcacctgtagtcccagctactcgggaggctgaggtgaaagaatcacctgagcctggggattcgaggctgcagtgggccatgatcatgccactggactacagcctgggtgacagagggggactctttctcaaaaaaaaaaaaaaaaaaaaaaaaaaaggaacagagtttaattaaggaaagaatgatttgtgaatcgggcagttccccaaaccagaataggtccagagaggctcctgtgctgccacatggacagaaaggatttatagataaaaaaaggaaagtgagatatagaaaatggaagtgaggtacagaaacagctggattggtaacagctttgtaatcatccaagggatttttcctgcccactgcataaagaaagaccacggcattgtagtagagaaagagtttaataggcaggaggccagccacgacacatgggagatagagttcctactcaaatcatcttgtttagagctcctaagttaggggtttttcaaaggcagtttgggggaaggggtaacaggtaacagatgcttgctgctgattggctggggcggagatgaaatcattcattggaggtggaagctatcctgtggtgggctgaatcgcttctgggtggggccacaggagctgggttggtggtccaggtggagccatgagtgtcaaacacacaaaaacctatgaagatatctgaaaaggccagtctacaatagtgttgttatttgcaggagtaattggggaagttgcgtatggtataacctcaggaataatggctgacgattgcttatgtctgcaccttagcaggactcaagttccgctccttcccccagcctaagggcttcccattagctttacaaaatcggttaagttttgggcaaggcctattattaaactatagccttaatatctttaaagttagcttggcccaatagcccaggaataataagaaaaaggcaagatggggattgggttagtttagcttactagttttgtttgtttgtttttgtttttctcactgatataacttttgcaaaggtagtttcagcttggcatttgccttatttgaacaaggtctgaacagtgggctgcctttgattggttgaaacttggtgagttcaccgaaaatcactgacatgaggcagattgactgataggagaaaaggtatacaagtgtatttaatacatatacatgggagtcttcaggatgaaaacacaaagatacaggagaaactgtccacttttatgcttagcttcaacaaggtatggatggataaccatgtaaaaatattattggacaaaaagggtatgatttactgctaataggataaccaaccaacgggttcaccttgcccactgcctagacagagccgatttaccaagacaggggaattgcaatagagaaagagtaatttacgcagagtcagctgtgcaggagaccagagttttattagtactcaaatcaatctccctgaaaactcggggatcagagtttttaaggctaatttggtgggcaggaggccagtgagtcaggagtgctgattggttggctcagggttgaaatcacagggagtctaatctgttctcttgtgctaagtcagttcctgggtgagggccacagaactggttggcaggcccaggtggggccatctggtttcagaaatgcaaaaacttgaaaagacatctcaacaggccaatcttagtttcacaatagtgatgttatcttcaagagtatttggggaagttgcaaatcttatgacctctggaataatggctggtaatatttagaatcccagcccctctcatcattactttatggctggtggcatatcattcattttacaagaacagtttagcttttggaaagaggtattatttaaaccataaactaaattccttcccaaggccaatttggcctatgcccaggaatggacaaagacagttgagatattagaagcaagatggagctggttaggtcggatatctttcaccgtcataatttctttagttataattttgcaaaggcggtttcaatagacttagtgggaaaaaccaataaggcctgcctgtctagattcttcttggcttctctgagcacacacccctttcttctgaatgtggggcaggactcttctctggaatggggatcagataatttctttatggccagtttttttgtttgtttgttttttattttgagacggagtctcactttgtcacccaggctgcagtgcactggggcatcttggctcactgcaacctcctcctcccaggttcaagcgactctcctgcctcagcctcctgagtagctgggactacaggcgcatgccaccatgccaggctaatttctgtatttttagtagagatggggtttcaccatattggccaggctggtctcaaagtcctgacctcaagtgatccgcccaccctggcatcccagaattctgggattacaggtatgagccatcacaccaggcctatggacagttttaaatagagtatttttaggttttatgactggccttcaagggaaaagggtttctggtttctatgacccaccttggggaagaagaagtttagttgctatggctagccttgtgggagaatgggactgacagaaaggagggcaggcaggagaaagtcatagaaaaattttggggctgggtgctggtggctcatgtcagtaatcccagcattttgggaggcagaggcaggagggttgcttgaggccagaagtttgagaccagcctgggcaacatggcaaaacctcatctctacaaaaaaattaaaaattagctaggtgtggtggcatgcatctatagtaccagctacttaggaggctgagctgggaagttcgcttaagaccaggaggttgagagggcagtaagccatgatcacatcactgcactccagcatgggtgacagagcaagatcctgtctcaaaaacaaaagaaaacaaaaacttttgtttctgaggctgttgctgaggatttcatttttgtgcattgttttctgagccccaatagtaggttacagtctatttacacatccagttaggttacagttcactatgtactgagaaaactttaggctgaacttaaaatatgtaagggagcagctttaggctaaacataacactctcattagcacctgggttttgaaacagaaagtttccgtggaccctctgtgggtgggaactggagtgcatgagagctagaattagctggctgcttcggtgctggcaggggtgaactccactcacttggtcccactgtgttccaaccctcacaggagggggagcacaggtgagcaggtgcaggagccagaacaagtgctttcgggtgctggaaggagcaaaactctgtgctgccccatggcatcatcttggggggtgcctggaacctctcaaccaccagaaagagtgttacaagagtgctaaaacaatgcttttttagctttgccacccacagacggcttaagtgtttacagctaagtggagtgtcagcatgacagctttttcacccacacctgagttcttgtctggcgtctaggaggaatgaagtcctgtgaacaaattggagatggtaaatgtgggggcttttattgccaatgaaagtggctctcagcaggaaggggagctgaaaaggggatgaagcaggaagataatcttcccccagagtcgagccatcctgaccagactcttctctgaagttacatcatcaagctgttcctctgaagtcaagctgcttctctctgacgtccaattgtagtgtccgacgtcctgctgcttctcttctcctccctcttctggcagaggctggggtattcatgggcacaggattggggggtggggtgggccatggatggttttggaaaaggcaacatttgagcgggaaaacaggaatgcatgttcttgctttgggttgcagttccaggcctgaggttgggcccctcactggggactgccctcttctgcccagaatttccctgcctcctgtctctatcattttgaacaataaattaactgatcaccctatcctacccagcagaaacttgaacctatgacttctgcattccaagaccactgctctgtttgccagattttattaatcccaggctccctgtcactgtctctcctagtatctccaggcctttgccaagtcacaccactgagtagactcaaatccagcgatctgtttaaacaacagttttctttcaaatctgcccggtttccaactggctaatgaagctcaatcacaaaaagtttctattaagaggtaattagcaagatgaaaataagccttgaagtttaattgttcaatgtgccttaacgaatcctcaggagcagcttgaatgtttgtaataaacgcaggacaaagatgatgttcattttgtgtcaatgtttaataccttacccaaggcaatttttattaaactgcaacctctgaacttttaatgctctccgaattttttaaaacatcaaaaattgtgtaaatgaatgagttacaaacctattcagcattattttccttcaagagtgtgtctgagcagagtgtcagtttattttctgcagttaattaattctgcctttcttaagcagaatgtctgattgccttaagcgatagagaggctttttgctagaacagaaagctgtctgcgtagtttatgttaatacaaacctgcaggcggtaaatgactgctctttggaaagaaagcaaatggctactttgaaactattgagatgcattagggctcttgatttgagaaacaggaaatactagagcaaaaaaacaaattgatttaagccattcatagactaacaagcactcctagtccctttgtgaattttgggttcttgggcccagccctcaggcaagtacttgcttccttccacccaccccagtgcggattctcctttctgctttgatccctgaattaataaaccactctgggaaggagggtcctttaagtcagcatggaaccaccacccccaacctcggccatcaaaaatccataaatcattcaaagcaggaattcttcatagcaggaaatgagcctcttgaaattcactttaatttcccataatctttggaattacaggagataatctggttcattctcccaatttctggttaggaaaatgttaaaggtggtatgccttttattgatatctgaggctctggatgagatgagtagaagttggaactagaatcccactctcctagggcagcactcactccactgcaccctctgccactaactagagactgcagagacagggattaccatcttgccgacagtgctgtcttctgaaggttcccttgtatgtcacttatttggaacctgggacacgctttgtcctagaaacacgtttgtttaaaaggtggctgggttctccatccaacttaaaaccagttttaacccacatcactgctgcggtcctcaaagcagcctaagccctcgaaggggttcagagtctgccaccccaaaatatgcctctctgcacaaggattcttttgaactgaagacaactgagaaaaacagacacagggtaaactctctgtccttccctgtatgcctgagagtgttaccaaaaaatgaggggttcagtcctggtcctgctgctcactgcacagaatgccaatcactgtgacaatgagtcaattgccggagaagaagactttaatcaggtgctgcaggctaggatgacaggaggtacagtctcaaatccctcttccaatggactaaaattgggggacttaaatactgaggaacgcaaagaaaacaggaattagggagggataaggaagcaattgtgatggatgagggtcctggggtctcattgtctgaatgtggtgatttgatgagtttcagttccttgcctgagggttggtttcttttatttttatttttataattattattgttttgaggcagggtctcaccctgttgcctggacgggaatgcaatggcatgaaataatggctcactgcagccttgacctcccgggctcaaacaatcctccaaccttagtcccctgagtagttaggattacatctacatgtgcctgccactgtgctgggctaactttttgtattatttttttttttttggtagagatggggtttcaccatgttacccaggctggtctcaaacttctggtctcaaaccatctgtccactttggcctcccaaaatgccaagattataggtgcatgccaatgtgcccagccaaagggttggtttcttgaggaagaagctcagatgagacaaatgtaagcttcaaattttaagactgaggctgggcgtagtggctcatgcctgtaataccagcactttgggaggccgaagagggcagatcacctgaggtcaggagttcgagatcagcctggccaacatggtgaaaccccgtctctactaaaaatacaaaaattagctaagtgtggtggtgcgcacatgtaatcccagctacttgggaggccgaggcatgagaatcgtttgaacccgggaggcggaggttgcagtgaggtgaggtcatgtcactgcactccagcctgggcaacagagcgaaacttcatctcaaaaaaaaaaaaaaaagactgagagggtcaacttctatgtttattcaaaacctcataaatataacttccatgggacaattaggccggtttcaaaagaagaagataaatttcccttctgaagttgtccccgcctccacttcccataccaggagtgggataacaaccttatcccagaaacaagatggcactgaggaagagtctaaccaaacaaaccttactaactacccttatcttccattagactcttcataaattcacctcccacaacttgatgcccctactagcctaagcccatgttgctttttctttttgagacagggtcttgctctgtcacccaggctggagtgcagtggtgtgatcatgattcattgcagcctagatcttccaggctcaagcaatcttcctacctcagcctcccaagtagctgggactacaggcatgcaccaccaagcctggctaatttacatatgtatgtatgtatgtattatagagatagggtctcactacgttgttcaggttcgtcttgaactcctaggctcaagcaattctcctgccttgaacccccaaagtgctgtaattacaggcgtgagccactgtgcatggccctaaaacccctttttgtttgttttgtcacatctctacaaatgttttgttcttttgttaagatgctatataaaccccaagttctttttttaaaaacattttattttactttattctaagttccgggatacatgtgcaggatgtgcagatttgttacataggtaaacgtgtgccatggtggtttgctgcacctaccaacccatcacctaggtattaagtcccacatgcattagctatttatcctgatgctctccccagaaatcccgacaggccccagtgtgcattgttcgcttccttgtgtccatgtgttctcattgttcgcctcacctcccacttataagtgagaaaactaagtgtttggttttctgttcctatgttagtttgctaagaataatgactagccccaagctctaaccacctctttgaattactcatttttgagtttgtctcacaagtatgcatgatgtacacattaattaaactttatttttctcattagtctttcctttgttagtctaatttgcagcagcacctgcccctctcaactagaaaacctagaagggtaggggaaaaatattttttttcctttcctacacacctctaaaactctagtgctgggcgttgacactggttcctaagcctttcgtaaattttctttatagagacagtgtctcactctggtgcccagcctggagagcagtggcctgagcctagctcactgcagtctcaaacttctgggttaaagcaatcctcccacctcagcctcccagaagcttggatggactacaagtgtctaccaacatgcccaactattttttaaatatttttttttagagatggggtctcactatattgcccaggctggtcttgtcctcctggcctcaagcctacgcctttctgaaagctacgctctgaggtctgggagaaccccaaataagccagggtatagagaaagagaactacagttgtgtccggaattggtgggttcttggtctcactgacttcaaggatgaagctgtgggccctcgcggtgactgctacagttcttaaaggtggcatgtccagagtttattccttctgatgttcagatgtgttcagagtttcttccttctagtggattcgtggtctcgctggcgaaggagtgaagctgcagaccttcccggtgagtgttacagttcttaaggcaatgcgtctggagttctttcctcccagtgtgttcatggtctcactggcttcaaaagtgaggcagacttccgtgttgagtgttacagctcataaagcagtgtggacccaaagagtgagcagcagcaacacttaccacaaagagcaaaagaataaagcttccacaccattgaaggagaccccagtgggttgccactgctggctcggcagcctgcttttattcccttatctggctccacccacatcctgctgattggtccattttacagagagccaattggtctgttttacagagagctgattggtccattttgacagggtgctgattggtgcgtttacaatccctgagctaggcccaaaagttcccagtccccactagattagctagatacagagtgtggatacaaaggttctccaagtccctgccagagtagctagatacagagtgtcgattggtgtattcacaaaccctgagctagacacagggtgctgattggtgtgtttacaaaccttgagctagatacagagtgccgattggtgtatttataatcccttagctagacataaaggttctccaagtccccaccagactcaggagcccagctggcttcactcagtagctcccacactggggctgcaggtggagctgcctgccaatcccgcgccctgtgcctgcagttctcagcccttgggtggtcgatgggactgggcgccttggagcaggggcggtgctcgtcggggaggctcaggccgctcaggagcctacggcggcgggtaggggggaggctcaggcaaggcgggctgcaggtcccgagccctgccccagagggaggcagctaaggctcagcgagaagtcgagcacagcagctgctggcccaggtgctaagcccctcactgcccggggcaggcagggcctgccggccgctccgagtgtggagccgccgagcccacgcccacctggaactagagctggcctgcaagcaccctgtgcacacagccctggttcccgcccgcgcctctccctccacacctccctgcaagctgagggagccggctctggccttggccaacccaggaaggggctcccacagcgcagcggcaggctgaagggctcttcaagtgccaccaaagtgggagcccaggcagaggagagagtgccgagagtgagtgagggctgcaagggctgccagcacggtgtcacctctcagagtgatggagtaggtggcactggagtatcccttggaggtctagggggtactggcagagaaggggttggatttgagagcttctgaaactgggggtggggattgtggagaaggacgtttttcaattacaggagaggcaaaatgctccttctatccttccaggttatttggcttgtctgtgaattaaattgacataagagatttaacaggagaaaaccaattctaattatgtatgtatgcatgaagtcccacaaaaatatgagactcaaaggagcagccagatgattgagatttatgtatcacccttgaagctgtcctcacaagggtaacaagcgttctggacagaaacattgttataattaagcgttaatcaggctgtactctggcccacttcctggtaactgaaagttgcacagcactagataatgaccatttgcatccccactgttgctataggtgggatttctgatgttagaatcataaggcttttaagaattaatttgtatccccattattcttacagatagaatttctgatgttggagtcataaggcctttgtgtttaagaattgcttaagaggttttttcagatcctgaattccagtggaagagctgatgccaaccgtttgaagatccccacagaagaaccgaatcagcgtgagaatacaatttccttatcttcctgtcccacaatttcccccatgcacactttcacccatcaatgatcttcacagttaaaatccctagccccaaactcctcagggagatggatttgaggtttcctactgtctcctcattcagcagccctgtgattgaacctgtttctctattgcaacctggttttgatgtgttgacttgctgcacatcagacagtgaacctatcacagttacaccccgagatacagaaaggaataagggtttggggttcctgcagggtggtggaggcaaattacaggaaggggaggggaggaaatgtatggtgaatggtggttgccttgctatgcagataaaagtctctcaggtgataaaagtcatctctgagtagctgtcttcttcctacagatacctttactaatgaagatatcctttataaatgtaaatttcctttacaaaagaggacatttgtgcattattttagttggggagaagtaaagagcttttcccacgttgactggttcacaatttcttttagctcaaaagaatcaatatgccaaagtggcatattttgaggtgatatgttttgaacctcttcacagggctagagaaggatccagcgggggagaaacaaaggttattttacaaactcttttttcataaattaagtgttctgataagttatgatggggctcagggcatgccacctcaatacaggactgcgaaagaccagaatttacaactcccaaatatgcctttttgatataagattattttgagctggttatcttgagaaactgcagacacaggtgaagttctgaaaagttacccttttgtgagagaaatttatgtctataaaggaaatctccatttgcaagggtgtttccctctcataccaggaagactaaatctctaaacatactttttacttttatttttatgtttttttttttttttttttttttttttttttactttttgtagagatagggtcttactatgtcaccctggctggtcttgaattcctgggcttaaatgatcctcctgcctgggcctcccaaagtgctgggattataggcttgagccaccactcagccaagacactcttaatcaatggagaagacatcaaccaaaatctgcataataaaccttgctgtgtttacggccatactcttcattgtttgtttcagagaatgatagtatttaaggctgaaatttaaactctttctttggggtctactctagagatttacttatttctctgggttatcactcatgtatacagaaggtgtacatattattaaatttctgcttgtttttctcttgttaatctgtcttttgttatagagagtcttggctaaaaactcatgaagggtgaaggaaaaattattttttcccccttacagttctaaaatgcctatatgaaattagagtaaatttgggaagtggttctctttttattgcaaaagaagtaccagggaacagctctaaaatactcccttggagggccaatgactggattagtttatcatttgaaggcagtctcatcagaagatagctatgggtctccagggtgcctgatgccagatcctggtcttcccctagacagacttgcccccaggaggtgcctggatgcgtaaattgaaagcactgagcatctgccctcttgtgagcccaggagtggggcactcttggctgaactgggtactgaggaaggggatctctctgcccccaggatttcctacagccttggttgagatctagaatttactgacatcatcacagtgggggcccagcatggccacttggactttataagactggctttcaacacagatgcacttaccagtaagaagccactggctggtggactcagtagactcaagtactgttttaaaatgtagattttattattattcaggtttgatgaggccaacagatcaggagatgactgccattgaaaagatagtttgttacagttcccaagaggtggggacgatccataccacagtgtatgtgtggtgggaggggcacactgggaagcagcagcgttggtcaggaggcagagggagggaggggaaaactcgagcaagagcctttattcctgctgcaggaagaagcaggtgaggcagggtaagcaggcttaggatggacagtttgaataacttcagctggctctgatacatagggggctatctctcattgtttgggagttggccctggggtgattagagcagaaggccccaagtgtgaaaggaggtgggtatgtggactctgggttggttggtttgcatatgaaaggcactctccaggggagtctgtactgcctccaggaattagtgatccctaaaccccagccctaagccctaagtcagggaggggcagcctcttcaggatcagcaacaccccagatgtcaaagcttcagaatacagaaaataagactaagagaagtggctcacacctgtaatcccagtgctttgagaggtgggagaatcacttgaggccaggagtttgggaacagcctgagcaacatatcgaaactcttatgatgtctccactgcactccagcctgggcaacagagcaagatcctgtcgctgaaaaaaacaaaaaccaaaacacacacacacacacacacacacacacacacacacacacacacacacagagagtgcacaagagacagagagagcaaataaaaaggcatgattaatacaggtactctctgcttcgggaggaggagtgtggaagctgaactgatttcttctttggctgaagtaagctgcccccgacccctactcaccactctccccatggatcttggataattcagggaaggagatacttgcctcctactagtgaggtagatggggcctacaagcaaataattttaaaatgccaaagaggtgaccatgtttgatctctgagtttgtgcagcattccgtgccagttacaatagtgagacctcagttgattagttgtagaaagaattttaaagcacttcaaaacttctttgcaactctcattatcctaataaagtggaagcaaaaaggaaataaatgaatatttaaatcaatttaaaatgtattgacctcaacagaacatttttgcaagaaacttgcaaatatatttgcaagaaactaattcctcagggattgaacactttcagagaattagtttggtgggagtcaaacagcacaataagcatatatgatcaaatacaaggagactttaaatatatatatatttaaagatgtatctatgtatatattcttactttgtgtatgtgaaactatgagcttgttttttgacctaattctcattttcctcaaaagaatttctgtccaatgtctcctgagatgctgtcctctggtgtccagtttattgttgaataatgttgcattattgaataactaccaagtattagcacggaggttataataataaagcacaagccttattcccaagttgctcctggattagggatgaatgattcttaatgttttctgggttgcagatccctgatcatccctgtggggggtccacagattgcagattaagaaccctgttctaacaggaaaggcagacaaataattatactacacggtgctctatccaacagtagaagtgtctgcaacagttgttctttactttggctgctcatgaaaacatctagggagttttttgttgttttttcttttgacagagtctcgctctttcgcccaggctggagtgcagtggcgctatctcggctcactgtaaactccgcctccggggttcatgccattctcctgcctgagcctcccaagtagctgggactacaggcgcccgccaccacgcccggctaattttttttctttgtattttttagtagagacggggtttcaccgtgttagccaggatggtctcaagctcctgaccttgtgatctgcccgcctcggcctcccaaagtgctgggattacaggcatgagccaccgcgcccagcccatctagggagtttttaagcaccagtcatttgttccctcatctagaggtcctgatttagttggtccgggtagcagcctgggtatcaggagtattattaaaaagttccctggaagattccaattgtaataagtggaaaggttctgcagaagcccagtgtgatggttagttttgggttcatcttgactggattaaggatgacctagagaactggtaaaggattatttctgggtgcatctgggagggtatttccggaggagattggcatgtgagtcagtggactgagtggggaagattcacccccaatgtggacagacatcatccagtccactgggggcccagatagaacaaaaagatattctctcccttctggagctgggatacagtctttttctcctgcccttggactccagaattggcactagctgcttttcacgttctcaggccttcagtctgggactcagttcgcttccttgtttctgagcctttggacttgaactgagccatgctccagcaacccagggtctacagcttgcagatggcctgttgagggacttttcagcctccataatcacatgagccaattcctctaataaatcccctctcatctatgtctatgtataccctcttgactctgcctctctggagaaccctgactaatgtacacagcaagggcatgattagctctagcattcccccaaaccaaaatagccctcaccctaccctgagaaaaaatgagaagcaactcaaagtagaaaaaaaccaccaagaaccaaatatgacaggagaagcaaggccagatcttgcagaacaaatgtgtgtggagagggagcattgaagcactgttttcagacagcattcaagatgttagggtgtgtttgagagttggtggtggctaagtagggctagacatgaccaaatcctgcaaagctattagaacaatgttgtcaagattggaaaatgtgtagttatagaacatccagcagacattaattagcacaagagaccataaaggccaggacctggtaaaactgggctggagggaattaacaacaggaataataattgcaccaaaatattcattgagagcttaccatactatactatacacgcattttttcatttcatcctcacaactggtcttataaaatagttttgattatcctttttttatacacggggatattggggcttaaaagtatgaaagacaaagcgcattggacaattaaggagatagttttacccaggcaattgcaatacagagagtgtttatttatttatttatctatttttttttttgagatagggtttcgctctgtcacctaggctggagtgcggtggcataatctcagttcactgtaacctccacctcctgggcttaatcagtcctcccaccttagcctcccgagtagctgggactacaggcacatgccaccatgcccagctaatttttcgtatttttgctagagacagggtttcaccatgttgcccaggctggtctcgaactcctgaactcaggtgatctgcctgtcttggcctcccaaagtgctgggattagaggcgtgagccaccacacctggccggagaatgtttattaatgaggaccatctcaaagaaagtgaaggaggcctgggttttatagaagcaggtaagtgagggaatgagtcttatagaagtcctgaggaaggatggaggcaggtcttgtcatgaaatatgctagggcagggtggtccttttcaagattagctatttcctgattttggagtataaaatggtggagggatttcttcacacttgctcttttctcagggctcaagtaaaattcaatattatcaaaaggttgagtaacttgtccaaggtcaagcagccagtaagtggcccagctggattcagacccagcctgcctggtgcaatctgttctggatttgtggccagaacatcagtttctgtaaaaggaggaattggatgctattcaggcaggaaaagctaggcaaagggaagactccagagagcaagatccagacttagttatcctgtgagcctgggtggaatcacaggagttgggttctaattaaatagttcttggatcactgtttgagaaatgcaacaaaccagggtccaggacaagggccctaggctgagagagtccccaggccccctatagacaagaacaactaggaactcgtatcagccccaggtggaagctgactctgctctcctccaaccttagacaccccttggtgcttagacagacaggtgggcagatatgcagggagccagagaggcctgctccacttctgagctcccagggtgatccaagtggctagctggcagagcagctagaatgcttcatgttaattagccattatcctcttggactcattaagcaagttcaaggagctttattgctttgttgactgaaggttaaaatgaaaatgagctttttacacttgtgtagtttaataattaaaagagagagagatagttctgtgctttctaatgcacagggcctcagataaattttcctgagggttgtaaatgccaatgtcttctcatttaataactattgagcacccacaatgtgctagccgttgatagagaatgctcagtgactaaaacagataaatatccctccccttctgaaacttacaatccagcgacacaaagagataataaacacaataaatgcataaattatggggaattataggatatgatatgtgctttaaaaattagagcaaggtaagggggcttacaagtgctggggttgggtgccgcaatttaaacagggtggtcagttgagaagttgataagcgagcaatggtttgaaggtgagagaatgagcctttccgatacctgggaaagggcattttggatggaggagctagtgcaaaaagccctgaggtggaaagatgcctggtgttctcaggaaacagcaaaaaggtctggctggtccaaagtacaaaagggggagcataatagaagatgtcagagaagtgacagggccagatggagtaggatcgtagaggcctttagaaggacttttgcttttattttgactaaaatggggactagaacgtttgttatcatattcctaaaattattgttcttatttgcctactcttggaggaagaggcttggtcctgccagagtcacaggggattcaggacaccaaccaggcataagaatgcccatgtccagatgtcactccatggcagcagtcagaaaagatggggacagggcaaagacatcagcgtcatggtgaaattgagggaacaaacagaagaagccagaattataggacttgatttaactctctcgacttctgagacgccttcacttgactgatctcccaatgagagctggggactcttttcattgactcagaacttgtctcattacagcactgatacattctattatacttgtctgtctgtctgtctgtcaatcttccctcataatctcagttccttgaagttagggtccctgtgtcatttattgtccttttttccccacatgtcaaactcaattctggcatatagtgtctactcagtgaatgataaatagtgaataataacatttattgagtgttccctgtgtgctgggcattgtctttgcatcttatatgcattaacccattcaattctccctgaaactctcagaaataaagactattactatcccacttcagcaatgagtaaattaagtttcagagaggttaagtaatgtgtccaaggttgctttataagtgaagaagctgctatttcaacctaggcagttggagttcagagtctgtgctattaaccattacaagatagatggatggatggatggatggatggatggatggatggatggatgggacaggtcaaaattatgatacagagtttgaatcagtgttccagaagggagcaaggatgggagaaatattaaaatttatatttattcattaataacttgatagtagtattgaacaaaaccccagggggccaaaagtacctgtgtgctgttgaaagaaaaaagaagaaggaatgcggaatggattaaaaaaggcaataatctacctgggctgttaccagatgcactaacatccctagctttggcccccttggctcactagcaaggtcatccccaggttctggaactgccaagtttgatggccaaccctgctggagtgggggcaggagtgggagattgtagcatgaagggttctcaaatgaagtgagtgtttttggttttgtttttaacttttattttttgaactgtaattcacctacaatgatatacaccatttttaagtgttgcagttcaatgagcttttacagagaaggtgaaattttgggtacagtcctggaggagtgagcaagaagttaaaggtcaggagtgcacagcacatgcaggtgcacagaacactcaaagagcacgaggtctcttgtggctgtggttcatcctgagaataacacgctgtttgggtatggcaagtagataaggacggataaaaatccaaaggaaagataagtctggcacatgtcggagagaggacactagtttatagtgcagagttttcacattgtcgtttgttatgagttgctatttttctgtctaaaaccttcaataagaaggcctctgccttttgttttctcttcggaattcattgattctttcaattttattttctttatttatgccctgtggtgctattccatattcaaacagctgcaggtgatgttgctttccttcccccaatccaagctactgcattaacccccacatatccagccaagttctgacggggaagccatttattcttgaggatgtagatatgagcatctgctccatttgggatcattgtttatgggctgtgaataagaacacaattcaaaggttatgagaaagggcagggcatctacaatataaacacatcagcccccaaatggagaagacatgccagatacaatgagagctgagaaattaactggccatggttcagttattcaatacataggtaactagtgctttctgtctgcttggcatgccttctctttctacccaactttactcaagtgacatcttgtgtccctgagaccttttttgggcatgctatctgaaagttccctccccaaataaacatttcctatgaacacttctgatatggtttggatctgtgtccccacacaaatctcacgttcagttgtaatccccaagttggaggtggggcctcataggagatgattggatcatgggtgcagtctctaatggtttagcaccatccccctagtgctgttctcatgatagagttctcataagatctggctgtttaagagtgcatagcaccttcccgctctttctccccctcctgctctggtcatgtaagaagaaggcctgcctcccctttgccttctgccatgattaaaaatttcctaacacgggcctcctgtaatcccagcactttgagaggccaacgcaggcagatcacgaagtcaggatattgagaccatcctggctaacacggtgaaaccccatctctactaaaatacaaaaacttagccgggagtggtggcaggcacctgtagtcccagctacttgggaggctgaggcaggagaatggtgtgaacctgggaggtggggaggttgcagtgagccgagatcatgccactgcactccagcctgggccacagagcaagactccatctcaaaagaaaaaaaaaaaaaaagaaaatttcctaacacctccccagaagacatcatgcttcctgtgcagcctgcagaactgtcagccaattaaacctcttttctttgtaaattatgcagtctcaattatttctttataacagtgtgacaatggactattacagaaaattggtactgagaagtggggcattgctataaagatatctgaaaatgtggaagcagctttggaattgggtaacgttacaagcagaaactggaagagtgtggagggctcagaaaaagacaggaagatgaggaaaagtttgttgtgaccaaaatgcttatagtgatataaacaataaagtccaggctaaggaggccttagatggaaatgaggaacttattgggaactgaagcaaaggtaatttttgttatgcatcatcaaagaaccttgaggcagtgtgcccctgctctagggatctgtagaactttgaacttgagagtgatgatttagggtatctggtggaataaatttccaagcagcaggtcattcaagatgtggcccggttgcttctcacagtgcatgttcatacatggtgagcaaagaaatgacctgaaatttgaacttatatgtaaaagggaagcagagtataaaagtttagaaaatttgcagcctggccatgtggtagaaaagaaagggccattttcaggggaggaattaaagccagctatagagatttgcataagtaaagaggatccaaatgcagatagccaagacaatgggaaaaagccctccaaggcatttcagagactttcgaggcagcccctgccattacaggcctggaggtctaggggggaaaaatggctttatgggctggccccaggaccccttgctactctgtgcagccttaggacactgctgcttgcatcccagctgctccagctccagctgtagctaaaagggctctagttacagcttgggctgttgcttcagaggttgcaagctgtaagccttggtgacttctacatggtgttaaggctacaggtgtgcagagggcaagagttgaggcttgggagcctccacctagatttcagaagatgcatggaaaagcctggaagtccaggcagaaggctgttgcaggggtggagccctcatggagaacctctactagggcaatgcagaggggaaatggattggagccttcacacagaatcccagttgggtcactgcttagtggagctgtgagaagagggccaccttcctccagaccccagaatggtacatccaccagcagcttgctccctgcaactggaaaagctgcaggaattcaatgcaagcccttgagagcagctatggggcagagccttgcagagccacggggacaagctgctcaaggccttggtaacccatccttcatacctggatgtgatacatggagtcaaaagagattattttggagctttaggatttaatgcctgcaattctggattttggacttgcatggggcctgtagccccttttctttggcagatttctcccttctggaatgggagtatttactcaatgcctataccccccattgtatcttgggagttattaacttatttttgattttataggctcataggtggaagggactagtcttgtctcagatgggactttggacttttgagttaatgctggaatgagttaagactttgggggactattgggaaggcatgattgtattttgtaatatgagaaggccatgagatttggaggagttagaggtaaaataatatggtttggatctgtgtcctcacccaaatctcatgttcaattgtaatccccaatgttagaggtggggcctgatgggaggtgattaaatcatgggggtggtttttaatagttaagcaccatcttcctagtgctgttctcatgatagagttctcataagatctggttgtttaaaagtgtgtagtacctcccccatctctctcttcttcctgctctggccatgtaagaggtgcctgcctcaccttcaccttctgccatgattgtaagtttcctgagacctccccagaagctgagcagaagacgtaatgcttcccgtacagcctgtagaaccatgaaccaattaaacctcttttctttgtaaattacccagtctcagatgtctcttcatagctgtgcaaagatagattaatatatcttctctgcttatttttttccttaacacttgtcacaatctagcagagcatatattttacttatttatcttattcattgtctgtcttcaccaccaaaatgcaagctccaaggagacagaggtcttttttcactgctgtttctgtcatatctaaatcatagcaggtactttaaaaatattttttgaatgaatggattgtgctaggttctgttaggaacaaagaggctttgaagtcaagaaacatcattcagtgatgacataaggccttcaattcaaataacattaaaaagaaatgaatgaatcaagacacaagtttccacatcaataacagaaacacaaagagcctacctcaacctaattaaccaacttatagatttaacaaccttgaaattccttaacatttctttcaaaggagcagattatttagcagcttcctttttaaaaccagggaacataattatagatacatagacttcagaagggtaaaggatttacaagtcatatttgcatgtttttaggaaaattctggtttttgcaggtctgaagaaatgagccattgagacattcaaaacaattaaaccaaggatgcagataactacatttaatattatgatcttacttactgggaagttgtgtgcagacaatttcactgacttacgggagctttcaaaattctattttccagttattttatctttgactgaactctgagtttttagtgattaattaaatttgttttttttgccacctaaattttaacaaaatattccatcagacaagtagattgtggcaagtgttatttaggttttttaaaataagtttttactcattagaaaggctcacaagtttttttctgagataacatttaagagaaagtcacacatttgagtttttcatgctaaaacgtttcaaaatgtaaagtttaggctgggcacagtagcacataccagtaatctcagcactttgagagggtaaggcgggaggatcgcttgagcccaggagttcaagacaagcctgggcgacatattcagaccctgtctctacaaatagtataaaaattagccaggcatggtggtatgtgcctgtagtcccagctacttgggaggctgaggtgagcggagcagttgagcccaggaggttgaggctacagtgaaccaaggttgcaccactgcactccagcctggagaggagagagagagagagagagagagagacagagacagagagagagagagacagagagagagagagagagagagagagagagagagaccctgtctctaaataaagcaaaataaaataaaatgtaaagtttatgaagaattaatacctttcaccccttgcatttacattggatattgactgacttgctgttttttctcagtgtcaaatcagaaaaccctctgctgcagtttgaggaaaagtcttcaaatgttcaacttttgtgtttttctgcactgaacttgcatagatgagtggcttttaaaatgtagttcaggacttacaaagtggtccacatggattctggggaatggtgcaaatcgggggcccctgcagcattaatgtttctggtatggattaacaaacattaaaggcatttaatgtaaacatttaagttcattaattcattcattcaaaaactgttgtattgagtacttactaaatgccaagcacaatgctaggtgagggattatagctgtgaacaaaacagacatggactagctctcatggagtttactttctagtgtggagaaagataccaaacaggcaaataaatgagagataattttaaatatatgacttgcattctaaacaaaataaaacaaataaaacggtgtgatgtgataagagtaatagagtggggtgggagagatttggtgcttaaggacagcctctctgagaaggtgacatgtgctaagacctgaatgacaagaagaaaattagtcccaaaagatggactgagatgaactgtcgatctcagcttttcatgcctgaaaaattgtaatcaattatcaaacttatttttaattcttccctacatgtacctgctgccccagccaggcgtatgtcaagagtgacaaccttcacctcacccctccatggaggtgacacattcttcaaaagccaaatgtcttgatgccttcttagtcataaatattactgtttcttaaataatagtaaagggcaggggagacaatttttttggcatttcttggcatctggggaaaaccatccacctattccatgcacctttagcctggggaaaagggaatagagtgttatgtgaggaagacttcagcaaaggtctaaaacatgaaggtgagtttttggactccaatgttcagctgactggggcaccaatctgtgaactgacaatagttatttagtgttctgtattcatgcactgagatctgattaaaccctttggaagattccttctcttatttccagtggaacatcttgcagcaggaacctgaggctccatgttgaagctaggttcctgcatctgccacctggatcttaagccaccttgtcactgagtttcaagacccttctaacagtaagtgcctcctatgacatgtgatatggtttggctgtgtccccacccaaatctcaccttgaattgtaataatccccatatatcaaggcaggtggagataattgaatcatgggggtggtttcccccatactgttctcgtggtaatgaataagtctcacgagatctgatggttttataaaggggagttcacctgcacatgctctcttgcctgctgccatgtaagatgtgactttgctccttattcaccttctgccatgattgtgaggcctccccagccatgtggaaccatgagttaattgaatctctttcctttataaattacccagtcttggtatgtctttattagtagcataaaaaacagattaatacaacatgcttatcctgcctctaagcctgtagactcagttattctagaatgctcaagcctttccaatgggcctgtgcaaacgttgcctgtcatttaaagctatctcctccctaaagtctttcccagtgactctgacttctcacagcccctgttgtggtcagcataatattctccttggctatgacttcgtagacctgcattcttttaaactctgctcccagagactatgatgatcagcctggtccaggaacttactttccatctgaaggagattcaaggggaaagagaaagagagtggccaaacagatagagacaggactgattctctgctttctacagttcttggttgacttcagagacaggccttcctaatttggatcaaactggtctttctagttcaaggccacaggtcatagtatggaagcttcttaaactttaggagcagaagaatcacttaggaggcttactacaaatgcaaatttccaggggtcagccccagaggttctccttcagtaaatctggtgagtcctgagaatctgcatttatacaagcacccccaggtaattgagatattgcttatctgtgaacattttgtaaaatacttgcataatgaagtgcaaggaaccattgcccacctctgcctcttctgtgtaacagggttctctattgtaagacaggatcctaaaattctagttcatccaacaaacatttatttaatccaatgtcatactaggcatacagattaggccataaaaatatttgggacatacctatactaaaaaggtattagttgcttatctcaaattcaaatttaaccaggcattttgtattttacttggcattgccaggtggcatggggctgggaggaattgctgcaatttgggtcctctggcaggcagactgagatggagttcactgctcaggatgtttattaggaagcacccttgaaatcaacacatgtggaagagagaaggaagctagatcaggctgagaaagaaggcaaattgagatgcaggcccaacatccttgaccagtccaacaggtggctgtgagccaaaaagcatcagaattgctctgcaatggactgaaatagctgggactttatacgccggctttcatccattactgagtacaagccatcccaggaagagtgtaacactaggcaaggcagctctttgcagctgaggcaggagctgaaggggcagcagcactcttagcagccaggtaagtccttctttgagtggggatccctcttctttgaaggcagggaatctcagccgggtgcgatggctcatgcctgtagtcacagcactttgagggaccgagctgggtagatcagttgaggtcaggagtttgagaccagcctggccaacattgtgaatccatctctactaaaaatactatatatatatctaaattagctgggtgtggtggtgggcgcctgtaatcctagctactctggaggctgaggcaagagaatcacttgaacccaggaggcagaggctgcagtgagctgagattgtgccactgcactccagcctgggtaacagaacaagagtttgtctcaacacacatgcacacacacacacacaccccacaaaaatgtagtgaatctctgtggcccctacaagagtctgagatctagctacgaagccagtctgtgggttccatccattaaaaattaatgtgatcttattttatgcttgagagatcataacacctggatatagtggttacattgattcagccagaagcctctggcctacaatagtataccaccgctggcttttttgagctacttcacagtgtgatatttttgtggacaccaattttcaaacctccacaacccagaaaatagaattgtccaaagtgaatgagtgattcatggtggaaactctcagggtttaaggaacagagctgatggaaagctgtgacaaccagctaatcatgaggtgatcaacgcctttcattccaacagtagattgtgaccaggatagtttacctaacactgtctcggggttgctgtatttcccattcttcatccacttattcagccaactggtgctaattgacctttgggcacagaaataagagctcttattccttacgtatagaattcctgaaagcttcctattattaataggacagcttgagtgaagatggaaaggttgttcttgatacttaatatgtttaggtatttcactttttcatatcttccaatgcctcatttgcctttctttgaagcatcacagcctctctttcctctacatcaataatttatatatttaaaaaaaccgcactggtttccatagcaacttcaaaggtgaacagctcatctaggccaggaggatcttcagaaactgtttatgataaaatcaccaggtcttctagagaaaaaaaaaaaaaagccagcgacttaaaacatttaaaagctaacactgtgggagaatacctccccccaaaacatgcgcgcatgcacacgcacacgcacacacacatacacacacacacgagagagagagagagagagaaagagagtggcctgatggtgtactgtggaatttggtgcattctggcatctttttacagtgtgggaatggggcacaattcccttagcgacgtaggcacaacactatgctgggggatgtgggactggagaaaaggaatgaaccctaacaaaaatgagaataatattttcctgctataaagtttcatggggacctcttgggtgcccagggctgagttcctcatctttgtcaaatgttggaagaatgcttaagattcgattatcatatttctgattttgtagaggaagaatacaggcttagagaaaaatggtattttggagagcaaaggccagaagaacagaaaatagagagaaggcgggtggccatgaaaatgtaccactcaggtctcctactgtgaagagcaaaattgcctgactggccccaggtgctgcttccggattcagcaccacaatgtgctgagccacactccccagggggctgatccctgggacggctgagcatagcagaggcactaaggcaagcccactccagcaagaggcgtgtggctctgactcgaggactgtggtttgagacgcttcctccccagtgctccttcctgtccaatttctttccctgggagtcagcctgcattatagtctgaaactcgtccagccttctcccttcctcaataattcttcttgtgtgtctgattcttcaaaaacatctgtttctagtgaacccaaactagggcacatatcatttgaaatggacaaaacacagagaagagttaagatgcattttgaatatgctggccaaagtcatcttggtctttaaaggagtgaagaatgaagtgagcctcgtggttcattaagaattcagccaaatggatgctcagcaccttgggcagacaactgtgtgcagtccatgtgctcatgatcaaacttgaacaactgctccttaaattcaatgggtgttgacacataatgttagtgaccaaactttagggagcagaaggaaaacaaaatgccaaacttcttttttttttttttttttttagatggagtctcgctctgtcacccaggctggagtgcagtggcatgatctcggctcactgcaacctccacctcccgggttcaagccattctcctgcctcaggctcccgactacaggtgtgtgccaccatgcctggcttaattttttgtatttttagtagagacggggtttcaccatgttggtcaggctggtctcgatctcctgacctcatgacccgccctccttagcctcccaaagtgctgggattacaggtgtgagccactgcgcctggccacaaaatgccaaacttcttaaaagaatagcttgagtgtgtgattcgcttcattggtctctgtgtaacattatagtttgtataatatataattatattagaaagctggattttcttccacaaatatcccggtatgtcttcattttccccctctttcatccctatgatcacgaatcacctgaagccctcattgtttattaccagacttacttcaacagtctcctgttggtcttcctgcctccttcctccaagctcctgggactggacagttgatttttctaaaccacagatttgactacatcaaccctatgcttaaaaccctccagaggctcctgctcatttctttcaaaataaaactgaactctttaatttggcttatgagaccttcaacgaggcaggtgacaccctctgggttccactctctttactcctcagccagacacaggagtttcttggactcttaagagcccttctttagagtagcttggcatatcctgatgaagtccagagagagaaaggcatgtctcagagagaactgtgggtgttacttttggcacattgggtatatatatatatatatatatatatatatatatatatatatatatatgtatgtatacctgaccatatttttgagtgactgataccaatttaccacatacaccatgggatatttccattaataaattcaggtgtttttttttcttcctggaaaattttcttagattatacttttttaacatcaactttttttttttttttttttttttttttgagacagggtctcactctgtggcccaggcttgtgcagtggcgtgatctcagctcactgcaacccccgcctcctggattcaagtgattcttctgcttcagcctccagagtagctgggattacaggcacatgccaccacacccagctaatttttctacttttcgtagatgtggggtttctccatgttggccatgttgatctcgaactcctgacctcaggtgatccacctacctgggcctcccaaaggcctgagattacaggtgtgagccactgcacccggccaacatcaactttttgaagtttaactcacatatataaatatgtaccaattttaaatatacagtttaataataataattattattattttttgagacacagtctcgctccatcgcctaggctggagtgcagtggcatgaactcgactcactgcaacctctgcctcctgggttcaagcagttccaccacctcagcctcccaagtagctgggattacaggggcgtgtcaccacgcccagctaatttttgtattttagtagagatggggtttcaccatgttggccaggctggtcttgaattcctgacctcaagtgacccacctgcctcagcctcccaaagtgctgggattacaggtgtgagccactgtgcccagcccagtttaataaattttaaaaatgtatatgttcatgttacctttaccaccaagataatacatttcattatctaaaaaaactccctcctggccctttgtcttcatcccccctacccaaacaatcactaactgagcagctttctgctgctgtaaataagatttaccttttgtcaaatttcatacagtaggtactcttttgtgtctggcatctctgactcggaataatattttgaggtttatccttgctgctgcattgctgggtcaattgttcattacttttattactgagtgtatgccacaatgtgtatccttttacttttgataggccttaggttattctagttttttttttgctgttataaataaaactgctattaacatttgtatacaagccttcttgtagacacgtttttatgtttatcaggtaaaaggtaggaatgtaattgctgtattgtatggtaactgtgggttcaaccttataagaagcagacaaattattttccaaaggggttgtaacattttgccttctcgacagcaacatatgagagtttcagttgcttcatatcctggccaacccttggtatcatcagttttgatcattttggccattctagtgagtgtgtattggcatctcattgtggttttactttacagctccttgatgaccaacaagggtgagcatcttttcatgtgcatattggacattcattatcatcttttgtaaagtatttcaacatagccaatgttaaaaattgggtagtttgtcttattactgagtaataacagttctttatatattatgcatacaagtttttggtcgtatgtatgtgttatgaatattttctctcatcatgtggcctatttcattaataatggtatatttgaaagagagaagtctacaattttgatgaagttcaatttatcattttctatttttgtttttcatgcccaatctaagaaatctattttttatttatttattttttgagacagggtctcactctgtcacccaggctggaatgcagtaacacgatcatggctcactgcagtcttgacctcccaactcaggcagtcctcccacctcagccccctgagtggctgagactctaggcatgcaccaccacacccggctaatttttgtattttttgtagagatggagtttcactatgttgcacagggctggtctcgaactcctgggctcaagcaatccacctgccttggcctcccaaagtgctgggattacaggtgtgagccaatgcgctcagccaagaaatctttgcttatcccagatcagaaatattttctgctatgttttcttctataagttttatatatttaaatattatgtttaggtttatgtttcattttaaataataaatttttgtgtatgatataaagtaagagttgaggttcattcttttcatgtggatgttcagttattccagcattatttgttgaaaagactactctttcttcattgaattgccttggtacctttagaaaaaagtaattgaccatatgagtgtgggtctatttcaggtctttctactctgttccattactctatatgtaaatccttatgcaaataacactctttcttgattactgttcatttagtaagtcttgaaatcaagcagtacaaatcctccaactttgtttttttcctcaaaactgttttgactcttctagatactttgcatttccatataaattttagaaacagcttattagtttctacagtaaagtttcttgggattttgatgagtcaaacctgttgatcaatttgggaagaactgacatcttaacaatattgagtcttccagtacatgaacatagtctatttctccattttagattataggcttaaatgtgagttttattccattgttttatatgtcttcttcaggggttcaagtgatctgtatctttaattttctttgtttatcttccatttcaaccactttctctctgaatctttttgcttctgtttttagttcatttttattttcttgttcattttcctgcctctgttcaatcttcttaacttttcagtttagtctactctccactgggtgtttgtaatttggcctttattcctaagatgattttgtctttttctttcctgagttgaatcaatcaatcaatttataaaatatgtacttatctgttgttttgttcatttctgttcttggttttcaaatatctgattcaaggtggtttttttatatttccaaatgtttgaggatatcaattccatttaaaattttgtgttttgttgttgctttgtggttcttttttgggaaggacttcatcagctaaaggctttgactctgatttttttttttttttttttttttttgagatggagtctcgctctgtcacccaggctggagtgcagtggtgccatctcagctcactgcaacctcacatctcttgttcaagtgattcttgggcctcagcctcctaggtagctgggattacaggcgtgtgccaccatgcccagctaatttttatatttttagcagagacggggcttcaccatgttggccagggtggtcttgaactcctgacctcaaataatctgcccgccttggcctcccaaagtactgggattacaggcatgagccactgcgcctggccctgattctaatttttattcccccttaaagtagctttacatggatttaggatgcttcatttcattgcagtgtatttcatgaagttatttaccatttctagttcaagatcaccctcttctgtcagtgtagtgaaatgcagttcctttaagggatggctatcttgttttttaaagttgtggggtgaataattttctgttgtttttttattacttacctattccagttttataatgtcctattgtggttttattgatgttatcttcttttatttccctgaaaattttaaacagtttcatttcaaagttctttttagattcttctgtcactttagaatgtagatctttgatttgtgatgacctttcagtgtgctctgtgtcttttaacttttgccggaaagttcatattgcgtgagaattttctcccacacttcccttgcctgtgaggcagtttcttggctcccttagtcttgatctcataggttgactagactaaacctatgccatatgtttgcagctcaactcacagctgctcatttctggggtgaaaattctccacaatgcacatggtacagactggtgtaaagactcactcagaatccctgagttgaaaccacctttgcaaagattatgacagtaagagaaatctgatatggctgactccatcttgcttctagcctcaccggttggctgtcttcactcattcctgggcataggacaagctaacatattcttacttttaaccaaattaaaatttatagtttaacttggaagcaaggatgataatagtttctccctgaaacgaatcctctccttgttggggccagggggcgggctgaaactactttcataagactaatgaaaggccataagattaggattatgggagggccctgaattctgctaaaatgtcggtatagtttttatgatcccttacttctcaggaatcgtgtggccagaggtcacaagatttatgacttccctaattgctcatatagataatatcactattgtagaacttaagattggtcttttgagatgtttttcagactgatgccacccagactcatgactcataactcaactatttctgtgccctcctctcccaccaagaggtggactcagtgcacagatggtgaccattttccacacccctatgattgcattgccaaccaatcagcagcacccattctctatcccctgcccaccaaactatccttgaaaaaccctaacccgtgagcctttggggagactgatttgagtactaactctatttcccctgtggccagcctcacatcaattaaactactgcaataccatggtctcggtgaattggttttgtctgtgcagaggatgggacgaactcatcaggcgattacagagttgttgtaaagattattttaagctgaagacatttgagactcaacagatgcagaaaaagactttcttggagctttcctaatctgatgaaacacagcaactttgggaaatgagactaccataaatcccttctcctagggagagtcctagctgtgaagaagagagaaaggccactagcacctatgtaaataaaatgtcacaaactttcttatctcccatttattctcataaaaatccaattgtctttcctaaggaaacctatttgttcttctcataggagccttttctcctttttccttcccctactatgttaggtacataagccctgaattctaacagtgagcacaatcactgagtgcatcactgagcactcctgtgtgtatgcacattgcatgcttaaatcaactcttcttttctcttgtcaatctatcttttgatggtttagattcgtaggcccccaggcactgactctgtgaaggtaaagtgtttcctctccagcaccaggaatagcactgatatggtttggctccatgtctcacccaaatcttatgtcaaattgcaatcctcacatgtcaggggaggagactggtgggaggtgattggatcacggaggtggatttcccccttgctgttcttgtgataacgaatgagttctcatgagatccgatggtttaaaagtgtgtggcactttccccctcattctgtctctccttctactctgccttgctaagatatgcttctccttcaccttctgccatgattgtaagtttcctgaggccccctggccatgtgaaactgtagagcctgttgaaccgtgagtcaattaaactccttttcttcataaataaccaagtctcaaatagttctttctagcagtgtgagaatggactaatataggactctgctttggacactgaccctgagcaagtggtgtatttctgccactgttctagatgtacggatgaagttctgtcatccactgttcttgggtagctccccactaccaagggctacattcagtccttcctctggactccagtcttgtttgcctagttccagtctcactgtttgtccctgtggttttatactttgcttattgtttaagttttactccttttttgagccagtgacattttcctcttgcatttttagagaagcatagaaatatgtatttaatatctaacctgtcattcctatggacttggagcacaggaaagaggattatgaatgcatttgctctgatatctttattaagaagttttcaggccttttaaaagtgaggatgccagtatttatctgaactcaaaacaatggttcttgatccagtaattctgtttctggaactcttcctagaggaagtaatccaaaaaatgggggaaaaaagcttcatacacaaagatgttcatggctgtattactttctatggtaaagatctgaatatattataaatatttcccaacaataaataaatattaatatttccatttaatataatattatgcagctactaaaataatactttacaaagaatatatgatataaaaatgcttattataatacaagggagaaaatttgtagccattttttgttgttttatacaagcatgcattaaaaaatagcatagaaagactaataaaaagaaaccacatcagtgctaaaaacggttgtctcttagtttttctttattttcaaaattgtgtgttatgtatatgaatcgcttttataataggaagatacctaaataaatatattaacaaaaagctgaatgatagaaggacattttaagacaggcatctttcatgattatagagaatggattggcatactacaaaacgattgcttctaaaacacacaaacagcagaggaagcttttgtgttagaagattattggttgtgattagatgggttttcagcatcagggcacaagaagcaccagtttggtgacatcgagcaaggaggcagggctacaagggactggcagatggcaagaacctacactctgcaggcaaatggccaggcgccaggatcagatgagggaaagggcaagctaggagactgcgccaggggagccagtggtaggggccggacaggagccaacacttattgaggggttgctgagtttgtgccaggcactgttttggatcctgaaatacaggtggagaagactgacacagttcttgccttcatgaaacttacagtccatggcaggggtttcaagctgtttttttttttttggaaagggctagacagtaagcatcttaggttttgtgaagctatacaatctgtgttacaattactcagttctgccactgtagcttagtaaaagcagccacagacaacagtaaatggatgggtgtggctaggtaccaatgaaactttgtttataaaaataagtggtggctagacttggatggtggcatagtttgccacctcctgatctaagtggaagacagacagtaaacaagtaaacaagttaatatgataattatggtttgtgatcattgtcaggaaggaaatcaaaagggtgatctagtagtgaattagtaatacattacattttaccttttaccgagatgtgacatccatacaataaggtgcacaaattccaggatatagaatattcttaacaccttagaactgggtcctgaagcattagaatgacctctccatccaaagaactgggcatggggaagcattccaggcagaagggaaaacaagtacaagagtctgaggcagaaaaaggtttcgcatcttccatgaacagaaagggttttcatggggctagatagcagtgagcagggaatagggtgggatgctgtgggtagaggaaaaccccacagactttagaggccattgtggacattctgtatcttattctaaatgttataggagagcaatggagggttttaagcagaatggcatgatctgattgaagtttcaagatgataagtgaactgctgtcttctttctggacttttctgtagtagtgttcagttaggacggggaactggggctaggggctgggggctgggagcatccagcctcagctggagctgagatgggctgtgtgaggaaaatccattaaagaacaccattaccatacaccacatactgaaccataaacatcgatttattttgtaaaacacctctttgaaatattactgtaactagatttattggcacctgtttccgagcacttaattaggagatactttaagaactgtgcatcaaagacaagaacctgaagaaaatgcaagcagggggttaagaggtgaggtgagctggcaggtacagatctagcagcagcaagtcatgctgccgaggtggaggctcacgggaggcaggaggagggggtcagaatatatctttagtgtccaggaagagaccccggtggtttttggaaccagagagttgaggtttgctttcattggtgtggcttggttctgatttaatgttttgaagacatattgtagggaatagttacaaagtgtccctaggatggtgaaaagaggcgggtggtgagggggcaagaaggaatggagttttgtaaatggagaattagaggaaatgataatttggggccaagagccttcctccttctctccctacctgcctctcttcttttctccttccttccctttcatttatttacttacttatttatttatttactatctaccttggttgaatgtcatctcctttcttttttaaaaatgcagaggcgagagaccaagaggaagaaattgaatcagtatgtactgccttactaaggttgtcatgaagcaagcgcaaactaaaatattgttcatgtttgtctgacattcaaatttaacagagcaccctgtatttttatgtgctaaatctggccatccgtctatgcctgtggcttggattttgccatttcagcgtcagcgagtgaaacctcctcctaattactccctgctaattggaaccagctgccaccaggaggcagccgggcgctgcttccacccaagatgaggacagtgtctgagattctagggagctctgagtctaccttcctctcgaactctcctgacacccatttccacttctagccacaactttccactgctctctcctaatcttgctttagtaaaaatagctaaactttaaaaaaaattatactccatttaaaggtaaaaagaacccataacatcacatgcatcttgcctccctaaataattgcagttagaaattaattcatcttcctttaaaaacctgaatttagcctcaactagtcacagcttctgtcactcgcccctttgacctgggggtccccttcgctcccagcttttcccgtgtccctgtccttgctccctctctccactgtgcccttccttcttcagccgtcactatggttacagggggacctgtttctgtggtgccctcttccatagcctgcttccgaggtaatttccccagtgaattccacctcctctcagttatctctgcccttatcctacttcagtgaggtgggtgggggggggaatcagagagagaaagaaagcgcatgcatccagcagctcagatatcaaaattctttctgttaccaggagactttctccaatcaatgttgcctctttttttgttttccttctttatgaggaaaagctgttcccgactctgcctcttactctggcataaacctaaatccacttataaaagttaactaaacacctcttggccttgtgactgtaacactgagcaacagtttgcttctttgcatacctccaattctggagtcaaaagggtccctttaggacagaaaaatgaactgaagaaagaacaccagctctgtcacatgggggagacagcgacacagaaaatgttaaccaagcagtccaggccacagagagatgtgtccaaagcccagggccccgtaatgagaggctacaggcaaagactttcccagagaggtggagaggaagcgtctccaacagtgtccaagcagcaaaggtgattccagaaagcttatggtgaaataacatggaagcaaagatcacaaacagcagtgttttgataaatatttggatgttggtttgtttggtttctgctaatttgagattctgtgagttagataattttctttgcttctcatgagatataggataacctactcaaattatgcaaatgctcattcaaaggaggaagcagaattatgttagtctcttctataattctattgaaatgatgattcatagggtccattctcaaagaagacttgcatcaaattaacgcagtccagcaacatttttttttaaatgtcataaaagggctgtaactcacaggaactcttcttaaaatccccatgtcctcacccttccactccctattcacagctccttctggtctctttcagaatacaaattctgacaccctcctacggcctaacctgtgagttactttgtgttattctcctcttctcccaattctgcttcatgggagtccccaaaagagggctatgctgggaacgctgtgggagaagaagaaattgactagaaaaagccggaaccttctttaagttgtagggcaactggaaagctgggaacacattgacagcagcacttttgcctggttaaacttatatttttgttctcaaaatgtaagtttcctgtaagtccagacctgttgggatagtcatctcacctagtggcgaccttgagtggtatttggtacttgctaagctgctgcacatgaagctgtgctgtgttcaagggcagtaaaattcaactacactcagtctgcctgcccttaaccaaggaggaaagcaaggtagtctgtgtgggtatgaagccagctctctcattgcgtgtacaatgcctgccatgctcaccatcacctgagccagatcattggccttcctgctaggaggatcgagggcagaggtctatgggaagatgaaagcaaagtgtttgttaccacaccccctttgttatggaggtgatgggcattgttgatataggtgatgcatgggcaaatctactgacatgctaaaaggatgggtagttgttcatgctgaattgaattaattgtttatatcttggctgagtcattaggaatctatgttacagtctctgactttgcatgatccaaagctgaattccgtgactgttattctgattttcctcttggaatgaccaggctttgggggactaatccaatcttccaaggtgggccagtggatcgatttcagggaagaacagaagcttcacgagggagacatagatatgagtactctcttcttgctaaggaacgtctatttagaataccaaagcaagatgctatttaaatactttcttcagtttcattctttttctctgtcctttactgccttccttatcatctgactgaggcaggaccttggcaaaccttattcagcaaaacaaattatcagaaccttgggaacccctggactctgttcttggaatctccataacagtcttgctggccactgtctaggaagaaaatttctttccccaaaactcattgctcacattagttataccttttctgggatccacccttttgtggtcccagtgtcctggagcacggatgttcatagtggctgtcacatgggcactgtgcccatgtgcatggcaggggggttctgctgccctctgttggccacagcagacttggtctggttgttaactactgggtcatgtccgcctctggcaaaaggctgcagttcttgccctctaactctccttcctcagcattccttaacaggtaccaaatcctcctattattaagcattggatgaagccacattgcagctcccacgaagagtttatctaacattcccaagtgaatgattctagcagtctatctagcatagggatcatgagttgtttctgggaacggccctgaaatatggtcagaaaatgtctgagctcatcaactctgtcctgacttatttgatttgctatcagagagtgatatccctggatcttgcccctacatagtgtggtagtttctatttggaagcctcaaaacacaaagccccttctatagcataataataataattattatgattaatctgctactgcatcctttaagtggtgagaattacagaaatctcaaacatcagcatcagtttgatcctttaaactagaaataaaggggagaagatttggaaatatgctgatgggggcaaaatcagttatttggaagaaaaaggagactgggtttagataccctgatgtgccaggttattgggaatcagtaatatatgccaacttttattttaccatgaatatctcctcaaagtcttggacaggcttctctctggcccttctgagtacactaatgcaggttggtagtgtggtttctggaatgtacttctaggaggatccatttactaggcagccttttttctttgctgtggaggaggcttttagcagatgggtgtgttatataatggtctgcactttgcccccacatgagtgtaaatattataaacatgaacatctggctgatattactgatgtctacagggcatattggcctcagtttaggagggtgaaacagtgaaaccctcatcaaacagtgataaatccaagagatggctgaggtgggatgaggagggaaattagtccctttttttttttttgagacggagccttgctctgtcgcccaggctggagtccagtggtgcgatctcggctcactgcaagctccgcctcccaggttcatgccattctcctgcctcagcttcctgagtagctgggactacaggcgcccaccaccacgcctggctcatttttttgtatttttagtagagacagggtttcaccgtgtcagccagggatggtctcgagctcctgacctcgtgatccgcccgcctcagcctcccaaagtgctgggattacagttttgagccacgcgcctggccccctttttttgtttttgttttgttttgtttttgacatagagtttcactcttgtcacccaggctggaatgcaatggtgcaatctcagctcactgcagcctctgcctcctgagttgaagcgattctcctgcctcagtctcccaagtagctgggattacaggtgcccaccaccacgcccagctaatttttgtattgttagtagagacagggtttcaccatgttggccaggctggtctcgaactcctgacctcaggtgatccgcctgcctcagcctcccaaagtgctgggacaggcgtgagccaccatgcccagccaacttagtcccttttaatcttcattgtggggaaactttcctttaagaaagttatgcaagtattatatgaaaataatttttaaaaatcaaataaaggaatttcaataaaaagttgatttctttctttttaaggctgaataacattctgttgtatgcatataccacgtttcttttaatcattctgtcaatggacatttgggttgtttccacacattggctattgtgaatagtgctgcagtgaacactggagtgctaatatctcttcaagatcctgatttcaaattttctggacagtcccagaagtgagattgctggttcatatgatagttctatctgtacttttttgaggaacctccatatggttatccagagcagctgcaccattttgcatttcacagtgtacaagggttccaatttctccacatcttcaccaaaactttttgtcttttgttttttttgataatattcattctagtaagcgtgagatgatagctcttgctggttttgatttgcctgtgcctgatagtgatgttgagcatcttttcatatatctactggccatttgtatgtcttctttggagaaatgttattcaagtctttagcccattttaaaatcaggttattagttttattgctattaaattgtaggaattcatatttttgatattaacctcttatctgatatatggtttgcatattttttcctattctgtaggttgcctttttactctgttaattgtttcctttgctgtgcaaaagctctttcagtttgatgtagtcccacttgcctgtttttgcttttgttgcttgtgcttttggtatcatatccatgaaaccatggcccagacgaacatcattaaggtttcccctgtgttttctcctaggagttttacagttgcaaggtgtggtttacttttgatatgttccctctgccaatccttaggcggcagttttttcactctgttaaatcatttaaatcgtaaagatgtatttattcccctataattagcattttaatccaaatacttaaaagagggggcaaattgggaagggaagaatgaacaccatagccgagtgactgcagatataaaaaatccctttgttagtttggttgtttttaattaataattgaacttaaggctgggtgcagtggctcatgcctgtaatcccagcactttgggagaccaagtcaggcggatcacgaggtcagaagatcaagaccatcctggctaacacggtgaaaacccgtctctactaaaaatacaaaaaaattagccgggcgtggtcgtgggcgcctgtagtcccagctactcaggaggctgaggcaggagaatggcatgaacccgggaggcggagcttgcagtgagctgagatcgtgcaactgcactccagcctgggcgacagagcgagactccatctcaaaaaaataaataaataaaataaatagtaataataataacaacttaaataaagaggacccagaggcagctgtttctaatattgaatcatcactgcacatgaaaaacgcatttatttctatgctatgcccttttttcaatgtagataattgataatttcttttttctttttctttttttttttttttttgagaccgggtcttgctgtgtcacccaggctggagtgcagtggcatgaacacagctcactgtagacttgacctcgtaggctcatgtgatcctctggcctcagcctcccaagtagctgggtccacaggtgctcaccaccacacttagctaatttttaaaatttttgtagagatgagatctcaccattttgcccaggatggtctcaaattcctggactcaagtgatcctcctgccttgaccttcaaaagtgctggaatttaggcgtgagccaccatgcccagtccgtaatttcttaatcttgcaaatgtaccatgcaaatgcaactttgagctctaccttctaacttgtccattacaactcctgagcccctcatatacaaacttcctaaatatctatcagacttcacccttatgacagagtactcttggggctacagtttaaagcagaactaggcaaaggcctcttctggttatatatcaaaggataaggccatatttccttgtcattaatattttctttcatttattcatatattcatgcatgtatgcaacatatgtgttgagttcctacatataccagtcactttgctaaaagacagagatacaggcgtgaagaaaacacagcccctacctataaccttcatattatattatatcagtgtggttttcattagggctgttggcaaatctttgtttatttctatctcctttcagacatatagtgggattatatttcactgtcccattggtttaggcatggctatatgacaggcattagctagcaaaacatgaacagaaatgatgtgtcaaattccagggagacgctttgagagccaatcatgcctttttgtcatgcctgtttttccttctgctaaagcgacttaccaatgttccatatactgactagtctaccaatgcatacatgaatgtgtgattattattgtgacttgcacatagttcttagtttcatgaataagaagtaaatatttattattttaaggcactaagatttgagagttacaaataaacctagaaaagggttaccaaataaccctgcctaccctgattgatataatccatgtgagtatagcagtcaattactatacttaggcgtggtgactcatgcttgtaatcctagtactttgggaggctgaggcaggaggattaggaggaccaattgagcctaggagtttgagaccagccccggcaacgtagcaagaccccgtctctacaaaaaataaaaaaattagccaggcatggtggtgtgcatctatagtttcagctgcttgggaggctgaggaaggaggatcacttgagctcagaaggaggaggttgcagtgagctataatcatgccactgcactccagcctgggtgaccgagtgagactctgtcaaacaaacaaacaaacaaacaaccccaaaaaaccactaaggctctaatttgagagagacaaaggtttaaatcctagctcttctatctactaaatctactagctacatgactttgggtaggcttctgaacctctctgaacttcagttctttctctggaaaataaggataataataggattgtagtaaggattaaatgactaaatgcatgtaaaatagtacatgttctgaacattgtaaatgcttaataaattgcaactatttttattgctttcaatcattaacaacatttttagcctattaaacataggtactcaggccatctaaagacaggaagaatgtgtgtaaggcagctgagttattgcactagatggaatactgtgttttaggagatgtggaaaagagtaagttcttcaagatttgggtgaaaataagtgcatatatgactattttgtgatagtagtgggaaagaggtctttatatttggtcttttaaaatagtatctgtgcttattcacactccattcagagtactagtccctctttactaaaccttgatgaattctgtgctaaaaatacttctttcccatttggtgcactgaaatgtcatatccattaaacaccaacataccaaatgctgcttgcagatactcaacccagcaaacccaagtcaacaggaaattggatcttcctcagcttgttcgtactgcacatctcaacagattattctgaaggattatctaaatgctaattattatcttagaactatcttagaattatgaaataaagaactcatctactataaagaaggtggtattgggtcaaggtctccaaactttcaagctgtttttttcctcctttataacaggtagttacagaaatttcagaactgaaagggacctttgggatgaccttgtccagttccaatatcttctagaaaattgaggcaccaagaaacttaagtgtcttgccatgggtaatgcttaaaactagtatgttctagagcttttggacaactttttctaaccacaggcttggagctactagcatgatactggttagtccaatgtggttatttatatcagaggctcccaaatcccagttagtgggcaggtcgtgggctatcaacatcagaatcactcaaggaacatttaaaaataagaattcctgggtttcattctttgaaaattcaggtttgatgggtttgaggtggaacttcaggaatctgcatatttagttaactttctaggtgattttggagtggggcatccagattggggaaccattatgaacagaagtcagcgttttatgttctgttctctgctgagattggcctgtgataattttagccactgactagatacttgcaggaaagctaaattaggaaaagtcttggaccactaaggagcctctaagattttaatctgcaaggccaacctcaaggtgattaaagtatagagagaggggagctagtgctgcccttgacagatacagattgatttgagatggaagcacattcaagtacagaatggaaagtgatctaagaacacttggtctctcctctcccagagacaggtggccactaaattagaattggcagcttgacttcacttaggaaaacatcattctgaaacaaaggacaccggtttaaatattttaaaacaatatttgatggaacatactttaaaactgcttatagaaaaggtaacagtaaatcgttataaataatagaccaagatgggaggttatattttgccaacttttgaaaaataagagctggaagggatctttgaaaccttttagtgaagggattctagacacgtctgagggtgtggccatcctttagtaactctggctctctaagcagaggttctcaaaagagaccacacctcctactgatagcatttgttgttttgcctgtctggtattctttccttccttttaatagcactccaattttactttagggaatcactcttatctcactctcactctatgtggttctcatccgtgggttccaggggtgggaacatggcccaacctgggccaataagcattctacccttagccacaacaattgcatcaggatgggcactgggccaatgagcaccagccctgagcttttgttagaactactagagaagaggagttcccagcctttctgttgggcaaggctacaccagcaagactaatgttggagctgttggtaggcatttttccaccatgaaaggagggactgacttaggaaaaagtcaacatagactaaaatagggccaagagtcagggaatgacagatttatgaaagtatcatctgagcatctggtccagatatttctgaagctagatgttcttttatgtttcaactagtttagttaggcttcagtaacttacaaccaaaaaaaaaaaaaaaattcctggctgccatgactcctcagggatcagaatctgggctgtgcatttagaaaaatcctgataattctgatacactcattgagagtggacaggatttgaaaacaggaaatgggagtatgcatttactcagtggagcacttctagttgagaataatttaagctagttgaggaaatttggccaaaatcacatggctagaatacaataaacctcttgggagcttgattctgtcttcttttggggaaaaaaaaaaaaaaaaaaaaaaaaaaatatatatatatatatatatatatatatatacatatatgtatatatatacttttaaaaagtaaaggcacacatcacttaatataaatttgctgacagggacgatgtggtaaaattgcttcattttatcattcagggatatctgacttttattgatgcaaaagccacacagaaatttgaagagctatttttcacacagtgttccctccactgatgtaaaaacaatgaccacattttaacaacagcaagttttattggaacataggtaattttctagaggccaaagtccctcaatgttcctcaataagaatgcatgcatatcacacactgtgactcctgtcatcttctatgttggagcacaccaatgctgctggggtggtcagctcacttcactgccgtcttctacctgtaacttcttggtgggccccactgcctcacctgggtttctgttccacctgttcttctagaggtccacagacatcctcagctctcacagagaaagatgtgatggggtgtaagcattttccacctatcctgatcagtgattacagctcctatacaataatgtaccgcttctacaactcataccagcttagcagaatggagtggccaaaatcccagatgcaggctcccaggtcagacttgctagccgtatgttcatggacaagttgctaatttcattagtaaaatagaggtattcagagtaaccacctcctggggtacttgtgaggcttatacagtatttaatctgcaaacccactctatgacgatcattattcacattttgcagatgagtttgattagcttgtcccaggtcctagagctagaggaggccatattgggatgcaaatcaaggtctccctgactcttaaacacatgctgttaccactatgcccactgccccagagagagaactattgtggacaccaacaggattgacctacaagcaaaaaaaaacagaaaacatgtgtcatgattcatttattctttagacccttatagaagttacttttgcctctttcaagtcaaattttttgcatgctggcttttagaaataagctccactggtttgtaaattatttaggggtaaggacaattttttgctcattttaattttctttgtatcatctaccatagtgctttgcacatagtaagtgttcaataaacattttcagtgaaaagctctaccaaaagctctatgataatggagacacatcaaatttctgagtggcgtatctgtctatctggcagtttacagagttctgaatttttaatatatattttgtctttaggcactttgtagcatggtgccactgatggatatgatccaaatgaatctttctttgcttcttaactggttgtatagctgtgggaaagttactttgctattctaagactctgctttctcatctgtaaaacaatactattatcataggattagagtacggataaagcccttaggatagaggctgactcatagtaagtgctcagtaaatgtcacctatcgctatgattaaattaaaatgttaaagaatatgtcctatattaaagaaattttattttagaattgttaaatatgtgtgtatagacagggccaagagaatgaagtatgaacaattatcctgagatctggcattattaagaggaccgatttctgggatacagatttgctgggaattactgttaaaagctccagctagggaggatgctccctctggggcatctctgagtagtactgaccacagatgtggattcctctctggggataaaaatttcaaagggcataggctttctgaaagtgctagtgtcaagcttcttgcctttttactccccatggcttaattcagtcagttcccatccttcagttttgtgaaccaggtcttaggtagatctgcagtgtgtgtgtttaataaggatttactcaggaaataaattgtgtctctttcaccttcaagcctacccaggttaccagtggggagctggcagactgtcaaatcctattcttttggggtaatccatggccagaagcttttgtggaactcactacaggggatgtggctgcttgtcagagatgcaaacaggagcactgaagcttctgggcttaagtgagttgattttcaccaagtttttggaccctcttcaaaaagtaggactattctaggagcttaggggagggatggatggaagaatcacagatttctaagacacagtcctgaccctcagagatgtgtaacctggtgggacagatggatatattgacagctaaccataatgcaaggtcaagtgaaacatgagccttgctcatggtacaaagcaaggggccaagaaacccagaggaaggagaaatcacacctaactagttggttgagaaggactaagatttcaaaagctagaaaagcagggaaagggcattctgggtggttggagccactgaagcacggaagcatgtcagtgcttagatgaatagagattggcaaattgtgtgggtaactggagtgtgggcaaggtagaggatgcaggagtgggcgaaaaaacaggccagatcttgaactccaccttcaggactttctagggccattttaggtcttcttgaaatgtgttgtccctggaggccctgatgctgttgatagaaatcatattaaaatgccttatatcccacattatgattgatatgtaatgataagagccgagttgagtgagttgagctgtagttgtttcagttacatatagatgtggtcctgggaccaatgccagtccagggagagtttggaatcagtttgggataagtacagaacttgagacattaccacatcaaccaagtgtgtgatcgtttttctagtaattcctttttaatttccaaaaagattggttcacaatatattggtccaaaatacactggaaattataaaattttgatggttcaaaaattttcatacattggaatttttacataaaagtttagaagcattaatctgattgaaataatagtacattttgaagacatttgacattgaaaatgaacttgaagatagagcaatagaaattatacagtctgaactgtggaaagaaaaaggatggaaatacctagtacttaccatcatatctacattacagtaaattatgcctaaaccttctgaattagttggagataattttgtgacaagtacagaaatccattcaaactaacctgaaacaaaacaaaatgtgtgtgtgcatgggttgttgttagaaggttatagaagtcccttgtattagtctgcttttatactgctaataaagacatacctgagactgggtaatttataaagaaacagagatttaatggactcacagtttcacatggctggggaggcctcacaattatggcgttagagcaaggggcatcttatatggcatcaggcaagagagagcttgtgcaggggaactgtcctttataaaaaccatcagatctcgtgaggtttattcactatcaggagaaacagcatgggaaagaccctcccccatgattcaattacctcccacgtggtccctcccacaacacgtgggaattgtgggagttacaattcaagatgagatttgggtggggacacagccaaaccatatcatcccttgaggaattcaagggcagggagctgaatccaatgctaaccagcatggaggctgtatacatataaagacctggtccccttgatctaacttgagacaactgagaagggacatcccagctcagttgtctcaagttagagcagctaccaggttgcctgaggcttttattggaattttgtcacagttcagtgcctccctccacccaatcctatttccattttctccttcccaggtgatgacctcaagaggactcctgaattaatgtctgtacagtaacttctcagagtctggttaccaggtaactcaacgaggaacactgtacctccccatcttcctctcactatccctccctcctcacttcctcttcctttttgctctcccttgttccctcttttcctccctctttttctcaccctttttctctcttctttcctctctctattctctctcctgctctccctcaaactgcgtagtttctcacctctgctcctttctgagctctcatgtcattctcttctcattttctgaccagtttcctcagctcttccggcacatggaccatgatggctgcccccagatggtgccttcagctccccagtcaccatcactgtggtatatgctgttggtatctcaccccgatgcctttactgggctgatgtcctcatcttgcagctgctgtgggtgtcagttaataacagctcatatgtgtacccttctctggaggactatcctttaccaactggaagcttctctcctggagatgcccaaaaggttttgccccacatgccttagccaatgactgtcagatgggtgggggcatgcaaaagtccatcctccttgcctcaaggcaggacacactctgtggtacaattcacactctggacagccccctaggatcaggtgcaggctgccttttcctgtctttgcatagcatcttcccctgttccatgttgctcctctcactcccttcaggtgtagcctcggagcactccctcaatcaatccctctgcctctaaggagcctgatttaggctcatctccttacagatcctgtgcctgtggcaaattggctcagcctttgctgtcctaattccaaatatccaggagacagaactctcttaaagttctttctctttgaactcccattcaaagaccagtgctccctacgtgcagcttggctcaggctgagctcagcccagcatctaggacaaacacctggagttcatttcaggtgaacactgggaacacattacaggtgcaaccttctgtggctgcagaggagacagagttaaatagaatagggcagatgaagggtacatggagaggggacaactctcagaaaaggctagtcagttcctgcaaaggtgaaccctacccgtgtcctcctcctcagtctttcttgaattaattttcttggtcttctctttacccctcatcaatcttcccatctacatgccaagttctaatcagatagtgaatgtttgaaaagtggcaccacatgatggagaaaggactaggctgagtgtcaggatggaagatggtcctaattcagctagctcgcttcacatacacctctgggtctccagctttaaggtaaattagagtcaatttgctagcttcaacagtcagtgcttttctgaaaacaagaagggctggctgggtgctttggctcatgcctgtaatcccaactctttgggaggctaaggtaggagaatttcttgaggccaggagttgagatttacctgggcaacatagcaagaccctgtctctacaaaaatttaaaaaattagttgactgtggtggtacatgcctgcaatctcagttatgcaggacgaccacttagcccaggagtttaaggctgtagtgagctatgattgcaccacgacattacagcctgggcaacacagcaggaccctaaaattaaaaaataaaaacaaatagagcagaatctgggtcttttaatctctgcattcctgaattcagcacaatgcctggcagaaaaaacattgataacgtattttttaaaaggagctattctcagccgggtgcggtggcttatgcctgtaatcccagcactttggggggccaaggcagcggatcacctgaggtcgggagttcaagaccagcctcatcaacatggcaaaccccatctctagtaaaaatacaaaaaaaaaaaaaaaaaaaaaaaaaagccaggtatggtggcaggtgcctgtaatcccagctacttgggaggctgaggcaggagaattgcttgaacctgggaggcggaggttgcagtgagtccagatggcgccacttcgctctagcctgggtgactgagcaagactccatctcaaaattaaaaaaggaaaaaaggagttattctctaaaaaatgaaatgatggagagttacattaagataataaggtagagcatgatcccaaagtatgcactattctgagtgtagggtgcctgttggcaataactatcacttggtaagggctcagttgtgccagttccatgttaagtattctactgctgttgtgtaacaaatcacccaaaaacttagccatttaaaacaatttaagccattttattatgctcatagagtccgtgggtcaggcctttggacaggacacagtggggatggcttgtctctgctctgcaatgtctggggcctctgctgggaagatctgaagtctggtagtgacttgtgagctggggctgggatcacccagaggcatcttcactcacagaaccggtggctgaggatggccttgtctgggtctgttgaccaaagcacctatgtgtggtttctccatgggggctgggcttcatcacagaacagtggcctcaggctagtaggacttttgaaggtgtctgctcacagctccaaaatcaagtgtcccagtttacaagataggagagaaacttcatcatttttatgacctagcctcagaaatcaactatattattcccaccacattcttacaagcaagtcataaactaattcacgtttaagagtaggtgaactaggtactgcctcttgatgggatgggggagaggctgtcacagagcacatgcgatggcagatattgttgtggttatatttgggaaataaaatctgccttgcatgtactgtctcaatccttccattatctttggaagtaggtattattgtccctctttacagggaaagaaactgaggctcagaggggctaagcaactggcctatggacaaggctagtacatggcagagttggagttcaccctagtctgtacagagcaggtgttctccagtagcatatgatgctgcttacaggaaaagggaactgaaaaaaataagacattcaaaggccagttcgggagtgaggtattcttctctcccataatcctgatgtcagagttaatatcttccccatatgggaatctggttcctgtgcataactccccagggagttgcttcccagaaactatgtaagtatgtgtgtacctttgatgcctcaagtcttccagatatgcactgtgtgccagcagctgctgtctgccctccccgaccacacttatatggcaaaatagtccagcaaacaatgagcaggagcaagctctgaccccctccgtgaaggcagcacacagaaccagttcgtgccaggaatatcttctctgccgtgatccccctttaaaattacatcttccctttaagtgcaaacaagaacctagacttccagaaagtcatcttgatactcccaggatacttataatctggaatctttagaaggtacttggcactcactgcttgctctgtaggatttttgtgttctaacaccccagttagtcttctaaggcctcagagggcaaggttcatgccctattctgcctcagtcccccacccctgctatacaataccccattcttagtaggtaggcaataattaggtcaaaaggcctcagaaagtttattatattataacaggaggacacgtgcttctttaaaagcattttttgagagcctactctatcaccggcattgtgctaatgacccatgtgatctagaagcagaaatttagaaaatcaaatatgagccttttgggcattctgcagcaggtaaataacaaatcaaaattggtatctagaagtgaagcatccttggtcagattaagaggccttcatgacaggtacatttgaggcaagcactgtaaggttacaatctctatcagctgtcagatgtttagaaagaccctaaatagggtattgagatcctaattcttgattttactttctcctagaaattgtctgagtgatgattttagctgggcttatcagtcaggaaaggatgggtcttgctgtccttaatttcaaatcagtcttcttgtagtaggcaaatttctctacctttcttttaatttgtcaccatttcacctcaaattatccctaaaggccatgacctttggaaatacctttgaatgttcaaaatcagctgatccagccacagataaacctggtcataatcaatgggtaatcaatatcatattacccataattttatcttcactcattcttcacatcgtaaatccttgatccaaatacaatactattatataaaactatttcttcaacataccaacaacaagaatgaaacagctcctgtaaataattacctctgggatatgaaagaaaatgtaaacattttatttggcagttgtttctgtacacatgaataaataaatggaaaagtacatattaatatttctttttggagtaacagataccattaaacgcttatttacacatcttcactgcaaagaacagttacacaattaaattttgtcttataaaaggtaacttcccacatcactggactggacagttaaggatggagatactggtagtgcttggttctagcagtctcaatgtttgaaaggcattcatttgcaagtgtgataagaagagtcatcatgcattgagttcatccgggtcatgtactgtagaaaatttctgatggcagccacagaatttggtgtctcatgcgcttaagtcaactatgacatgtttgtaaatctgtgtatttcccttaaaactggaagcaaaaagaaaattacgcttattaatggacacatgtgtgaatgatcttggtgcctgaacatttaattcctgaaatttcacaaatttggctttctctgcatcccagttatacacttgagtaaaggagtaatcacttccaagaattgcatattggtaattatttatttgaagaggctggaacaccatggatcctcgcgatggcatcctctgaatatcctggaacgaggagcctccccatttcatgactttggaatcaccaatgaatcttgtcaagcaaatgtacacgtcccctttcactgagaagtgcttcactgcgtacacatcctccatgttaggaatgtcagtttggttagtgaataattgtgttgctttgttccactgataaattacaggacgctgggaactactagacagaattaaatgaggcgttctgagtgtctgaggtgttctgactatttctagatattccacatcagtgtccctgtaccacgcgtgtaaggattgatgggagtagaatccgtttccgttccatttgtaaatggtagtaaaaccagcttttgaactgtcagcaacaacaaagtaccagttgttttcaatcttgaatgtttcaatgtcattgggttttcggattttgagaatttcaatatcctggatttttatgaatttatttgcaaaactgtctcgcttatagatgtgagagccaccaaacagctgggccacaataacatagagctgagtttcaatgactataggcttgcatactacagtggatgtgcctgggaaaagacaaaggagagattagttgtgtggccatcctcttttggagcatgtaaacatgcgggctggggccatacaacttccacccaaatcagcctgaaacaagagatctccttggttgattaggcaaggctggtctccaaagcccaatggcagcagtgtcctaaagttccgtgcctttgtgcctcgtggggccttgttgccaacaattgagttgttaatgtcatatctagcctgcgctagacgttcaggacacacagctatggcccgagtgttctcctcttacttcttgcagaaagaaagcattagtttccctgacacaaatgagttaatcataattctaatgaaaactactgtttactgagcatctattatgtgctttctcaatttacctcattaattttcccaacaatcttaagagataaatattatcctttttccacatgagtaaactgaagctcagagaggctgttctggtagcagaaggcagagttggggattcaaagccaggcctaccagcatctctatgcttttaacccaagctggggacaagttagctattccaggacttcaaatttggtttatctaagatcttagataaccaaaggctagcgttgtggtctgggtagcccatggctctactgtaattgttttgctctaagtctgaactgcttcctgctctagaataatttgcctttcccctgcaaagaaaggagatgccacttgtcacttttctggagctttaggtcactggtggcaggagtgaagagaaggaaaaggaatctttaaaaaaatcgaaagaagggtgcagccatgggcactgctcctgaaagttattttggaaaatcacagaaaatgatgtgggatctgtcagtggcctagcttggtatcctttggggaagagtttgacatttatcagtagattctgatcttgcaggagtttggctctagaaaatccagagacagctgaacaaatctgggctttaggcctcttctgactacagcgctagtgcggggcagaaagttctacattaattctttctactaattggcttcatccataggcaaaatagttttatttctgactcttttcagggctaaactgattgtatgatcttaagaaaatcatttaacttctctgaggctcagttttcttttctgtacaatgagactttagactagattaaggatggccaccagattccaacacatgtaccaatactgattggctcattgcgtgtgattgtctggggaactgtgttgagaaggattctgtggccgtgtctgcactctacatgaaagattcccatgatagattagtggtgcctgtctagagtgaaggaagggataatgactgagtatggggcatatatttgtcatctgctatggttggaatgtttctgtccctccaaaatttatgttgtagcttaatccccagtgtaatagtattaagaagtggggtgtctaggaggtgattagatcatgaggactccacactcatgaatggaatttgtgcccttgcaaaagggcttgagcgagtctgttagatctttttttgcccttctgccatgttaggacacagagaaggcaccgtctttgaagcagagagtgagccctcaccagaccctaaatctcctggtgccttgatcatggagttcccagcctccagaactatgagaaataaatttctgttcttataaattacgcagtcaaggtattttttgttacagcagcaggaagggactaagacatcatcctagacaagatgagctctgagatgccctcagaaagtttgcagatgtatgatttatttctcttgtaagtgctcatctaaagagtcattcaaagaaattgatgaaccatacacaagtaagaaaagcctggtttcgaccgcacaaaaccctgctatagtccactggaaaacttatgggggcctaaggaagcatgaccttcttccttcagagaggaggattctaaaagaaaggaggattccaaaagggtctcagtttggaagggatccctttatttaagcaaccccagcctcaagcaagccccagacctgtcttggtcctttgagcaatgagggtgatggctaccagcaaaatctatcatgaccctccatgccttgtctaaagggttaccttttatggggaggtgtgagtgctcttgagagcagatttaaaggtattagaagctaaaactgatattaaaaattgtagagggagccctatgttctaacttatgacttataattttaaaaattattaaaatgggaaagaaacttaagagatcagctaagtaagcccaggcaaggtggtttactcttgtaatcccagaactttgggaggccaaggcgggtggatcacttgaggccaggaattcgaaaccagcctgaccaacttggtgaaaccccatctctactaaaaatacaaaaaattattagggcgtggtggcacatgcctgtagtcccagctacttgggaggctgaaggacaagaatcgcttgaacccaggaggctgaggttgcattgaccccagatcacgccactgcactccagcctgggtaacagagcaagactccatctcaaaaaaaaaaaaaaaaaaagagagatccagataagtaaaagttttcatagaaagaattagattccggccgggtgcggtggctcacgcttgtaatggcagcactttgagaggccaaggtgggcggatcatgaggtcaggagttcaataccagctttgccaatatggtgaaaccctgtctgtactaaaaatacaaaaattagctggacatggtggcacgcacctgtagtcccagctgcttgggaggctgaggcagaagaattgcttgaacccgggagttggaggttgcagtgagctgagattgtgccactgcactccagcctgggtgacagagcgagactctgtctcaaaaaaaaaaaaaaaaagaaaaaaaaagaaaaaagaaaagaaaagaaagaattaaattccatggccaaattaagggtgaaaaatattggaaaaatttcctcactgcaggacttctcagatccacagatgtctgtattatgaacctacaagaccaagatatggttcatgaatttattggaccacaaaatccttttcattacaaggcatacattaacattttgtagaagacacgtttgtgtaacaaatttgagacttattgatctaaaataaccttcttattttatagttaagaaaaaggggttgaggggtgtcagtgagtatgagcagcttgcccaaatagactgtggcagaacctggactagaactcatgattcaccatccaatacttttatttgaagaaaaataatcaaatatttactgtttatgtattatactagaccctatgctaagtttcttgaatatgtgttcacatgatcttattaacaaccttgtgagttaagtattaatattattcccgttttacaagtggggaaattatggcttagagaacaatcccaggtcacttaacaaatggtagagttggaattcaaatgctaaagcattcccctataccactcatctttccttgttgcccttggctgaagcagtttaaattaccactcaaaatatcattaggcttttcatacctgtaatgttgtcataattccggaaggtcttttccacatggtcccattcaaggaaaatgcattttccagtaaaaggctgagcgatgactacatactcatcattcaaataagaaaaagtgtctatggacaatgattgataaggcaggtcttgagactttgcaaattctgcaaaaataggaaataataagtaactgtgagctaatacctctttccttggctagatcttaaatattcacaagaaatacatttatttcagagaatagtaaaatggccattttacttttaaacacatgaagcattgtcaatggttcataatttttttaaaattaagttgctcagctagtttttaagatataaaaaatatcagttcctgcacatgaaaaaaaaaggtagcccttattttaattttttgaggtggaatgatgatgagtacattacctgtaatgatgcaatcaaaatccttcgaggagagactattgattttgcgcttcttgtattctggggggccttcgcagtagatgtcttcaacagttgcattggtgtggccaagccattccactagccatttcagtttacagtcacaattaaatgaattacccctcaggtccctgaaagacaaacttcagctgcttttgctgtacaagggccctacccacgcaggaaagagttctacatcaacaattaacatgtgcagaatgaccttacccggcgttgcatcctgccctataacctgcctggaacctgactgaccactcattcactttgggctcagagagttagcaccatgcacacttgaagactacccagtcaatggaacctcatcacttactccctcttgaattccaaagcggcttagtctagggctgtgctgtcaatagaaacagtatatgaaccgtaattgtaatttaaaattttctatagccacattaaaaaagtaaaaagaagcaggtataattcattttaataatatgttttatttaacccaatacatacaaaagattatcattttgacacatcatcaatataaacattattgagatattttacattccttttttatactaagtctttgaagtccagtgtgtattttatacctacaatatatctcaattcagatgctaaattttaccagaaataggtgatctatatttagatgtcataaaattcataattgaaaaaaataggtgtatatacccaaattattccaagcgtacttaacattttccaataattgagctgagaatcagcttttaaatttaaatttaactgttaaaaaattaagtaaaatttaaaattcagtctctcagttgtactaggagcacattttaggtgctcagtgaccataaggtctggtggctaccctattggacagcacaggtctaaaggacagaatgtagtgattattgtaatgtatttaatcaagtgagctatttgcttttcttcttcctcacagacataattaatcctgatcctcttccgtggtctacaaattcagtttaaataggaaatgactttgacacagcagagttaacacaggcatacaatcgctcatgcctgtaataagttatacagcatagaccatttacatatccacatatgaccccaactcaccaagttctctgtgtatttgcattgcttctgttcaggaattccacctcctttcctggtcacacagaattcttaagataggtgctgcctactcttcacaccacacataaataatttttaaacgcccaaacatttaaaaatgttttttagaggatactttcaagaaagccaagaaatccactaaaaggcaagttggcatggatccttgtacttctaagataattcttgatttgggcatattagagtaggtccaaaaggctaaacccatcttgggattcccatgagagactgagccaatttcaatatttttttgttttgtctttcactagtgtagggtatagactgacacaaaaatggggtaaaggacccccaatgagctacatcccacgtcacccatggagtgtgttctaacttccaagacactcccagaactgacctagtctcccaagagaactctgacccacactaatgagtggcaacctttcaggctactgtaaaccagagaggataactatggtctgtccaggactctcttggaagaatcctgatttgggcattctcctggaattaaaccatatcattcaggaattgaggtaatagacatggaggaggggctggggaaatactgcaaggaacaaagaaagtttttcattaggctactgatttgaagttaaatactgggcttggaagaaagtacttgactcagattttctttttgtttgttattggagaaaagttgttttgaatatatattctacagacaagtacctgaataattttttaaaaaagcttttgttttcatatatcctttcatttgttcctgtcttccaccttatgacatttaaatacctttctaatgttctggaaggcaaataatgaagctgaattgcttttgagaagtttaggcatatattacttgctttgcttacagcaaaatatacaaattccttgcaaagatctttcactcggaggcttaaaagtcaaagtttgaaagctcttttgtttgaaaaagggtcaaaaataattaagttcattcccttcctggggcttaagccaaattcctggggattaagcttagagttgttgttcagtctaatgagaaaaaaggcaaacttttctcccttcccccacttcctgttccatttctctgttgattgaccaacccaaggatgtaacctttcatctttattctgtcagtttcccagactcctttatgtttttcctttgtagccctatttcctggacctcatgagaaaaaagggattttgaaatttctagccgggtctcttcccaccccgtcaaagtcctttatcatcgctccctgccgtattgacacacactttgtcaaaggaatgcctgggtgccatgtattcagaattcccaatgataaataccatagaagactcaaatgttagtccatgtaaatttaaatttttggccagttaaaatttagatttaaaaatcctaattttaatttaaaagccaattaaaaattataataatcaataccaggcttccttgttaatgactgcaaattaattaattgttcagtgatttcttaggtcctcttacacatttgttaaagaatccaggcctttgaaaatatcttttgggagtgtctggagattgttgtttgcaaggctcctggaaaaaaaaaaaaaaaggtgatgtaaactgtagtgataaattaaacaaaggcatttaatgataaagcttagtgatgagtctcttttgtcatttccagcctactaaaagacttgtggtcctttttttttcttctgaactactactcagattcctgctattgtcctttcagttcctaacctgttcacttcaacacccactccatatttatttacttttatttcttgagacaaaagtctcgctctgtcacccaggctggagtgaagtggtgtgacctcagctcactgaaacctctgcctcccgggttcaagtgattttcctgccttagcctgccgtagctgggattacatgtgcccgccaccatacccggctaattgttgtatttttagtagagacagggtttcaccatgttggccaggctggtcttgaactcctgagcttcagtgatccacccgcctcggcctcccaaagtgctgggattacaggtgcactcaatatttaaacaacactttatgttggttaaaaacaacaatgattcctgggcattgatctttccatttagaacagaacacgagagattcacactctcagacgctcaatctaggggatatctcccaaatgatgactaaccaaactggtgagtgtccatctccaaaatgcgccccctcctcttgcctgggctgccccttctgcctgcttcctcctcgcttgctccggagagcaaccaaacctccaacccacagtgccagtagctctatctcttccccagtacatcctttctcctttctaaagcccacgcctccttttcctttctagcaccattcattccacctcagaaaaaagttttcttataaaaacctatccatctattctctttaatcatccccctctttctccttcttctggttcttttcctgtgatcacaggaatgtttttccctttccctttctatttgttcttccgtaaatcactagaatgattctaataaaggttaatgagtaaaaaattgtcctgataatgtcaaggaaagggaaatgtgtccctagtacacaaatatagacatagcacagtgctaatgctgtatgactggggaaggtcaccaagtagtgtaattttctatttttaaccagcaccatatatatacacgttataaacttttcttagaggtgttttttttttccacaataaaaataaaaaactaaactaaaactaaagagcccataccattagcctctaaacccttgaaaattctctcaacttccctttaaaacattctcaaaagtctatgtcttctacctccactaattaaatataaggtttctcaagtgcaaacattcatgaactttagaacttatttttaagttagttatgttgtttttctaggttttagaaattactgctagtttggaaaatggttctcaatgaaccttggaatgcaagaataggaactgagtcagaatgttccattgtcaatgacggtccaattgtgacaaagagcatggcttttggagtgattctgagctatgtttgaatcctgactccagcatttactggctgtgtgactttggtaatgtatcttcttggaaattcagttgtttcatttttaagtgaagataataataccttatctcataagattattgaaaaaaggaaatgagataatcaaggatggtgcaggtgtctgaactactctcagtagagtggctggtgtcagaagagaacagcttctgtacgtatgttgtccaagaaacaacgtttagaaacagaccacatgaatgaactgctatggctgtccacatacagcaaaattaataaaatgctgctaaggaagactattcaagagaatgtctccataattcatcttactgactggtgtttgaatgaagagattttctgatgtcttggaccagtccagagtcactcccatgttatgtgtctcagtttattttctggcacaatgtggcttaaagttatcatactaacttctaagtggatgtcccttcctctgaagctggtaaaaactgcaactggctgcagagcataaatttagaggaggctgagtcacaggacagtgggcatgcaatgattaagcagtcaaatcctgaattactactgccaataggggctatacaggagaaggcaccatgcttgtcttactgtccaaggggaattctttttttttttttttttttgagacagggtctcactttgttgtccaggctgaaatatagtggtgcaattacagcttaatgcagcctcaacgtccctggctcaagtgatcctctgggctcagcctctccagtagctgggaccacaggtgtgtcccaccatgcccaactaagttttttttatttgtagagacagggtcttgctatgttgctcaggctggtcttgaactcttgggctcaagctatcctcatgcctcttcctcccaatgtgctgggattacaggtgtgagccactgtaccctgtgggattcttttaaataatgagtgaatctggaagttctacttcctgcccaaaggagtagagctttaggcctcacatgatccacgtgcaagctaaccacagaacagatggcaaaacagagctgcagacttggagctatggggcttccagaatggagaggcagtatttttgcatgacaagatggagggcttctaattcaccagaattgtgagatggggctgagaaggacaggctggcccgatgggctgtggaatgaggcattaaatttcctgagaacctcttgtgacaggcttttgccttgggaatcagagggtgggggaggcaggggagccagagggagaaatggtgggtggattcgctgaacccagtgtcaaccctctgatgctccgctaccaaaaattcaatgaaatccttgcccacaatgaactgctcttagaggagagagaatgaagcttcatgtctaggtttggtgagtgatgggcatgagaaggctgcctggattcactaagagaagcagactcaagaggaagcaagattcagaaatgagagtgaggcttccagacatccaaggctagggagctggagttcagacagcttccctaagtctctgggaggctccagtgacaggttacatttagataaaaagaaagtaggcagagggatttgggcagagaacgacttaggaaagcaatgctgacagagcctgagaattactctgcaaaaaatgtaacaggttgccagggcatggtggctcacgcccgtaatcccagcactttgggaggcagaggtgggcggatcacctgaggtcaggagtttgagaccagcctggacaacaaggcaaaatcctctgtctgcgaaaaatacaaaaattagttgggtgtggtgtgtgcctgtggtcctagttactctgggaggctgaggttggaggatggcttgagcctagaacttgaggctgcagtgagccatgatcataccactgcactccagcctgggtgacagagtgagaccttgtttcaaaaacaacaacaacaacaacaacaaagagatataagggatcatgtaaataaactatggtccatatgtaacacggaatattttgtaggagattttaaaaatgaggtaggtgtagggttactggaatctttcacttttctgtgtaaatacatatttatgttgtgagtttttatcatcaagcatgtattattattttataatcagaagaaacaaagaataaagttgactttttgaaaggatcctgttgcttagtatttgtatatatctatggttctgtccaatgagggttcagtcattcgaaatcaatcgtttggctgcatttgtcaagttccaaagctacctacagggttagattaggaattaccgaactcgggggcctgagtggtcaggtcatgcaaatgtctttcacaagacctcctgcagcggggagctgcctgtttcctagaaaactctcatgcggtttcaggccctcaccctttagggaggtttggggctacagggcagccgaggcttgaagccaccgctgtggttctttgcgccagcttaaagccagctgtgatgagggcctgttgcctccacaaatcatcatgggcatctgagggcttcagggagatttgctgcagcggagggctgctgagggcaccgggctcaggggcaacaggaaaaaaaaagggcaagtcacgcgacgttccctgaagcctcctcagcatttagtcattaaaaaaggggtaagtagaatgagatcctgtgtctatcagggaattttaacagctagagagactgagatagcactttgtgggttagggttagggttattttagggttgatattaggattatttgattcttcagattccacctctgcaccgagttttgctaccagaaagcaaaatacctggataaaattttcccagttctgtcttcatcccactcccagcttcacagagtaatgatataataatattattattaacttttcctcaacagaagctctagttgctatacgtgctaagtatttttaaaactggttgtagctattctttcctgcatcacttaggggagtatagtggtttaagtgccaacttcgtccaaatccaccagggaataaatttgaacgtcatcactcttaggaatgtgtccttagccaagttaatttcacctctctgggtttctgttttgacatctgcaaaactgagtaaaggatatgaatttcacttattgtgagaattaacacatgtagctactaatatttttatatacatatctttgtaatggattccaggaaaaactgtatctgcaggtgaatttttaaaccttatgtgttaagaccacaaaactaatctttttctttgttgttattgtcattaaacagtgatattaaatatctaaacactttaaaatatttgcttcaggaagctgagatcatctattctttctgcctctcttagtagggataatcctatgcattggtattcttaaaagtcccatcttttacttttattgatacacacacacacatatacacacactacatatgcacatatatatggaataataattatttcttcacttcaagaaaagttggaaagtgcaaaaattatttttttaaaaaaggagagaaataataattatcatagcagaagtaaccactgttaagatttagtcatgttttcttccagccattaatacagagcccatcaaaagcaagtgattctggaacatcatgttatggatcctggcccacagagtgtctagtccttctctttcctctagagtgtcatgactagagagagtgtcacgacttgagagagtgtcaccctgaattgcagtaggggaccctccttcctctgcaaagatctgttagccaagagctgttaagcagagctgaattttaatactagatataagaattcttaattcttaggaataggaggaagaaaaattatgaaggacagagaggcaaggagtcccaggtagccaccagagttgtcaggaaaaagactttctacatgttttggtttaaggagtaccaggctcctgtgttggccaaagtggaccccttgccagtcagactcactttagggcccagaactcagccacagagtacaggggtgacgtggacagggaagtggatatctgagtttgagctcaggctattcccttttctataaagtgaatgatcactgggtcagaatgatctccaagtcctattcttgctcttaaatcacagctttgtcattttcactgagaggctatggcttcatctttaaaattaatagatgacactaggataggtgatactttaggccacgtacttaggggtcagtgagtttgacaacaggcttttccagggcatggaggtcacactaggtggcactagaatatctgactggggtggggtggagccgattgggagaggggtgaagacacagtcaatgagagacttgaggaaacatttaatcaatgttcttttatttctaggataattctgcaatgagtactagaaggatggttctctttccattatctgtagtgctagcatagtgcctggcacaaagtaagccctcaatagatacttttatttatttatgtatttatttattttgagatggagtctcactctgtcacccaggctggaatgcagtggcgctatctcggctcactgcaacttccgcctccctggttcgagcaattctcctgcctcagcctcttaagtagctgggattacgggcatacgccaccatgcccggctaatttttgtgtttttagtagagatggggtttcaccatgttggccaggctggtcttgaactcctgacctcaagtgatccgcccgccttggcctcccaaagtgctgggattacaagcatgagccaccgcacacagcctaatagatacttttaaatgaatgaatgaatgaggcaggctggagtagacgagaggacgcgtacatatctaggcaaagaaaagagcagaggatgctcctttgaggccccctgtgccaaggcactgggggagaaagctcaaagccctgtgagtgactagtgcagtccccaccagctggtgtggacccccacctcaggaaggaccctccctccccacagccccactgtggtagaaatcccaaggcaacgtggaggctctttaaagttgccttcaactaagcaccattctctaggtcctggttcaaagttcacctaagaaacattcttttatttatttatttacttatttatttattggagacggagtctcgctctgtcacccaagctggagtgcagtggcgcgatctcggctcactgcaagctccacctcccgggttcacgccattctcccgcctcagcctcccgagtagctgggactacaggcgcccgccaccacgcccagctaattttttgtatttttagtagagatggggtttcaccgtgttagccaggatggtctcgatctctgaccttgtgatccgcccacctcggcctcccaaagtgctgggattacaggcgtgagccaccgcacctggccagaaacattctttaaaacaactgagatattgcgcagctgaatgtctagttaccttgaaactggctgagtaaggtcaagtgttctcaaaggcagacggccattccttcttcacagaaatgatgaccatttcctgccctttggtgttttcatcatttacccaagaaaacctccgattgtgactgtggaacccactggaaagtcttctctctaaggcagaccagactggctcaaacaccgcgtttgtttcagtgccaccgggctctgctgctaagaaagcatcgcccacagccatctggggtgcaccagcccccctgcaatgcagattctcagcttgggtttgtgtctctctgaacctgcggcggtgcaagtgcagttactttaatttcatagaaagtgtttaaaggggatatacactgtagcatttagcattctgattcaggactaatggaggttatgcagtgagttttagttttttcctacacagtggtgcttactacataccaggccctgttctgagcactttgtagttacttaaatttcacagaaaatgtttaaatggtatatacactatagcatttagaattctgatccaggactaatggaggttgggcagtgagttttagttatacagtggtgcttactacataccaggccctgttctaagcactttgcatttattaactgacttaatctcaagacaaccttgggcactaatactcttaaatgccttgttattccccatcccattttaagagattattattataaccccattttacatgcccagtctgtagcatagtgaagctaaatggcctgccccaaattccacagctgttaaggtgcaaagccgaggaactgatctgaggtggagaaaagtgcactttgaagcctaaagtcttaaaaaggaaactaatggctcagatagatgccagatttattaataagtagtaaataatggaaaataaacttgtcctattgagctggcagagagacagttgaacccaggcagtctggtggcagagatcaccctcttagctgctacattgcactacctctttacatataaggcaatgtgaaggctaaaacaaagacatcctgtgcaactgattgggaacacacaagcatcctgagtttggggactgttatatagtcctttgtaccccctcagtgctgagcaaccattggatactctacaatacatatagattgatgataattttctccaaatatttatatatatgcatgcaaacaatgctggctccactgggccttagccacagtgacacttaatggcacacaaagcaatcattactaaagactcataggtattactagaagccaatacataatgtttgaagattttgtcatcattggccataaattaattttttattcataaactaattttttattcatgttttcctgattaccaaaataacatatattcatcagaaaaattcaaatatacaaaagattactaaaatatacaaaccattcaaacattaaagtgaaacatgcataacattagaacaatgattcaaaacaaagtaattgagaatcccaacatttgacaggctttgaaaggacttaactttaagaagtctctctccctttttaagggttaatttgcagggttttaagggttaatttgcaggggaggggaggatctcgcctgatagccaggtatatataataacttttttatatttatttatttatttatttatttacttcttagagacggagtcttgctctttcacctaggctggagtgcaatggcgtgatctcggctcactgcaagctccgcctcccgggttcatgccattctcctgcctcagcctccagagtagctgggactacaggcgcccaccaccacgcccggctaattttttgtattttttagtagagatggggtttcaccatgttagccaggatggtctcgatctcctgacctagtgatctgccctccttggcttcccaaagtgctgggattacaggtgtgagccaccacgcccggcctataataacttttaagttatctgtaaatgtctcttagaagagaaatctactgacatctctgtataagaaggtgagaaagtgcattgtttcttaggcgtgaactaaatttatataaaggcgcaggtaagggagtggctttaatgttaggccagagtgggaaccagctggacctgaaagtatacgtctaatcccaactatctgcattttgagatgaaatatgagggtaggtttcctgttttcaggatcttttctttcttctctagtcatattttctcctcaaatcatgtcccatggaaggatccagccagctcaataaaagctatctggtcctgcggtaactggcacagtggacgtagcactggacgtctcatcaaagacggtgggagctgtctggctttaccacttagtaactggggagcagcttcaactcatggtatacctccacttgctcgttcatctatgaacctagtgctactgccctgtctctttcacggggtcgtcaggagactatgatgaagtcaagaatatgagaaagctttgtaacctcttcctgcaatgcatgcaggttagagggtgaggtactaattcctcacagcttgaatgtttgccttgattgggaaggattgatctgaggtggagaaaagtgcactttgaagcctaatgtcttaaaaaggaaactaatggctcagacaaatgccagatttattaatacgccataaataatggaaaatgaacctgacttactgagccggcagagggaaatttgggtttcagatcctccctactccatctctccttgaaagacagaaaggaaagaaggaaggaataaaagaaggaaggaaggaagaaaggaaggaaagaatgaaggatggaaggaaggaattgtaccatgaagaatagcataatttgaaaggagaacataacttggggacaaaggcactcagtgagaaaatatttgtccaatttctcttgctagcctgagcttctctaaggtgggactagatcttactcatctttgtaggccctactccttgtaaagcatgtgtcacatcttagaaactatttaagatgaaccatatggcattgccatttttgtagataaaaaacagcctaacattggcaatgccgtatcagtcaacctaataagtgttagctaaagatacaagagacctaagggtcatattcatttagccacagccttaacccctgttccctcataacaccttcctacctccagcaccagctcagagaggtgggacttctctttcactgcctgttaagagtcatgcctctctttgaaggctgcccttggtgttcctcgaacctgaaattttctgaatgttaagcgtgttctgtatcagtctctctctcttacaggctccatactgctaaagaaagggcatcattaagacccatatttaaattcccatttcatttgatacacatcataggctccagtaaacaaaatgggtgtcctacactaggatgtcaaacagactttttctttccctttttcctcttccccttccctcctttctcccccttcccttcctctctcatcttccttcctctttttctttctccctccctcctttcctctttcctcccttccttccctcctttcccctcccctcccctccctccctccctcgctccctccctccttccttccttccttctttctttccttccctccttccttccaagacagggaaacattttttcctgttctgtgcatggagcctgagagaaaccacaggcttttaggctggagaggagacacagctggatgaattgggctgtgcatcctccctacagctctcatgatgctaagcactggacagaggccatgtggattgggatgtatgtgaatctagtggatttcaagttgaggtcatgaatttccatttctccttccatatatttgtttcttttgtttatttgttgtctgaaaaatgaggtttggcagtgttgagctctgtgataaaattgcatagcattcattctgtaaacagccatctttgcatcatatcatgtcattgacatgaagagtagtattgcaaacactgtttttttattacaataactctatacagaagccttgaaaggcatgattttgtaaaatatatctggctattagcttctctttgctacaaaacaagcaacaggagagaaaggggcctggtggaggcagagtgacaaccgcgtggacacactggaaatcaggctcagtccaaggacaggcatttttgtctcctttgttccctgctgcatcctagggcctagagcagagctgggaatgaagtatgatgagagaacaggttaaagctgacagaatgactatgacacttggatctcttgcatctgtatctagaactgataagatacatattaggtagattgagaaatagctgttgaaaggatgaagagtcactgcaattcaacaattaagtagatgttctcataattccgtaactaatcagctcacgaggcatatatcccctccaagactgtttcctcatttctgaaacagggattattgtgcctgtttggcaggattattgagaggattagatgaaaagtgatgtaaatgttagtgccttttctttccatgctcttctagtttccttaaaataatctgtgtgtatgtgagagtgtgtgtgtgagtgtgtgtgtgtatgcacatgtgtgcctgtgtgtgtgtgtgtgtgtgtgtgtgtgtgtgtgtgtgaatgtgtttgtctgtagagggtgagggaggctagaagaaacaaattgtttgggtcctgttgttcagggtttctcaacctgcccacgatgccactttaggctggataattcttggtcgtgaagggctgtcctaagcagtagaagaatccctgcctttcacccactagatgccatttacatccccagttgtgacaaccaaacatgtctctagatattgccaaatgttccctgggagacaaaattgttccctgttaagaacaactgctgttagctgtaatcatccattgagtaattaaatatttcactgataaacaagttgatcaggtactatgaagacatcgcctgtggctatattatgtttaaatgtatataaagtgagggcttatagagggaaaaaaagctgatatcaaattatacagtcaactcataatgatccatgaagcaagtaatgatgtagataataaaagaagttatttcaggcacacaatttccctgcattagattgcttttctaattgtggttggttttggataaaaatattaatagtaatcaatttattgaacaccctctgacagatgacagggaaagatggcaagtgtgcatggagagaagtcatttgggtttcttaaatttttatggacactcataaagtaggtgcattaaccacaggtgatcaaactgcattgtccattagcaagcttaaaaagtaatagcaacattcatacttacaagtgaattaatgactttagtccccggaaagtatgtcttgaaattgacttgatgttgttgttttctatgaatctgcaataagttataatattttttgtcaaacagttacaggaacttgagagtacttgtcctgaatcatcatgttttaaaaaagcttttttacttacaaatactctagatgtggaagaccaataaaagcatcatcactgatcacatcaaaggagttcgatgtgaataacctgcccagaaaaagtacacaatgaaaatggtgaaactgacagattgtcaatcttggctgcttttatctctcagaaaaatgagtgggagttgtatacagaaaaatgtctgcatggctgtctgctacagtgttagttatgcagataatctatgcagcatttttttactcctaatcatctcctcatcaaaggctcatcaaggggtgcctggtgcccgattcctcacaatgactgccacataccctgggtgacattttgagatacaatcagagcagctatgatagccaaagcagccaaagcaacattttacatattttcatgacaaaggcactaacaatcttttctgcttgttctagaaacctctggagtgttctaactggcaaaaacaatggtactttgcggttttgagcctgggaaacctaaaaaaaagtaagctgcatgcctggttgtgctgtgacatctcgtaacagacaggcagttgacactggctccatgaacaacagccaacctcctcctttgcacacagactgaaaatgggaaacatgaggtttgggaagagtcttagacccattttattaccaaatagttgaagcttttacttggacaaatatatttgcaatttcaaaatccacaaggatttggtttagaaattactgatgaaaaagaacatcaatcagccatcccacaccctgttgaactccttggagaactgaatgagaggcttaaaagaggtagttttaggccaaacagtacaagaatatattatattatgtcataatgtaataataataatagtaattctgttagtaaagcttatcacttttacttctgaagccagggattaaatataagtaccactaactagcttagtgaattcaccgctgaacctgtgaactacaggaattaaaactaggagatctcactttgtgaacatttatgagtaatttatttgtcatctgggattgcttcaaataatcagaggagggggacaacaaggggttagagaagaattggcatgagttgatgatttttgaagctgaaagatggatacataagagtgaattttactattttgtctacatttatatatacttaaaatttttcataaaaatgtggagaatggggggtaggaatgaaccaaccaaacaaaatgagatgatttcttgcatttcttcctaaactatcaatcctagagtggtgttggattgtcttctaatccctcatgcctctaatgtcatggatttgtacccaagtaattcacgaggctctgaaaagccagtactaatgaacagtgacacatgttagaattccatgttactaaaacaaattcaaagctgtatgatttccatcacagctttggcaattgtgtctcttctcacttcatggctctggaaaacaagaagactgctcagcttgactccaaggtaagctaacacccaaaggcttccttaggttccagactttcattgcattcagtataggcagcatcagcagtggagagaatggaataaggaagaaattggtacacacaaatattatacctcccacactcactgatttgaaaaatggcccaaggaccagggacttctcatattccaagttgccagaagaaatagtttccattgctacttccctttatgttaaatcagatgcaggacatagtgggaaatgaatattagtgggcagaacttgcccatgcacgtcacgggaagaaaagagaggatttctgctagattttttgtctgcttgttcatttcttatccctagcacctgtgatacagcgcctgtcctctagtggacactgaataaatatttgttggacaaagaggaattcaccttacactaaattctgatcattacgagactactggattaaatatttcttacagcaggaatttgcccttatttgttttggtgtccccagccccgggcacagttcctggctgaataatgtttgttgaactacatttcaaggactaaaacctctggtgagaactacaaatgcatatgcaaaactaaggatgaatattcaaggaaaggagccaaaacacaataaagtacatcctatatgactgtacttatataaagtacaaaaactaatctatgctgctagaatcaggagagtggttacccttggaggcaaggagtaattggaagagaacacaaggggcatcttttggggtaatgataatattgagtttcttgacctgggtgctggttacaagggtattcactttgtaaaaagtcattgagatgtacatttataacgtgcactttttctttatgtatattatacttcaatttaaaagtttcttataaaagctaaaaaaacaccctctggctaagataataatgaataccataatctctcaatgctaaattcaattgtagtttctatggaaaaagatgtataaaattatacatacattctaaagatagttgagtgggctatccattttattatcctacgtatacttaaaaagactcctacatcatattctatacagaggatgaaactctgacccttaatttgtatggattcctctaaatatgtttgatttcattattataatttgttattgaaccagatatgttaaagtattccacagtctctgttaagggaaaccgtgcccaacccaccccacctacacaaaaaacagaactggggcagaccagggtggccgtgttctacactgcacaacctctgtccctttccacagagtagccagtctctaaatcaaccagcatcccatggcccaagtagcctggtttaaaaaggtgagttgggctaagacgacacccttcttggggatctggaattggcagactgagaaatggagccagccggtagagaagctaaaggataaaggatgccttagggttgaattggatccatggtaggtaaaattacgtgcaaagaatgcttaggagagtgtagaattgtggtggaaaacccaccaagataagttttttgaagactggtgtgggagagatacctagatctgtgttgaaacctgagccaatgcttctgaatcctgcttgctcttggaatcacccagacagctttaaaaatactgatacttggttcccactcctggagattctggttaaattctaaacgtggggtgtcacctgggttactaaaaagctccctaggagactcatatgcagccagggttgcacatggtaagcttgccaagtcagtcaaaacactgtcccctttacctgtggtgaccaaggggtctctgctccttgcagcaagtctgcctggagccgttggtgtggggagtggaggagctgtggactttcttgtccctataactacgtgtagcctagagtctgcaataatatgagttggaagtgacaactatcctcacaacagcagcagcatcatggaggggtttatgaaaccaatgtaccatccaaatgacctcgttactctgagccacagatcagagatctggaccctgtaggcctgccaagcagccagcccgtgggtttgtgcagaggttgtgcggaatttgccctctgccccagttccatgggaacacttgaggtttctcctctttttttagggaagcattttcctaagaagccaggcattttcccctagaattttggtggaggtggacacaggggtgtgcctgatctgtctacaccctccccaaagggctgtgcacttattaattcagtaagaaaaggggctgtgggaggagaggggaggcttttttcttctgcaaccacgggagtatgtttccttaccaagagggagatttagaaaaatcatttatatgaactatgaattccaggcaggtactagcttattctttgaataatgatctttggcttcataatagcctacatgtcatagactcctgcctggattttcttatttggtctttagacaattctgtgaaagtagtaaagcaggtaagatctatttgacagaagaggaaactgaggcccagaaggctaccaaacactttccttgaggtcgcaaggcccaagacccctggttcagtacccttttccacacactgggtggcctctcagcacaggtcccaggtcacataatggcataataaccacgttctggcgagcagccataataacaccactcagctcatacggatttaagaaatgtaattaaacaataatgcctttcttagaggaattaattagagtaagcagtcttaaaatcacatccagataatatcaatctgtgtttttcaagtagaaagtttgaaaattttgaacacgctttgtgaggtttttccagtttttttttttttgtttctttttttgacaaagtctcgctctgtcacacaggctggagtgcagtggcgcgatcttggcttactgcaacctccgcctccctggctccagcaatcctcccacctcaacttcccaagtagctgggaccacgggagcgcaacaccaagcctggctaatttttgtatttttttttttatagagatggagtttcaccatgctgcccaggctggtcttgaactcctggactcaagtggtccaaccgcctcggcctcccaaagtgctgagattacaggcatgagccaccgtacccagccttgaatacactttggtgaattctgtttataaataatatatgctcattgtggaaattctggaaaacacaaaagcttaaagaagaaaatgaagtgcaccataatcatactacccaaagacactgatatgcataagcataatgcatatatgatatatacacatatgtatttataaaattgatgtaatattatatcattgtgtatccttcttttcatttgcttattatatcatgaacaatttctcatgacaatcaatttttcaaaaatatagtttccatagatgagtaagttttgtattatggatatatcatgatgtaactttttaaattatcgattccaatgtttactattataaacatgattataaccatccttatatataaatatttttcctatctctacttatttccttatgatagacttaggatagatttctaaaagtaccattattagattatagaaggtttttaaatctctagttctttactgctgacttgtaccaaattacatgtccaactctgagtaaggaaatgcctatctgaccatatcctcaccaacatttaaaattatcatttttatttctctatgaaatcatgtcctttgaccccttttgttgctttctaagcactttttatttattaaggatattacttcatcttttcctatttcttttgatgctaaaagttttttcctactgattaccaatttgccttttcattaatgatttttaacatatagaagtttaaatttgtatttaacaaaatacatcaactcctattatgtattatttctttgcgtttaatcttttttttttttttttgaaacaaagtttcactcttgttgcccaggctggagtgccatggcacgatctcggctcaccaccacctccgcctcccgggttcaagagattctcctgcctcagccttctgagtagccgggattacaggcatgtgccactgtgccggctaatttttgtatttttagtagacacggggtttcaccatgttggtcaggctggtctcgaactcccgacctcacgtgatccaccctcctcggcctcccaagtgctgggattacaggcatgagccagcgcgcctggcctgcctttaatccttttttaaaaaaattataaatttagggggtgcaagtgtagttttgttacatggatatattgtgtagtggtgaagtctgggcttttggtgtaaccgtcacccgaatagtgtgcaatgcactcgttaagtattgcatcatccctcccttcctcctacacccccacccttctcagtctcccatgtctatcattccacactttatgtccatgagtacatattatttagcccccacttataagtgaaaacatgcggtatttgactttctgagttattttactcaagataatggcctccaacccatccatgttgctgcaaaagacatgatttcattctttaaatatcctttcctgtcttgagatcaaggaaatattgcctacatcttccccttaacattttctttttaatatttaactcttcaatacatttgggacttacttttatgtatgatgtgaggtaagacacagccttgatattttctaaatatttacccaaatttacccaaggctttctgttgaataattaacagaattaacagaatctcccctatttgagtatgtgatatccttcaaatgtctggcacatttttttttggcattttccaaggatcaaatcttcgatttatttttttattcccactgttttctaatttattattttatcttttctttattgcttttctcctgatttccttaggatacttattaagtttagtgctcaataatatacttttattctttctgattaaaaaatgaaagtatttagaaatggaactttactttgtgtaatgcatccagtaagttttgctctgtactcatcttttaaaattgcgtatttgatttcaatgggaatttagaataatattcttaaaattgcctgtaattgttttttttaaaaaaaagctttcataatttcattattaatattgctctgggatcagaggatgtgacctgtaaaatgctaacattaagctctaattcctccagattctgctgtctgtagggacgggtcatgactaagtgacactttcacaccaaggtcataaagctattagggggttcctggttgaacggagaggtaggacacacagaatttacttcaaaaggaacggaaaagtaggcaacagggttaacatggagctcagagttcagagggaaccagggccagcaacagagaagtaaatgaagaagcagaggatctaagaatgaggatatagctacaaggggtcaagggtaaggctgcccaaataccgggtgagaggccagagacgggaatgcataagagcgaaaggactgggcaggctcatgtgttggtgctaagtctggtgggccactgaggtgctttcctgccctggggcctcgcctcttcagaggccagggaagcagcacactgaagagtgaatcaggaagcctaatataaatttgaccataccttctgtgtcctagagcataccacttttctctatgttgtaaagcgaggagactagactagatcatttgtgaggtcttttgtagctctaaagatgtgtgagtctatgcttatagcactgtagccttcattcatgaaagagtaggcatgtggaatctggggagcggggaggctggtctgcagatggctgaatggttgggggaagggtgactcctgctaagaaaacttcccattgtctcaaactagactgctcatttggtcccgtgccaggcaccctggctctaatgacatgtacttcttcagactctctccagtcacctataatatcttgattgccattagaattgtatctggcccatgagtggcctacatcccatgtttcagcctagagcagattttcctggctatggaggggagatgatctaggaggctcttccagatgattcccaactccacaaaaaccactctgattaagaagggaaaagtgagtagccagtgcctggttgtcacttggagaatgaattgattggattcagaatagagaatcaggtttctaagcttgtaactgccagttattattgtatgtttacacatcaagtaggtaaatctgtttcatcatctgttaaaataggattgaggatgcaaaaagacttcctggatgattttaagaattatgtgagataatgtgtatgagcatgtctccaatgcttctgccaaggaatagctaagtaaagagcacagacatcaaatgtcagagctggaagagctcttacttagatctaggaaaagaacacgtgtttaactgctaaggaaactcaggtcccgtgaggatgtcacctgccccaagaagactttgatggacatctaggatattaggtaggacacggacagtgtgtacaaacatgagtgtgcacactcccaagtgaacatgggtttatttgcatatgtatatgtatatgtaaatgaaagagcacaggatgcacaggttatagctgttggaagatatggagggacagctggaggggcttgccaaattgcttagagctggctttgcttaaatgatccaaaccctttggtttttactaacactctcctttatccaaaagaatagggctggttaaatgataattaataataggctgatgattcactttagttaaatgcacacattataagtgcatgtgccatgtgaataattcacatttgaatatttaaaaatatgctcctaacacagaaaagcattaaaattggaagcatcacacacaagtacattatttgacagttctttttgactctcaaccttgaaaattcagctgatccttaattagattaccaactcttcaacctggattgattggaataaccttaatttggttccacactaatctgagggttgggggtactccagagagatacgtagtccaactcctctttttacagatgaggagactgaggctggcagaggttaagtgacttaaccaaggtcacatcttttgtcagtggtggggctaggatttaggatgtggatttcagatttgcagggatgtccttgacatgcacactagcaaacattcgagcatggaccctctccttttggagtggtaacccccttttggtaatcctcaatcctcctgggattatctctcatcccagagcagtggaaactcttcctttctaggaattggcacagctagtcagcagcccaccctccccatgtgtttataaaatcaccctggatctccccagtcctggaacatcaaggagaagggtctactccatgccaggcctcatcttcaacagcttgacatctgattttaatcctcaaatgaatactaagatgtaggttttatattctccacgtaagagataaagaaaaccgaggtgagggaggtgaagtgatttgaagcttgtaagtggcagagctgggattccaggctcaggcttcctctctccctccccgacttccccaggactggtgagtggccatgaggaagccagctccctctttttagtatcagctctgcctagtatctgctgcaaacctgcaacagtcttgcccagaatttcccagagtgtattccctggaacgcacgatcttcaaagggttgagaggtttatgtacacaaaaactggcagatacatttaggaaaagtgggttaaagaagttaatcagggttcttaactgtgccttttctatccttaagtaaattgagactcttcaaaatggaattaaatatacagtttcctggtctcattgacaatgcgactcttttatcattgagcttcctacaaaatgaatattccatggaacatacccagggaaatgcttgtttagccatttagaaaatagctgtgatgaaatctgctccaaataaaaacagtgacagtgtatatttacacactcagaagccttttcctgttgaatgagctgcaagaagtcatctccttcctcccaaagatggagatctactgggaggtccctaaagaaggggtgtgtgctaaattgcttgaccaggtagagagcctactgaggagcctgactcccagaggtcacatcaacgaatccacactaacaaaatggtcttgagttgctccttatatggagacagaccgtttaatgtatccactaggatgagattctttccacctgcgtatcctttgctatccaacctctctagaatgaggtggggtacaaatagttaagctaaaaataagatgaattatcacatgcatatatttccaaagtactgtatgttccatagaaccaatattctatgggatgttaagaaaagtgaaacaattttgaataatttcagagatgtttctatgccaaggtaacttcattgtaaataaccaagcagggatagaacgtgcagtttcccaaatttatttgagcacagaactcttctttcaggtcaactgctccacaggacacaagtttagacaacagtagtctaaggtgtaactttaaagtaaataaggcctttttcttttgcttttttcttttctttctctctatttttgtttaagcaaggagatcagagcttacacatataaatgagagttgcaacctagggaaactagctgctcttgccagcaatgcggccactctttcaaagggcttttgaaactcctttcagtcattgtctccaggaattagggcacattctcctgaaaactcttgttaatggcaaaggttgaccctttgagaggggatttgattttgggaacaaaactatgcaaagtgaagcatgatgattcatgttcaggaggaagtagacagaagtggttaaaagtgaggacatgggtttaaactccaactctgctacttaataggggcgtgacattgaggaggttatcttttaggactcagcgcttcatttgcaaaatggagataattatatctacctcaaaaggttaccatgatgatgacattaaaaatgagatctataggccgggcgtggtggctcacgcctgtaatcccagcacttcgggaggccgaggcgggaggatcacgaggtcagtaaatcgagaccatcctggctaacacggtgaaaccccgtctctactaaaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggggacagagcgagactccgtctcaaaaaaaaaagagatctataaaatgcttagcaccaagcaatacaaaaataactaatgtctctaataaaaccttgcctggttttattgcgtggcttgtaaactggcaatgaagacaattctcaaaggagggtccagaaatctttagccatggaagcacagttgggcaaaatctatggccctctgtgaagtcaagagttatttgtatgtatacattctagtttgtatttttaaagatttattgccttttgatcacattttacacatgcaagcacctgccatcttgctatataaaaatgggcctaacaatttttttccaatccttgctccatgagagggatactgaaacatcattttatcatcaaccaccacagggagagcctggtaaggtccctttggacctgtttgggagattgggaactacaattattgtattaataaccttataacagccagtttcatattatgagtttctttcaatgaacaacctaatgtattggtttgttagaactgattcaataatctttgtccatttcttttttttttttttttttttgagacggaggcttactctgtcgcccaggctggagtgcagtggcgcgatctcggctcactgcaagctccgcctcctgggttcacgccattctcctgcctcagcctcccgagtagctgggactacaggcgcccgccaccacgcatggctaattttgtgtatttttagtagagacggggtttcaccgtattagccaggatgttctccatctcctgacctcgtgatctaccctcctcggcctcccaaagtgctgggattacaggcgtgagccaccgcgccaagccatcgttgtccatttctttaaccatgccatttctatattatattaacgtaactgtttgtagaatacaacagaattttaagataggaggagaccttagatgtaattgaatgcaagggtctcaaaatgccaacttatatttgtttggtctttatcctgtttaaaaatctacttccagaattccaccttcccctaaaaatgaggaagatagggctccatgtgcatgtaccacaatcccatcagcaatagtcagttggagcagaggatttttaggtaagacatgtcttctctggtttacctcagtcaccactactccttattgtcttatactcaactgcttccttcattggtcttaccgccccaaaccccactagcatttgagtttcagaaccacagtttaatctacctctaatattttatgcaataaaagctgaggtccagtgatattttgtgacctacccaaactattaggtagttttgtgacctacccaaactattggatcacgcagcccaatagtggccaaactgagtttcaaacccatgtttcctgatttctagtttaggcctctttctatgctaccatagaaccactcatctgaagactgccaatattaattatttaaacaaaatctggcatgttttacaaaacgtggtgccagtcattttattcatgaggaagaaaggagagggttatgacttttttttgaaaggtaaatagttcatgtttcctgtaagaagtatttaaagaaaagatttctcagcaagttctgctggggaactgtgtgtagaaccacaaaatgtttaaagctgagattatcggcaaacccagattatacaatcagacactaatctgatgttatggtagttccaattaaagtgattttcagatactgtaataaagctaatgtgtattgagttacaggaaccttgcaaagcatttttcatgcattgttttacttaatccttactgtaattctgtgcaataggtactacggttcttcctcattttgtagatatagatatcaagacttgattaagcttgccccaaatcatacaactaggaagaagcagagtggggatttgaacccatgcttatctgcccacaagtctgtgttgtctgcctcattgccagctcaccagggtcagctgttttgatattacagctgatgctgtaaagcccttgcagacattctgtagcccgtattagccacaggatcaacaaccagcaagcatcaccatcatcactaatcaactgaatctcattttgaacaaaatgagaatgcttatcaagactaccttataatacatttaaggaggccaggcacatacccataatcccagcactttggaagggtgaggtgggaggattgtttgaggccaggagttcgagaccagcgtgggcaacatagcaagacctcatctctacttacataaaaataattttttaaatgaaactaatgcattcaaatacaggcaaagtataatttaccatatcaagaatcactaccagcttggagctgccatatcagggtgaaaagtgacagcgtgtcactcatctttgtgtccttcacaaagcccaacattgtacctgctacccagtagagcctcaaaacatgtctgctaaaatgggaggcttttgttttcattttgttgctgcttgcaactatacaataaataaatacttattttggctaagcagtacttaaatcaaaaaggaaattatctttgtgttattgatttttcttttcatattaataatgcttaactaacatttccctctggatgtccggtcaggctggataaaggagcatcttacccttcccaggacagactagtcggcctctgcagtctgactaaaaaccaaggagaccaaatgtgaagtcagcgtgggacacaagagattcgagcggtgggtctaaggaaaggcttagatgctttgcctttgaaatctggtatgctggaaatctctgctgaggaagtttgaattcacaacttcatgagcaaatatctcctcgagtttttttagttcggctcacttcccagacctccacactattagtccacgtgaattcagatagggtgcaccaaacatcagaaagagtgtgaacatgaccagcattatctgctgagagtaacacaggagtcttcagcacaaaatcgatggaaacataaactggattcaacaaatacatgggaaaacatgtctgggtttttctctgggaccacagtttattggtgatcctccatgaaagacacaaggcagatacaagcaccataactctagcaaatggcacacagtgccagacatcagtaaagtctagagaatttgagaatcaacagaggtcatagaatgagatcctgcagaacttgtttgggcacgtgtgtgtgtgtgtgtctgtgtgtgtgtgtgtgtctgtgtgtgtagagtcaatgatgtgagtgataaccttggacaaatagaaagggccaaacactatggatgccagctcaggtgtctggactttctctgtttctagggagtcatgaaagcacggagagctgtgtctcaggaaaggcagcgctaatggagatgggtcagatgggaactgaaagcagacagtgaggcgtggaggctcctgccacagcctgtgaaacagtgaatgaaatgcagcctcagtgaaagcagtggtgctgtggtgaagaggaggaggcagattctcatgctgtcggacaggatgcttgtccaggtggaagtggagagtgaaagagaggggtcaggtaactctgaagtttcttgcctgaataactgaaaggatgaaatacactttcagagaaaacaattgtggtgagtgctagtttgtgcagttacgagaattaattcacttcaagtaacaaacctgtacatggaccctcgaatctaaaataaaatttaaaattatttttaagaaagtaaaaacaaaaaagaagtaattaattaaaaagttaaagattagatctatggatcattgggcaaactgtagacaaaacagcctagatgactgaaatttttgctttttggtccatcatgggggcatcagctggatacaaaccaaaacgtgctcacctataaccagctaataattcctccaaaaacacccttggctgataggtttggcttgagtggtcattgaagactgctaaattgtaggcttctaatataaggaggaatagaaaaaggtagcaattgctttaaaggtaaaggaggccatggatattttttcctggacagatcatattttgaaggactaaatgataaagccttagtaaggatggacttattccttcttttgttcatgccttttgcttttccatttgtttttagtttttaatttcttatggatcaggtatttatgtgttgattgtggattaatttttaaaataacgctattcccctcctttgaccctgaaagatcaattctgtctttcaaacaagaccacatccaattggaatactaagaaattttttctggtcatgtcggattcttacgtgcagtgtttttgttttgtgttgttttatttgagcatgatactaaaactaccctggaaatcactccctgaaaatagaacactctcgggaattacaggggtttataattaaaatatgttataagtgggtggcgaagtggccacattttgtcctcttaaatttgaatttcacttccatcatgagcccatatcattggggacttcagtctgtagttgagaaggaacagggctgtaatgtgtgaaaacacatttccctaaactgcattcactaaaagtaccactttctatcactaaaagcaagctagaacgcataatcgttgtcattggttatgtttcgaaactggccctatgtaaaacatgaatgaaattgcatttgcttgggaaaggtttttattgttatgtttaaacccataaatgagatttttaaaaaatgtatattacaactaatctaatgaatttttattgaataattttattctttctctctcttctctacggaatgtgggtttttgtttttcttgttctccaacacaaactgccagccatggcctaccaggatcttttcccaaacactgcatgtaacttcagataccatgtctattttcctcagtaccccagactgacatttcaacaagtacttctcatcatagctttttcagaagctctgaaaaagcatctgggggcatactgacattatcagatttttagggtggatgatggaaataggacatttgctttaacccttcccaacaataaagcaagaaaccaacgaactgtcttcctacgtcaatcaagccgaattgattctgaaatttatctcttcacagtgtatgatgggtgagtgtggcaattcacaatcacaaatgctgttggaattcattgcaaacctcaatggcttgtgtgatctaggcctaatctggtggtccaatgccattggtcttcatgttccaaagggggattggcagcccatatggggttttcagggcactggacagccctgtctcacagaagagatctttctctgtgggatccatgcattcccacaattgttatgatcgtttcatagttcatattcagagccttctcatatatttcctacacaccgcacatgagtttattagaccttttcctgaggataggcggaagcagagaatattgggcaagaaggatggagagcagagtcttcaggcacagggtcctggagattagggacaaactttggcccctgacaattttgcataagttcagctctggcacaagtctaccatgttgaggttagccaatctgagttaaccgagaacacactgggagagaattactcgccttttgttatttctgaaacctgaactgcttttagaaataaaggctggaatgttccataggaactcggagcatggggcacgggcatggcacacactcggttgggctatttaaaaaccagtcccttggcttccctctgtgattctaaatacgtgaaatcacattaccctgcagcagccggtaactatttctataacattgtccagcatctgtgcttgccgtgactgggtccacccaacaaaaacaaagtggagatgtggtaattgattaggttaatcactccaggctttctgtgccacagctaatgtccatctagtgtctactgacactactcctggaattttaaggactgatctatgtaactagatctatgtaacttcctaggggaagggaggtgccttagcatatcaaaaggatgctttttaaaagagctatttattcatttaacaagtgaggaccagaaacacaatttatcactttctcagagacagcaaattcttatcctatggaaggatcccagcattagagactctgcccctttctgtgggaaagaatctatcttttttggatttgtttgatgtgctaactaacacttcccccagtcacaccactagccatcaatcaaacagataaaccccttaggaatatctagtcaattgctaatcatttgaagacatcagccagtagaagggcattagccaacatcattacataatgtcaaaacaactgatcaagtttgtgaatccaatgaaacagtcaaaccagtttaggaatttcatatacacaaaacaatagatgagtgacttttagctttttagcttgatataaaatttttaaaccctaccatttataaatgtgtaagcatttggcacaccctatgccaagtgttttatctacttaaaccttggaagtatgtgttctcacttccattttaaagataagaagactgaggcttagtgagatatactaatctgcacaagactacatgtttaggttctatgagtggcagggtgaggtttaaacacttgtctctccaacgtccactccatgctgtttgcctctgtgtatgtaacttcaaacagccaaaatggccaagtaaggcaagaaaataaaaaaataaaaaacaaacaagtgaaaggcctgggtcctgaatcatgcagttaagatagccaagactcagctgatccacaattgtctaattctgcccatatccgtccagctacaaaccaagtctgcgacctgatacctgagtcctgggagacctcttgacccccatgtgataccgctgtaaggactaggactccaattgccaaacattacacatcagaacaaattttatgtgttccattatgcctgtgaacagatctgatttcttagtcaaatattatttttttgaatattttcaggcatagactgagtatgtggttcccttgtggccaactcaaaacatatagcagagagtaatcctttgcactatcctatattaatattttctttccctccttgtaatggaactagttataaattagatgagattaaaaaacagtctcttgagaattaacattttaaggaattacctagaaagagctgaggtgttttttttccccacatggtaaatcatacagagtagcagcctgccccagatccccggagacaacatcttgagcgcatatgttatgctgggttctgtattgactaattcaaaaactccagggcaaaagaacccaagttcccaagttaaaaatgaaagtaaaatagtggaatggaattgggatcattgttgcaagattccaacaacttcataaatagccattaaagtagacagcatgacaggttaacagatttaccattgtaagaatcaacctgcactgttggtgtgaagtcgcaaacaaacccatctacctctcactttacggatattctgttttctcagaaatagaatcacatttgacaaaattaatattgagatcattttactagaaggcttatccaaatatatgccatattaaaaatagtcatgatataaatatttctcacaagagctgcagcgatggcgtgaataaaaaactcccttctgagatttcagtaaaaccagatctcacaaaggatctgaaagaaaacaaaaaagagaaaacaaacaaacagacacacacaaagagacacacacacacagaacaaaccttatgttaatccggtttagcataacagtgactattttgacactattttatgaagtacgatactattccttcccagatgaagtaagagaaatgaatcggctacaggtttctcatgataatgttcagggctgggggtatctaagcatgttcagtagcagctaaaaaaatcaaaaattctaaatgcagcaaatgttagcactgtcaaatggccaagcatgcaagaggaatctctctctccatgcccttctacaaatacatgcaaagccccaaatccaccggctggaatttttaaatcgtaaattagatatcaaaatgcttacgggccttacaatgagataacatcaggaggaacggtgcgtggaatggatctggcattctcacataaagcattatctttggtacaagtacacacggcagggcattttggcttcgctggtttcttcccctcagtcagcaaaagcgcagataagagacataggaaataagcaattcttttcaggggaatgcaggcatttcccatccttttgcttctttctgattccatgcagtcgagaaaatatccccaaccatgaacagggcttctggaattcagatggtgattgtcttgctctaagaacaggtcacataggagtccacccttttcctctgcctctgtatctctgctttttcaaaacagagacctgcagctgattcgtgagcttctcctcgctccagcaatgcactgctcgggggaagagacctgtgaggtactgtgagatgggagggatccaactgctggaggagagagccgacttgcatcaccacgaaaacactgagcacagaccagccttcgaaggcaaagtgaagtgatgtcacagaaaataaacagctttctgctttcaccgggaggccctttaattgttaccaaaaataggacggcattatgtcttattagtgagtgggtgggcgggtgggtgggagcagtcatcttgcataggatgtcggcaatctcagaaacctctgggagtctgcttttcatgtagcaaacaacctagtaagaaaaactagctttggagccagccccggctggaaaaaatgaagctaaatgaaactctctccacaatattgggctaaaaccttttgatgtttcttgctgagcctacctggctaatgccatcagtgaaagacaaatcagaacagatgaagaatgtgactttcaggggatgaatgtgagtacatacttttctgacacttattaactgtcatgaatgattgattttcctatccccctgggtcccccacgtaattcattctctccttccatgacaaggaagggaaacagaagtgcgggaccctctctgtgtataatccacctccctctcttctcccaccctcccttctttggcagtagcaccagaagcctggaaggaactccctgccagcaggaggcggccagctctagcttcctggggctttgaaaaaggcctggctcagccccgaggctgtgacatggtgggggaaatgctggactgagaaccagacacctggctttgagaacgcaggtctgctgtgaacttgctgaatctattctcctgtctgtaaaacggggatgatagtaaagacattctggaattaaatgaaaatgataggctatgttactcgtgtacttgatgtgagcggatgggcccttggaaaagaaaattcatttaaagaagcaatcaagagcccctggccttggggtgggatagtttagtccaagagagtaggaagacccttgggatggaggaagatgaggaaaacagacccccggttatctcactatggcgaaggcggccatccttcaagctggcacgaacagcctgggatatcagtccacgttcctttctcctctagcttcttagactgaaagtattaaaaggactgcttgagcaaaggcgattttgacataacctcattctgcatcagagctgaaagcattgccattctaccctttcgctcatgtagctggccccatgctaacttcaatcccttgttcagttctctgtaaactctttgcgggggacagtgccattcacgtgcattctcacatttgataactgtctgtttaccccagaagattgcaaggtccacgaggttagagaccccgctagggaacccagggcctgtgtagcattgtgcatgtagtgggcaacctggatggctatgccagcaacagcagagtgtacagtccattcatggtcatgcccagccaaataaacttacagttgcaccttgcagttctaataaagagatctaacctagtcaaggaagtcaggggccaattccctgaagtagcagtgattgagctgagttcagaggtaaggaggagttacagagagggttcgtgagaacactccaggtagagggaacggcatacataaagtctggctcatgatctgcagagcaatgggacacctctgtagaatcaggcaggggagtgatattaactggtttgtgtttcaaaaggaccagtaggttattatcactaagtcagtttttgtggggttgtaaatactgtgtgttgttttttacggaagggaaaaagaaaaactcttcgttgacaagaagtcatgattttaaagtgtattctacgaatgcttcactgtcaaggactctgtggaggagggaatggagggcagtgtttttagaaactgtgacctctgcgcaagcctcactttaaacagtaaaagtgtcacttaaaagttggctgcaagtcgggtttttgtaaattgaaccctgcttcaagtgcctagtggaaacttgctccgtaaaataattatgtggtaaaagttttatggaggattgtttttattcaaagtcaccctctaaatcaactgacttgtaaatgatgtgttctgtaactacaaaatgaagacatcgagaagattcagggacctcaaagatcctggattcgatccctgcatattacagatggagaaaccgaggtacagagaggacacacagagaccaccactctgcatggggtaagccccatggcagaaacttggttacaatgactaatgtaatccatcaggctaagtcactccctgtgtttcactttcaaatgtttcaaatcatgaagattgcttgactagctgttggctttgtggtatgaagacacagccgaagaaagggtgagcggtctttttcttttgacttggtaaagctaggaaggcaaatgaatgaggggaagaaatcatatccatactattcactttgcagctgtatttatctggcagttcagtttgtcagttcaagggggaaaaggaccattggggaggggaggggaggagaaactctaaggacaaattacaatgggcattctgaaaagacagtaactttttatttttctatggcatttaaaacccagacttgaattctttattcaattaaaaacacccactaaggtcagacaaaatttaaccatgtaatgcaggatgctggcggcctttttgggaggagaaaccacttcctggctccagaattggatctgaggagagactcggggagatgagggcagttcgctgcattgaagtcttgagaggcctgaagaggaggccccattgctgataatgcttcccatcttactgctccaggaagccccagggagcacagagatgatgtaggaagcaggaggtggaagcttaggggtttccaccatcttggaggccttcagataaggtgtggccacccacttgtggatcacaatagggaccctggggagaggggcttggaaaggattaaagcagagttggaaggaggcccagggaagccaggaggcctagctgaggcaggctcaatgcccagtctgagctgtagaggagtagctgagctctgcactttgccagccatatgaccatgggccgatttacccttcctaagtcacaattttctcctctgtaaaacgaggataataatagtatgtatcacatagagttgttgagaaaatgaaacatgataatgtatctaaaagtgcttattgtgcagtctgatacgtgtgaaagatttagtatcatcttcaccgtcatcaccatcattctcatcatggttgcaacaggacttgaattctgaacatgtgacttctgggacctgggaagcaaagctctcaaataaaaatgaggttagctgaagcgtatattcactctgggaagcaggcacttctgagcagtatgacacactgtggccttgtcaagggttccgccatgagaaggaaccaagctgcctcctggaaaaaaaaaaaaaatctcaccagtttgggtgagagtaggagcacgcatgcttagcccaaggacaaggtctacaggtggagaagattaaggtggttgtgaatacaggatgaagacttttttcagcctactgcccttgaacacgtgtaagttagaagggagtaagaggaatctcttttgggatccctgtaaaaaagtgggacttctctctaatgtggtgggcaccattgcatggcatgcaggtgctataaggaactatgcacagtggtgacaccagaggctgctgaagaggtgagacaaacaatgctcccatccaggcctgggagtcagactaaagtcatggaatttttcaccagcagcagctcagccttggtggcccagcagcagtgacagccctgcagacatcaaaggcactgggaaaggatcccagcagggaggcagagcagaagagaaggaaaatgagggacaaggaatgatgtttgggagcacatgtacagtgttccctggacatcctcagaaagaccagaagggggttctcgtctgggggcttctggtggttctggaagagctgttgaaagcagagtgagaaaggaacagcatgtgcctggttatgatcccagttttcccctcaggctggtgtggcctaggaaacacacattgtacaagtaaacaaatcactattaggaggcttagaagatcaagcttggccttgcctccttttacaaacactcagacatgcaaactggtgtcattttaagcagctttctcaacagagcagggtttgcaaagctgcgtgtcagatatgatagtggatcgggacatcaatatcaatctagtgagtacaagtagaatttgaaaaataaatcatttcaaatacaaaattggagcatattgcaccagtaaggataactattgccttgtgaagcctttgtttccattctttgtgtgtgtatgaaggcacagctgtgatataaatcatgcttctttcagtttacaaccaaaaaaaaaaaaagaagagaaaagaaaaagaaagggaaaaaaaaactgcatgagaggatgctaaagatcctttcccaacccaggagtccaaaatggcagggaagtgatcttgactccaataaatttcacttactggttgaagttagcaattagacctgtcggaatattgtttctgttcttcactgactgtgtgaacttaggaaagttgattagcttctctgtgcctcatttgcaacaaggaagtaaaaataacaatactatctctgcattgttgatattaggattagtgatgatgtacatggaaagaatgttgcaaaaaaggcactggactactgatagttccactggaaataagtgggaaggggattgagggccaatctttaagattatttggcagtagtgtgtcattaggactctttggtagcaagtgacagacactgactctgccaacataagtgtaaaaggaccttgttgccatggtgattgagtgactcacagaatccaaggaagggttgaccaagcaggatttagaatgaaggaacttgtgaaagcttgggaatctatgtggcaggagctaatggatgatgccctctggcaaattcagtccaacctgttcttatccttatgttcctccccaaaagatgagtatggtggactgatcttgggtcaggcacccctgcccattgccctgggaaagtggggcaccttgactggcaatctcaccaagagtgcacatggtgggagagaggtggttccacaaaagcaagttgggtactgctgtcagagcagagagaacaggctgggcaggtgaaatccagcgatgctcatttgggtaggagtgctgggctctgatagctaatatcattggcccttgcccctaactcaaccttatggttttaaagagaaatgaccagaagacaatttagacaaatagatatgaatactttctccaaggacagctaaactcgcatgttctaactgtggaatcaggggattttcaccttttatagtccatgagaatagaacttgggccaagaaaggggttgagaagtaataataatgaaagctgactcttataaaatgcgtattatgtgccagctgccattctaaagcactttacccatattaactcacttaatcctcataacaatcccatgggctagatagatattactattatttcccctatattagcagaaaaggaaacagagggtcaggaggttaagtcgtgtgcccagggtcctgtagctagtgaaaggtggtgctggtatcgaaattaggtgtcctggctctgatgtccacagcattagccactgctggacactgcctctctgatgggctgtgtggaatgagggataccgtgagctgcttcggagctggtagcacctcactggctgggcgctactattgtactacaattcccagcatgcaactgggctggctatcatcttaaccccttcttcaccaaaagttcctcactgtcttgggtaaaatcttttttattggcaaaatctgatctccctcatggataattatgcaattgaggcataaatgtagatataagtggcagcagataggggagagggtaagattctaagttaaagtaccctccacattttttagtatttgaaggaagacattggagattactatgggaaagattttttaacttagaaatgtgtactatgaaaacgtcgatggggatgttttaaagcacccattctcaaagttggctacactttcgaatcacctggggaattaaaaaaaatacttaaagtttgggtcacattcctagaggttctgatttaattggtctagggtatggctgttaaaagctccctatgaaattctagagagttccccatgggtataaaacaggaggcacagcttgtcatgcagtgggggcatatggggaagcatcagggctggtcaggggcccgagggagcaaggggaaaatgcagacaagagcctttattgtgatttctgcaggaatggtaatgcaagacagggtaaacaggctcaggattggctcctttgaataagttcagtgaactttggggcacagggactgtccctagttgtctgttactggccctggggtgattagagtaggtggatggtggccccgagagacggcccaataaaggaagtgattgggggtatggatactggatcggttggtttgcataggaaaggtgcgccctcccacgtgagtcatttactgtttctcggaattggctaaccctgggagtggcagtccctccagggtcatcagcacagccccaggtgtcaaagcatcaggatacagaaaatttaaaaacatgttgaatgtatccttccactcttcagcagaaagcagctgaccgggcttaaagagaactgggaagagcttgaagcctggggaaccatcccattaggaatggtggtctgcagggaaggaagcaggagggctagtgaaacaaggagaatttcagccatggctctatttagtttatcaagattccaaacctgtcacggaatgacacccaagcgaatgggaagaaaggcggcaagttctgcctttaaaagcctccttgtagagacctccgcactcccatgtttactgcagcactattcgcaataatcaagatatggaatcaagttagatgtccaacaacagatgaatagatagagaaaatgtagcatatacacaccatggaatactatttagccattaaaaaacagtgaaatcctgccattcatggcaacatggatgttggaactggaggacgttatgttaacggaaataagccaaaaacagagagttaaacaccacatgttctcattcatacgtggaagcttaaaaaagttgatctcataggagtaaaaagtagaacagaggatactagaggctgggaagggtagggggaggtggagggcatacagaaagttttgttaaaggacataaaattacaactagataggaggaataagttctagcgttctataccactgtagaatgacaatagttaacaataatagagtttcaaatagctagaaagaggatattgaatgttcccaacacaaagaaatgataaatatctgagatgatggatatgctgattaccctgatgtatcaaaacatcgctatgtgccccatgcatatgtacacttattatttgtcaattaaaaaataaatatttaagaaagcctccttgaaggcagtacccacaatttatttatctttttatgcccttgattaaatgatcattacctagcagaaacagttaaaatggtcttataaaagagaaaagttagtttagagatgtgggctggtactttgctcttaaaaaatagagtttttcttaatttttattaccaaagttaagtatgctgaatttatacatttctatacctgcctttaaactcaagcagaacctgaattaaccattgattggagtttattgcttatgtccccaagggaagcgcctcctctggctcatgctggtgggagaaaatgaaccagccctgctttctctccctggttcaattcccagcaaaggaaaaacaatgtaattcatgatgatgatgacaatgacaatgacgacaacaacaataaccaacctttaacacatccttataatgtgccagaccctgcggtaggtgcattagaataattacctcatttaattattgtaacatagtttggttaatttgcccccatttttcatatgagcaaactgaggcatggagaggctaggcagcttgcccaagaataagaggctgtgctggcttgaaagtgaggcattcagacattagtgtcacatgctcttaatcgctccacagcaccatctccttggatcggagtgatttcctggagcaaaggtaatctgatcttattcacacaggagcaggcaataactgcctgagtacagaactcctatgaggcgattggtgttggaaccctgagtagtctagttacataaccagcataacccttggaaaagctgtcgcataagggaaggctgcctctgggactagaagaaagactatgccaagatctggttctgcaatagatgagctgtttgaccttgggctcaacgcttcacatttaggctctgattttcaaaggaagttcttgggctgggtaatctctggagatcctgtcatgtaagcagcccctgccagcactcctactggggagtgattaccataaagacaaggaaagtgttaagcaggttcttgcacctcccaaagtaagtagcaaatagctgtttgggtgtcctgaggagttctgaaaacactgggcctagttgcctcctgcttcatcttgcaccatatgcctgaagctagtgaatgaataaacatcactcgtggctatttctggatgctcaagaaactttgaaaaaaaaaaaagaattattatttttgaggagagtattatagaagacccaggggaagacagggtagggaggagagtgaggattctctttgttgtgatcctagaattcccattaggtggactggaaatgctagacttaccattgttggactggaaatgctaacatcctgaaactcttaggacctctgcatgaagaattgtcctgccccaaatgctcttagcacccccactgagaaggagtaaaagagtttctcacagtggaaacactgcgaacctctttatgcatttttctgaacatcagtcaataatccattaactcggggaagctgaatgctcttcatacaggaatccaaaataaattgacagatatcctctgggaagaactgtagaaaggctctgtgggcttgaacaaggcatttcatttccttgggcctcagtttctttatctttatagcactaacattctatagcttcctaatttctctccccagaaaggagaaataatttttaaacacagaggcttagaaagagtttgttttccaattcggggcatgctaggtacatgtactgcagttaaccaaaatgcacatggtaaagtttaagccaaaagaatgcagaatcaggccgggcatggtggctcatgcctgtaatcccagcactttgggaggctgaggtaggcggatcacaaggtcaggagatcgagaccatcctggctaacacagtgaaaccccgtctctactaaaaatacaaaaaattagctgggcatggtggcgggtgcctgtagttccagctactcaggaggctgaggcaggaaaatggcgtgaacccgggaggcggaggttgcagtaagctgagatcgtgccactgcactccagcctgggccagagagcgagactccatctcaaaaaaaaaaaaaaaaaagaaaaaaaaaagaatgcagaataaaattatcccagaatatttttaataaggtatgatcttaatgacttagcatttttttctggaaatatatttgaattttatcagaactaagcaccaaaaatttaggcaaggtcatggaaggccaccctttttactggctagacttgaatagaaatctactcaagaaaagaagtttgttagggaattaaaaaaaaaggataattctaagtcatgggcaaggtggaaataatctagccagaaaatatatttgggggtggtactaaggaaaagcagtggctctaagaggtattgccctagagcggggcatggttattggaatataaagttgaaaatatgattactcttctatcttcctcttcttctttatggctgaatcactcccaagatagttcttagcaggtttttatttatttatttatttatttatttttatttttgagacagagtctcactgtgtcaccgaggctggagtgcagtggtgtgatttcaactcactgcaacctccgcctcctgggttcaagcgattctcctgccttagcctcccgagtagctaggactacaggcctccaccaccatgcctggctaatatatatattatatatatatatagtatttttagtagagacggggtttcactatgttggccaggctggtctgcagttcctttttttttttttttaaagatacttcttcattctttcgaggaagttattaactgcttttgttttgttttagttttttggtttaagattctgaagttaagaggaaaatcatgcaactaatctgttcatgctttggaaacttgaacttcatgatgttggatttcagcctttttgcttttgtcttatccctttagaagggatctgttttgttttgtttggctttatactgtcgttctggaagaactcagagctttccattgctgcccgtgacttatggcctgtgttacacccattggtttctgtaggaatgatgacccaagaagctgggaatgtgaccgcagaaaatagcaaagcaatgaggaaactggttatgaccataggattagtgccctgagggtccagggcagaaatgggtgttaacagcagagaagcacaaggcttctgcaccagcctactgctggctcacattcaacactgcccctattgctcccagcagtgcagcaaagaagacaaaggaacccatgcttgctgggccccctgcaggccaggtgcttcccatacattgtctctgttgatcatttcacctgccgtgtgagcaaggcattatccccactgaagcttacagaggttagactcgtccaagacaatatattttggcttcaaactgacttctgtctgtttccaaaaatatttttcatgtgacttatttttgatgtatataaacttatagacagttcttgaattcttgtctatgtgaagcacatattgtgtgaagtatttgcatggggccaggcgcggtggctcacacttgtaatccagcactttgagaggctgaggtgagcggatcacctgaggtcaggagttcgagaccagcctggccaacatgacaaaaccccgtctctactgaaaatacaaaaattagccaggtgtggtggcaggcgcctgttatcccagctactcaggaggccgaggcaggagaatcacttgaaaccgggaggcagaggctgcagtgagtcgagattgcattactgcactccagactgggtgacagagagagactctgtcaaaaaaaaaaaaaaaaaaagtctgcatggtattgtttgcttatatgatgtttagaacaaggaaacgactgaggctgaccatgctctggctctggaggctctctggggatacctggaggagtctttgggtcacaccaaaacactaggatgcagcctaatgtgaagattacaactcaagtcttggctttgctatttagcagctgagtgaccttgggcaagttttcattgtctctcagcctcagtttcctcatatatagcatggaaataatactagtgtttctcttacaggatcactgtgaaaagaacatgagatgccctttgcagggacatggatggagctggaagccattatcttcagcaaactaacacaggaacagaaaaccaaatactgcatgttctcacttataagtgggagctgaaccatgagaacatggacacagggaggggaacaacgcacactggggcctgtggagggcaggcggggggagggagagcatcaggataaatagctaatgcatgctgggcttaatacctaggtgatggattgataggtgcagcaaaccaccatggcacacatttacctatggagcaaacctgcacctcctgcacatttaccccagaacttaaaataaaataaaatttaaaaaggacacgagataatgtaagaaagtagttagcccatagaaagctgttactattccagtatgtatcctactacccacggtgccgcttatataagagcgccctcctgaggctgtcagaataactggggcgaggcagggaatgagaggggacaccaggcctgaggagtgaggagaacagactagaatggcttcctgaccgaaactacacccgctcaaccccaggcctgtgtaataggcacttccactttagtgtgagggtaaatcccagaacactgaagaaacacagcccagagctggcatccttttggccatttcctgaagtggagctggatttcagagggctgtctcaaatgacagtgtcagcactaggagctgatggttaaagctctgcaagaaaacagcatccagcattttcttttgctactctcatgggccaacatgaaagtgcgtaatgatggacacaggctttgcttaagtggtgagtctatcatccaacctttgactataattatgttgctcagattagagctaagtaaacactggatttgttttttttttttttttactacgagcaaatgaattttatttcttactcagcatagttgtcccagtttgtttattcaacaaacgtttaagcgtgttctccatgcgtggtgcttgtggcactgggcattcagtagaaagctagaggccaggcgtggtggctcacgcctataatcccagcactttgggaggccgaggcaggtggatcgatcacctgaagtcggagttcaagaccagcctggccgatatcgtaaaaccccgtctctactaaaaatacaaaaattagctgggcatggtggcacatgcttgcaatcccagctacttgagaggctgaggcaggagaatcgcttgaacctgggaggcccaggttgcagtgagctgagatcgcgccattgcactccagcctgggaaacaagagcaagactgtctcaaaacaaaacaaacaaaacaaaacaaaacaaaacaataaaaaagaaagctaaacccacagagttcctgccttctagtggaggagatgagcaattaaacaagagaaaacaagtgcggtgagggtgatgtgcaggctggcggagcagcaacaacagcacagaatcctgactacggtttgaactaaacctaaagggccccgactctgccttgatctctccagaaagcctcccagggccctgacttccctgtgcatgtcaggtgaccacggtggtgggcagcttcccacctcagcctcttccctcagtgagatctgggaaacctcctccctcctttgcctctgaattctcacaaagaggaccaagggttttgaggcatagtttttaggaagaaaacagggaacaaggagaataataataaagaagaaaaaaagtacaagaagtaaaaggtatcttgccttactgggccttggttaggtgctgaacattgtgctaagaatctttcgatgtatattacaatgtgttgttcatttctctgaggttgatattgttgatatgtccatttttcccgataaggaaactgagggtaaagaggagaaagaaataggtcataaacttcaccaaaggcagagctattatttgaacccaagaaaatgtgaaagttaattgatcatttcttaagggcaattttattttgttttttgcaggggcagtagagggagacgttgttgttcccagaaaggggcctttagggagaataaagaaaggaatccttgataggggtgctaaatcctccagtacctggtagtgctggccacaggaggagctcaataactattgaataaggcagtgagggagggcatgaggaagggagtgaggggatgagtgtggcccctcccagcctaccaggacctgtatggcttttctctcatgaatcccagtcacgagccagctgcctgcatcctcttttcttccatcttgcagctgccaggcgtttagggtagcttggtggttggtttccaccactctcctcagtccttgaaatcctcattcttacaacactcgctgtacctgggacttggtctccatggcttttccagatgttactgccctggaagtcaatcccacaggaccattttattttaagggtcagagggctatagtagttcaagaccccggtggatgcctgaaaccatggataatactgaaccctatttaattgtgcttatatgggtattgatgatataatattgcaaaattactgcagacattataattacataaaaaaaatagtaagttgaagaataattccatgacagtaaatcagtctaaaataaattaaaatagaaaactccaaattaatggcagcaagtatatttaaaaaataagaatatgagtaaaaagacaagacctgacaaaggagagtttcaacactacagtttatgtatatattatactaagttttgattttttgttcgtttgtttttgagacagggtcttgctatgttgcccaggctggagtgcagtagctattcacaggcatgatggtagctgattgcagcctcaaactcctaggctcaagggatcctccagcctcagcctcctgagtagctgggaccagggcagcatactctttttgatctgataactgagacggctactaagtgactaacggattggtagcgtatacattgtggatacactggataaaaggattattcacatccgagggtggagtgggagggtgcaagatttcatcatgctactcagaatggtgcttaatttaaaacttacaaattatttattttttagaactttccatttaatatttttggacctcagttcaccgagggtaactgaaacttcaaaaagtgaaactgcagataacagggaactactgtatgacaaacagtaaatatgaggaagttgtagaggttatgaaaccttcccaaccactccacgaatgacctacttttagctctggctatcatatagtctccccagagtcagacgacagtcttgccacttgccacctgggtagtggtgatctttagcaggttacttaatctccctaaccatgtctgtaaaatggtccccatctcctcaggttggagtgagcattaaagatggttctgtatttgaaatctcttagtacaaagaaaatgctaaataaatgttgtcaaggactgaattttatccccccaaaattcatgttgaagccttaacctccaatgtgactatatttggcgatagcgcctttagaaagtaattaaggtcaaatgaggtaaaaaagggtggagccctaatgcagtaggatttctgtccttaggaaaaagggggcccggcgaggtggctcacacctgtaatcccagcactttgggatgccaaggcaagcagatggcttgagctcatgagtttgaggccagttgggcaacatagtgaaaccccatctctataaaaaaatacaaaaattagcctggcatggtggtgtgcacctgtagtccagctacttgggaggctgaggtgggtggatggcttgagcctgggggtggcggagattgcagtgagccaagatgtgcctctgcactgcagcctgggcaacagagccagaccttgtctaaaaaaaaaaaaaaaaaaaaaagaagaagaaagaaaagaaaagaaaaatggaagagacaccagaggtgcacatgcacagaggggaaaggccatgtggggacacagacagagagtgactgtctgcaagagacctcaggaaaaaccaaccctgccaacacgttgatcctggacttccagtctccagaacagtgagaaaatatatttctgttgtttatgccacccagtctgtgatatttcgttatggcgacctgagcagactaatacacatgttcagtctacttcctttgctttccttgttgtttgaacacatttgccaggcagtgtcagagcccctgtattgggaagtggtcagtgtgtgggttggtaagaagaatttaccaaaaacagtatagatttgaaaaaggaaagttttagaaagaaagaatgctgcaaaagggtgcagcggggcacctcagtgagagaggactgagcacacagtggtggattttccttaggagcatttatggaccttaaggcgggagcttaagggtaattttgaccatattagccaggtaggtcatgatacatgattacatctgtagacattttggtgccttactgtcagcaagggttgcacaatgagttttgacatgcatgcattctggaggtgtatagaaattctagttatgacatttttgaaagagatctagatgctgactttagatactagggaagtttaattacttctaaattcctcagataaggagtttttgtctctggagactgctcgatggtcaccaggtgattttcctctcctcatttgctccctgacaaatatcttggtcatatctttgaccctttatatttatattcccccatgttcatgtctacctgctgcctcctggggtctcaagaaagggaaaatggtccagtgaagaggggtgatgagtctgtctggctacttcctcctgaaagggggctttgaggggataagttgcgtttttctcttttttgctctgtgtcataaaggaaatgaagggtcatgaaaaactcagtcacgaggggtggggactggattctatcaagaggccccgtataaatggaagttgctgttgcaggccagtattgagactgcatagtcatctgtaggtggaatcgttgtattctggaagatacaaacttaatgagagcattaaaaatgcagggagcaaatattaaaagaaaaatgacaaggaaaaaaggtccaaggaatgggagaagcccagtcttggttactttgggaaagtgtgtataaccatttggcttgtttgaaaatttactgggacattagtttccacttctccagacaacagattttgttgatgacagcacagactcctccttgttcaggtggaggtaatcaagaactcatctattatcaaaaaccatttctgctagtgagtataaagacttttctagtgctgatagacttgtgccagttttttctaagattatttaaaaggagatggtaagttcttgtagtgtgatttcacggtaagtaaaacctccccaaatagtgacagttgtgatagtttccacaactctggccacaataagtcctaggaccctttatcttctggaatggaattctgaattggaagttatactccagacagtgatttgggtgggagctattgttcctagagtacaatcatcagaacgaagggaattatcaaggtagaatagggccaaaacttgaaaagggtttaaataattattggcagagccacaaagtcataagagtccatgagggggcaggtattatagtgtgatgagcttatgaatgcataaaatatatgtagatatgaatctattttatcatatactagtgcaaaacatacacaaatctattatacaaagttaaaatttatcaaatcttacacaaacacttatggaccatacatggtgccatttgcagtcaacagaaatgcagccaagcatggtggcacatgcctgtggtcctagctgcttgggaggctgagacaggaggattgcttgaacccaggagttcaaggctacagtgagccatgatcgcaccactgcattccaccctaggcgacagaacgagaccctgtttcaaaacaaacaaacaacacccaaaaacataaagatgtggtattaagtcataattgcataaaatgaaccgtagtaatactatgctactgtaatagtcttgtagccaacttctgctgctattgcagtgagcccgaatgttgggagtattcacttaaaacaccgtgtgacactatcatctccatgtgagccgttcgcttctctagtaaattgcatatcgcagtaaaaatgatttcctgagattcgtgcgcattttttcatcatgtttagtacagtgctatcaaccttgaataacaccataggacccatacaaagttccactagtgatgctggaagtactcccaggaagcagagaaaaagtcatgacgctattttaaaaaaagaaaggtgaattgctcgttatgtagcagattgagatctgccgctgtgcttgcccaccatttcaagataaatgaattcagtgtaaagaccattgtaaaagaaaaaatggaaattcatgaagctatcgctgcagcaacaccagcaggcacaacaaccttgcaatttttgcaaaatttttttatattgatgcataatagatgcacatagttctagggtgtatgtgataatttaatacattgatttattttgtaaagatcacattggtgtacttgcgatatccaatacattaaatatttgtctttttttgttatactagagctgtttgaattcatctatttttaaatgttcaagatgtcattctaaactatggctccctactgatatatctaacactatttcttctatcaaaccatatgtttgtacccatttttccacttttcttcatccccctgactcttacccttcctggcctctagtatccaccaatctacttcctatcttcatgagatctactttttttagttcccacatttgagtgagaacatgtgatatttgtcatcctatgattggcttatttcacttaacataatgtcttccagttctatccatgttgctgcaaatgacaggatttcattcttttttatggttgaataatattccagtgcagtatatataccacattttctttatccattcattcattgatgggcacttaggttgattccatattctggctattgtaaacagtgctacaataaacatgggagtgcagatattccttatatatattaatttcctttattttggatatctacccagtagtggaattgctggatcatgtggaagttctatttttagtgttctgaagaacttccctactgtttgccatagtagctatactaattcacattcccaccaaacagtgtatgagagttcccttttctccacatccttgccagcatctgttattgcctgtatttttgataaaagccattttaactgaggtgagatgatatctcattctggttttgatttgcatttctctgatgattaattatattgagcatttttcatatacttgtttgccatttgtatgtcttcttttgaaaaatatttactcagatcttttgccattttaatatctgattacttgtgggtttgccttttgtttttgtttgtttgtttgtttgtttggtattgagttgtttgagctccttatgtcttctggttgttaattccttgtcagatgggtagtttgcaaatactttctctcattctgtgggttgtgtcttcattttgttgattgtttcctttgctgagcagaaaccttttagcttgatgtaatcccatttgtctatttttcctttgcttgcctgtgcttttgaggtcttacacaaaaaaatctttgcccagaccaatgtcctggagtggttccccaatgtttacttctagtagtttcataatttcttagacgtaagtctttaatccatttcaatatgatttttgtgtgtggtgagaataggggtctacttgctttcttctacatgtggatatctagttttccctgcaccaattattgaagagaatgtcctttccccattacatgttcttggcatctttgttgaaattgtgttggctgtaaatgtgtggatttgtatcttggttttttattgtgttccattggtctgtgtgtttgcttttatgccagtaccatgctgatttggttgtagtaaattttgaagtcagatagtgtgatgcccccatctttgtagtaaattttgaagtcaaagagtgtgatgcccccaattttgttctttttgctcaggattgctttgactattcgaggtgtttttgggattccatataaattttaggtgttttaaatatttctgtgaagaatgtcattggtatcttgatagggattgcattgaatctataaattgctttgggcagcatcgtcatttagacaatattaattcttccaattcataggcataaaatatctttccattcgttttgtattctcttccatttctttcatcagtatcttatagtttttcttatataggtctttcactttggttaaattgagtcctaattactttatattcttagtagctattgtaaatggcattgctttcttgtttattttttttcagattgtttgctgttggtctatataaatgctactaatttttatatgttaattttctatcatgcaactttacctaattcatttatgagttctaatagtctctttgtggattcttttgatttttctaagaacaagattataccatctgtaaacaggggtaattcggcttctttctttccaatttggatgccctttatttctttcacttacctaactgctctggccgggacttccagtattatattgtcttgttccaaatcttagagtaaaggccttcaatttttccctgttcagtatgatgttggccgtgggtttgtcatatatggtctttattattttgaggtatgttttttctatagctaatttgatgaggacttttatcataaagggatggtgaatttcattgaatgctttttttggcatctatttaaataatcatatggttttagtttttgcttctgttaatgtgatgtatcccgtttatggatttgcatatgttgaaccatccttccatccctgggatgaatcccacttgatcataatgaatgatctttttaatgtgttgtcaaattcagtttgctactattttgttgagaatttttgcacctatgttcatcagtgatattggcctgtagttttttttttgttgttgtatccttgtctggttttagtatcagggtaatggtggctttgtagaataagtttagaagtatttccttatcttcaatttttttggaagagtttgagtaaaattggtattagttcttttctaaatgtttggtagaattcagcagtaaaaccatcaagtcctgggcttttcttttatgggagacattttattacagcttcagtcttgttacacattattggtttactgagttttctattattttcatggtttaatcttggtaggttgtatgtgttcaggattttaaccatttcttctaggttttccaatttcttggtgtatagttgttcataatgttacataatgattcattgtatttctgtggtcctagtggttatgtctctttttttgtttctaatgtcatttaatctggtcttctctctctcttttttttttagtctagccaaaggtttattgattttgtttgtcttttcaaaaaaacccaactttttgtttcattgatcttctgtactgtttttagtctcaatgtcatttatttctgttctgatatttattatttctttcctgctactaatcttgggtttggtttattcttgcttttctggttccttgagccgcatcattaagttatttattggacgtctactttttaaaatataaatgtttgttgttataagctttccctttagtactgctttttccatatcccatagattttggcatgttgtatttccattttcatttgtttcaagaagtgtttaaatttccttcttaatttcttcattgatccattggccataatttaattcagaaactatacaaacacatagaaattaaacaacatgctcctgaatgagtttcctcttattgttgatttctggttttattccattgtggtcagaaaagatacttgatatgatttctacttttttgcatttgttcagacttgttttatggcctaagatatggtctattcttaagaatgttctgtgtgctaatgaaaagaatgtgtattccacagcaggtaggtaacatattctgtgaatgtcagttagacctattaggtcttgtgtgtagtttaactctgctatttctttgttagttttctgtctggaagatccattcattactgagagtgaagtattaaagtcccttgttactattgtatttcagtctgtctctcccttgagatctattaatgtttgctttatatacttgggagctccagcgttgggttgcatatatatttgtaattgttatatcctcttgctggattgacccctttataattatatagtgaccttctttgtccctttttacagtctttgatttgtagtctattttatctaagtatacctcctcctggtcttcttttggtttccagttgcatggagcatctttttttaccccttcccattctgtctatatatgtctttataggtgaagtgggttcttgtaggcagtacatatttaggtcttttttaaaaaaaaatctactctgctgttctatgccttttaattggagaattgagaccatttatattcagtgttattattgataagcaaggacttactattgtcatttcgttgcttattttctgattgttttgtaactccttgcttcttttcttactgtcttcctttgtggttaagagattttctctggtagtatgttttaatttgttgctttttatttttagtgaatctattacaggtttttgcattgtggttaccatgaggcttacaagaaatatagatataaaaagttattttaaagagatcataacttatcttggatcataaagaatagaaacaaaaaaatgaaaaaaactatgctttaactccatcccttccacatttgacttttagttatctcatttacacatttttatattacctatctcttaacaggttgcagtagcttttttatatagatttgtctttggggcttcgtactacagttatgagtagattgcacaccacaattacagtattagagtattctgggtttgtccatgtatttaattttaccagcgggttttataccttcgaatgttgttgtttctgcatgttaacttttttttcagattgaaaaactccctttagcattttttaagagacaggtctggtggtagtgaattttctcagctttcgtttgtctagaaaggtctttatctctccttcattcgttttttattttgttagtttttttgtggtataatattcataatataaaattctaattttaacaattattaactattcacttcagtggcatcatatgcatgaacaatgttgcaaaaatgttattatttatttttagaactttttcatcatcccaaacaaaaactctttttttccctctctttttcatatttgaagaataactttgctgaatacggtactcttggatagcagtttttttttcttttagcactttgaaaatgtcgtttcactccctcttggcctgtatggttttcactgagaagtctgttgccagacaaactggagctcctttatatgttatttgcttttcttttgctgcttttagaattttctgttgtccttgacatttgagagtttgattattatgtgccttggggtagttttatctgggtcaaacctgttctgtattccctgagcttcctgtatctgaatatttatgtctttctcaagtttggaaagtttctgttattatttctttgaataagctttctaacctttgctattgttcaacttccccttcatcaccaataattcttagatttggccttttgaggtagttttctgtatcttgtaggcaatcattgcttttcattcttttttctcctttgtctgtgtgttttcaaatagcctgtattcaagttcaccgagtgtttcctcgacttgatctattctgctgttgaaagcctctaatgaatttttcagtatgacaaatgtatttctcagttccaagatttctgtttttaaaaaattatttcaatatctttgttaaaatcctctgataaatttctgaattgcctttctgtgtcatcttggagatcactgaatttccttaaaactgctattttgaattcatcagatagctcacatatcaccatctcattagggtcagttactggtttctttgctttgtctatttggagagttcatgtttctgtttgctgttgtttcttgtggacctacatctatgtctttgcattggaagatcggttatgtatttctcctctgtctggcttgttttggtttttattggatatgtttgcttgaagtttctttactgctaggtcacagcctcctttttggctctaggtggtgccttaagcccaggttcactttggctccagtaaacgattatagcactgtcctttccaaataggggaggtcccaaaggggatgcactggtaatttgggaaggctgtctagaggtttgtgcccaggggacttgtaggatgaatcccctacaatgtggcaatgcagaaaagctgctctgttttggtgcctcctttggctgagtgaaacagcatagtttccagggctgtaaatggcagtcttaactcccctctttgtctctgcctgttctcgggaatatttctcccttcaggtgctcatgatgcttcccataggttaaggcaaggagaggtctcctgacagggaaaccaaaatgttggagaaactggttgtccacctcaatttcacttttttgagggggatatctttctgttttgtgctgggaagaatggaaggaggggtactgcagatgtggaagtctgagtatattaccatctgcttaaagtttatttatttttatttttttaacttcgctgtggccccagaaactctctcatgttgatattttggctctgggatatttctggttatgatctcagagctgtatatttgtttttggttttctgttggggagagtgaagcaagcttgtttctacattaccattttggaatcaaaagctgaaataccctttaatcttgtattgaaaatacagcttttacgtggatgcaggactgctataagaaaggcatacccatagactctaatatgattagtgaaaaaacaaagtccttacataacaaagcataaggaaggtgaaggaactaaagctggagcatttaatgccagcgaagtatggtttgataattttagaaagagatttgcctttaaaaatgtcaatataagagaataagcagcccttaccaaccaagaggcagcagataaattcctggacactgttaagaaaatcattgagggctaagtgcagtggctcacacctataattccagcactttgggaggccaatgtaggcagatcacatgaggccaggaattcgagaccagcctgcccaacatggtgaaaccccaactgtactgaaaatacgcacacacaaaaaaattagccaggcatggtggtgtgtgcctgtaatcccagctacttgagaagatgaggcaaaaaaatcactcgaaccaggaggcggaggttgcagtgagccaactcgtgccatggcactctagcctgggtgacacagaaagactctatctcaaaaaaaaaaaaaaaaatcattgaggagaaagaatatctacctgaacaagttttcagtgcagatgagattgtggatatggcaaaaaaaaaaaaaaaaaaaaaatggagggaagttgaaggttttcaagatgatcctggagaaatttaagagctaacaaacacctcaccaaagacagcagaagacaacttgatggagatgagtgatttcaaaccagtgccaggtgatgaagacgatgtatggaaagcagttccagaaagcaaattgacattagacaatctagcagagtggttctgatcattcatgactgcttttgactttttttctaacatggaccctactaagatatagacactgaaactaaatcaaatggtgaaagaaggatcagtaccatatagaaaatttttagagaaatgaaaaagcaaaaatcaaatagaaattataatgtattgctgtaaagttacactgagtgtacctggttattccaccttctcttccaccttctccatcttttctgcctctgccacccatgagacagcaagaccaacccctcttcttcctcttcctcctaagcctactcaacatgaagatgatgagggtgaagatctttatgataatctacttccgtttaatgagtagtaaatatactttctcttcctgatgatttctttaatagcattttttctctagctcactttattgtaagaatacaatatatagaaaatatacaaaatatgtgctaatcaactatgtcattgataagtcttctggtcaacagtaggctattagtaattgagtttttgggaagacaaaaagttatgcacagatttttgactctgcaaggggttagcaccccaacccctgcattgttcaaggctcaactgtaaaataacatgtgattgtgaagggtttttattaacaattttaggcattgttgtcatgtaatggagatgtttgagggccacagggagaaccgctagaactttccaaatcatgccaattaagtgcccacttggtcacacggttattgatttttaccttagtgtaagagcacttactcccttgttaccttaaattccttttgccacccatctggttctccagtttctaattaaaatttggaagtttcatgaaaattcggcaggaacagtttttatgaaatgttcgctacagtggagcagattgtgctgctcatccgaggcagctctcaaactaatttaactctcagctctgtagacttcatacagaaaggcaggggaagcaaaaatggagctgtgatgaatgatgccagttgaaatgcctcatgcttctgactcatttcagaaccattatcatctcgatagaaacatcccctctaccctccatatttttgcgaggaaacgttactagaaaagcaaggtccagagagaagcaatgcattaatgttgtgattaggcttaaagataaagcagcactggacatccagagttgtcttggtcactggatcaaagggaagaaatagcatttgaagatatgggaagggaaaagtctacatacctaaagcagggctgacatcatatgatgataaatagctgttacttactaaatatttactctgtgcctgacaccgtgattataaataaatgttctcgtttgattctcagaattgctgaattagtcaggtgaggctaacagccataacaaacaccctcaaatctcagtggcttgatattttaaaggctgatttttacccatggcacagtatgggcagaaggcgggggagggattcaggttccttcctgaataaactcaccctccccaggaccttgaagttcttcactggatcttctgcatctcactggcagatgagggtagagggagcaagttcacatggcagggaccccatgggagggttcttaagatctaggcctggatatagcatgcatcactcctgccaacattccattggatagaatgcaatcacatggcctgcctagctgcaagaaaggttgggaaaagtgcacaacgactatgaccaggaggaaaaagaaagtgtgaggaacacatagtctctgacctaagtacttatcattacccccatattacagatgaagctgagttttagacaggtaaagcaacttgcccaatagcacatagcaagtaaatggtagaatcaggataggtttttggcatggtaagttcttggaagagcccaagaacctgactacaagttattgagctttgcaagtagagcagaaactgtcacatttacggagcacgttctacaaacctgggcattttttttttgaatttgtggacattacagtgaaatatgtagacattatagttttcaacactacgatggaaagacaatagtgggaacagggtgaggacaaggtaatctaaaggtgatacctctttaagtacttgattccccgcaaaggttcaggtctggtcccctggcttgctccccaggtgttagatgatagaactgagctcatcttttgctgcacgcaagcatgcacccttaaccactgcagactctctcaaagatttatttaagattcccttgtttaacagcacctactttgatatggctacaggggaacctaccacattttagacttaggtgcaaagcattagatcttatcccaccacttccttgtctcacagagcagtggtagtcccagtgtgtcacctgaggcctaaggtgatgaatttatttccctacgctgtgttcaggccatgtagaactatcaatatccacataaactcaccatgttctcttgactcccggcctttgtactcattgttccctcagccccaatgagtctagaatcactggtgtggacctagatgtcggcaattttctttagctactcaggtggttctattttatggccagggttgaaatccaatgacaagatcagtctaagccaatcgtggccagtcacattctccttggccagatcagtgaatgaacatactccttatcaatcaacatagataggattttgggaagtcaattctcatgatatgatcactatcagttctctgattgtcatagactatcttgagtgtattttcaaggcccccttgtattagtcatttctcacactgctataaagaaaaacctgacactgggtaatttataaagaaaagaggttaaattggctcacagttctgaaggctatacaagaagcatggcagcatctgcttcagggaaggcctcatggagcttttactcatggcagaatgcaaagtgggagcaggcttctaacatggcaggaacaggaccaagaaagagaagagagaggtgctacatgcttttaaacaaccagatctcatgataactcactcacctgctatcacaagaacaggaccgaggagatgctgctaacccattcatgagaattctgccaccatgatccaatcacctcccatcaggcaccacctccaacaatggggattacaatatgacatgagatttggtggggacacagatcaaaaccatatcactcctataacactttcagcttgttcctatcatagaattcttccttgttatgcaataggccagcctgggagatgctgccctaatgatttggaagactgtctactcctatgtgccactgtagctcagtagggcaccctagggccaccgccactctgcagaacactgaagtggtgacagtgggttctagttctctgcaccaagtctaaaatgtggtagaaaggggaactttcaaagcattttgtacacgttgtgaggaaagaatgattgccgctttaaatcttgactcctctgtacaccacttggccctcaatataaaatctgtaaatagccctgcctttctacgtctcccagctccccaccctgcatggattctgtgtccagacaagtgaaggtttcttgtggctgaccctgagtttcctgctactctgcctttggtcacactgtttgctttcctagtatgctcatctcttccccttcccaaactcctcaaatgttaccaccttaaactaaagctaagggtttctaggttctccagcggagagtggagtcaagaaaagggttctaggaaaatttcagggtgtggatgctgcatctgttgatccagccacctaggcactatagatgtaccttaggcacaaagtggctctgtgtgtgtaaactggaaggtcggcaccccacaggtgctgtgacatcagaagctcagacctgattagtgcagttgttccaagggtgggcacagtcctggagcaagagagaaaaagagagagggagggagagacagagatagacacacacacacagagagagagagagaccatttatcacctaaaaatctctaagaatcttttaggactgtcaatagttatctgtcttgatactgtagtaatattaaaacaaatagggtctcattctagataactgaactttatggtttttgcactgatgtaaagcaacacaaacagcagacaacagagccctttggtggactcaccagactttctggtttcttctatgaggtaatattaactaattaacaatgaataagttaatcactttggactatctgctcctggtacttctatcagggtacttcatgggaaaagtaccctataggagtaggataggttcccctgatcaataagatgaacttcagttattatggtttgagcaccatattagtctgttttcacgctactgataaagacatacccgagactgggtaatttataaagaaaaagaggtttaatggactcatagttccacatgtctagggagccctcacaatcatggtggaaggcaaaaggcacgtcttacatggcagcaggcaagacacagaatgagagccaagtgaaaggggtttccccttacaaaaccgtcagatcttgtggcacttattcactaccatgagaacagtatgggggaaatcgcccccatgatttaattgtctcccacagggtcccttccacaacacctggaaattttgggagctacaattcaagatgagattttggtggggacacatccaaaccacatcaagcactaaaacaaatgagacattattttgcaccaaaggtagatgaagcaggacatgccaatcaaattgatgaaataaagcacctttaattttgtgtctcatttacttcctcaaatttctgatgtactgaaatgattcagtaagtgcatactaagggcttgtcatctgctgggcactcttgaaagtgctggagtgtggcagggaaccaggtagaatggtccctaacctcaaggagcttctggtctgtacctagaagctcttgctctgttttcagagtctctcttttgctggtatctggctatgatagagggaattcaaaagcagctttaaaatgttttctgcagaagaacaaagcagtagttaccagtatgagaagaggggaattgctactttgacacctacaaattgaaggatggatgcctttgtttcacatctgttttctccatgtgagaagcagccagctccactgattgtgtactgttgagggtgaccactccatttttctctcctggaaacatgtaatttaatgtgaagcatctattgatgaactgcaagtatgaagaattctcaggataatgtacttgattttccccttgaaatgcaattcacatttattaagtatcttttctatacaaggcatggagcaaggtgcttcatgcacataatctcatttaagcctcacagttgcctctgaggtaggtgcatcattagccagcttttatagacaggataaaagggaaaagaggaaatggtagcccaggattccaaaaagtgcaaattcatttccagtggatgaatacacttatgattttgtttctcttagatgggttatgataaacatctttaatattaatacctgccttacatttgcataattctttcaacttttcaaagcacctcttttataccttatttgatgctcatgctaagccctatgctcctaacagtctcgaactccttgatggtgtctctttgagagcctaaatctctgcagagctggcttttgttgcatagctaaggttcaggactaagctaataaaaatcttgcttccagacatctaatctgcatcttcatttgcaaggtctccttgggatggtgtgacctgctgtttagtaaggacatcagtgctctcataccagtgattactatggttacatctgccccaacattctctaaagccctagattttagaaatattggtgtctttactaccttgtccttgtctggatcttcctgtcatgcctgagttaatgatagccaaagggaaaggaatgaaataaaaagaaggaaaaagacagctctgcgagcttgtacactgaggtgcatatattctcaaaaaaaccagaaaccagcctaaatgaagagggaggggatggtggcagatgaagcataaagcaggtgcttacttaattgctgcagctggtgccaagtgtttggcataatttttctccttattttcaattattggcactgttattttactttttagctgaagcatctgagaacagtctaggaagcttctctgctcctctcacttttacaggaaagcaagcaggcattttttttcctgaaaatattgtaaataaacacaatccttgaaattttttcttgtgccccaaaacaactcatcgactatagaaaaggaagagaaattggctgaaatgcaatttgacgttttcattctgccaaaattactatgggttgaatttttaatttgattcagaagacgattcaactcttcagcctcatctatgtgattttgatttcagaatagcatgtctgagaccagagcttcctaagctgttttcttttaaaacacagattgttaaattctccaattgacatggcatattcattttgctatttgacttttttcttttaagtagtgaaggtaaaagttgcaaaaatattggatgaaagtcatttcatgccctgttattccaccaatttttaagaagagtaagcgctgtgccaaaaccttatatagaacaatgtgcaaaaaacaatacaaggacccatgaggaatgcaaagataaacaagatgtagtctttttctttcagcagatttagtcctgaaaggagaataaaatgagtacaagcagtaacataacagttttgagggaagtaacaatgatatgctaaaaaaaaaacagcacacgtctatcaattacttttgatggcagatctaacataaagaaaataaaaatgtttcatctttctcccttttaaagtaattctgcttagagaatgctatttaatcactgtatttaaggtgacatttgaattctgaaggttttatctcctattgactctattctagagagagagagagagagagaatacgcatgtgcacagttttgagcagaaaaaaatatttttattttagaattttgtttcagattgcatttcaggaaaaggaaaggagaaaaatcgtgctcccagagggcattgggaaatgtgggttacagtcttgttttcaccttcagccatttgtgtttctgggttcctgagtgcttaggctgggttactccaagtttcctttcagtcttcatagtctgagtgtgatgcctcgcatcttgtcctgaatgaatccagtggctttcccatagggagcaaaggaaactgaaggcttgagggagtatccaaggtgccaggaggtgtagggaagaaagaatggtactactggatgagacactcttgggcctctcggttttcttaacttcctatttaaatacttcatcatttgtagaaagccttaagttcagagccattcacaatttatactgggtctgattccttttcattcccactgtagcattggcttttaagaatgtagaagcatggcctagccaaaatatatatatatatgatttacaggctagttagagtttgtgctgagctgtgtctgcaaataagcctttaaggtaaatgaaagaagttctaaagaacctgaaaaggaaatgggagagagtgtgatgtgacagtgaggaatgtcatttttctctgtggttctttcctgtctaatttcacagccagcaacctggtccaggctctaattaaccacatgtccataggctgctgctgatgctctaacaatatccagtcttcagactgttcctgtccagtttacacatcattgtccttcctcaaacactcccttcaccatggtgcttccctaggcagtgatttattatgagtccttgttacctggtacaactcatctcttttgtttatttacttatttatttattatgattacatatatttaaagtatacaacatggtgttttgatatacatagagctagtgaaatgattactgcagtcaggcaaatttacacatccaccaccttgcatggttacctttttgtgtgtatttgtggcagaagcttctaaaatctatattaacaaatttttagcatacaaaacaatattattaaactctagtcctcatgcagtcctttagatctctagacttattcctcctacctaacagcaagtttataccctttgacctacatgtctccattttctcccaatctctgcccctagtaacgaccgttctactctctatttctatgtattggactttttaaatatcctacatacaagtgagatcatgccatatttttctttctgtgtctggcttatttcactgagcgtagtgtctgtaggtttataagtgtcacaaatggggatatctccttttttttttaaggttgaataatacttcattgtatacacaagaattgtaccacactttctttatccgttcatccactgatggacagttaggttgtttccatatcttggctattttgtgaataatgctgcagtgaacatgggagtgcagatttagcactatgaggtgctaatttcatttcctttgggtatatacccaaaagaggaattggtggatcatatggtagttctatttttaagtttttgaggaatctccatactgctttccataatggttatacaaatttacattcccatcagcagtgtgtgaaggttcccttttctctacactttttctaacacttgctatctcttgtctttttgataataaccattttaatatgtgtgaggtggtaacttactgtggttttgacttgctcatctcaaatctttagcccagggttcgaggtccttcatccaggaagcatggtattaaaaataggagactgagctttagttttggcctttgcagctttaaagctgtatgattttgggcaagttgttgaacttgaacttcccttgccttcattttcctcttctgtaaaatgacttggaattgagttctccaactctaagtgatctcctggaactgctggtcaaacatggccatcttggtatcacatttcccaggagtgcccagactcaaataagctggcctgtggtcctattagcacctaccagaaacttggcagaccttgggtcccaagttttgattttaaaaatgtggtccccataggtttccaaggctacttcctgttcttctccaaggctccagacaagtcaatggcctcaggggctctgaacaaacctagctgcttccatcctatttgttctggctgagtcattgcccagcaacctggagtcccttacatttaccccatggctatcaactcccatgatggtaacttcaaaagccatattgttggccccagtgacctttgccaatctattgatttattttaaagctccaattgttcccccaagagtatttattttatttttattttattttttattttttgagacagggtctcactctgtcacccaggctggagttcatggctcactgcagtttcaacctcctgggctcaggtgatcctcccaccgcagcatcctgagttgctgggactacaggcgcccaccaccatgcctggctaatttttgtattttttctagagatgaggttttgccatgttgcccaggctggtctcaaactcctgggctcggctgagcacgatggctcactcctgtaatcccagctctttgagaggccgaggcaggtggatcacctgaggtcaggagttcgaggccagcctgtccaacacggtggaaacccgtccgtactaaaaatacaaaaaaaaaaaaaatagctgggtgtggtggtgggcgcctgtaatcccagttacttgggaggctgaggcagcacaatcacttgaacctgggaggcagaggttgcagtgagccaagactgcgccattgctctccagcctgggcaacaagaaagaaactccgtctcaaaaaaaaaacaaaaactaaaacaaaaaaaagaaacacaacacctggactcgaatgatctacctccttcggcctcccaaagtgctaagattacaggtataagccactgtgcctggttctaagagtacttttttttacaacatgattttcatcatatacatgcattctattataggctatttttttcattcaacattatatcatagatactttctctcattgtcccatgtctgggcactcctgggaaatgtgataccaagatggccatgtttggccagcagttccaggagatcacttagagttgaattcttggtattgtattaacttttcacctaatgttggacattaaagtgttcagtctttcattattataaatatcccactatatatagcctttagaattatttttctagttgagactcagatgttatcgttagatataactttcttattttttatgtcatgctgtagtttggcgatcctccttgtgtccctagctaattcttaggcactcctttacagccggtgtccccagcctcaggctcccctgctaccctaacattcagcagatggccttgcctagggcactacataattttgtctcaaagatcctgcctctacaactatttcctgatttagtagttctcaaagtttaggtgcatcagaaacacctgaagggcttgttaaaacaagccctttttgctggactctcctccagagtttctgatgcattgtgtctggggtgcaggccagaaatattcatttctaaccgattccatggtgatgcccacgcaaggaccaaacttggtgaacaactgctctaattctttcatctgatctcaggggaaacggtttagattctctgactccaccccatgacctgtcctctgaacctctttcccatcttcactgggaccaagctatcactcctaacctgtttcctttcagtggcttcaatacctgcaccttgaaaccctcccttactccatccttcaaggactctcttatcactgctgtctcaattaacctttcactttccaacattacccaactctaaccactaacccaaaaatctttcctcctgctgtgggtttttctgaacttgaacttgtgaccttcgcctgctgcttcagcgtcttacccacgtatttcctttttaatttccagaaatttcccaaggatgctctattgaaattatctggaaagttaaaaatgacccccttcttcccaaaatcaacggcctttccttattatgtaataatagcagtcaatattaattgacttccaattgtgttccaggaattgtgctaaacattatatagatagaaacagaagtatctcatgtgaagattattcttatgtcaatcttatgaggtagatattattttagagatggaaaaaactaggttcagagatgtgaaataatttgcccaacagaccaagtgaaggagccaggattggactcagctctgcttccacatcccttgtgtttaaacacttccagaataagcacagactccctaagcacctattaaactgccaattccaagctccagtgccagagacgctgacccaggtgtgcccagaacctaggaatctgaattattaatagtccccctaatgattctgatatgtgtgatcccagaaccacacacgttttgaggaatggtcccactgtattgacataattggccacttcctctccttaaagacttccctccgttgctatgatatagcttttattttatttattttttgtcccttgggctctctgattctgttgttctccatctcattcgctctctctctcctgcccatatcactgccccccagagtctgtgctctgcctgctcctccctctgctgtctgtcccctgaagcccatcctcttgctgtgctccaactcaggcagatggtccccaaccttgtccttctagtgccaacctcctggcaaacgccatggagcagcatgaaataattttggaacggtgaagagctacagcccaggccctggacaaaactgtgagacaggtgacattgatcctggtgccccatcaccccactgtgcccttggtctttcctcttgctcataagatctctgtgccttgcagttttctaatcaaatcagttcagcaaaagagctgatcattttacgctctcattctaatgtgttaactctcccagtcatttgcatttttaaagccttttatctctctttgtgggttcaactgttgttcctgtattgaagagttttcaggcttcatttagcagatagtgggaatttagagggaaatcaggactgaagaggaaggaggaaggtgagcaggtttggaaggggaccctttcttccccttgaaatgttttgaagtttagagccaagagcagagaataacagtgctgggagggcagaacttggcctctcttgcctcctgcacatcccaacgccctgagcaggagcaagccataactgggttgctgcagacctgtccctagaggcgcagaaggtgaggacagactggagagctggtggctctgctggcttcctgccaccctacgctcggcgtggctgacctcttcctctttcaagtatcagcttaaatgttctctcttccaagcagccagtcctgatcaccatgcttatgggggcccttcttggtgattctctgcgtttggtagttttccttcatttcattgatcattgtttataattattttatttactagttcttcctgtctccatttgtagagtaaggctaaagagggcagagaccatgtctgcgtgttccctctgtgctcatagcacaatgctagttcatagcatatactgagaatttgtagtaggaatggctggagagttacacctccaccaccaggcgcttaagaaatagttcttgagcttaactcaactcccctagtagctatcctggtgctgaaagacttgaggcaatcagagagcattgtgttcaccccactgttgggatgaagtggggagtgcagggaggtggcatcaagaaaagttagggaagactttgaagtaggcaaaaagattactgggtgtcctgtctggaactctgttgagtttacatttttatgtctttgagctattttacaactttgcacattttagaaaactgacagtaatacaaataattcttgcccatggagatgcaaatgaatttttttctagtggaggtgcaattgataattgccctgtggatattgaccagctttgcatctattcgtacatccattttcactttcctgattgcctatatacgtgtgtgcttgaattttcctttgaactggttgtaacttcatactggttccctcattaattagtaaaataaaatttctgacccaggttaattttatatttatacacaagtcacagtttttaaaaaattgtttttggctgggtgtggtggctcacacctgtaattccagcatcctgagaggccgcttgagcctggaagttcaaggccagcctggacaaactagggagaccccatctttacaaaaaataaaaaattacctatgtgcagtggctcacgcctgtaatcccagctactcaggaggttgaggtgggaggatcgcttgagcccaggagctagaggctgcagtcatccgtgatcatgccaccgcactccaggctgggtaacagagtgaaacctagtctcaaaaaaaaataaattatttttttaattggactgtatcaaaatcaagaagttttgtgcatcaaaggatattatcaagaaagtaaaaaaaacaacttacagaatgggagaaaatatttgcaaattatatctagaatatatatatctacaatatgtaaatgttatgatttaaatgtgtgtggccctccaaaattcatacattgaatcctaatcaccaaggtaatggtatcagaagatgggtctctaactgagtaccctcatttttctaagagatagtttaattattgttttctctctcttcttgtctctttctccttttccccacttccttcactctgtcacccaggctggagtgcagtgacacagtcttggttcactgcaacctctgcttcccgggttcaagtgattctcctgttaacccctttcctctttcttctttttctcttttggaatgggagtgtctatcctatgcctgtcccaccataatattttgaaaacaagtaacttgtttgctggagggggatttgcctcaggatgaattgtaccttgagtcttacccatatctgatttagatgatttttaggtgagacttctgacttttgaggtgatgctagaatgagttaagacttttggggctattgggatgaaatgaatgtattttgtatgtgaaaaggacatgcattttggtgggctagtggtggaatgctatagtttgaatgtatgtgtgtctctccaaaattcctatgttgaaacttagtgaacaaagttacaacattaaaaggtggggcctctggcagatgactagcgcatgagatccctgccctcatgaatgggataacgctctataaaggaggcttcagagagcttccttctgcttctgctcttctgtcacttgaggatgcagcaaggtgtcactttggaagcaaagagcaagtccttatcagacactgactctgctggccccttgattttgaacttcacaaccttcagaattgtgagaaataaatttctattacttataaattacctagtctgtggtaccttgttatagaaggaacagactaagacaataaagaactaaaactcaacaacaaagcaaagaacccaattcaaatatgggcaaaggacttgaatactcatttctctgaagaggatatacaaatggccaatgagcacatgaaaagactctcattagttgttggggaaatgcaaatcaaaactacagtgagataccacttcacaactactaatatagctacaataataatttttaaaaggaaaataataggtgttagtaaggatgtagaaaatgtgagaatgtaaaatggtgctgctgctgtggaaaggagtctggtggtttctcaaaaggttaaatctaaaactcccacatgactcagcaatgctactcctaggtatctatgcaaaagaaagcagagacttgaacagataagttgtacaccaatgtttatataagcattattcacaatagccaaaaggtagaaacaacacaagtgatgtagtttggatctgtttccccacccaaatctcacgttggaaatgtaacccccactgctggaggtggggcctggtgggaggtaattggctcatgggcagtttctaatggtttagtaccatcccccagtgctgttgtcatgatatctgattgtttaaaagtgtgcagtgcccccctacttcctcctgctcccaccatgtgagacaccttgctcctgctttgcctttcaccatgattgtaagtttcctgaggcctccctagaagccaagcagatggtcagcatcatgcttcctgtacagcctgtgaaactgtcagccaattaaactttttttctttataaattactcagtctcaggtatttctttatagcaatgtgagaacagactaatacaccaatgttagtcaacagatgaattggataaacaaaatgtagtatatacaggccaggcaccgtggctcatgctggtaatcccagcactttgggaggctgaggtgagaggatcgcttgaggccaggagttcaagaccagcccgggcaacacagggagaccgtgtctccaccaaaaaaaaaactttttttaattagccaggtgcagtggtatgtgcctgtagtcccagctactgagaagactgaggtgggaggatcgcttgagcccaggagctcaaggctgcagtgagccacgatcatgccactgcactccagcctgggcaaaagagtgagattttgtctcagaaaaaaaaatgtagtatatacatgtagtggaatatattctgccattataaggaataaagcgttgatatacagtgcaacatgtatggactttgaaaacatatgcttagtgagataagctacgcacagaaggacaaatactgtatgattccacttatgtgaagtacctaaaataggcaaattcattgagacaggaagtagaatataggttaccaggactggtggaaggtagaatgaggagttataatttaatgggtccagagatttttggggtggatgatgaaaaactttggatatagatagtggtgatagtaacacaacattgtgaaaataattaatgccaccgaattgtccatttacaagttatttaaatgataaattttatgttacatatgtatatatatatttaaccacaattttaaaaaccatcttttaatgtagagagaaaccatggccagaatatgctctcgatggcaacatgattgaggatctgaaagtcttgtggcgtagttcacattcagctcacttacaagctgtgtgacgtgaataaggtagaattgactaagttggggcatcagtgactgaaagggaggagacaaagggaatttctaggtttctggcttgagcaccagggtggattgtgatgacgagagactggcagaggaagtgttaccaaccaaaattgggtccactcggccagggcagcaaagccaaacactgacaatgagatttgcagcaagaaaaaaaagacatttattgcagcacaccaagcaaggagaagtggacagctaatggttaagacctgagctcccagatgacttacaagcaaggctttttacaggcaagggtacatttcaggaaagtagaagttatgggcaaaatcatacatacctggaggttagacattcatttggacccaaaagtgtgatatcttcaagcaagagcttacaggtcataggtggattcagagattccttgatttgcaactggtaaaaaaaaaaaagcaaggctttacctaaaaccttggggccagcagaaaggaatgttaagttttggcctgtaggtgtgatgctcttcaggcccctgaggatgaaaattagaacaaagaatggcagtcagagtatagtcctcagtttccccttatccaagatctacaggaggggagtcagcattttctatctgatggggctccaggtttctgaaaaacaattcaaggtgctatctttagtttctatagggaatgaaacattttgtgagtctggcttacttggatggctttttttttttttttgagacagagtcttgctctgttgccaggctagagtgcagtggcaggatcttgcctcactgcagcctccatctcccgggttcaagtgattctcctgccttagcctcccaagtagctgggactataggcccccactaccacgcccagctaatttttgtatttttagtagagacggggtttcaccatgttggccaggagagtctcgatgtcttgacctcgtgatctgcccgcctcggcctcccaaatgctgggattacaggcgtgagccaccgcgcctggcctggatgactattgtttaagttattattaccttcttgctttgtgggtgattcatttacttctctaattgctggttgaaaggtgcctggaatctgccttgaagggattcaaaatttttcctttatctctacgctggggtttggggcctagtcttgcagcctagttcacatttcagctcagttactagttgtgtgaccatggaaaaggtagaggtgactgagttggggcatcagttccaactgatggcaggcgcctaagaggggcctctgctctgtctcagaagtggggttagtttggagcagaaggtaagagttcagtttttgtcatattaagttggagacagccatgaggagatgttaagtgaggaggtgactatgggagtctggagctcagtaaagacgtctgggctggaggtattaatataaactgggacacattggcatgcagatggtcctttgagccatggaaatggctgatagcataagatagaaaagaacaaccaatcccagccccacagaacagcaggggcctgagaaggcagtctctgaagaagagaactgagtgtggggacatggaggccgagagggactactggccttactcttgccctctagccactccctgtccagtaacctggggtcaattcagctgctacttaatttttgccatgtgagagggcagcaccctatacataatggttctggtcatacacagaatgttttcaacagcagcagcacgacagcatgcttcttcttcttcttcttcattattattattattattattatttgagacggagtctccctctgtcacccaggctggagtgcaatggtgtgatctcaactcactgtaacctccacctcccaggttcaagtggttctcctgcctcagcctcctgagtagctgggattacaggcgcatgccaccatgcctggctaagttttgtatttttagtagagacgggatttcactatgttggtcaggctggtctcaaactcctgaccttgtgatccgcccaccttggcctcccaaagcgctgggattacaggtgcgagccaccacgtctggccgacagcatgcttattgtcagaaattttgctaagtaggataggatgcataagaacactgccaagtaaaaagcaaatctgcacttagtgaggacaaccttttatttaaaaagattactacaggagagaaagggactattgcagtaggggaagtgtactattgcaatggggaaaatactgagaccttaagaaagggactgtctcttgaacagagaaaagtaaccaaggctaaaaacaacagggtgtgggaaaagggaatgaaagggtggcctgatgggatagtaggccatacaatgtcttactctgaggccagcctgttctcaggatgggctgtgtgctggctcaggctgggagtgggggtgggccaaagtgcaggggcttaggggaaggagagaaattgaatcaaagtttggttaacaagcattttgttcaattgctcagtggggacaagcagttcagctcatcatttatcaggtaaggaatgagaatttgttcggtctgtatctaattttgccataggttaaacacagggcatctgtgcatcttatctaagtcatatgagaaagagtcgttctgatgcagagcagatgagtcccaaaattggggcttagcaggggagggttcttggctgcacccaggaaagaattcaagggtaagctggtggttttagacagcaacttttattgacacagcaggttccagcattggcagcagcagcagaggtaccaatggcagtgtgcccagagtagcagctcaaaggcgagtctgcagtcatatttatacccacttttaattacatgcaaattaaggggcagattatgcagacatttttaggaaaagggtggtagtttccaggtcatcaagttgtaactgaaaggggctgtaacttcagggtgttgccatggcaatggtaaactgacatggcacacaggtgggcgtgccttacggagaggtgcttctgctctgtccctcttttagctagtcctcaatatggtccagtgtccaagcaccacctccagagttgagtcccacctcctacctcagttttttgcagtaagctgttttctagaacgtgcaaaaaaaggttggtgtggggggatgggaggggtttactttacccatcactgtcttccaggagcaaagggcttcagtgaaattcaatattgtcaacgtgctctgggatgtgaattccatccctccagtctgggtgacaccttcatcttctcaaccagcactgatattcctgcccaggaacttaagaactgccccttgctgtggtctgggtctcaaggctcttttcctgggagcttaagacttttgacttttcccttgaaggtgtccacatgcctccatgcctggcttacctgcagcctgtctaacccccaagagatgcatctgagacagcgtcataacctctgcttccaaaccaccatcgctaaaggcacagtcctgagggaaatgaatcatcgccttggaaatttgcaacctatgggctgaattcagctcacagaagtgttttttccacagggtgttttgctttgatttttaaacttgaattagatgcctatataaaaaatcaggatattgaatctaaaaatccaaatttctaaatctaaaaatccaaatttctaacttctcctgaaaagtagattgctccagcagttctggcctgtgtttctattgtatgctcctacactgttcaacaaaagttctgacaataaaatttgttatttaaaaagttctatttatgaatacaagtatttgagtgctgttacttttatacagcctaagtgaggaggagtacaaattccatcttctaatcaccactgttccgtgaatctattcagtcttttatattttctgtgggtgtttaagtatttctatttcctaccaccaattgtcactttcagtactaggacaactagccaaagagattttagtttcggataatttgttaatcaaggcatcatttagaaaaattacttactgtttatttcgaattgcctgactacataataatcatgacatgtatccttaaacacatgacctacttcactgtacattttacttgatcatcccagcacactgtctgcatggtcaacttggtgttcataaactgtgaaatcatgtgatatggtcaactcctacttggagcttgcttataccttatatagagagaggggctgtggggcatcactggtgagtgtgggaggcctgaaaggaagtcctatatctccctctcctttggacgcaaaggcagcacaatttggagcccagagttaaactgtggtttcagcattgtgaacacaagtgtaaagtcctgtctctgaagccttttcctgctctctcttaggattaggggctcctccctagtgtccccatagctttctgagcctgttcctattactgcccaccccattgtattgtaattacttgtttctgtgtctgtgtcctacctagaggtgagtcttgaagatgggaatgatgtctttcccatgattatagccccaggcccagcgaggccttgaggaatgatctagagacacagcactcttcaaccttgattattacagtaggtctccccactttgcattttcctaagtgaagcatgaaaccgtcatacctgcagatattatatgacagaaaataacagcatcagtttcccggtgatgtttagcattcctggtttctgcctctcatctcatctgacccggtaagtgtctccctatctcttaatcacaaggctccttatccacaactgtctcagagaggggtttaccagacatcctgtctctgttctcatctcctgggagcaggccaaaaatgacaatcaattcatttggctaattggtatactgctgtctctccacttttgcttcccaatgtccattccaggcacagaatttgtgcagtgcaacctctctggcagcctgctccagccatttccacaagcaagggcttgacctttggccagcttgcagatcactattgggctgtgtctctattcaaggaccgagctttaccatgcaggtgtggagctaccttcttccagatctgagcttataaatatacagaaagtgcaggctgaccttgccaagtgttcaaggcccgggaactttcagtcctttggatgctgactagagtctttctcagcatttacagagctcccgcaggcctctgtctcaatgcctacaggaaatttgtctttgagtatgtaagcacttctgtggcataatttccaaggccccagaaaattccacctatccacttcctaatctgttctttcacgcctgaagttgcttaaatcaccaaaacttccatttaccaaagttttaaaaacccctaggagcaattaagttttttaatgtaaactttttattgactataacactcatacataaaagtgcacaaattatggttgtgaatgaaccactcatgtaaccaataccaggaccagaaacagaactttgccatgtcctcagaagccaccccttcttccttgtatccctttgtagtcccttcccctccctcatcagggaaaccactatcctaacttggaacaagatagattacttttgtttgtttgtttgaattggcatatacaattataagtatttaccttgtacaacatcttgttttgaagtacatatacaatgtggaatgactaaatctagctaactaatatatacattacctcacatagttgtcattttgtttatttggttttgtcttttatataaatgggatttgttgtatgtactctttttcatatgtaatgcttcttttgctcagctcaatactcatgagattcatccatgctgttgcacgtagttgtagtttgttgatttttattgctgcatagtattccactgtgcaaataaaccaccttttacttaactattctaatgctgatggacatttgggttgtttctggatttttatatgcaaatagagctcttatgaacattcttgttcaggtctttcagtgaatacatatacacttctctgttggaaatacattgaggagtggaattgatgaaacctaggataggcacgatcagcattagtaggtacaaggtactatcaaacatcttttccaaggtagctgtaccaatttacactcccatcaccagcatataagagtcacagtcatgccacatcttctccaacaccagatttgtattttccatttagccattctgatgggtgtgtagtggtagtggtgtgcttacttgatatttatctgataactagtaaagatgcgtgctttgttttatgtgcattggccatttggctatctttcgtctgtgtattttctggtcaagtcttttgagaatttttctattaggtttatgtcttttatgtaatagttttttttttttctttgagaccgagtctcactctgtcacccaggctggagtgcagtggtgcaatcttggctcactgcaacctccacctaccatgttcaagtgtttctcgggcctcagtctcccaggtagctgggattacaggtgtgtgccacaatgcctggctgatttttgtattttttagtagagacagcgtttcaccatgttggccagggtggtctcatggaactcctgacctcaaatgatccacccaccttggcctcccaaagtgctggaattacaggcatgagcaaacgcgcctcttgggctgtcttttacataatgatttttgaagatttgtatatattctgataatttgttggatatacatattgtagatattttctcccaccctatgtcttaacttttcattttctcaataaagtattttaagtgaacagaagttctttattgtgttttcattatggttagctccctgtgtgtcctatttaagaaaatttttcttgccctaaggaagttatcatatcatgaagatattttcctacattttctttgaaattgacttttgtatacagtgtgaggtagaaatcaatattttttactgtattattcaattgacttgggtctatttattgaaaagactatacttaaccctataccattaatcataggactatattatatatataggtctgtttctggactgtatttgagaagcagttaattgttaaacttttctaattattttctcaagtaggatttattacatacttactatgaactaggcatcacattatgctaagcatttcaactgtatcatttcatttcaaatttcatcaaccctctgtgagataggaactattattatccccgtttatagatgtgaaaatcaaacaagttgcccaagttctcctagctagtacatagcagaatgcaggtctagttgactttaaagtatggttctttactgtttcgcagagcagcctttgagggggaaaggaacgataacattttgggggttgatgggggagaagtgacggacaagagtgaggacctataaaaagatgaacaggtgaagaatgaagaggtagagtatgctaaaaacgatgtctgcaagcatcacacttttgcttggaagaggtattttaattgtttgtgtgttttgttgtagtgccaaatccccatttgaagccaacttatcatttccccaagacaatgtcattttttagtcaccccctccatttccatcaggggcacctatgttatttcagtgtcttcagctttggaggtacctttcacttctgtatcctttgtgccctatgcccaatgactcatatcttttaccacttatttcttcaactcactcttaaatgaaattttccatttccattcccaccacttcctgtactctatctatattgcctcctctttaaaacaatagtgaacatttaagtgaacatttagtgaacatttaagtcttaccatgtgccaggcagtagcctaaacactttaaatgcaacgtttaattgattctcacaagaatactgtgaagtagttactgtcattattcccattttacagaagacgatgaaaatttgaagaacattaagtgatgctcaacgccacatagctggtaaatggcagagccaggatttatatataaatttgatttcagatatctaccagtccaaaccaccactgtattatgtacaatacttccctagctctaaactaatctctgcaccctagcatttaagaatgccccaaatctagctctaatctctctttctgatctttctttcactaatccttttcaaaaattcttctccagctcaagtgagctactcaaattcctctaaataacctgtggatatttccacctctaatcctttaccgaaactcccttgccttgactgccccctcctctcctctcctctcctctcctctcctctcctctcaagagctacctttaagtcatagcttaagtcccacttcctctacaaagcctttcctgcctcttactaatccctctgtctcaatgtatgtggtacctttcctccataaaaaaagtttctaattcttttaagtatcacaaaccaccatgggccttattgaaaggcaatatgtatggtggtcaatagcgtgagctttgggctaggtgctgtggctcacacctgtaatcccagcactttggaaggccgaggtgggagtatagcttgagctcagtagtgtgagaccagcctgagaaacatagtgagaccctgtatctacaaaaatcttttttcaaatagccaggtgtggtggcagcagcctatggaccagctactaagcaggctgaggtgggaagattgcttgagcctgggagttgaggctgcagtgagccatgactgtgccactgcactctagcctgggcaacagagagataacactctctctctacttatctctctctatatatacatatatgtgtgtgtgtatatatatatgtatatatttagtattagtactcacattgctataaagaactacctgggactgggtaatttgtaaagaaaagaggtttaattcactcgcagttctacaggctgcacaagaagcacggctggggaggcttcaggaaatttacaatcgtagtggaaggtgaagaggaagcagacatgtcttacatggcaggagtaggagaaagagagcaaagagggaggtgttacacacttttaaacaaccagatttcttgaaaattctatcacaagacagcactagggagatggtggtaaaccattagaaaccacccccatgatccaatcacctcccattaggccccacctctaacattggggattacaattcaacataagatttggctggggacacagagccaaaccatatcacacacacacacacatatatatggtgtgagctttgaagtcacttatatttgtgccccatttgcttactcatgactctggaagtgttatataatttttttaaaaaaatctgttttcttattgtaaaatagggataataatagtacccacttcatttgttcaataaatattctgagcaactatcatgtgtctggcactgtgctgagcactggggattccacactgaaaaagagaggtatgcttcctgccattgtggagcttgcatctcagtgagggaaacagggctaaattattactacgtatgtagctaagtgcaatggaaagtaatgtgcatattatcagtaatcctatctagtctgtgggagagatgctcatgaaaggcctttccttcacctaagttgagttttgaaggataaagaggagttagggaggcaaacagaaagggtttaagaccattccgggtagaggaaatggtaaatttgaagaggcatgcatgttgaagaaacaaagaaagcccagcgtggctccataacatcaaatgttatggaggttaagtgagacagcagatggttctggatatttatcggtatataacaaacaacctcaaagtcttagtggcttgaaacaattatacttattctgattattagtctgcaatctgggtgaggctcagtgaagttacttcatctctgctccactccatgtcagctaaagaagtagagtgacaaacccaggcagaagctctaacaccttttgcaacttagcatcagaagtgtcttagcattacttctgctatagtcactgacatgcccagattcaaagctgtggccataggtattagcttatgttagagaagtgtcagcatcatattataaaaagaacatggaaaatgcaatcttctcaaagacacacagtattagaagaatgcatattcagccaggcgcagtggctcacccctgtaatcccagcactttaggaggccaaggcgggatcacttgaggtcaggagttcgagaccagcctggccaacatggtgaaaccctgcctctactaaaaatacaaaaattagccaggcatggtggctcacacctgtagtcccagctactgggaaggctgaagcaggagaatggcttgaacccgggaggtggaggttgagctgagatggcaccactatacttcagcctgggtgatgaagtgagaccctgtctcaaaaaaaaaaaaaagaaaagaaaagaaagaatgcacatttgttgggcgcggtggcttacgcctgtaagtccagcactttgggagaccaaggtgggtggatcacctgaggtcaggagttcgagaccagcctgaccaacatggtgaaaccccatctctagtaaaaaaatacaaaaattagccgggcgtagtgtgcgcctctagtcccagctactcgggaggctgagacaggagaattgctcgaacccaggaggcaggggttggagtgagctgagatcacgccactacactccagcctgggtgacagagtgagactcggtcttgaataaaaaagaatgcacagtcatagtttatatcagaattattacttggtattatcaccaccatcatcacccaacttccctcatcctgaccacatacttaatatagtattttgttgctttgagttacatagcattggtgcacatttaaattttcatatccattgaaataacatattttataaattaggaacaacaggttcatgcatgtactagacacttggtatatgatagaatatattgttgtagttattccacacattgtctgtcttactagtcaaccttcaaggataaggagttgctgttacatacctgtaaccctgatgtctagggcagtgtcctgcccagagtaggcactgaataaatgtttgtgttttttattgttgttgagctataattgttaacttgagatttcctaagcaggtgggttttctatcctgtattatttctagttcagatcatgcaatctatgcctaatatatattttctatttactctttttcagtaactgctgtctcaaagtaaaaaatggaaatctttgcctgaatggactggtagcaacagatctgaaattcttagaaatgttggaaccagaagctacttcccacacaatccatgaagtgggggagagagagacagagagagagagagaaaagagagaaagagagagagagaaactgggtcttatagagagacagacacaagtactacccagttctcgaccctcaccaggtttgtggctttaggttctgtgcctctcttccttatgtgtaaaatgaggctaataacacagcagcacagggttgttggaagagtaaaatgaagcaacaaacaagaagatgctagggatggtagaaaaatgctaataaatgtcaaatatggatagaaaggaaattggatatgaggtataggtctgtttagttttattaacaataaaataattatatatttaatatatttaccaaaaaagaaactgcttgacaaaataattccatatactataacgtcaaattgtaaggcttcctattgctttcactttttttagtaaaagtttttattgaagtataatctgattgcattttggaataagttaatttacaataatttaatttatcttatagccttttaagatcacattcagtgcaatggataaagcagaatgtatctataatttattgtcagggttagagacttgaactgataaggatatcgttatctactgtttagggcaaaagatgtaaaatgactgtgcattaagtgccaaggttttctctaaaaagggcccactgtaaacgccagaagcgtgccagttcaattcaacaaatatttaattagcacttgtgatttccaaggcaccgttttgggtactgaggaggaagcaaaaaatgaatagctgctaatgccagcgagagacaagacatgaaccaaacaactagagtggaaagagtggggcgtcgtgatgtagaaaacgcaaagcacaggaagaacctagtggcgcttaaaataatccaacttttcctgccttttttcttcttctttttaagattctattttggatcccttttcgcatgtgccaggtcgcttgtcggcagagaatcctcaaccctgagaaatctctcctcctattctttctttcctcacaaattcgatgagctcttctgccatcagcactgcttttggaatggtatctattgtgtgggtggcgaaacgatggagagatatttttgttctaattatgagaactgttttactgggggaaggagggagaggctgatctgaagcgctgatgagctgctctgagaggatcctccgaggaggcgttactaaggttactagagagaggacggcaggtgataggcacggtaaaacaaaatatattttcaaatgagaggcgtgggctaagcagcaagcagtgccagcggtactagatgccggattccctagaggggaaaggaaggaggcccagggaaaaactgggagccgcgacttggcgaaagctggaagcctcttcgtccctttccgggccgtttctcccgctgcccttgtttcccggagctgttctggctgtagcacaaggtcggcgcactcgggggacggtgccatttagatgtaacacgtggccgtgtcggaccggaagtggtgcccagtcgggacccgtagggagaggcgggttgcgggcggcggcggcggcggcggcggcggtggtggttgtggcgaggctgtgcggcagggcgcacgggacctgtgctgcagcggctctctcaggccgtgggtcgtcgctgcagctgccgggaaagaaggaaacgacgactccgggggcgaacttggcacacagggaggaagggaaagggtgtgtgaggagggctgtgggtatatttggcatcagggagaaggacctcaaaacttgtttttcatatagtactagctgatcgtcgggtttttttttgttttggtttggtttttttttttttggatgacagattctggagacacctggcatctccgtttttgagtttctccccgctcttgtcagttgattcgtaggcctgaagtgagtgagagctttttagttcaaccagtgagttaagataggtatgggtcggatggagcggccagcgaataaagaaatgggagagtgggagcaagaataggaagtcgtgtcctggggcgagggaaaagatgatgatgatgatgtaacatttactgggtttcactgtacaagacaccgttaaaaccctttagatgaggcaactcttttaatctccattcgtatgaggtcagccatcttactagcctctttttataaatgaggacactgaggcttggagaggttaaggaacaggcccaaagaaagacaaatggaaagtgcagagccaagcagtgaaatctagtaggctgatcctagaatatatctctaaacacactacagctgtcccccatcaagatgtaaagaacgtgaggacataggacaaagagtgagaggacaatatggcttgaacagatgtggtaagacagctggagttgacctaaaaaagggtgtaaaatccaggtgtgtaaggcaataacagatgtaagggagggtagagttggaactcgggctttcaaaccttcatctccaaccttaactagcatcttcctatctaggattttagtggggcagagaagagaggtatatacccacacacctatgtttgaaaatggaattacagactttaaaggttatttaaagatttaaacaacttaaagattatttcatgtagctatcttatttaatagatgaagtccagggagatgaaatgacttattcaaggtagccaggactagaaacatgtcgtttaccctagatccaatgcaatgaagtttagagagttctttcctctttttccagctgcacttgctgtcgttatattagttttaacaatttgatatatcatttaacctggactgttccttccagccatgtaaattagttatgtatgacatcaaatagtccatccttccttcttagtgtgtgttccaaattcagtgcaaagctggaactaggagcttcttccaatacaattgagtggcaactgaggtcttccagcatttctaagaatttcagttctaaaatgaagtcccagcattttgggatgctgaggtggacggattgctcaagcccaggagtttgagaccggcgtgggcaacatggcgaaaccccttatctacaaaaaaaaaatttttttaagtttgccaggtgtgattatgcactcctgtagtctcagctacttggagaggctgaggtgggaggattgattgagcccaggaggttgaggatgtgagccatcaaggcgccacagcactccagcctgagcaatagagcgagactctccaaaaataactggataaataaaatgaaacaagagaaagctgactaatccaaagggcaaggtggtttaccttaaagaaactcaaaagaaaatggaaatctctacatatattgaaaaagattacaggaaaattttcatcaattgatgatgtactgttcacaaatactgtaattctcctggaatatagtaaatcatattccagagaggaaatttggagtaattgaaattgtgggcgcaggaatcaagtacagcagattagccacttactggatttgtaaatagatttacttaactttgattacttcattcctaaatgaagataactttctaacttgcagaattagaagtgttgtttgtaaagtatttaacacaatgtctagaacaaagttggtgataaacacacagtgattattactactctgaatcaaaagtgaaggattgctaaaccttgtaagcagtcactgcagcttttaggcctggtttttcagtgaaaagatcaaagagtagccttctttgttcacctaatgataattaagggtgaaaaatgttgatgcatttcctgaaaggtatgtctcttatttaaaagcgaatgaaagttttagatggctagatggcctgtgaataggaatctgcccacaatgatcctttaaaactattgtggctgtttaagataacttatttttgaattattgtttcctggacaattggcaacatagattctaaatagctgactttgtactcctttacagatgcatggtcatggaggctatgattctgattttagtgatgatgaacgctgtggagaatccagcaaaaggaaaaaaaggtaagtaatttttttttattgatctatttttcacatcctttctagattaatatgaagtataaataaacaagagtgaaatttttgaattctgtttacatgtgaagacaattgctctagtgaatgaatttttgttcattaagctaatacattgattaaaaattggagaacaattgtgggaaaaataaaaattaattctgcaaaggggtttattgaaagggaaagaagagtttcagatttctggaatcttttcagaaatcagtgaaaccttttcattacatatatttttcattcaactgtcaaggactgtttatttgtaaatgttgtagctcagaaggggcttgaatggtggtctcttgccattacttgccttcaaagtgaagttaatatggaggatgaaagtataatgcagcacagttcttacgcatacgtgaatgagcagactaaggtcacgggaagaaactcaaggaaggtttttttgaattgcaagagacaaaaactcttagcacataaagcctgtgcgttataagcaggatacgtcttggtggagctgctgtgcgtaggagcattgttcttagctttcagtgcatagaaactcagttttatactttgactcaggagtggttgactgatgtatactaaccaaacttacacggctgttgactgatttttttaagcaaatgtatagaaattggcttattatttcacactgagagcaatatattaggcatactaacaggttctgaacatttttataggatactcagtctctgcaataaaggatagtactaattataataaattacatttttgatgctttacattttctagatttttcattcaaaaatactactttgtaagaatagaatttgagcaaatctagttggatactctgctccaggattatattcatcactataactagggctgacagtctatggcagggtgtccagtcttttggctttcctgggccacatcggaagaagaattgtcttgggccacgtactacagtggagcacacacaattgtgaatctgttggttcacattgttggcctgaagcagtgctgggcctgcgtaaaatacactaatgatagccaatgaggtttaaaaaaatgtgaaaaagtgtcttaatgttttaagaaagtttacaaatttgtgttgggccacattcaaagccatcctgggccacatgaggcccatgggttgggcgagctggatctgtggtttgtgttctctataatcagccttgctttttgtgtatcattaattaccaaaaacttccttatcactatgttacagatagagaaatgaagaaacaaagagataaataattgaatcttattaagattaaggtagtaattgacagaattaggatttgaatcaggaagctaggtgatatgacactagagtccatgcttttgttagtttcatcttccccgtgttataggtattaaaataatgttaaggtattaattaagctatttaaggaaatgtaaaatatctcattaaagatcagtgagtcttcttaaagttaagacttacattctttaaagtatattccagttatgaaaatataaagaattagaaaataacctttgaaaaaagtgaactcttattttcttcttaatatatcaggacagttgaagatgacttactgctccaaaaaccatttcagaaagaaaaacatggaaaggtggcccataaacaagttgcagcagaattgctggataggtatggtatttcagtgtcaattctatttcttggtttaagttgcttcggattaggggatttgattatgttaatttgaatataaacattttgaattttcttaaaaaaatttgttttaacagggaagaagcaagaaatagaaggtttcatctcatagctatggatgctgtatcctttttttatttccagatttttataactagtagaatattttaaaatctgcttttttgttttataaaatcttgtgaagtcaaataggcttttttatttttaaagataagtatttagtgatgtaggattttgccatttatacttttgggtacaattctcttttactaatatataggaaagatttagagacaaaaataataaaacatattactagtactctataaataggtttataaagtacatgaatctgcaaatatattttccaaattgttttttcaagctttcaacatttccttttcctatacttatctttagtctcattttaatttattctcttcctacctggttctttgctatttaaggtctctataaaacttgtatttaaaattaggtctatccagtctgtccctggatctaaggaaaaaataaaaataaaatgaggcctgcctgtggactgtcctcaggcctgccatggctttaatttttaggcatgacttaaagctatctttaagataaaccctgcttcctggttatagccatttgtcaactcagttttttaataagactggctgatgacactaactgctacgctggccatccatactgctgttgagaatattggagaatttaagagataccaagcaaaaactgaagtatttttgggtatttattgctgtgatcagaattgggagaaggagacagtgtcaatttgatacgccccctacctgtaatcatctgtttcactgtgctattccaatatttttcttttaagttatagaagtaccattgtgtcactaattgatttattcttcttatctcctaacccaatagctagcttttccatggatctcatctgccatttgttcctttagcatttaaacatttgctctgccttctctgacacctactgcattgggggcacctagttatagcctggtgagagtgaaagtatgggtactcttttttctggcataggaggagttggagccacagttttttttgtttgtttgttttttgttttgtgtgtgaggatttattttattttatttttctttattttattttattactttaaattctgggatacatgtgcagaacgtgcaggattgttacatagggtatacatgtaccatggtggtttgctgcacctatcaacccatcaccctcacccttccccgcccaccggctccagtgtgtgatgttcccctccctgtgtccatgtgttctcattgttcagctcccatttatgggtgacaacatgtggtgtttggttttctgttcctgtgttagtttgctgaggatggtggcttccagcttcatccatgtccctgcaaaggacatgatctcattcctttttgtggttgcatagtattccatggtgtatatgtaccacattttctttatctggtctatcattgatggacatttggattggttccatgtctttgctattgtgaatagtgctgcaataaacatacatgtgcatgtatctttataatagaatgatttatattccttttggtatatacccagtaatgggattgctggatcagatgttatttctggttctaggtccttgaggaattgccacattgtcttcaataatggttgaaccattttacattcccaccaacagtgtaaaagtgttcgtatttctccacagccttgctagcatctgttgtttcctgactttttaataattgcgattctgactgggaaccacagttttctctgggttgtttgacaagagtagagtagttattgtctcaaagttgtcttgctaggctgactcttggtcatttggttagagagaacagcttttgttgacgattttttagtccgtgcctgttggtgtttccgggttgtcaccttctttacctccaattctaggatacatgagacaaaaagaaaacctagggaactcgctatcatgtcataccataggtcttcaggaggtccctagcggggcgccttcttccttccaccttttagagtctttttatgtttgatatataatgtataaggattttagttgttattagtatgaggaatagggagaagtacatctttgcctactccatcttcccggaagcaaaagttacacccaccacctgttcttgtacataaaattatattggaatacagccatgcttcatttatatgttgtctttggctgctttcatgctaaaatggcagaactgagcatttgcaacagagaccatatggcttgcaaagcctgaaatatttaccatctggccgtttgcagaaaatgtttgctgaccccagctctaataggttacatgacttgccatggtcatgtgaccagttagtggtagatcaagagctagaatccagatctccaggtatttggtttttctgtctctctcttttttttttttcctgaaatattaactggtttgttacaatatggaaataccataatctgattaaattgtctgttagtacacattatgatcagttaaatcactatacatgtttaatagtcacagagaatattgtagaaggtgaggttagctattatgtgcatgtttggctctagagagagtgctgttgagctttttaaaacaaaaagtaaaatgctcatatattttgttacaatgctttgaaaaaacatggcattttattctttgaatttaaaagactataaaaattgattttttatatttgcttttttgaaagtttaatgttgggatttaattataaattataaatataattataaaagttgcatcttctatttagaggctttatcattactaaaatagataaattatattttatgataatgaaagataaattctctacttttagaaactataatttttaaatttttcatattgtgattattagaatgagtggtggtaggaggctatatgcagttcagcaatagaataagaagctctatttctccccagatggaggtatatttttatcacaagagtagtatatgcttgaaaaatagtcaaaagaaagcctgtactttacaatcttcactttcaacaatttaatatatacccttctagattttctgaatgtgtaagcatgtatagtgtgtgaatatttttaaaaagctaaatagactcatattgtgcttttttttaccaccaatcagcaatatattatgacaccaaacagctcctaagagaataaaatccttaattttttgcatttcagtatcaaagacatacaaagttcgtaaatgactatattttatactatggtggcaaaaaagaagacttcaagcgtttggggtaagtatcaggaagtttacatagaagggaatgtgggttatgggaaactttaaagacccacagctactgtgccttctgattctgtcattcttccctgctttctattccggtgtgcctttttttttttttttttttttttttttttttaagatggagtctcactctgtcgcccaggctggagaacagtggcttgatctcggctcactgcaacctgtgccgctgtggttcaagcgattctcctacctcaggctcccgagtagctgggattacaggctcctgccaccatgcctggctaatttttgtatttttagtagagacggggtttcaccatcttggccaggctggtcttgaactcgtgaccttgtgatccacctgtcttggcctcccaaactgctgggattacaggcgtgagccactgcacctggccccagtttcttttttatattataaggtagagataccatccacagctcctgagtagctcttcatgaatcccatttttttggacaggcctcaggtagactctttacctgctgagccgggcacaaccctggtgataaaagaatatctgaagaatactcatgtgtcttcttggcaaagatctttgaaataaggaaatttttataccttgatgtttgggattgctttttaaaagataggtaaacaagaactctcagtctagcatttcttgcacatcaaagtccttcccatgtttaaggctcttctatcagaacttgttttttgttttgttttgtttttgtttttttaaatttttatttttatttcaatagtttttgaggtacaggtggtttttggttgcctggataagttctttagtggtgatttctgagattttagtgcacccatcacccaagcactgtatgctatacctaaaatgtagtcttttatccctcacctcccttctggccttcccccacattgagtccctaaagtccattatatcagtcttttgcctttgcatcctcatagcttagctcccacatataaatgagaacatatgatatttgattttccattcctgagttacttcacttagaataatggcctccagctccatccaagttgctgcaaaaagacatcatttcattcctttctatggctgagtagtattccatggtatatataaatggtgtgtgtatatatatatggtatatatatatatatatggtgtatatatatatggtatatatatatggtgtgtatatatatggtgtgtatatatatatggtgtgtatatatatggtgtgtatatatatatggtgtgtatatatatatggtgtatgtatgtgtgtatatatatatatatatggtgtatatatatatatatggtgtatatatatatatatatatatatatacacacacaccacattttctttatccactcattggttgatgggcactttggtcagttccatagctttgcaattgcgaattgtgctgctatagtgtgtgtgtgtcttagaacttcttagttttatgtgaggttttttttttccctctaacaattttctgagttggtaggactctgagaaaatttagtaccacctcatttacccccaatttatctcacctatcaatttatcctatatctcccaacaatcacttttttttttcctttttttttttacccccagactgttagcattttattttgaaaggtcaatccctttggctttcttcctcctttactcagtcttctacctaggaaactagtaaaatgagatacggaaaacttttcatattttttaaaattaaatctcagcagagtggttggttagaatgaaacttattttcattcactttattcatttagtgtttagtcaggtttctcattctagctttggtaacttagcaccatttgtataattgaaaccaatgctacagacagattccttatccatttaacttgcttctgtagtagtatttttataagtgccttttgaaaatactgaaatatttttataaatatgtgaacaaatttatactcaccaaaaaactatcttcatgtattatatttttaataaaattttccaaaactcacagagctatttaacctaaatttgactacttttgtttttgtattaaattgaaaaagttctgttttccagggaaaatgacaagacagacttggatgttatacgagaaaatcatagattcctatggaatgaggaggacgaaatggacatgacttggtaattagccatcagaggcgtaatgcatcaaatgctttagtcctgtttctcctgttttctgagtggttttttagtcaaggtgttcagccccttcatagaacagttctgaatcaaggacataaaatcaagcctaggattatttggttcttttggtaatttttggcagttttaactgacttctcattgtttgacttagtcttcaaaaaaataacattcttttttacagtattgtgtgttatcttgtaatatgttattatatgctgctgttttagaaaaaagtcatacctgaaaatgtttttttaaatccaaacattacaaagggtaaacagtgaagagtgattctccttcttatttgtgactgtcagttctccaatttccctccctgagtgaaccacttttaatagttaatatccagatattccatgcacatgtaagtaatagttctcttaaaacattaatatttatgtagtatgtattctttgacatcacttgaaagtagcaaaccatggttgagtttctaaatgtataatatttatattttcatgggtctagggagaagagacttgctaagaaatactatgataaattatttaaggaatactgcatagcagatctcagtaaatataaagaaaataaggtatgctttccacatatttatggaaagaggttcttattcaagtaaaatattaacttttattatactgtcatgccccacattattcttttaaagatgctaattctagactcagttgtcctgcgtttatgatgtgtcatttggaccatttaacctctgcagctgtggagtttacaaaaggcctatggaaatttatgaaggacaaggatgcttttttttgtttgtgagctgaggcatgaaaagtctaaaattaaacgcaagtgggtattggatcctgtttcatcctgactctagtctagagcctctagtgattgtaatgaatgacttaactctacagaataatgtcttatttcacagatgatgtttgaaactgatagattttaaaaattgattaccatttatagagatccagatgcacatcttctattacataaatgtctattctagtaaaattaacatttcaatcagtgctaattagtaatgacagatttcctttcccactttacatcttactttagttaatatttttatttttggttgggcgtgatggctcatgcctgtaatctcagcactttgggaggctgaggcaggaagattgcttgaggccaggagttcaagaccagcctgggcaatatagtgagactttgtctccacaaaaactaaaaaaaattagccaggtgcagtggtgcatgcctatagttctagctacttgggaggctgaggttagaaggttgcttgagtccaggagtttgaggctgcagtgagctatgatcgtgccactgcatttcagtgtgggtgacagtgagactctaaaaaatagaaagttacttttatttctatctcaaacatcaaattatagctggaaaaggtgacccaggagcagatctcagttagaaatgtgagaggagggaatgttgcataaatatgtgttatagatactgtatatttgtattaagaaaaaaacctatttaaaaagctatcttgtatttatctatcatgaagatttatttgtcatttaaatcatttgatctcattagaaccagggttgatttaataattttttcagtagtgcctttaatatgtgtgttgcttcacagtttcttatagaaaatagtaataatgttcattttgtataccctatttataaacccgtgcacttaatttatccccagaactgctgtttcttatgaactagttatggactctggttcacagctgtcttctctgtaccacatctggttcaaaaagcaccacagtaattggagttacttaaagttactgtattgtaaatcaagtgtgaaaattatgtctttctaggagcatgtaacaaaggagatttttcagccctggcttattcatggattgttcttaagttgttgttttttttctttttttcatttatttttccccacctcctaataccatcataattcttcagtattttgttgttgttgtcagtatctattgaaactggactaggtactgtgggttaatacatggtgactacttttcagaaaaagctagtctagttgaggggagaaaatatacataaataaaaattaaatatttgagttctcaatttttcaaaaatggataccactagaaatcgtactttaaagaaaataatcttgaaaaaatgtgtattttcctgctagaacatgatgagtgattgtacatgagagtaaatgcagcaagaaatccgatatgactcgcagattctgaccatggatgctgagaaaaatacagaatttggaggaggattttttttgtggggggaagataatgagtttggttttggcataccatgtttgaggtgttggagaaagagtaatgcctttggttccctcactaggatgcattttctcttctctttatttatacaaagacaatgtattattcagttaattaaaaccagctcctaatatatatagtagatacttttagagcatttttagtgaatttccacctttgcctcttactcctattcctttctttattgcatttcccctttttagttggatcaatgtatcagttaggattaggtccagctgcaaggacagagaagactccccgaaaaaaaccactggcttaaatgagctggaaagtttatttttcttatacataaaagttcaagtcgatggtcataaagtcagaatccttcttgtttactgcttgcgtacgtgacctcattgtgatgagtgcagagtgagaagaaaaggaggctcagcaccaaatcctgaataacttcagctttaatccaaactaggacatttatgtcaggaaataatatacagtctttaactagtaggatataatgtaatttgttttgttacatttattatttcctcataagattataatcttggtgacacactattttaataatcactttttatcctcagtggaatgccaagcccaataggtagttgcttaataagttgtctgttgaatagattaatgaatgaagaagaaagtttggaaactattgctgttacacttggctgtgcttcagtagacatcctaacatatgttggatggcaagcaatctccacatacatatataggctgaaaaatagaattaaacagagttatcctgaaattttattttttcccctagatttggaggattttatttttgttgggttttaatcagagtattttgaaatattttgagcctttatttgcatttaaaatacaaaattgccaaattcaagtaatagattaatgattttttaaaaaaaataattgaaattgccaggcacggtggctcttgcctgtaatcccagtactttgggaggctgaggtgggaggatagcttgaggccaggagttcaaaaccagcctaggcaatatagtgagaccttgtctctataaaaaataaaattagccaggcagggtagcacatgcctgaagtcctagctattcggaaggctgaaaaaaaaaaaaaaaaaaccccacaacaaactgaagttagcaaggcattgaacactttatatgaatcctctgtcttactataacaatccggtgaacttaaggttgttactatttccatttttatacatgaagaggaagtagagaagttaagtaactttcccaaggttaagacctaatgagtgacaagagcttcttgagttgggtacaggtatgcatgtttctagactggagtggttttttatttgttgttattttttgttgttgtagtttttgtttgtttgttttgagacaggctcttgttcagttgcccagggtggatggaatgcagtggcatgatcatggctcactgcagcctccacctcccaggttcaagtaatcttcccaagtgtattttttgtttgcttttaatttttagagcatttttaggtttacaacaaaattgagcagaaagcacagaattcccatataccccctgctctcatacatgcataacatcccctactgtcagcatcccacaccagaggggtacatttgttacaatcagtgaacctacgttgatacatcattatttgaagtccatagcttacattagggttcactcttggtattgtacattcaactgctttgacaaatgtgtaatgacgtgtgtctaccattatagtaccatagagaatacttgcactgccctaaaaatcctctgtgctccacctgttcatcccaccctccttcctaatccctggcaactactgatcttgctacttcctccatagttttgccttttctggaatatcatacagttgaaatcatatatatgtagtcttttcagattgggttttttcactttgtaatatgtacttaagtttctccatgtcttcatggtttgatatttcttcttaccactgaataatattaattgtctggatgtaccacagttgtttatccattcacttaatgaagaacatcttggttgcttccaagtttcagcaattagaaataaagttgctgtaaacatctatatttaggttttcatgtggacattagttttcagctcatttgagtaaataccaagaagcatgattgttggagtatactagttactattctaagtgtttcatatgtattatctcatttaaacctctttaaacctctgtgagtaccaaggaagtaggtactcatatttctactttacatatatgaggaagctgaggcaaaaaagagattaatttgcccagtactatacaactgttaagtggtagagctaaaatgcaaatgtaaataatctgactccaaaggctgtacttttttgtactagaatatactacctctttactataccataacctctttttttcttgtcagtcttacagaacaggatatattatttgttaacttaggtatcttgtggcctggcacctataacttttaagctatcttaaagtagattgttcttaacagataaattggtgattgttcaatgtattttcttcaaatcctataagaagagaaaaatctgtcatgatgggaattacatttattttttaggttggtgaatgtcattgttggctccatgtttagatttctgtataatttaaatttacattggcataaatgtaatttttttattatcagtttggatttaggtggcgagtagaaaaagaagtaatttcaggaaaaggtaattctttaaaatttttactttttaataggataaacttattttgttaagttactgaattggagtcattaagatcattcctaacatatacaagaaattattagctacaaaagtaaaattagagaaggtgtattcatgatacattattagcaaaggtctgaatataatgctttaatgattattacctttatacttttgcctttagaacattcagttgaatgttctgcatatttctaagtatgtagaaaatattttacaaattaaagatttcatagcaagacaactttcaacaaaaaagaaaggtttatttttttcctttctttattaatttttggaataatgaattggtgttactgtttttcagccaaatccacatttcaaaagtagaagttaaatatcactttaatcccaatagaattttggggcaggctagtactcatttttggaagtcccttatattgagcccaaatacttagtctaatagcaaaagaccagacatttggtaggcaatcagtaaatgctttttctatgcattattgtaaatctattcattaaatttttcctggaaattgtgtatctccatactgtctcttgctataaaattagctccttactgagtaattgcattttaagtgttaaagtactgaaaactatatagtagcactaaggaaataattttaaacttactttaaaaaaccttttaaatggaaagattacatttttaaatgattaaatatttatgctatcgtggctcatatatatcttccataagttggctatgttaggtgtgaaattgcatatgccataaaacaacattaaggaaaaagaataaatttaaagctattttaacttttcttagggttatattttagtttatgtttttatctaaaataatgagaaatcctgaaatgtctatcacaattttaagatgtacttttattgaatgagattttcaggtgagtttataatgctaccttttaaaaaaattgatgggtagtctctaaattcatataactgaataaaagactagttaggaaagggaaagaaagctgctaatgtgatttatgtgatttcttttataaagttataattttgttgctgttttaacaacaaagccttacctactaaacatatagatttaataaaatattcatttggaatgagtttaaaaggctgatttagaaataagtctttttaggatataattttctaaattcattttgataatttcttaatttttatgaaaaagatttgctggttacagatttgcttctgttagtgcaaattattgtgatataaattaataagagtttgatcttgtctttttgccaaagtaaattactgttgagttgtttctctttttttctctcaggttatcagttagtctttttttggaggttttaatatattgtggacatggtaatgtgtgtgatgttaataatagtgtcaagttattctaaaatttagagtatcaggtttgactgcgtattgtacttcacctcaaagtgctagaatttttaaatgtgttttcaaggccatctatgctagtatttaaaataaatgtcattatgctaatacttaaaactattaactattattaccattaaatattgaaaggtttcacccagctataagtgtgtgtactttggaaagtgcgtttttttttggggggggtatttgtgagtatgttgttttttttgtttttgtttttttatttgtttttccttaaaccaactttctgagaaatatgtccattctttaatactgtctttccaaagtgtaagattccctaatagggagtcgctaaaatgtctatctaaatacagtctatcaagcaagaattctgtgactgattttttttggtaacagtactttgatttgatacttgtatacaagttggttgaacatattactctggtcagtttttaaaggctgactatggttaatttgcatattttagaagtacattttaggggtaatactagatcatatagataaatattatcaccaactaccatagctaatattcctttcctttctgcaggtcaatttttctgtggaaataaatattgtgataaaaaagaaggcttaaagagttgggaagttaattttggttatattgagcatggtgagaagagaaatgcacttgttaaattaagtaagttgattttagggggtatatgattgattcttccaagtttgtctttaatttaaaaatatatagactttaaaattcaaatgcaatttttaacatatctttctggaagtgctcttttttcttggagcttcccaaagtctcaaagaacttttcagcctcagttttttacatttttagcattacagtggtgtttcagtaaaaagaattctaatgtcaaatgtaaactggtaatttgtagagtggggctccgtccccattaacttgagaatgccaccacattacatagctaagaggcacagtatcagaaaaggcagtgtaatctcacattagctgattactcagtgatatcgttgtagcacagataataaacaaattcactctgtttcacagtattaataaagaaaaactttaggaaggcataattgttcttgacctcagtcttaaaaccatagggaataaatactccagaatacagcagtttcccttaggatgcatgttttagagtctgtcattcttttatttattttttaagttagtcttcatgtgtcagctgttcctctagccttctctgggtcctaagtaaatgtgccttcagagttttctgctcatacctaataaaagtcaagaatgtccccacatgctacgtatgcatgtcaatacagactgatttctgagttccttctggaagtgctcaagaggaaaagtcagccagtgtgaactgagattaaggcaaaaaaaaaaaaaaaaagagaccacaattatggaactatttgaaaagctcctttgcatttgaaagttcttagagcacttcagaggaaatgactatactcacattattattagatatctttgatgtgagacacatgttaatgtgcctgtggaacacagtttgtttttggaacaaattgacaacacatttttctaaaatagtgttattttcaattcctcaagctaatatttttattatatgtatgtgtgtatatatttgcatttttgaggtgatgaaggtcagattgttttctttggattgtttgtttaccctcttatagtaatggaatataaagaaagtgcgaatttatgatattaaaagtagattagcagtgtggttattcaaaatcagccattcagtggtgtcttttctttttagggttatgccaagaatgttccattaaattaaatttccatcacaggtaatgtcttttaaaatgccattcttaatgtttagtaatccaggatatagtcatttacctgcactaagtatctaaatgtagacttaggtggttgatggttgaattggttgatcatgtagaaaatgtggcattgtcgtatggctacataaacgaggggtttagaagtccgctatgccctattcttgccaagcagttttaaatgtaaaggcctatgtgaggtggtagatggatgttagaatttttagtttggagccaatgttctgacactttaatattagaaattatgttgtaaagcagacttcataaagcagttcttgtgtctcatttagacagtgttttagctggagtttgccattcttacaaaggattagacacctctatactcattttaaatgttaaaatcaagaacaggcgcggtggctcatgcctgtaatcctagcacttggggaggccagtttgggtggatcacttgaggtcagaagttcgagaccagcctggccaacatggtaaaaccctgtctctactgaaaatacagaaattaactgggcgtggtggcaggtgcctgtaatcccagctactggggaggctgaggcaggagaattgcttgaacctgggaggcagaggttgcagtgagccaagattgagccactgcattccagcctagcaacagagcaaaactctgtctcaaaaaaaaaaaaagttaaaatcaggcttttattgaatgagctttaatgtatctgccacattgaatgtgtgggaataccagtgtcctgcagttatggggtttgaaatcagacctcagtttttaatctcagcttctccgcttactaggcttcttcttgggcaaactgcttaacctctgtaaggcttaattttatcacctgtaaaaatgaggctactcaggctattgtggggaataaatgaaagtgcatgtaaagtgcttgccacagtacctggcattaaagatgttcacactgattcttcgcaacttgcctttgtgatggtcaggttttatgcgctggataacagttaaaagttcagcttttgcaactttataaaatgtatacataagcatattaattttaaaatagctttcttttttttaatcacatgggttgtcaaaaaataacagctttgttataaatgtgcctatatagtattttagctgttaaaaataaatgttaaataatatttttaattcttaaaattagcaggattatttttattattttcattattctttatttttttgagacaaggtctcactctgttgcctaggctgaagcacagtggtgtgatcatggctcattgcagcctcagcctcctgggctcaagtgatcctcacacctcagcctccagaatagctgagactacaggagtacatcaccaaacctggataatttttttttaaagtttttgtagagatggtgtttccctatgttgcccaggctggtctcaaactcctggactcaagcagtcctcctgcctcagccgcccaaggtgctgggatgataggcataagcctccacacttggccagaacttttttggattactggaatagcctaaacctttatttccccttcccatcagtgatactgaaagaaagcagggatttgttttgaccttgacttttgagcttcatttcaaaatggaaatgattcttacaaaatatgcaaaagtggttaatgcattaaatactattatagcatttagtagatgtactttaacttggaaaatctactgaacaagttttttgaaagtaatcttttcctttgtctctattctccttgccagtcccaatttcagcattatcactttttcccatttagtatttcttttcttaacctattaaaattaattaattgtttgccaaccttgtaaacctgctctagaagagataaagctgcaacaataagagtataaattataagtggcctgatgttgatatatgaattaacaataagccctttccattttcattccattatgcttctactatattcctttattcttaagagtagaaatttctatttactggtggcttagagctgttcagcagtttcttcttctttgtgtttttttaacatgtaggtggatatggattatgtgaagggaaatgaggcttttttttgtaatttagttttaaatggctaagtgatagaatatagaaagaaagaaacaaatacaattataatttgtatttactatggtcgtatacagaacttatagaaagtaattatttgtgtcagtgttaagacttcattatcttatagaatgattttaattaatatacaagcataaaatatttacagtctcacttaacgttccttattatataaatcacatttaaaaaataagtattttaactgattttggttttttgttcatatgatggttatttttgaaaaggtcagttggaaaagttaactttaattttatattgtttaacacaaaggagaaaagaaatcaagtcaaaaaaaagaaaagataaaaccaaaaaagactgtgaagagtcatcacataaaaaatccagattatcttctgcagaagaggcctccaagaaaaaagataaaggtaaaaggaaattaagataaggcatctactcacatttgtgagcatgaaatataatctgccatatttcattcatctaattggtgaatgcattgagaatttcattttatggtagttgagaggaaactggctgagaatttagatatgaacttaaagtgacttacaggagttttaagaactcctctaaattaattaagggttaattttagttcatttttggcagatagtataatattgccaacagttttctaattcctggctttgtcacctacagacttgttactttgcatcagtcactgaactgctttatttttcttatgtgtataggggtgaggtgcatacctggccttcatactggtcaagcttattgtggaaactcaaataagaatgtgaaagggactttgatcagtgcctttaaacagtctataatctataaatcaatataaaattgtaacactgattttatttataatggcctgtgtgactttttttactagtttatgagtttctagaaatgagaaagattgtcatatatctgtgttctcagagcctagcatggtgctgtgcacctatacttagaactgcctgctttttctttagcagtccttaagctcgctaagactcaatttcttcatgtgtaaaatggtcttgattccttttagaattgttcagaagttgaaacgagataattcattaagcagtttgcatagtacttggcacatattagctattatgaaggttacttctagttgctttttttagcccataataaagtagagtcaatcggctgtaatttatagtgaatcagactaatctagataggtaattgaattagattcaagccaatgttaatataatatttggacaggagagggctctcttgctccagctatgaagatcattagctatgttgcatgcttagaagcatttacttcttcttgcacatggtaatatattcattatgtagcagagtttaaatctgtgtgcccttgtgatactgtctactcccatagcttcaagtatatggtgtcaccaacctttagacttcgtaaaattgatagatggtgagaggaagatattgttattttattgcttattgagagatggcatttgtagcagaatgccttttttgtctctatcttaattattttccactctaaggtaaattttaaccaataaatgttaaaaatatgttttgagttttaaaaacttatttatccttatatgctagtaaaacatttaatatgtcacttaagaaatttgttgccctcattgtattatatgttcattcttatcacaactgtgataccatgttaatcactgcgtattccaaatgaaagaactagtctctactttataaaatgttactcagtacaatcaaagtagatcaggtagatgaatgctcaggttcagggctaaggttggacccttcgtattatgcgtacatatgcacatgatcttccttatagacatttttcccttagtgttctgtcagtagatgacacctatgttgacctaaaaactaatatcagaaatctggggattatccttgatactttctttccccttattatttatgtttaatttgtcaccaagtcctgtgaattttacccccagagtatatatttctcaagttctctccaccctactacaaaccactatattttctcttataggctactgttatattctccttacgggttccgcctctgtcttgccatcccaccttccctcctcttaatccattctccataaatcagtgatttcctgttgtttttaggctgataagcaaaatcctggacaaagctaaaaggttctctgtgatccagaacttgtgtactatacaaggcttgtttcttaccactctgtacctcacgttcacactccccccatgtagcctttcagtttctggaaaatgtcaagcctctttcaattttaggggttacatggatgctgtgtcttctcttcctaaaactctcagttctatcccagctcatccttcaggtctaagctcttaaatgtcatttccaaggatcctttcctgatttcatcccccaccttgaatctaaattaggactctcatttgtaatgctgtcatggctcctgacactttccattattacacatatgacgatgtaaaagccaaagaggcagagattctgcctgctttgttcattgctatatccccagcaccccactagctcatgttcagcataaataataatcagtaaaggactttgaagattcttcagggatagaagaccaaagcaaggtggaattgagacatctctttcttatgtattctctatttagaatgcctttgaaagcaaagtctctagaaatatagcttttttacccccaacttctatggtatataacagaaaataacaaaattttagcaaacttttaggaaaaccatgtggaactctttaatatcttatctgggatcatctagaattagctttatcattgatttgattctttcttgccagaccaccttaatttggaccagacttgaagagtaattaataaacgcttaacatctcagctgcgtttggactgttgacaacttcctttaattttatttctatctttctggcctctctttagctaatgcttttttttttttgtaagacagggtcttgttctgtcacccaggccccaggctggagtgctggaatacagtggcatgatcttggctcactgcagcaggcttaacctcggaggcccatgtgatcctcctttctcagcctcccaggtaactgggactacaggcctgcactaccatactcagctaattttgttgttgttgttgttgcagagacagggtcttgctgtttcccagactggtctcaaactcctggcctcaagcaattctctcaccttggccccccaaagtgctgggattaccagcatgagtcatcacacccgacctccttagctgcttttaactgaagttccttctcagtcttacatttagctgttagagttcctcggggctcttacctagatttctctagtttctctctgtactcccagtgtaatcccatcaactctcatagctttaggttaccgtcttagaaaatgttaaataagtaatagatggatgaactagatagctgaatgaatggatagagagaaaaaataagaaagatcagtagctgactttaaggaccagtctgctttggcaggtatgaggagaacaagatatttaggtagactgtcttggcaaaatgttcagaatcttatctgtctcaccatcacccctttcccaaaagctacgtcatccttcaggtttctgcttagctcaattccttggaaaggcccttcctgacacccttctcctcacttctccaaataagattatgttcctcttacatattccaataatacctgtcacttctcctttagaaatacatagtatccttggaataaattgtttattttctgtaagggaagggactgtgtgacatgtttacttcgttatctctaattcctaatagtgcttgctcccataggaggcattcaataagtgtaggtgagtgaatcagtgaattcaaccacattttctgaaagttgaaaggaacttcagagatcagtcctggaatcatgactgaaaggatattctttaattttgcttttcaaagtaaagtcctctgggcagcatttaggaacttgttagcaactcacaatctcagacccttccagatctactaacaagttcccagggcgaatcatatgcactaaagtttgagagaggcactgttgtatattatgtgattgttctgcattggttcaacatttccagggaaaaggaacccactactatcaaaaataaagctttacattttcaggtagttgtatttgctagcacgtttctcttaacattcagccaaaatctacagcttcctccctttggttctaattatgttcttgggcctccaaattaagcctaacgtcttttttacctatggacctttggatattgggaagcaggtatcatgttcctcattagaggatgacaggaaagaatacatttcctgtttccttaccctgtagttcttatactcttcatctggtctaaaggggccaaaaactttgggttacgaggcctcctatccaggaacattggaggaattgttactgtccatctgtcacctgcccttttttactttatcatccttcagaaatattttccctgaggtcttattgcaggaagctctgtatcgtggtgattttttttttaaattacactgaccgatcttcagtgcctttctctctctctttctctcactggatgaccattgtagagctgagaatttttgttttatgacataattgtgttgtgttcttatcagtttctgagaactaatacttacctgcatatatgactttagaaaagatactgtaaaaagcaagtatttatttgtaaactgctttcaaatgttgaacatctctatagataataaattattgcttatattgcagctaattatctgtgaggttttctttttagcaatatgagattttttttgcaggtattcattattttttgttttgtgctggctattacagaccatatgagcacataagatatgatctctgcctaaaagaacgtaacattttaatgagggagataagactaaggaacatgaaagattagaaaacagtgaagtgcttatctgtaagactataagcaaactagaatattgctaagaattctggttatagctacaatgattgcactattacaagatgatagttaataaatcaatgatgtttccttttcaggacattcatcttcaaagaaatctgaagattctctacttagtaagtaacaagtgtttatttaataaaaatatgcatttgaggtatttgcaatttagatttcccatgaatcgtatcttgctgtgatgtgaattattttttgtttttgttaattatttttgtacatgagaaaaactgtagaaaaaaggccaaaagtgtataggatttattccccaattaagggcattaagaagtttcttattttaagtatagagagcattaaaaatttttccagtaaatacaatggatatatctttcaatttcatgttataaaatgtgaaggaagaaagataaagggatgaggttgaaatggatttaaattaggcctatggttttcactagtttggatcaaaacagattggatttcgttgagtatttgctgcaaattttattattttttccctgcaatattccaaaaagtattcacaatgacttataaaaacatacacaataagtttttttaaggttaaaaaagtcagaataatggaaaaataaggtagaatagcaatgtaaaactacaggtgaaatttatacacacaaatgtattccaaaaagtcctgcataattgcagagatagatcacagatttgtcagtgttcttcctaacaaccaaacctaagagtgaaaccagcaatagaaagattaattgtacccataagataataatgagaactcctggagtgttcagctttttgctggcagttttgagagaagagtcttctatgggtttataaaagggtacatccatttgtgtcataacaaacagtagctttgaatctaaacagtaatataatgttgaattttttaaagacttgtagtaggctcaaggcctaataataaggtgtagttcaatagcatatctaattcattttatactctctggacttatctcatagaaatttagaaacttgagatttctaggcttacttagttattttattttatttttttggagatggagtcatgctctttcacccaggttggagtgcagtggcgcgatctcagctgactgcagcccctgcttcccaggttcaagtgattctcctgcctcagcctcccaagtcgccgggactgcagacacccatcactatgcccagctaatttttgtgtatttagtagagatggggtttcaccatgttggccaggctggtcttgaactcctgaccttgtgatctgcctgcctcggcctcccaaagtgctgggattacaggcgtgagccaccacgcctggtcacttggttatttataaacctaagaattaagaaaaaattttttatgactttaaaataatatttattgtggcaaactcagggaaaaaagtttgatgattattctaaatttcaaaactcaaatataaacattatttgcatttagtataattcttaacaagaaattttaaatattcaatgatcagaaattttgcactgagaaaaatagaaatgttaagatatttgttgtttaaaaatttagcagagagggagatgttgatggaggtattcctctcttaggaatatagtatattccttataattattttgcttgtacgaactttgttttcaacatatttgaagtgtcttaaagcactgactctttctctccacgtaaattctaatttatcaggaggtcctttcctaaattaggtaaaatgtagtgacagtttcgaaaatacattcaagtataagaccagtggaccaatgttatctcaggatgaaatcatagatacatacttcaacaaaggtgtacacaggctaaagtgggagagtgtattttagttttcatccatttccaacagtgagaggtgtgaatgcttatgcaatatagaaaaaattcccctttttcagttctaattttttatccttaaaaagtcttttggggcaaattcttgaatcactgatttatattattcttttatttcttctgcctgccttctccttcccactgtctttcaccccctgccctttgaatccttccctgcttcctagaaatagcccttaatgctcttttacctctcctcagctaagtcaaatttttactagtagaagcagggtgaatactgtgaagactatatccaatctgagaaacccctagctaatttgatcttgaaaaaacaaactatccacttcaagctgacctgctgtttggcagccggtacgctatttaccatagcaagcatgaaacatatacattgttatggtatgccaaccccagatatcctctcaggtggtcagtcatctgtattacatggtcttggcaatttcagacctcacattttgctctttatttccatttggacaatactcagttaccttcttaacccatttgacacctggattattaaaaccaaatccatggagaaaaactcaatttctgttgggacagtaacaagtgctttagatatgttacctcatttaatcttaataatgtgcatataatatcctcgttttgtagatgagaaaaatcaagacctagagaatgtctttaaatgaatgaagaaactcaatttttaaaaatatatatatttaaagtatacaacttgatgatttgctgccctcttaacaaatttcaagtattgttatctttagtcaccttgcacatgagatcgcccaagaaccaaagaattgaagtaaagtgcccaaggtcaaatagttaatggcaaagctgggattaaacataagtttataattccaaagtctatgccctttacctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgttggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaaaacagatttttgccttaatttaaggaaaaacttgtcccttagaactgtctgacaaaaggaatggagaaatgggctgcctctggagtagcgagtgttccagcatggactggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactgccaaccctcagggaaccaggatactatagattcatagggttataagggaccttaaaggtcatttagtccagtcttgtagacttgattctctagggatatctggccacttttttagtgggtattttttaagacagttagtttataatgttactctaaactgacttgattttttagtaaaattgactggtatcagaaaactggtgtaagaaagctggcatgtgggaagtactcttggaagggaacaagataacagctgtccacttctaaaggccttgtaggtttcgttctctggcatcattaacattagcagagtaatacaatagtaataaccttgctaggcctaattaatttttctctgctttctttatctcatattaatgagttttcataaaaataagagaagattttaattctttttttccctcacattatcaatttgggacactggccattccagtgatggctgtcattgagtcaggaatcttgttttcaagattaaaattttatcatttgtatgtagatcattagaatacaaaatgccctcccccacttttgccatttttgctagaattggtgtcagaatagattcagttaggagcaaagttcagacacacatgttgattcagggatcagagtccaacaggtaaaaggctagaactaccgtaacaaatcaatgctgttttatttttatgttgtgtttaactaaaggacattctgtattgacaggccacatttgtgccatttcttttttagactaataatcattattggagaggagttgtctgctaatgtaactactttgtgagttatagtgttattgtctgataattttgcagtatttttaaatttttagttgactaatacaggtgatttatttgaaacatatctattttgtcatctttaataaaatgtctttattgtttttactgattttgaaggtaattcatgctcattgtttaaaatacaaacaatttgaaaatgtttaaaatagaaagtaaaagtattccaggcccacaggtaatataatcagttaaatttggttggcttttgcaaacttacaatacgtacataaaattacatgtatgtatataatgtgcatatgtttttaacatatctattatactatgcatactttttgtaactttttaaaaatttgatatagaatggacatttttctattgcagtacatacagatatgctaatgtttttaaacagctgtatagtatttatttaaccagtccttaatccctaattggtggggaattaggttttttgttgttgttgttacacagtgtgcatctttgtacatatgtatcagaggtgcttatttatgtatgtaagtaatcaaattcctaaaagcagcattgctggtcaaagggtatgcgttttaaactgatctatattgccagatttttctccagaaaaaggtttacagaattttcactcccagcaatgtgtgagaatgccagtttcttccctgaaacaggcttcttctcattatgtaatcagcattggttttttaaaatgtctgacaattttttttaaaataatttaactagctggtcttacatactagctcagttcttaaggtactaatcctaatgtaaacatgttctctacaaatgtaaatcttaacttgcgtgtcttctgtgtaaccaagaaaaagaagaaactagatcagagacaactatattgcaagagataattgacttacaagagttaatattggaattgctactttaactcagtgtaacttagagaagtttcgatgagacttaaaatccttggcctttttgctgagattctttggtaacccttggcttatttatatatgttttaaaagaatttattgtacctgtgagagtgaattaaatttctagagagtcataaaagttgaagctgagttaaataaaaagttaattgtattggcgaataattcaaaatgtgctttaagtataataggtttttaaaaatcatcttttttaaatgaacaggaaactctgatgaggaagaaagtgcttcagaatctgaactttggaagggtccactaccagagacagatgaaaaatcacagtaagtgctgatattaatagagaatatgtaccttttcaatcagtttaggaagctataaccacagctttattaatggaaaaatacaacatcatggtgatctatttaatgccaaggactgcctagcctggtaagattagagcttattcccagccattgtcataagcagccaacacatccagcttcctcctggtaaataaatctttcatcagttcactttaacagatgaacctctggtccttgcttggatttcttcagagatggctgtttcctaagcttccagagaagcctattccatcatactgtgattatcataaacctatgcaagggaatcccttgcatgggaagtacacttctatactgctatcccactggtcttttaaaaagtaaaataataatatttactgttacaaatacataatatatttactatgctcagtgtagtaaaaaaactacagcctaaggagatttacccaattccccttagttattccccaatataacttaggcttacatttttccttaaaaatagtttcttttttattcacttcttgagcagactataatttaaaatgagaatgaacagagaagttataaagtaagcccacaaagtaaagagaagcaatgacatttcacaagtatttcaaagcaaaattttaggtaatacatttagggagaggtgccaccatatgaaatatttttattttaatcaatctgggtatagttatgattattctagaaactaagaattatttgatggctgaatcatggcaatatattgatatatagcagaatcagccaatatgttgacttaaagtattttatttttattaatctcatataatgtatcatgtagtaatttttttactctattgatcttaagtatgcttttttttttaaatagggaagaagaatttgatgagtattttcaggatttgtttctatgagacgagagagagaagcctccgctccttaatgtgaaacttcatgaagttttaaacttcatgcaatttgaaattccatataagtttttatctgcaagttacagcttgtgtggtttgtctttggaaataaaaatccaggttctctcagaatgtcagaggctttggaagttcattagttcaattaaagactttcctgtcctttaaatatcttttcaattgcttatctacaattctgttttatttgtagctcctagaggatagagctggacagattccattgttcctacattttgtaggttttttttcactgccttcattatgtatcttctcttgccttcattattttattttattatttcttctttttctcttttttagagccaccaatactggatttgtttgtttttcatttttttcttttgtggaaacggagtcctcctgtgttgcccaggctggtattcaaactcctggccttatgcattcctcccaccctggcctcccagagtgctgggattacaggtgtgagccaccatgctctgccaattattttaaattactaggattaaagtatattatgtatgtctttaacttctttctttcccattgataaactggcacccttcttttaagtacctgctctcccattaccacctatttccagctgctttttgaggttttttgcttgcctgtctcttgcttccttcttaacctctaccacttaagagagtttgttataatcaaatttgacttcctagcctgtggataatttactattaagtaaattattaccacagggagccagtgaggtcccagtagtctaaaacagttcatgtgttcacaaaaattgcctccccggcagagattatgcagtaagataatttaactgaataatactatgtgcatgtatcttgcctcagatatactcatgcaaatatgaatatacctctgatatggtttggctctgtgtccccacccaaatctcatcttgaatgtgtactcccataattcccacattttataggagggatccagtgagagataatttgaatcaagggggcggtttcccccatattgttcttgtggtagtgaataagtctcacaagatctgatggttttatcaggggcttctgcttttgcatccttctcattttcttttgctgctgccatgtaagaagtgccttttgcctcccaccatgattctgaggctttcccagccatgtggaactgtaagtccaattaaacctctttttcttccccagtctctggtatgtctttatcagcagtgtgaaaatggactaatagaacttctatgcagaaatataaaatgtaacttcttaacataaggtcctagtcgcaagggtctatggaggtgcttcaggagatccaagcctttttagaatctgtgcaaacttctgtgtatgttttttggaggaaaagtccataaatttcaaattttcaaaaatcagattttcaaaaggatttattgatttctgaaaactagcaaagatctgcttttataaagagcaaatagatggatagatataggagaagatgcttgacttgatgaataagagaaaggacatatagaaaatgaactgaacataagcaagtattttattgaagatatactattttaaataacatttaaacacggaatgattggcaataaactgcaaaatgagtaatttggtatcattttaaaatggttattatcagagattttccttttattaaacagttattcattaattccacaaatatttatcaggcttctattatatgtgaggcactgagctgggcatggctgtaaaggaaccatctaggaagtaattatgcaatcatttctgaacctgtttcagaaaagtaaatcagtgttgggtttatcagtgtttaacattgtttgatagtcccctcacttcttgaataaattgttttttttcacctcactacttgtagtgtgtaaaaatgaatctgtatttccggtgaaaaagtgtttgaaatgtccagccgcaagactgatattagtagtagaatatatgcagttaaacattcttatggtaaaaatatgtccattgtttagtggttgtcagaaagtaaaattcctgcaaaattaaaattaggaatttaactaggaagaatatctaaagaccctttaaaaatagatcagtgtatttggtatttcaagtagatttatgacatcaggctcatttataaatttatataaaatcacaatacttaatccatgcatacacagtgacagataatgggagttatgtttttaaggagtcttgaaaaggcctctaatatgatgagtttaaaaagtaattctcctacacacctatctcaaactttgctatagtgcggtcagtggtggtcagcagaccactggtctgggggtgttgaagttaggccttcttatacttgctcttatgcagagttcatgtatttggcagaccttcagtggtggacatctctaccctcaatacaatttctggtgactaaggaggggaagttgtttgagctgactgatgttttggggtctaaaattacatagggctaaaggaataacgtttcttacgtggtttttaaaataatagtgcttctggaagtggaatttcaaaattattttaagcaatggaaataagggagcatgcatcacttagctaagttgattactttaataaacaatactcatttgagtgtacatatgacttactgtcataccttatttatatctgtttgttgtaacatttattcacatagtattcattcatattactgagtgcctaccttgtgccaggcactgctctaggtgccgagatagagctgtgaacaaaacagacaaaatagacaaaatctttcctcataaattttacattctaatgtgagagaagcagtctgacaattctaagtacctaacttataaaaataaatggcgattcatttcttggctgctcaaaattgaacattatcttgtctattacaaaatatataggttcattgatgttcaattctttagactgtagatagcttgtgacaaaaaaattctatgataaaatatatggcataactatattattctattttctaattttatctatgattatagataagtaaaagaagaaatcttaaatttctcgaatatccagacagacatataccatgcagtcgaagtagttgattgcccttagtttgtcttaacaatttaatatttagaatgcctggtaggtctattaatcatttttagaaagtcatcttggttgaagtttttctgtactatttttgataaggttcttgcataatccaatcacatgcttcttaacgcataatattcattagctgctttaacttgcattatgattatccagttagaatcttgtgcattgataatctttttaatgaaaagaatagttctgaactgtaaaaaatattcttagttacacccaaaataattgatttcaaactttgaaggaggagtgtaggtcaaaggcatagttttaataaatattgccaaaaaatagtttggtcttcatcattctattatcaagggtaaaagtagagaaaagagataagcatttcagatggaatgacgttgaataaaatgacatcattattttctatatcatatttacaacactatacattctatactgcgtttactcttttattaagatgttgagagattttagttcggggagtggcttgaggtatgaatcacagttacgaatgttatgggtgaattgtgtctcccccacccctcacccatttcatatatttaagccccaatccccagtacctcagaatgtgactgtatttggagataaggccattaacgaggtaattaagactaaaatgaggtcacatgggtaggccctaatccagtcctactggagtccttataagaaaaggagattaggacacagacacacagagggaagaccatgtgaagacacagggagaagatggccatctgcaaaccaagttgagaggcctcccaagaaaccaaccctgccaactccttgatcttgaacttccagcccccaggactttgagaaaatacatttctattggttaagcacccagtctgtggtactttgttatagcagccttagcaaataaatacaattaatgttttaaaaaagaatttgtgactagtttcaggattgcatattttttaatttaaaataaattggcaccaaaaatgtacctatttttgtcatattttgcacttttgttgaactttattttgcccctgggatttttgggctagcaatatatattttcttcatagtcacagggtagtttttctgaagatcctgttacgtgatgatttgttgaagttcttttgaatgttttctggttttcttcaaaggtaaaatgatatttgaagtttagaccagttagataatattacaacattaaacatgttttggactttttgtcatcaccacctcctgaatcttcagcagctagtaaaatcaaggaaagcaatattattaggagttagtggatatacagtgtttttattctaacattcccatgatagtagtgtcaactttgtagactaattagtcattttaacctagcaagtactgtgggtttgaccatgtaaaaacttgaattaatattcagagttggtccattcaaaaaataaaatctgggttaggtgcagtggctcctgcctgtaatcccagcactttgggaggctgaggcgggtggatcccttgagattaggagtgcaagaccagcctggtcaatatggtgaaaccctgtctctactaaaaatataaaaattagctgagtgtggtggcatgtgcctgtaatcccagctactcaggaggctgaggtgggagaatcgcttgaatctgggaggcacaggttgcaatgaactgagatcatgccattgcactccagcctgggcgacagagtgagtgagactccgtctcaaaaaaataaattaaataaataaaaaacagaatctgatcaatggttggccagttaacatcttagtttctcactgagacaatgcagtctggaaatctgagcttgatgcacaaagctccatgcctggtgatagaaaataatgatcttagtccacaaagaattctctatgtagtagcaaaaaaactcagaagtaaatttttgtgcaaataaaatacagatccatatccaatgtcacttaaaggacctgatcatctcttcataataaagttgagataaaggttaaatctaatagtactaagaaataccctcacttttcacttgcttggtaaaaatcacttattgttttgaaatgcaaatcatatcttaccttaaatctctcaaatgacccatgaacatttttagcccaccttcaaggcaatacagtatctggcagctacctgcactaccagcttcatatgtacttcgcactctttactctctagactccagctatatcagcttaaaaatttttcaattgcaccaagcttattcctactccaagcctttgtacatattttcttactcttcctccccaatgcctgctttctgtggttagcgtaagcattcttcaggaaagccttctccatggcccatgtgcacactagtgccttcttcgagatcgttaattgtgcattggttcacaatgtttagttcccccaccaaatggtaaattgttcaagataaaggatcccatctttccccagggcctgcctaacaccgggctttatacagagaagacatctgataaatacataagtgaatggatatcaaggagtcaaaaactcctgcttttattctgaaggacatccttaactttgttaagaaaaatattttctcctatgaattatttaaaatttcactaaatgcaatagagccacctaaaaggaacatgtcagggcctttccacatagagatgatttctttgttaagcaataacaattgcttacaaaaccttcagagtgataaactttcaagacagaaattagcattccactttcaaaatgatgtttgggccatctgatgaactaatagttaatcctaagcattttaagaatccaaaaacaacattaaacttgacaaagtgactttaggaatagaaatttcatgccagaaaaaaaatggcacaggaatctcatgccagaaaaacatctcccaatgagacatttgggagaccggcaatttcagccttactctacatgtagggcttccttaagctgaagatctgtaaaaccacctcattacatggagaagaatattaaactcagcgaggttaagcaagctgcccaaggtctcacagctaatgcataatgttgggacaaaaacttttttctcacctaactctaatcccccagattctgtagtttacatattatccctaagcacccagtgttctgcagaggagccaccttctagcaagatgaagaagcctagctccaacctctacttcaactggaccggtcaattcgatctggagttatacataagatgttgtctgtggcagggccagggggacctgaaaaccactaatcggcctgttaaaatgatcagtctgcaccagtaaagcaggttttctgtttgtggtgactctttatggctttgtcacatgccattaagctcagcctagcttctggctacattacagggagcaaaaacagagcccatctaacctttttcggctcctccttcttgcttttttgcctcctcttcaatgaccttcatctttgcatcatactcatcagctagtgatttccattctactctgttattctgaagaccactcagcataggtgtgatttctttgtgaaaccgtgagaactcctaaaaggaattttaggtcagaaactacataaatcatacagttaattttcaggatctttcatatgcagagagtgagctgtaaggaattgttacagcactcagagctgctaggataagtttaaccacgggcctatgaagtttgggaaagagacacgtgctgtctttactgcctgcctaaggaagtgttcagttcgctcacatctgagttccctccttttattccagccctgaatgagattagggtaaaacctcaaactgctttggagaaacagtgataccccaatggctttccgtatgggtgacttctaaattttggtgacagtttgaaagaaaatttctcatccaaatgtttatgtatttaattcaaataatttgcttacttaccttatatacaaaagtacaaacaaaatcaataaatccaacttgaagtttaggtaattcatctcttttgtttctgtccatcataggctagaaagagaaataaatcctttaagacaggtttctaagatgtatgaacaaaacagactgatttgtcctgataacttttttttttttttttttttttttgaggcagagtctcactctgtctccagtctgggtgcagtgccacaatctcggctcactgcagccttcgccttctgagtttaagtgattctcctgtctcagcctcccgagtggctgggactacaggcatgcaccaccatgaccagctaatttttgtatttttagtagaaacggggttacaccatgttggtcaggatggtctcgatcttttgacctcgtgatctgcccacctcagcctcccaaagtgctgggattacaggtgtgagccaccgcgcccggcctgtcctgataacttttaataagtaatacatttttatgtcaaggtcttacaatgggttgttgctgcaacactgttctctccagatctccttgttcccaaaattcatttgcaaccataagtgctacctgcaaatgagaaaggcttggttcactaaatccacttatgaatagagaacttgcattttattagtacaagtgacatttaaggatcgagtttacagtcaatgtttgaggtgctatcaaaccgtatgctcttaacttttaaaaagaggtcatttacagattatattgaaatgcgaaaggggagctttttcttcctacttcagtgttctaggcttattctaggagtatctatctcccatttacgattgccaccacttctcaccaacgaaaaggagaaataggaggattaaatattatgcttcaagttctaacacttcgccggttgttctttgtcctgtctatctgttagcatctagcatatgtctgtgaatgcacatgtgacatacacccattagtatgtagctttacctaattacagtgtgaggatattccagcattaatttatatcactaaaaaaaaacatttatcaagttcattgaacacctgctagctgcctttacattggcatgagccaggcttgccaagaggaataaggggtgatctttttctttaaaatgttcagagtctagcgaagacagtcatgtatacagtgtggtaagtgctgtaacaataatagtgtaagtgctatgggtcagggagaagggagtaaagataagtttcatgaaggaaggaggtggcatttatgttgtattgtgaagaacaagagtaattttccaggaaaagaggaggggaagaatatttgccgagataaaatggaacgtacaaagcttctgtgagtgcaggcttagagtgtgaagcaatgacatgggagaaggtgatgggaattgatgctgggagtgtgagttgaggacaggcagtgacaggccatgtaaattttgccaggaagcttgaatttgattctctaggccagtgctgtttactcttggagtctagggttcccctgaagtgctctagggcccaagaaggtggagaccaagagagatgaaagctaaagtagctttgcttttttctcttttataaagtgatctttgggcaagttttgttgggagaaaatagactttacttctttgggaaagaagttggaaacctctggcaatggggagtatgagccttttaaggagtagaatggctgagttgagctctgtgtagagacatcctggcagcaagtcagaggatgacttgtggagttgatgtgagcatctattaggaggctgctaccatagttctgataaaagtcagaactgaggtactagcgaggctgatataaatgattttgaaatgagggagataagctcaagcaggaccccaggtttctagcttgggtgacctcatcgataaagaacagaggaagaagagcaggcatgtcgaggtggaaggagaggaagcatttggttttggacttgatggtgacggagttcaggacaccctgcccccaaatattttaaggtgacggaatttgaggaaactaaagcagcaggaagatcagtctcaccttcccccgaccttctcccctgaagtaggtcataaaaccaggtaaggattttctgaccttcccctgaagcagatcataagaccttcattcaagaggtgccctccctattcctggaggaaaggagccagagacacaaagatgccaagaagaatctgaacaaatcggccttgctaagctgcctcacgattagatcataccctctttgttgaattctatttctccatgactatctaattcatccaacctagcataaaacatacaagtttaactgtttcttagggtctttgtttcctcacgaaggctcctgtattacatgtaaaacaaataaacgtgtacgcttttctcttgttaatctgtcttttgttataggggcctcagtcatgaagctaggatgggtgagaaatagatattttttctcccctacactgagttctaattattctatctttttaaaaagatacaacccacttttatagttaaacccatttaattctgggctctcttctgcttaggggtttccctagaaattactggaggaaaaaggaaggttttttcatccaattagtaagaaagcaagtggtagactagtgcctccccaaggtgggggaagaacttcagtggaaggcaaccttagacatcatctcacagtcagtgccttcttataattcacagcacattgaagaagagactataggagcaaaaacacccttgatagaggaaaacactaacgatgcatcctgatcttgttctgacttacctcattgatatagtttggctatgtccccacacaaatctcatcttgaattgtagttcccataattcccaattcatgggagtgacccagtgggaggtaattggatcatggggacaaatctttcccgtgctgttctagtgatattaagtaagtctcacaagatctgatggttttataaaggggagttcccctgcacacgctctctcttgcctgccaccacataagacatccctttgctcttccttcatcttccaccatgattgtgaggcctccccagccatgtggaactgtgagttcattaaacctctttcctttataaattacccagtctcgggtatgtctttattagcagcagcatgagaacaggctaatacactcctctatttaaaaactcagacatttcttggataattttatataaattatttacagtgtttcaatgttaaagaattctttcaagaaagaattctccttccaaagttccttctatttgctttattctagggcctaatcaaattgcctactgtctcactaatatttgtaatttttcagaattctgaggttgcctgagatctttaggtggacatttacatgggacctaggcagtacctgacagtgtgacagaaaagaaaacttaactggactcacctgactttgcacctcccagggcttggtaatagcagacaagtcacatgccgtcatcatcattgcccttaggaagaaaacaaaaaattttaaaatagaaataagtacaaaataagttatttttacaaaaaacaagagagaaatacaatttcaactacctacatgataatctctttcttggttggatcaacagttacatatttgatggcttcttcttccgtttgcatttgttcacaggcatcaacaattttttgaaacatggtcctcttcctagaaaagatacagctgtgagcaacaattttagcttatgaaaagagagaaaaaatatcttaaatacatgcttttcagatttcacgttcccactttgcattgtgatgtccacatagcaaagtctacagggccagaaaatacgagagcagagaatggtggtataactttggctcagaaagggtttaaggcagaaaaagcacaaaccatacagagagagagagagagagagagggaaaaacaaaacaaaacaggtaacttggaatacattacaacgaaaaagttacatataaggccgggtgcagtggctcacatctataatcccagcactttgggagactaaggtgggaggattgcttgaagccgggagttttaaaccagcctgggcaacaaagcaagaccctgtctctttaaaaatgaaagtaaatacaaaattacatatgagaaaagagaccataacctaaaaataaaggccccaaactatgataagatatcacaacacatatagccaacaaaaagttggaacccaaaacacacggatgtccagctggtctcactactaatcaagaaactacaaatttgaacaataagatattatctcacactcattatattagcaaaataaaatttcaatttgctgagttcaagagtacttcagatgtggtatttttctttttctttctttctttctttcttttctttttctttttctttttttttttttttttttttttgagacagaatcttgctctaccactcaggctggagtgaaatagcttgatcctagctcactggaaccttgaactcctaggcttaagggatcctcccacttcagcctaccgagtaggtgggactacaggcatgctccagcatgcctggctaattttttaatttttttgtagagacagtcttgctatgttgcccaggctggtctcaaattcctggcctcaagtgatcctcctgccttggcctcccaaagtgctgagattacaggcatgagccacctcactcagctggaactcttgcacactgtgtgtgggagtgctaactggcacaacttctcaggagtgcagttttgtaatgtagcatgaaattgaagacatgcaaatcctacagcattgtcacttttacatttcttagagaaactctcatatatatatacagggacatacaaggtagcattgtaggcaatgatgaaaaattagaaacaattgaaatgtctatgaatagaagactgggtaaattaattatgaatattcaacagttgaatactctattcagttaaaatggatgcattggagctccatttattatcaatgataaatctttgaaacacaatgttgcatgaataaagcaagttgcagaaaggtatgtacagacagtatgataccacctatggacaatttgaaaacacacaacaggttgggcgaggtggctcacgcctctaatcccagcattttgggaggccaaggtgggtggatcacgaggtcaggagatagagagaccatcctggccaacatggtgaaaccccatctctactaaaatacaaaaaaaaaaaaaaaaaaaaaaaaaaaattagccaggcgtggtgacgtgtgcctgtagtcctagctactctggaggctgaggcagaagaatcacttgaacccaggaggcagagattacagtgagccgagattgcgccactgcactccagcctggtgacagagtgagactccgtcgcaaaaaaaccaagaaaccaaacaaaaaaaacaacacacaacaataccatataaaaacatggatggaaattatgaatacacatcaacgtcagacggtgatatctttgtggaagaagggaagggatttttcatagtggagtaggggtggaatacctcaattgcatcactagtttttttctccttataaagcaaaatctgaggcaaatatggcaaaatttcgcatttgttaaatttaggctatagatatttggatatccattttattattcttagtatttgtcttcacattgaactatttaataattaaatattcaggcccagtgcaacggctcacacctgtaatcccagcactttgggagggccaggtgggcagatcagttgaggtcgggagttcaagaccagcctggccaacatggtgaaacccatctctactaaaaatataaaaattagccagatgtggtggtgggagactgaagtcccagctactcaggaggctgaggcaggagaatcgcttgaaccttggaggccgagattgcagtgacccgaggttgtgccactgcactccagcccaggtgacagagtgagacctgtataataatacatataataataataataaataataaataaatatttagtgaaggatcagaaaggcataatttgacaatgcccaagccactgaatatttccatcctataactagttcatcttgttctaacccattttcatcaagcaactttatagttcacttatgagaaaatgtggagatactgggagtatctggtctccttggcaatattactgttgtaaataggctggctctctgttacgtatgactcagttttgtaagtttggttaatgtgtgtcaatgccatcaaaattgttcagctcccagactttgacagaattaaatttctgaggctgaaacattaaaatgccagattctggaccatagagaattcacctggacaaaaagccaccttgagaggtctcttggcttcactcttttgacaaggcacaaacttggctgcacattctgcaattcaaacctgttcggagagcaacctacttaatattaggagcttatgtttttaaaatatgttcccagaggtctagtaaatttactggcaggcatctgtcttgaagatactctacttggtaatccaaaaggagagcaaattttgtgtgtatgtgtgtgtgtgtgtctgtgtgtgtgtatgtgtgtgaataaatgccttttaacattaatgcaacagataatttatggaaggtaaaaccacacagagtatagggcattccactgtgcagagttatgtacttacttgaaatataaagccaggtcagttgctattattgcgacctcgaacaaatgaataactgtttcaaactgccgcttatttaggttctggaagatgtttaaactctgtaagatgaaaattcacaataaaatgctatcaataatttgcctctgaacaaatgaaactatgcttaacaagaagaaaatctaaaagtctttcaacacttttttgtttgttttttttttgttttccttccttttttttttttttttttggcttgcttttagtttttatctcatggactaagcaaacccctctactatactttaagtaagataatttaatttaaactataaaaatagatactgttagccaatattcatgtaatcagtgtttaactttttggagtaaataaatgttttcttctaggaccattaaaataaataacaatagattaaaaatgtgcttgtattaattgagaagctttaataaagaatttctgggagaagtccaactgtcagacatgttactttatctaccaggtaattttagagtgatcatagaaaccactggtctttcagaaattgcaaattacactcatattcgtgtatatgtaggaaaaaataatgaaatccttccacattatcctgaaaatgttttcatgcaattctattttaccaagacttaactagacctttcttcaaagagtttctcactacatctcttcacataaggatcagcttcatttcttagcattctagaaaatgagaatataggccgagcatggtggctcatgcttgtagcactttgggaggcggaggtgggtagatggcttgagctcaggagttcaagaccagcctgggcaacatggtgagactcctgtctctactaaaaatatggaaatacaaaaatagctgggtgtggtggtatgtgcctggggtcccacctactcaggaggccaaggtggtaggattgcttaacgctggggactggaggttgcagtgaactgagactgtgccattgcactccagcttgggtgacagagagagaccctgtttcaaaaaaaaaaaaaaagaaagaaagaaagaaagaaagaaagaaagaaagaaagaaagaaagaaagaaagaaagaaaatgagtatataagctgggggtggtttcttaaagcccagttattccaaatagaccattttagtcatacaggccaaatgacagatagatagtgattttgccaaatgaatttgacagttacaaaatacagaaaaactccactggaaagaaagaggagatagtctatcaaactatataaagagagaagtagcataatgccaaaaacaatactgtcctgaacaccaaataataacagtaaacacttacttagttcttactacctaccaggctctaagtgctttgtgaatattcttaatctcttcacaacagaccccagcacagagaggtgaagtaacttgcccgaggttaaacagctagaatgtggcagaactggtgtctaagccagtgcagcatggttccagagtctgtgctcctaatctctgcaccacactacattacctctcaagagggaacccaggttcatttcctggcttccccactttggcagtggtataatcctagagacttcacttaacatctgtatttgttttctcatatgggcataataacagctgccctgcctaactgcctagcacttagtctatgctcaattaatatctgtggaatgctgaatcaaatgaaatgacaactgtgaatgcattttaaaactgtaaatcgctgttaaaatttattgttgtatcattattattattacgtaaagttatgaggctagctcctggtagaaatagaattgcaaacctaagaccaaatatggctcagtcatttcagaagattgaaatattagaaagcaataattggacaagaactcaagttttagacactacactatgccttatataaatcttcccttaagtcatctttttataacattttctaggacaagaaaagtggtgttttacaaagcatatataagtaatagaagggaaaattgtgatttgttttgtcaacataatgagttcatcatagcaactatagttaaacttttaaaatagctagaatgaagcaatgggtgttgaccagtctaaattacaaaaacaaaagagagattatctggatcaaaatcaatgtttttttttgtttttgtttttgtttttgtttttgtttttttttgagatggagtctcactctgttgcccaggctggagtgcagtggcacaatctcagctcacttcagcctctgcctcctgggttcaagcgattctcctgcctcagcctcccaaatagctgggattacaggcacccaccaccatgcccagctaatttttgtattttttagtagagatgggttttcaccatgttagccaggctagtctcaaactcctgacctcaagggatccgcccatctcggcctcccaaagtgctgggattacaggcatgagccaccgtgcctggaccccgaatcaatttcttacttgggacatttcacagaagtctattgtacatatcagtccagaatctctgaatcaaatctggatacaggttattttcaacctggtctggattaccagggaggggaaaagtaagtggagtcattttgatcccacttaacctgcccctgattttggaacaatggtggccttccttttggacttggggtgatccagtggcatactgacatcagggaatcactgcctttatttgttcactgatgaacattgctatgttcccaaagtgatgtttattatgtgactcagatacatacttggcaaattaataatatttgaagccaaccttgattgctatactaggaaaaaaagcagggggaggggaggaatgtgtgaaaatgccttaaacttttagacaagttaatatttatagcacattaagtcatttaaagaagcaaatcagactgctgaattcagagaaataattccttgggacagagacttcctcgtctctaccaagtgtcagattgtgcagagtatataatctacaacaaatcaaatacatcaaatttattatgcaccaattgttttagtgcatattgcttaatgtaaacctggacacttgttgctatttaatagacgtgaaagaaaacgctatatataaagaaatatatagaaacatatgtgacaaatactgtttactcttatacctttttccaatccaaaataataaaacaactgtattaaagttgatagattatcaaaaactatcttacttttcaaaatgagtcaatactggatttttaaaaattgatataatgaagaaaaagggtttatagtcaccatttcagtactgcttcttttgcatatagcactacatatctgcatttcattcatacctttttcttctcactcattttcatttttatctaaaaacatgtacaagcctcctaattgaaaaactctttcttaattctacattcttttagattttctctgttctccctttcacacctgaggttcttgaaagaagagcttctaattgacttattaagttgtggatatagattcatataaaagatcccattccagtttttgtattagttgctagaaagcacttggccaaatttgtggcctgtgtctgataaacgttttggccaaatttgtggcccatctctgatatacattttgggtatgtatggcctttactatgctcacctcgtttttcttatttttccattagtcctcattttctttttctttagtgttgtatgtattcttcgaagctccatcaaatcctctttggaacaaagtgggacatacacacacacaggcacacacacacacacatgcacacacacacttgcacacaagttgggttttttgtttgtttagtaagtaaacacagactcagtgattctttaattagagcaagaggtctcaagatgtgcccagcgcacaggagaagcaaggaattcctttcaagacctactttgacaacacaaaacaacagcaaaagaggagttgatggagaagttatgctgatgtacatttgtattgacttctgatattcaatctcctagaccaaagacattgtcataggtaacaagaagtgaaggagggaaggcagacagcaatggccagatcccaaatagaaggcctggagcttcatgggctttgctcagtgtgagctttaccaacttccggaaaacaaaatcaaagaggtgttgatatggctctgtgtccccacccaaatctcatctcgaattgtaatccccaggtgttgagggaggaacctggaaggaggtgattcaatcatgggggcagttctcccacgctgttctcatgatagtgagggagttctcacaagagttgatggttttaagtgtgccacttcctcactctttctcacacactcttgcctgccaccatgtaagacatgccttgcttccccttctccttcagccatgattgtaagtttcctgaggcctccccagcagtgcagaactgtgagtcaattaaacctcttttctttataattacccagtctcaggtagtagctttacagcagtgtgaaaacagactaatacaggtgtgctccttagaattggtgagagaatgtttgagtcaacaaattggaagctgaggatttccccagctcattcctgcccttcttccatggtactaggcagatagttggctccactcagggatgagtaattttcagaggggaacaagtgcaaaacctatgcatataatgaccacaagaacataaaataatccatagagcgagtagaattccaaccaaaataccaacaagtttgtgtatgtgtgtttgtaaattgacaaatcaattataaaatttatatgaaaatgtagagtcaataagtactggactcaattaaaagttgaattaaaataaacaatagtggaaattacagagcaaaatgtaattttataaatattgataatggtaaaaaaatatatcatataaaacagacatgtgggaaaaagtataccaattccttcatatttcatagaagggagttagtagatactgtaaagttaacacatatagcttaaaaatgtcaaacatctaaatgctcagctacaacttttcataatttttcatagtcatttgttattcattttagagggctctttaagagctaacatttcttgtgataaggacaccatcatgtgaagttctgcaattctttccatttcaaaaacatttcttctgttaaattcaaataaagtcaaatgcaataccttttatttaagataaagggattctacttagcaatgaaaaaaaatgaattgactgggcacagtgactcacacctgtaatcccagtgctttggaaagccaaggagagaggattgcttcagctcaggagttcaagaccagcctaagcaacacagcaagaatgcatttctacaaaaaatacaaaacattagccaggtatagagactcatgtctgtagtcccagctacttgggaggcagaggtaggaggtttgcttgagcccaggaggttgaggctgcagacagctataacagtgccacagcactccagtcttggcaacagagcaagaccccatctctaaaaaaaggaatgaatcatggatatacacaacatgagtaatctaaaaattattattttgcgtgaaagaaaccaatgcaaaagagtgtgattgattgcatgattattctattattgtgctaattgtgtgattgcacttatataaaatctagaaaatgtaaactaatccatagcaactgaaaacatttcaaaggttgccgcctagggctgggagtggacagtgggatgtgctgtgaagggtcatgatatgagcaattacttggatgatagaagtgttctgcatcttgattgtggtgctggtttcccaggtatataaaatagtcaaaactcatggaattgggcactctagagatgcagtttaggctaggcatggtggctcacacctgtaatcccagcactttgggaggccaaggtgggtggatcacctgaggttgggggttcgagaccagcctggccaacatggtgaaaccctgcctctactaaaaatacaaaaattaaccgggagtggtggtgcatgcctataatcctagctacttgggaggctgaggtgtgagaatctcttgaacccaggaggcggaggttgcagtgagttgagatcacgccactgtactccagcctgggcaacaggatgagactccgtctcaaaaataaaataaaataagagatgcagtttattgtatatatacttcaatgaagttgattaaaaaccaactctggcttaaaaaaatagcttgggtagtgggaacacatggagtcctttctctccatgcttcctgtgtatatccacagggtgactgcaatgaggttcattagacgttaatgaaatatcggtttctggatggtaggatttgaagcaatttaagaaatatttgtctttgatgttttcctatcgtttgaatttttatagtgggcttatgtaacttttgcaactattaatgaacattgaatacatgtataaatatgtaatattccatttgttttcgagcattgtgttgaagacattttgtggagacaggtgcactagacaagaaaggagacctacttcccagcctctggccacgggccctgacttgctcagctgctttcatttgctcacggaaagaatcttttttattttccctgactattaaaatggcgatagaactatgaattctgcatagcacaccccaaacaggtagaaatggctttaattcattcagatcgtggctctcgagctagctgaggccagggaaagtacaggccgttctagtcttcagcatggtgcctatgacgcccgcaagagaatattgccaacatgttcttgccttgctagtgccagtacacaaggtatttgatttctccttcacatttctatgtgtaaaatggggcaggctgatgcggttgatatgaaaaagcataaataaaattatcatacgctttggaaagagatgttctgaataataacaagattttgttatttatgctgagcaatatgttttgtcatttctacagtatattctagtattaaaatttatacttgtgcaaatttggctaacaagttttccactcattcatttgggttaaagcattgatttctgtctggtttagagtacaggcagttctattcctcaaagcagtgaatccatctctgctaggatagaaggacattgccgttcaaagccttataatatgcaaaacaaaatgtctgagtaatgcccacagatgctgaaattactggataaatcccaaggatttcccttatttaaaaaaattaaaatttttaatgtgtgtattttctttagagaatgaaaaaaatacaagaactacattgtctccccaaaatgtaaaaagaatatctgataggtaacaatctttttgtgtgtgtgtccaatttgactgctcataaacaggctctgtgtgactgcattgcctagcgactctattgacaaggctttaaaagtctgcaattagcaggttgaatggtattacagagaggtccttgaaaagatggtatagattactgagatgcaatattcctttttagaaagaataataagtctttatatagccatcaaagccagttcagactgcaaagtaaataacattaaaaaaaattcagatggaaaactgtaactctaaactgccaaatcccagaaggaaaaacatttaagaaactaggagccttccagtgttaagcatgtagatatttggcagctgttttaaaacagtattttgttttagtaggtgactgtatgattatgcgatacatgacatttgatgctacctcactgtggtatcatataaacagtgggatttacagaaaattcttactcagaaaccaaagattgtctcaaccagcaaaataaagacttataacaaattaggtaataacaatttactcttacattcctgagttattttcagttccgctccttcttttaattctcatagaacaggtgttacctatgctgtgaattctgctgcagggagagattctgtctgcatatcagaattaaaagggttctggttcaaaatacagattcccaggcccaaactccagagagtctggtcagtaagtggagaatggggcccaggatctgtgccttaacagcctgtctgcccccgccctgttaaattaatgagtctgaaagagttggtccaggtacccatgtctgagaaccaccatctggacttatatgaggttagtgctttgccaagagcatagcggaattagaaatgccacagcaggtctgggatggcaatggtgttgggtgctgtgtcaatcacagactgttaaaacaacgcaagcagttttcttctttttccatttttctgcccagttgctctgccttatgagattttcctgcttggcttatgaggaccatcttggattttcattacctagaagaatttagtattctctctaaacttggatatctttctgtatattctccctgagcttttaataaaagattattattgaaagtgagaaaagcccactctccagagggctcatgtatcctaatgaagcatgtgattctgaacaagttcactgcctgcgacaaaacagtgctcccctcaatctaatgactcaccttaatcatttttggtttggaacgttcttaagaaagtataattagacaacatccacaactttccacaggcccatatatcccttcaataaaattgatcaagggaagaagaatgactaccctctctggaagattagtagtacgtaatatgtgcaattcacaatgaattcaaggggctgagccgctcctgcagaaagccatctctgatcccaccctctttgcccctttccgctgccactgtcttcacacaaatgtggtttctccctttggaactctcagagcatggctcagtgcctctctgatggtggctacgtcatgcctacctccatgatatagtttggatctgtgtctccacccaaaccccatgttcagttgtaatccccaatgttggaagtgggtcctggtgggaggtgattggattttgcgagcagtgtttcttatgaatggtttagccccatcctccttggtcatgatactgagtgaattctcatgagatctggttatttaaaagtgtgtggtacctcccccgcatctctcttccttctgctctggccatatgaagtgctcgctcccccttcagcttccaccatgattgtaggctccttgaggcctgcccagaggttgatgctgccgtgcttcctgtacagcctgcagaaccgggagtgaattaaacctattttctttataattacccagtctcaggtatttctttatagcaatgcaagaatgtgtgaatacactccactatgaaagcttgactttcttaaaggcatagaccatgctctaaagcatatgccccatgaatgaataagcaaatcagtgaccatgtagcctcctttcctctttacatttacatatgcttggggtgcacggagcccttttgcatccaccataagctttttcttctttccctacagacccacagagattctgtgactttccatggctctcttcacctgtctcagctacttccaacttggctgttcaaaaactagttcaatatagcaatttctatcaattgacttcaacaagggtatacactatcaactgctgtaactcaaggccaccctttttccaagcattttctgtgggttagtgctttgatccagaatttgtgtttagctgtcctaaagagaggtttacgtacctcatcctgcaacagagtcttactgtactccaggtggtgcctctccaaaatagaagaaccatgaagtcttgctaatggagacgtggatctagaaggaaaacaacatgccatgattctagctgtttaaaaattacacataggttcatacaattcaggatttttcttaatgtctctcttctccctcctcactcaattatctgtgaagtggtcaaaaataacatattggaaaagattttctagatttagaagatgagaatatgctcttttggaaaaaaaaaaccttaatttgttgaatgcataaatgatttaattgtttaaactaaggagttcagctccttgtatctaaattctttaagttccctggggcttatggcggtggactatgacttataaaacatatagcaaacatgtggaggcccataggttatctgcatagaaccaagatgaaaagcactataaggtaacatttctctcctcccccaagacagtgagataaatgtatctccctgttccttcccatttattaacaattagatcacagctttatataagtaggggccccagtcttttgtaccctgtttttcttcaatgccttcagggtaaaagaggctgatgtcaaaggtctagagattatgtgaagactctcatgaaaatatagaataaataattttaaagaaagaagaaataaaaaacatggctggtagccttagtagagaagctttatttatttcatggagaacaaaactttaggctgggagaggtcattgccaggttactggcaggtcagggaaagcaaatactttagttggggaataattaggccatatctgatcaatattacaatcgatcataattttaacacatatttaaacaactactctgtgttggcattagagatttttaaaaaaatgagtaaatcccagtttctataaccaccaaactgctttctatcttctgagatccacttttgaagcctccatatatgagtgagaacatgtgatatttgactctctgtgcctggcttatttcacttaacaaaataatctccagttccatccatattgctgcaaatgacaagatttcattattttggtggctgaataatattccattatatatatactatatcgatatagtgtatatatactatatatactatataaatatactgtatatgtactatatatatacactatatatatgtactatatatagtatatatatagtactatatacatactatatatatactatatatatatatatacacgcaccacattttctttatttgaagatagagagtagtttggtggttatcagaggccaggaagggtagggaggtgggaaggatgaagacaggttgattaatgggtacaaatatacaggtaggtagaagaaataagacctactgttcaataaattaacagagtaactatagcaaacaacaatccattgttatttcaaaatagctagtaaagaataatttgaatattcccagcataaagaaatcataaatgttcaaggtgatggatatctcaattatcctgatttgactattgcacatcatatgaatgtatcaaaatatcatgtaccccaaaagtatgtatatctattatgtagcaatttaaaatgtatatttttaaaaatgaaaaagctcaattctagtcagaaaggagtggtatctttaattcctttaggtttaaaaacattagttaaaaaatgttattgggaagctagatattaatctgatctcaaactaacgtttcacgtattacttattaattgcaaaggagaaaatgttcctttacataaagagatcttctggacatcgcccataaataaaattgatatcatgggcttcttgacacaatgcattgagaaggacacagcatcatctatgtagtattcctgccaaaaaaatgtttagtctgaatttattaatcaggaaacaagtggttaaatccaaattgaaagatattctgcaaaatagttggcctagactcttcaaaaacatcaacatcctgaaacacacaaaaaggttgagcaactactccagattaaaggagattaaagatatttgacaactaaatgcaaagtgtgctccttgattagatcttgaattagaaggaaaaaatagctataaaggacattattgtggtaattggaaaatttttaaaaaacactttatattaggtaatattattgtaccaatactgagggtgatcattgtattgtgtttatgtaggtgaatgtcctcctaattcttaataaatatatgctgcaatatttaggaatgaaatctagtattgcagctgactcacaaatgatttagtgaaaaaaaaaaaaaagaattagttggccacatacagtagctcaggcctgtaatcccagcaccttgggaggctgaggcaggaggattgcttgagcccaggagttcaacaccagcctgggcaacatagggaggccctgtctctacaaaaacaatttaaaagttagccaggcatggtagcatacacctgtagtcccagctacttgggaggctgaggtgagaggattgcttgggccccagaggtcaaggctgcagtgagctgtgatcatgccactgcagtccctgggtgacagggtaagaccctgtctccaaaaaatatatatattatttatatacacacacagacattcacacacactgacagtctgcagtcaggaagcccttccatcaccacatgcccatacagttgagtttacagaggaggaatgatgaaagaaaaccaggccaatgcagagggcagggtgtggctgcatgcatctttcctgcaaacctggaggcaagatggcaacttcaatcctgctacttcctataacctagggaaggtttaacttcatcttttgagctcatcagttaaagtgggggatactagtacctcctatatggcacctcccttcactgtgctgtgaaggttaaatgaggcagtaggtatcaagtccttactagcacacaatagatgctcaatttgtttctctggaactgaattggctagtatactactgatcaagaaggaggacgaggacttcagtgactgtcaggggacttgcattctggaggagcgagcggccagtgtaggctggaacctttgagatgaagatgtctcttgcctcaagtctggatggagatcatcttttcaagacaaagcctaataataggtagaattgctgaagatgaggagtcactgcttacaaagtgcttttcgctcaatgaaattatatatgtgaaacctgcctagcaggcactttctcaagtaggtttcacatatgtaatttcactggattctcacaacaatctttgagaggtcaacactttatacatctcatggctaagaaactgaatctcaaatagattaaatgacttgtccaagatcccccaaccaagaagtagttggtccccacaaacccaagactccaaagcccattcagtctgtctacaacacttcactacttctggagaggggtagttcatgtgtcagaaatgagaatgaagtgtggctaaggcagatagaccatcttaaaacccattatcaaggaactgggctggccatgagcaatactggtgaatgaatagtccaatgacatcacaacaataatagtaaccataataatacctgaagtttatttatttatttattttccgagactgagtcttgctctgtcacccaggctggagtgcagtggcgtgacctcagctcacttcaacctctgcctcctgggttcaaacaattatcctgcctcaccctctcaagtagctgagactgcaggtgcacgccacaatgtccggctaatttttgtatttctagtaaagatggggtttcaccatgttggcaaggctggtgtccaactcctgacctcgtgatctgccctcctcagcctcccaaagtgctgggattataggcgtgagccaccgcacccagcaatcatacctaatatttattaactgccaagatcctaccatgagttgagggctttatatgcatgatcatatttaatctttacaacaaccttatgtgctgggtaccattactataattcttacttcccagatgaggaaattgaggcttagaaagtttaaataatttgtgacccagtgaatccaaatctgcctgagcccagagcttgcacccttcttattgtacttcctttcttggggcaagagagaaagatggcatcgatgttaagatggaagaccagctgaaggagagtttggcagaagcaaaaagaccagggaggtgaagggtagtgagcccaggggtagtattctctagcctgagctggggagtgctccataggagtgtacaagtgtaagcctaacattcatgtaccttatgtacttgttttttatttttaatttttttcgagacagagtctctctttgtcgctccagctggagtgcagtagtgcaatcttggctcactacaacctctgcctcctgggttcaagtgtttctcctacctcagaggcacacgtctacctcctatagacatgtgcctataatcccaggtgtgccacatccgactaatttttgtacttttagtagagacagggtttcaccatgttggccaggttggtcttgaactgacctcacttgatccgcccgcctcactctcccaaagtgctgggatttcaggtgcgagccactgtgcccagccagattcatgcactttaatataggaattcaatactctgattaaacaaagttgagagaagaaagcctgaaggcctataggaagaaggcagaggcacatctggaaatgaaaacagaaaggaaagggggacgcaagaacctagggagaaagagcaacgttatcgtgaaggcggaagcttgggagggaatagaatccagccctggaatttccaacatggcaaagaggcattgactgggccaaggaatagggagaagcgtttttctcaccctaagtactttccaatgtccaccaatacgtgtcaacattggacatgtgttcacttacttcatctggtacaaattattggtgcctctgtggtcaatatcatggcagaaagcagcagcaagcatggcaaaggcttcgagatctgtgtagtacttctttaatcttcctgtctaaaaaaataacatatatatgcatatctataatttatttgaattaatatacctctataccaagtgcagcctgcaatagagaataggcccactaggtttctggagcaagttcactttatttgttgtgagtattgtagtactgtgggtgaagactgaaccttcctttaagaaggtaagtgtgtgaatgtctgaatgatcatcccaccggtgctcaaggatactgggactcatctgcagcggagaggggtttgtgccctgaatttttaaattactgatctaaaatgatggaccatacctatttctcatcatgctcaaatgggaaatctgcaggtttacaaggatttacagccctctgtacctaccatcagcaaagtaaacatggtctgccccacgttgaacccatgccgccaattgtggtaagtgacagctcggtaccctttcctcacagtgtacatccatctggtaagaacctaaaagaagatgacaccattcagactttggaatagaattctaaaggttagaaggtctgtggcaatcttatctaaaaagatgtgttggtcttgtagataggggttaagctgatgtatttagaaagttaataataatttaaaattcaaactgagtccatcttttgaaccacagaaaacatcagtgaagcagagccacagaatcacacagtattttaaattaaataccctctgacctctacaggtactttgaatttctccaccacatttatttcaaaaaacagtcgtattccacatttaatcaatccgtgctctgtaagggggaagtcactgaagcggaattcgtacagttctgctgagcgtgggtctggcaagtcctctttctgttgaaataaggatgggttgtttcagattacattcatctgttttccctttccactcccatagccaacattgggtgtaaaccaaaattacaataaaagaacacaatgtgtgattcactgaaccaccatgtgccaggcactggatgatgcagtttgcacagattatgctaacggcaggcctacacgattatctccattttacaggtgatgaaactgagacttggccatattaaagactttctaagtgatgggttaccattctaaatccaactccagtagctcttttctttcaatgatgcaaaataaaatgtttagttacaaaagccttactcatttttgatactcaactttttttctgttcaagaaatattcagtaaacagtaaacgactgcttaattcaattctcttgaattttctttatgtgctcagtgacagtttcccactagaatgtgagctccccgagggtggggatcatctgcttatttgctgccatatcccaaatctgcaggtcctgtcccatgaaggtgctcaggaaatgcctgttgaatgaatgagtggatggataaaccaatgattgccctgcagtacataggtatacttgcagacatttcatttaactcacatctggttaggatttcggattatgtgaaaaaatagccaagtagacacatggcattggtgcgacttgagaaataaaaatatgtatcttgcccttaaggaacttaacttattaaagtggctataaaatatatacgagtgaaaagtaagcacttagaataatcagagagtatggccagtgctccatgccgagggagaaactgaatgtccttggacaggtggggaaattaaaggaggagagatgctggagggacatgcatgcagctgagctggcagaaggaagcggagagacgattccatgtgggtgagaaagtgctaagaggcagaaatgagcaacaactatgtgggcctaccagacagatctgcaggagagattcagttcaatgggtatttatttgaatgtgtagtatgtccttactagtgcactgaggaggacacaaacatagggaaagggaggtcactccccttagtaagtttaatgtttttcaggggacagccatgctctatttacacagatttcaacaccgaatggtatatagctatttaaaacaaaattacggtttctggttcccccagcccctgagcctgggctgacccctcacactcttgcacagaactgttgctacacccagaaaatcagctgagccttccctggaggtaacatgaaagtgcaggcctggagagagactcaggtacgtgaagatggacaaataattacgtagctgggaaatgatgccaggataattttggagaactcctctgaaatatttgttacgttcctcaattttatgcaacaatgatttgggatttgccctgagtagattttacattcaaaataggctggttttttaggaagtctactggttctttgtccactttattgcttctacaacataagatccttcttcctttaaataagaaattagagaatttctggtgacacggatgtcaataaaagttttgttttccaagaagatgcctattgttgagggcaggtggggagaagaaagggtggtcttctgggccaggctgagaggatggtgccaaaggtggagccaagcaaaatgggagaaaagggaacctcagatgacatgaaaacacgggggtgggaagtaagccccaaaaaagggtcaaagaccaacagtcttatggtagcagagcaaaggccctgggtgggaggacagagcccacaaaagatggaaagggagaaggtgagatagtcgatgtgtcttagtttagaaagaatgctcacatcacagatcggaaagagatggtggaaaacaggttatagcagttagtaaggaaattaagtgtgatatttccatttcaatcagaaggaattcaatcctctgaaattcaaggtcttggggtcttcgtaaatatcccaggatttcatggattccagaggagccactttctagaaacaagggctccaccctaatagtaggaataaagccaaaaaagatcattccaaatgaaatctaaaacaattctctcacctgccagaagaaactctaatgctctttgcagaaggataatatcactcagagcccctacacgtttttatctacaatatctgattttttattttaaaagcataaggcatgctttaaaacaggatcaaatgactagaacccaggtgtaaaaataaacagtagaatcagatctacaggtgattctggtattaagatgggtaccttaaaataatacacatcaatacatttatgaaaatacaggggaaaatagtcaaaatagatcaaatgatgaaaagttttaacacagagttagaatcttaacaaaagaattaaatgtaccttctagaactgaaaaaaatctctgaaattacgaacttattgagcgagtttaacagttgatcgggcacaacaaaagacagaattagtgaagtgggaaagttaatttcaaagaaaaataatagggatggcctactggcaacaacacgaaagaatggagccttcagactccagaagagaagctagaaatggcaggcggtgccagtgcctagaaagatccatgctccacgctaactctgtcatgttctctgtggtggccatggtgtcatccaaagctattaaaataaactgtgccttgatatccctagattctgtgcctgaagtcccctaagcagtagtctaggctacctacaattgtaaattatctgtatgaattggaccagaggcgacaaagatgaagaaaagcagggaatcaaaagatcaatctttagaagaattctttctttttagccttgagaaatatcaggaaagagaaaactcaacatttacttgaaaaacaagaaagcatgtcctaatatattattgatttataatgcctctatttaacaggcattaaggttagaaagaaaacacttaccaaaattgcaacaagttgtttttcttcacagtcgtcaattacatcaacatttaacttctcttgaaatttctaaaatgtaaaagcaattgaggtgtgaaattcctaaaggagaagatttccatctgattcctctactattacaatcttagttaagatatatttaaaatatgtgggaggaagaggcgggaagatccctggagcccaggagttggaagatgcagtgagctatgatggcaccactgtaatccagcctaggtgagagagtgagaccccatctctaaaaataagtaaataaataaaatatactacaatgagttccatggcaaagatgcattctttgtcatggatacaaagacctatagcacctgattatgaagacttttttcaagaaataatctaatatatttgatttttaaaattcccccaaaatgattacagtagctggtttttttaaagaggtgtgggttgtttgcatgtaggaaagaaaaaatgagtggcttacatttatttttgtattagcttatcacagttccttttattacccccagatcttctcatctttaacatctcaaactatcaaactgaattacactcaaaccactcggcaaaaccaaaaaccaacatgctcaccaaaaccaacccactccagcaaaactacacacacacacacacacacacacacacacacacacacaaagccagggaaataaaagaaatagagatggtgggcacatgatattttcccttcattttgtggtgattagaacatggttagcaaatatccacttgctcccccatcatctataaggttggtcttcgtgatgtggctttctttggccaatgagcattttggtgaatgtgatgtgagcaaaaacctgaagtatgcctgcacagttaggtttgctctcttgcacttctgtcatctttgtgagaaggacatctatcaggtagctcctggtccaagaaggatgagagacacatagagcaaaccaaattcatagcttggagccaagtccagccactgtcaatcaaagcctggtcaacccacaaatgtgagtgagagatagaggttcattactgcatgacactgaggcgttagggttgttgttatgcagcattatatgacaatagctgactgatacatttcccttcctaaaatatatatatttttttcttgctatagctcccatagccccagggctgttttgaacaaagtgctattccagccaagcagctgtacttccagtaagggtctctgtacactgggccatccatgtcttcttccaacccctccttccctgtctctctctctcagcccaggagtaaaccatttgcatttgtcagacccctgggtaattagatgacttctagaatatgtggttaggtaacatcttatgtccacaggactgaatttcccacttaccaaaatggacttaatttcttcaggagtggctttggtttggttcatgagcatttcctgagcaatgtcctttctgttttctagcttattcatcttatcgtaggtgtcagtatttaaaagagaccatccaagaaattgtgtgagagtctgaaatggataaaaggtgattctaattctcttcagtgaaagaaaaattggtttggaggcaacaatctgcacgcttttctatccatctcccttccatcatcaaccaccccattccttcttttaatttaagaaaaacatactaataatcagcttcagacaataaaactggctgaattattgctttttaaagtgtaccatgcaccatgaatagaagagagaggtgttaccaacaccagtatagtcaagcaggacctaaaaattaggcagggggctgggcgtaagaataagaataagaatgagagggaacaggaaggaggagtgggagaaagaagaagaaaatcctctttcctgttttccgagtattattacaaattttggttaagctaaaattttatactttggtagaaaatgttgcagtttatagaagtcaggaaatagaaacgacaaaataacaacatattggttacagctatgtgtgactcatgtcttaatggcccttcaaaatatcattccagaataacaaataattacgtgccctctcttattttgtgaattgcattgacttccattatcttattattgcacttgcctcggtaatgtattcatcatgctcatcgaaaggttttccatccttcctgttgtaaaatgtagccactcccacaatatcttctttcttgttgacaataggcagggacaaaacattcttaatgacccaaccagtttcgtctacaggtcctttctacaaacgagaagggacctcaagttatttttttgcctttttagtttgaaataatcataaattcacaggatattacaaaagaaatgtacagagagatttcaggtacccttcacccagtttcacacaatggtaatgatggttagacaactacagtacattttctaccatcttgtgtaactatagtacaatatcgaaaccagaaaacagacattgtacgatccagagctgatttggattttaccaagatttgtatgcagttacttttgcacatatatgtgtgtgtgtacatatagttttatgcaaatttatcccttgtgtagcttttcaaccaccattagaatcaagatacaacactattccatcactacaagactgtcctgtactcctcccttctagctaccacccaaccacctgtcacttagtttatttttaatttaaagaaaaaggctgggcacagtggctggagcctgtaatcccagcactttgggaggcagatcacctgaggtcaggagctcgagaccagcctggtcaacatggtgaaaccccatctctactaaaaatacaaaaattagccaggcgtgatggtgggcacctgtaatcccagctacttgggaggctgaggcaggagaattgcttgaacccaggaggcagaggctgcagtgagccaagatcgtgccactgcactccagcctgggcagcagagtgaaattccatctcaaaaaaaaaaaagaaagagtaatcttttggtgttagatgtgcaattcctactttgtgtcagaacatggctaggaccatacagccattatatgtactctagcacatccaatagagtgaactagaaccaagtgtctgttttctgacaattctaaccttttccctttctttcccaagcctgagtgatgggaagtgcttcttaccactatgttacctcactgttccctttacactttttctatcttctaacacctgtttagctaattccttaaataaaattctcccgttaaaatactagtgtggtttttgtttttctgactgatccatgaagatagtctttcattctgtggtgtgttgagttgagtaaacatttgtcaagcctctgtggtatgccaggaactggggcagttgctgaaggtacaaagaataaatcacaggtcttgccctcaagatgcttagggtctagtcgagggatgcaggcacaaaagtttaggagtgtttctcaaagtgtggtccaaggaccatgtgtaacagatttgttttagcttgtttatttttttttatttttttttttttttgagacagggtctcactgtgtcacccaggctggagtacaacggcacaatcttggctcactgcaacctctgcctcccaggttcaagtgattctcctgcctcagcctcacgagtagctgggattacaagcatgccccaccaagcctggctaatttttgtatttttagtaaagatgaggttttaccatgttggccaggctgatcttgaactcctgacctcaagtgatccgcccgcctcagcctcccaaactgctgggattacaggcgtgagtcactatgcctggcctgggcatgcatcttcaataagcttcccaggtaattctgatgccctctgaagtttgagaaccatgatgtagcatttgcacagtatgtagctaaggcaaagatagacaagcactcaacacaccacattatttgttcttgaagacttcccttggcttacttagtcatccttacaggcccctgttaagtcttggctctcccatgaagcctttctaatttttctaactcataaagaacttttctgttttggaattccaactgcacttatagcctgaaccacaatttaacatttagactgagcatgtaataagtgctcaatctaagtaatttgttactactctatgtagtcattatacatgcaatgaaaagcagaggaaccaaacctcaacatccgtctcctgatggtcaaagctttagaaaaaagatgcagtgcatagtgcttgcaaagcctgcatctttggaaaacaataagaaatatttatgtacttacaccatcatacgaaccaaggacaaaatcagtaatagagaatatatcacatgcgtgtgaaagaacttcatgcgtatttgttaaagcttccaaaataagctttgctgactgcttctcagtgtttcaggaaatattcatttgctaccagttcatattcttgtgctttgccattagttagaccttactgacagacaagttacagaaggaacccaaggtttaagaaaaattagtaggacaaaaaactgaggaaattctatacacttttcctcctgtgaattaggaccactttaattgacgttaaaggaagaccccttagtccacttcgaggaaccctatggcaggcagaacaatggcccccaaagatgtctatatcctaatctctggaacctgtgaatatgttatcttacacaacacaggggaactaaggttgcagatagaatgatggttgctaattagctggccttaagatggggaaattagcctggatgttccaggtggacccaatgtaattacaaggatccttaaaagtagaagagaggttagaatcagaatgggagaaggagctatgatgacaaaagcaaggtcagagtgatggtgctgctggctctgccaggggaagggtcaccaggcaaggaaggcgggaggccctgagaagctggaaaaggcaaggagatgaattatccccagagcctccagaaagcaagagtcccaccagcaccgtgattttagcccaagaagactcattttggaattctgacctccagaactgtgagataatacatttcgtgtggttttaaaccactcagtggcaattcgtgacagcagcaataggaaatgaatccattatgcccccaagaaacatagtgtgagaaccactgcctttgcaggtttgctctgatggcagttctttttatatcattggcttgtctatcaaacttctcaggtgcaaaaaggaatcgtaagaatcagggtggggcctgagcagggagagacagaatcagaagacggagcacaaaaggagggtggtggtttggggagggcggtcacccgtcctagtccgctgtgcggaatgatgcacaggtgatgccgttgaagagcggcggggagggaggctgggggtgctgagagagacatcagacagagatgcagtcccgaccctttgcaaaggagaaacggaaggatggaaggttgaggggagccccttagaccaccgtgctgttctgaaactgtttgcagagctgttaggcattcctagggcccaagctgcctggcagggtatctggctgtcttccaggagcaggcctgctttactgtccctgccacacttagttaccaattgggagtggcctgtggagcgtgtggcctcagcacagatgtgaccatggatttcaggccagcagccattgcacggctacacttcccacaggtggagatctgagaagcacattttcatgggcaccacaatgatgtttcccagagaactgggaaatccctgtggcctggaggtttatcccacactggggactccccaaggccccggggaggccccaggcctcctctctgcccaggccatgagagcacatcagagcagtagctgcagtggagcatgagagaaagcaaagggcctcacatttcagagcagcctgcattctcctgggccagctccattcccactccctgtttagacaatgactgcttaaggttcagactctagaaaatcattgtcgcccttttgctgacatgcatcctattctgacatccacgtgccataaatataggggtcaggcctgggcacagcatggtcacaaataagcttcaattgcaaggaggaaggagctagagcagccatatggtgtttacatgttttccatgtcaatcggcaaagggaggagcaggcagatgcacgtaacgaagcaagtgtgtacagctttccccaaggtgtggtgtggttctgccgctaaggaggcacgctgcagcctggggaaggctggcttttcctaaaaggcagagatggggctctgtatgtgagagagacagaaaaacagaccccaacggtacccaccggggagggcagtctctatttgtgactgagatcagggctctaaggggatgtttttttaaatacaggacagagaataacaagtgcccagaggcagaaaataagaggctgtggagccaaatgccagtttatctctaacagtcaggttgggaggaggtgacaggtggggagtgggtggcagagatgacaggtgaggagggatgggcaggtagagaagggagtggcagagatgacaggtggggggtgacagttggggagggggtggtgaagatgacaggctggcccttctggtgggctggatgaactcggggggcggggagggatcaactcgggtctgcagccaggttccagcaggaagccctgatggggagaagtgggtcaggtagagtagcacatacagaagctgattcctgggagcatctggcggtgagtggaggcagattccccaggcagtgggtctctgcacagtggagaaggaaggatacaaccgagtctaacagcaggagaagctctgaagactcagtcagaattgttgattttcctgagaacagttgcaataagctgcagggaagggctgctgagaaaaccaccaggagagcaggattcaggatgtaggaggtagccagccattcatgcatgcagagaacgtttattgagcatgaatgctgtgtcaggaactgttgagcccttagatcaggggtccccaatccctggactataaaccagtactggcccatggcctgttaggaaccagcaggttgtacagcaggaggagagcagtgggtactcgggtgaaacttcatctgtatttacagtcactccccattgctcacattaccgtctgagctccacctcctgtcagatcatcagcagcatcagattctcataggagtgtgaaccctcttgtgaactgcgcatgtgagagatctgggttgtgccgtccttatgagaatctaactaatgcctgatgatctgaggtggaagtttcatcccaaaaccatctcccaccccaccctcattctgtggaaaaattgtcttccacaaaaccggtccctggtgccaaaaaggttggggaccactgccgtaaatgaccaggagtgtgagcaaatggaggagtggcaggtcccctccctggccttctgtcttaaccttcttttcttccttcactgaagaatctgctacttgctggcccagccagggtgagtgggagatggacccgtgtgtgcctgtggccacacctgagcatcaggcggactctgggggtggaggagaggcgagagcatccactcctctaccccagccccaagaggtgaggtctgacccagagtgcagttacctgaaatgtgaagtattcatccgcaggggcattcatcatgttacagatctggaaggcaagaggagacaaatggtctgaaatattgtgtagtggagccctcttgatccacaaagcagaataagaaagaacgcattgggagtgaggattttctacacggctcttgactgcttgcgggcaaatggacctcaactaggccacagctgctaacaactcattcaagatggcttccctgctgctaattaaatcactggaggatatgtggtaccgtctctgccccttcccactcccccagactccagggaatccccttcaaattcaaagcaacaggctgctcaggccaaggggaggagaaagctgagaaattctagctctgctacagccagtatgagcagcagagctaggattgctttttttcttcttcttcttcttcctaaagtgagatttgggttagaagatgatggttaagaggcaggaggaaacagccagataagtttttagttacaccaaagtaaggattcagtgagagatatcactttacttagtggaattcacagactattgctcacatctataaggacaagaaatcactcaactttgggtcattttaagttttctgtaccttgggtcataatcacaaatggatcttaataaaagaccatgtctttccaagagataattaaaatcatagcattttatttgattttattttttatattttatgagatggagtttttgttctgtttcccaggctggagtgcaatggcgcgatctcagctctctgcaacctccacctcctgggttcaaacaattctcctgcctcagcctcccaagtagctgggattacaggcacccaccaccaagcccaactaatttttgtatttttagtaaagacaaggtttcaccatgttggccaggctggtctcgaactcttgacctcaggcaatccacctgccttggcctcccaaagtgctacgattacaggcgtgagccaccacacccagctatcatagcattttaaagccagaagggatcttagcaattaagttcatacttaaaaaaaaaaaatgaacaaatggaagcctaaagaggttaagtgatttgtttaaatctatgggatggaactagaactgtgagctccagaatgggtgctggggaaatcagctctcctggctgggaattggggaaatccttggcttgtatcagttgccaatttccatggtcccaattctcttgccatgggagatttcaagctgccaacagtttaacaacttgctcacaaaagtcctaaaaaactaacaatctaacaagatctaagtgggctccctccttaaatccccacctcaccaaactctgcctgcctctcggccccaaggtaagtgctttctgagaataattgaatgaaccatgtctactatttttgtagtactcttacacagaaaatgcgagaatctttcaaagtttttataagcatatatagcctaagaatttaaggaatctttcatgccatgcattaatttcatgatctaacttgaataaattacatcatttgatgggctgagcacccttcaactgtgtttttgaagaggcaaaaagcagcctattcttttttaaacttttcatcagcaattatctgttttagtcctttctttgaagaacattatgttctaaatgttataagaacatttacaggtgggtcaagaccttagaggcccaagcttttaactcaatattgaaaagttccacatcccacaccatccccaccccatcccccatatttatgctttaaaaaattgactgatgtacttgagatagaattaaacccagtcattaaatcatagtcattggattccaaaggatatctgaaatgtgtgtggctgcagaataagaaattgagggatggaggaacctttctcatgctgactaaatatttctgtgtagagttcagaagtctccagttaacctacatttgactgtcaagattcttctctcctttgtcctatgccaaaggaagtgatcatctagcttttttttttttttttttttttttgtggagtttcactttgttgcccaggctggagtgcaatggcgcgatcttggctcactgcaatctccacctcctgggttcaagcaattcttttgcctcagcctcccaagtagctggcattacaggcatgtgccaccacgcccagctaattttgtatttttagtagagacggggtttcaccatgttggtcaggctggtctcgaactcctgacctcagatgattcgcccgcctcagcctcccaaagtgctgggattacaggcatgagccaccgcgcccggcccatctagcttttattggatgcattcttgctttcacaattgtatctatctcttagctaataagagtttcttgcaatattatttaaaatttgaatttgttcaataacttacaaatccattttcagcaacatatgttggcaacccactaatgagtgtccagtggtctgcaggaggcgtccttggggaagagaagaaaaaaaatcattgcaatatagagaaatgcaatatgtgcaaaaatacaacggcaactgcggcagcaacttcctgccaatactcacggaatcactttgatctcttcttttccatgtaaaatgtaatcaatgattttataaaagttgacttcctaagaaagaaagaggatattatgggaataatgttatttcccaaagaaatcatttttcattggggaacttgtactttaaaactcttacaaatagaaccttatttcccaaccacattatattataacataaattatcaaactacttatatcctgactacaaacttataataaaaccagaaatattattggctgtttatctacatgcacaggctaaaataaattttgtttttaaaaagttgaattgcccccaaacagcttttggggtgggggggatctttggctaccaaatcatcagagagtctgtttttattttcaagtgatcccttttgttgtccagaaatacctgacattaataacttcactagaacaaatcatgtaatttcttaactgtagtcagttttacattatatatagtgacccgtaccctcctttcatcagtgacttatctgaacaggtgcctcagaaacaggaggtttcactgccaaagctgaaagggactagagaattattctctctgtttcatggggcagatgatgaatctgaggcctggacacaatccatccccttctctttcctgtgtgctatggacacaggggtttctgccttcatgaagcttgcagtcaagggggaaagtaaacctaacccaacccttccttagagattctaatcccacatatctgaagaagggcccaggtacttctttaaaatgttgtgcaggtggctctgatgcatcccttccagttgagaaccactggtctaccaagccctggctttatagaaaaggaaacggagaggttcaacaaggagttaaggcaggggccaatcagctctagcttggggcatagctgggactagaacctcaaactccttgtctagtgctgtttctactactccaggtcttcccaggccagtgctctatgcactgtggcctcttaattttagcacctgacaccatgcacagatggcatcaaggaagacatttgcacgtaccctgccatcaggtgtctttggacctttataaggctctacttctccaagcttgattggccattcatcgtagaattcctggaggcaatcagatttaagtatcattaaacacactgttccatgacctaccatatcttatatgaattttatgtgtttgtatattttatgttaatctacgtaattctggaattttagtgctgaaagatctacaattcccagcaatactggttaggaatttttgactgttaacatgttacttaaccttttacatctgtaaaatagggataacaatagaatttgtactaaagaattgttgtgaggattaaatgaataatacatatgtaacatctaccctggcacatagttcaaaatactcaatgtatagcaattctttcatagacaattaagctaaatctggtaaaaggcttggccaaggtcacacagagtggcaaaatgttggttgctttacccaacattcattctctgtcttttccttgctagcataacctgatgcgatttgagtatcaggtggtaattttccatcagaccacagcccatgagtggtctacatgaggtgcctagatcagtttaagggcaggtatgtggcccagatctggacattgaagaagggggagaagtctgctgagggactactggcaaaaggtattcctcagataaaagctgatgagagtgacatttggagaaaatgcctcccagttgtgtcatgcctatgtgccaatgatttgagctgcaacagccatctttccaccataagaggaggcctcaccagcacgctgcaggtagcagagaccttgccaggaagaaagagaaagcacctggactttaatgactgcactgatctctgaatcaaccagtactagcgctgccctaccttgttaagtaggagaataaatatcatattgttagagatgcttttagctgtgtctgatgtttcttatagccaaaagaatcctaaccaacatactcagctacaaagtcccagaaccaagatcagaacccagctctcctagtgcttcatcctatgtttatccacttagaacaattactctgaaaaaataacttccaatcacatgaatatgaagaaatataaataaggccaggtgcggtggctcatgcctgtaatcccagcactttgagaggccaaggcgagcggatcacttgaggacaggagttcgagaccagtctggccaacgtggcgaaatcctgtctctactaaaataccgaaaatcagtggacgtggtggtacaggcctataatcccagctactgaggcatgagaatcgcttgaacctgggaggctgaggttgcagtgagccaagatcatgccactgcactccagcctggtgacagaccaagacagagtctcaaaaaaaggaaagaaaacaaaagaaaaaatatataaataatatggtatcgttagttattttgaactagaagggtagcaacagaattaaagaagatgacacaagggcattatattgtgaataatattacatgtttcaatatttctactttaattaaatttttttagaatacaaaaacctaaagttggtaaagataatattgattatccacctactgtgtaaattctagacactatgtacatatagtgtttatatatataaaaaaatatataaaatctctaattctcacaattgataagagagatgtcctcattttacagatgaagaagccaagaatcaggtaggttaaaagacttgctgacaagaagaacaaaatcaaaaagctgacactacctgacttaagatttgccatgaagctgcaataatcaagacagtgtggtattagtgaaagaatggacaaatgaatcaatgaaacaaaatagagaacccagaaatagacccttacaaatatagttaacttggacaaaggcgcaaaggcaatgaacaaaggatagtcttttcaacaaattttgttggaacaactgaacatctacatgtaaaaaaagtgaatctagaaacagaacttgtacctttcacaaaaaataactcaaaatggattatacacctaaatgtaaaacacaaaagtataaaaattctaggagatgacatagaagatctaggtgaacttgggtttgatgaggcttcatagatacagcaccaaaagcacaatccatgaaagaaaaaatatagaaaaattggacttcattaaaattaaaaccttctgctctgcagcagacactgttaagagaatgaaaagataagccacagactgggagaaagtatttgcaaatcacatatttggtaaaggacttggacccataatatacaaataactcttacaattgaatgataagaaaacaacataaaaaaatgtgggcaaaaaatctgagcagctatctctctaagaagatatacagatggcaagtaaacatatgagaagatgctcaacatcatatgtcattggggaactgaaaattaaaacaacaatgagataccacaactgataccccaaatactaacatcagcaactgctaatacccaaaatactgacattaacaactgctggtgagaaagtgcatctggtagacatgcaaaacagtaaagtcactttggaagacagtctgccagtttcttacaaagatcaatttgtcttacagtataatccagcaattgccctattcggtatttacccaattgagttgaaaacatgtagacacacataaacctacctacaatggttatagcagctttattcacaatcactaaatattagaagcaaccaagatacccttcaacaggtgaatggatacacaaacctgccatacagtggaatattattcagtgataaaaagaaattagctattgagtcatgaaaagacatggaggaaacttaaatgcatatttcaaagtgaaaagccagtctgaaaagctacatactgtatgattccaactatatggcattctggaaaaggcaaaaactatagaaacagcaaaaaaaaaaaaacaacaaaaaaaaaaacaaaaaaaaaacctgtggctaccaggagtttggaaggggtgaggaaaggttgaatatgtgaagcacagagggctttgaggcactgaaagtagtctgtctgatactgtagtagcagatatatgacattacacatttgtcaaaacccagagaactgcacaaaggatgaaccctcatgtaaactatggactttagttaataataatatatcaatattgattcatcacaccacactaatgcaagatattaataacagggaaactgggagaggagattgggagggaagaggaaactccgtactttataatcaatttttctgtcaatactactctaaaaatagtctattaattaatgtaaaaaaaaaacagacttgctgaaaacccatattactaggaagtggaaaaaccaagattcaagcctacatcttttttgctccaagacacacacttttacctctgttcttgtcatcaatcatgactaattatttacatagtgtatctgttttttaaggatcacatttcctgtggtgtgtgttatataggcgatgtgagatgagacaaaatgtgtagaataataagaaccttctccttggtcatgtccagcagtccaatggagtatcgttcacagttcagatatgatctaaccgtgtagagcgctttgtgaaactgtcgctcaacatctgtgagttcttcaaatactttattggctgaccacataaggatctgaaagtaggtatcaaaaagaaaacagttagaataaagtatgctatggagagatagagcattcaccacaagaaaacatgaggtgcatcaaataaaataaatgcatatcattggaaagtgcaattctgattttgaacatgtgtacatccaacaaactactcagatcctctaggtgagatgatgagtagacttttgcaaggctgcgggtctatggagagagagaagctatgattggttcctgtgtctagatgttttggctccaaaggggaagtgccctgaaatgggatgcagggatggtccctggacggagaatccagtatcggtggcccactggctcctgctggccctgatgtggagagagccacatacctccttccatgcatcctgagatagtcagaggtaaccttacctggagagttcaaacgggaagggacctccctctcaacctctactcgtgcattgtactggtgaggaaactgaggtccagagagtgggccagacctaggtatcttaggtactaatagtgccctttatccctctgtctcatggagttaggaataatatgctcctcaaattaataggtttactatgacccaggaatttctacaaactttatttgagagctaatcgctaatagtcacaacaaccatctgaagtaggtaccattattgtcatcaccatctcatagacagaaatgccaagtccactcgggatctagactgaagaaagccaagccagttgtgtacacaattggagagcttggggtgcaggggagtgtgtgtggggagagtggcgggaagatcatgagaggacacgtgggactgaagtttggggatctgttccacgtggcttacacccccaggaggaataggaggggtctgaatttgttgtctctgggcggctttgtcagaataggtcagcatggaatgactaatgctgccttccttttacctggcttcttcgggattcaatattgtacatgtagctggtgtgatgaagccttaggatgatagacacaaagttgaggtatttggaaaagacctacagacggcagagaataacaagttatggttgtgacatcttttctttggttatacaacaaataaatttcctgagcctccaaccagatgcccagggttagcattacctcttcatcctgtttggaaaattcagatgcatttactttgttaactgccatgatcacagcaagaacctccttgcccaccacgatcggggttgccagcaggttcttagtgacatacccagtttgcttgtccatgaagtcagaaaaatggctgttctgaaagagacagtcacatatttgtcaaagtggcacaaaatcatagagtggtagatctagggatgatgacagatcattctctctcatttaaatgctaccaacagataaccagggctccagtacagtggtccccagtaaacaatcccactccacctgccatcctatgactgcatagaatggaattgcccatttcagaataagcgctgccaacctgagctatggcctatttaggttaggctgaggttgggccagaagaaaagaggtgatcagacagccaagtggaaagtgaggtgctaagaggaagagaggggaaggcacaaggttacaatagacagcaagtacatgcagggaaggagagcacagctaggaatacagacacagttcatagagcgcttctctctcattacaaagggaaaacatgcacttgaaatcatcaacccatatgtcataacataaagcaaaaattatcattgcccccagttccttccaatctagcctactagaagaaatccgtgctaactgctggtgtgtctcctatgcctttctccatgcttgaacaaagagttttctattttttctaaaatttccttttctaattgcttataatagtttcatcacttaacaatgtcttagggacttccctgaagaccaatgcatatggatgtgaactcacctcttagatttgtgcacactactccaccctgggtgctttatgatccactcaactgtcctttactgattttgcctgtgtatagttttccccactaccaacaatactgcactaatccttcttgcttttatttttatgtgacagattcccaaaaaaggaaatcccttttgctggatccacaggaacatacagtttttctttacatagattactttgatgaaaggttcacattctgaggctgggcggggtggttcatgcctgtaatcccagcactttgggaggccaaggcaggcggatcacctgaggttaggagttcgagaccagcctggccaacatgatgaaaccctgtctctactaaaatacaaaaactagccaagcgtggtggcacgcccctgtaatctccgctactcaggaggctgaggcaggggagtcgcttgaacccgggagacagaggttgcagtaagccaagatcgcgccattgtactccagcctgggcaacaagagcaaaactctatctcaaaaaaaagaaaaagaaaaagaaaggttcacattctaacttccactgaccctgtgtgaaaggaccaaggactaccctcttgccagcatcagatgcttatcaggtttttaatgttctaccaggcttatgtcttccattcctatttttttttctttctctgggagagaggaaagtggatcttcccagattcagacctcatagagtagattcgagagataattctaatccactggccatagcagaggctgagtaatgagtctggagaagcgcacaaatggaagggcttgagaaaaaggtcaaggaaggcaattatcttattagttatcatttcagagaatagccactcacggtgggtttagacccagccttccttgggtcatgacattcttccctttgaacctaggacttcttcaattagaactgaacttcagccttaactctgagactcgttggccaaaattagtgcggtattccttccacagttgtattattttcatttccctgtgttggcagtgcttctaaaagcagcacaaaccttgcagactggattctgtctggtttcccgtagaaaaaaatgtgagaattttctgggtgtgtcatttccaggccagagtttccaccagggaacaagggctggttggccaatagaactcacagagctcaaatgagattagcagtcctgagatatgcctcagaatcacctgcagattaatgcagcagatgcactgaatcctaatctcctacagtggaacctgcacttttacgtggcccaggtaattcttaggctcaacccaatggggaatcactcctgcagaggatcaccagaaatggtaccgctctcagaggaaatatgtgatgtaaaggggataaaggcagcccctcactccagatctcttctatacctttcccaaagtggaaacacacaaaccaactcttgaggcatcagcattgcataaaggcaaggaaggtattggagtcagactttcttggctgaaactgggccccagtgtactagctgtatggtcctgggcgtgttacttaccttctgtgtcctcgttttgtaatctgaaaataggggtaatgcttccatctactgcctagaattcctgatgtgaagatagaataacatagtataggctgagcacttagaaaaaaaaagagtgtctggcacatagtattcagtaagtactaggaagagaaacttagtacttttctaggctttcctgaatgagaagtagttcttttgcaattaccattttgcttctagttttaatttttctagccaattcaaatcactgaagaaatcagatgcccatagctggatgtaggcctcccataccgcggagcacccttcctccagaaggccagcacactccctcactcatgccaccaagaaccacatttcttttctatccattttatctgttacctctctctggttccccatagcatcttcaccctcagaccaaagtgtctgcagtttttgttagattctttctcttaatccactgcttgtctaggccagctcccattgtttcccttccaccctgttatccatgcagatcacatcaccttcatttacacagcctgggcactaaaggaatcatcgaaataccagaaatgtgcaccatggggtgaagttagccaggacttctttctttcttttttttgagacagagttttgctctcgttgcccaggctagagtgcaatggcgtgatctctgatcactgcaggcttcacctttcaggttcaagtgattctcctgcctcagcctcctaagtagctgggattacagacacctgccaccacacctggctaatttttgtatttttagtagggacaggttttcactgtgttggccaggctggtcacaaactcctgacctcaggtgatctgcccacctcagcttcccaaagtgctgagattacaggtgtaagccaccatgcttagctggcagcacttctttgcaaacacatttcactctgcagcttcaaacttaatgccattttattccagattctaaacacaaggaaatgttaagttcaatggactgttttgagaaaatggcttgtaagtttcaaaatttgatacttgcttattattgcatctgaaagccctagataaaccagccattaagttacaggatggggatgggggaggggtttttgtgttttattttcactagctcaaaaaatccttagcgaagtttctttgcataaatcctgcgtgtgtcccttgatggttcttcagagaagcccttgaaggcagctggagaacattgtttagagcaacaggaggcctgatccctcatcagatgtcagtattgctaaatcctgattaaacacccttaacccctgagatccaaagcagaagtagaggaggaaaggaagagagaggaaggaggacttttaaaccacagtcagaatcaggatcacccatagtttatggacagctttccgaatagagaaaaaaacaacttaaagaggatatctctcagtttcctgttcttaaaagtcttcctctcagcactttgggaggcctatgtgggcagatcacgaggtcagaagttcaagacgagcctggccaacatggtgaaaccctgtctctactaaaaatacaaaaattagctgggcatggtggtgcatgcctgtaatcccagctactggggaggctgaggcaggagaatggctctaacttgggaggcagaggttgcagtgagccgagatcaagccattgcactccagccttgtgacagagcgagactccgtctcaaaaaaaaaaaaaaaaaaaagtcttcctgccttcaacttgttttaaaacaggcaataatcattgaccattttttggccaaccatatccagctcctaaacgcctactggcataatgacaatattatcacagctatcatttattgagcatctactatgagtcaggtcctttatatacatttaatctgtacatttgcttatctccatttcttaggggtagaaactccatcacacagttactacgtcacagacatggatcttcacccaggtctgtctgatgccacagccctctccctatactagtggcttccctgttaccttcatggaccctccaaggttgggagtatgtagttctgtacctttgtctaggtgtgagaagtctttccctcacctgcgcccacactgctagccagaggaaagttgtgtgtggtcagggatatggtagaaagagggaggcctccaagacctgagttattgccccagatctgccacttcctgtctacctaactttgaacgattcctactacacaggctggaaataaaaatatgacccttgtcagagaatgttgtttaaattgtcaagtgcaatgaaaagaggaagaattaatcagatatttcatttgaaacattggtttctacttcctttcccgttgcaaatcttactgcagcggctaaagcaagtgaaactgcaggggtgtaaggtaggcaaacagcactggacacatactcagccacctccgttccaaccctcctcatccacagacacacaccatggacccgggggatatacaactcctatggcctcaacttcctgtcctccataggacagagttgggctaaagacttcataagccccttccatctctaatattccacagctgatttgaaattcacttcctcctcctgtatctgcttacccaagagaccagtggttttcaacattggctgcatattagaagtagctgggggagctttttaaaaataccaatgcctgggccgggcgcagtggctcacgcctgtaatcccagcactttgaaagtccgagacaggtggatcacctgaggtcaggagttcagtaccagcctggccaacatggtgaaaccccgtttctactaaaaatacaaaaattagccaggcatagtggcgcacctctgtagtcccagctactcaggatgctgaggcaggataattgcttgaacccgggaggcagaggttgcagtgagccaagatagcgccatcgcactccagcctgggtgatggagcaagactgtctcaaaaataaataaataataaaataaaaatactaatgcctgaattctaatctttgagagtccgctgtaacaataaagccaccaatatggttttgtggattgtgtttattttttgagacagggtttcattctgtcacccaggctggagtgcagtgtgtgaacacagctcactgcagccttggcctcccagactcaggccatcctcccatctcaaccttccaagtagctgggactccaggcacacaccaccatgcctggcttatttttgtatttttggtagagacgggggtttcccatgttggccagcctggtctcgaactcctgggcttaagccatccacccgccgtggcctcccaaaatgctgggattacaggcgtgagccactgcacacagcttaatatggttttaatgtacagccagagttggaatccccactctagagagaaaaaaatgtgaagaagcagttgaaatgaagaaccaatgaggtctctttctcgtgagcacagaaccgtatctgtcttcaacacacatttctctgtgtcccacccagaacagccaggagtcctccagagaagagaggagagactccccactcccagatgaagtgctccgtccatgccgtgatgctcaccatggacagccgcagaccaaaaccacctccaagcagctccatgctcttatttccttctcaccacagagaactgggctaatcaaagtataacagcagaaatcattttacccatctcttctttaaaagcctttcaaaaaattgctgaatgtcactttttcaagtttgatgtgctagcagggatgggctcagttggggaccctcaaggagcgtattcccatgagaaaaacctcaggatgtgcagacattgccttccagttggttgtctagagaactttgccctaaggatgagcatccatttagacacttgaagcagctgcagtcaggctcaaaagcaaacttaacccagcttaaacttactgaaaggaggaattattcaggactgaagccctaccaggccccatggtaacccttgcacctgagcggtgttctgtggttgtttgcagagagtcactcgtgtttgatgacttccacacctcttgggtccgtgtgaccctccccctataatcagcttcaggaggcatttaggagattatcctcctgcctctccagctgccctatacacccctgcacagaaagcatttcacaagttgttcccattcaactctgttccatcataatccacttttccctttttgttaatggtaaactgtaataatggaccacatgtgtagagaaggagctgccaggagaatctccaagctggtacccttgattattgctgaggggagggatgatgggtgattagcatttcctcctctggtttatttgtatcttataattgtttaaaaatgaacatgtactctaatggtaagaataaagtttttctatttctataaggggcatctcaatgccttgtatttgtgcagtatgctgttggtcttcaagagggtccaaatgtcccacttacttgattggaattcattcttgaaagatctgggttatggagcagtgggagtggtcaattgcacttaaccatcacctaaattcacatatgtaatgaattccaaatttgaacatctgaactttcaaatggcatcattttttctctttgcacatttggtcgatagatgaaagaattgatttactagcaaatccatccaaaaaacctgaatgttttcgaaggactgtgaatgagaggcatggggagcagttcacaagtcttggcatctgggcacgttggcccatctccctagtggggtagtttgttttgctggtgttgctgagaaggaaagtcccccagagcactggaggaggcgtaagggagggtgtgtggaatgcaccagggccaggtaggatcacctgataaaatgccaaactttacatgggacatacttatacttcagaaaataataattcattgtttatctgaaattcaagttcaactgggcaacttgaaatttcatttgctaaatttggcaacactaggcctgggtgatcctcttccctgccacccacattcccccggttattgccaaactaatgccacaaggatagcactatctctctttcccatttgttcctccctgaccctgccaagacctctgccccactgtcataaggccacctacctttttcacatctgggacattatgagttttcttcgtgtgagcagcccaacccactatcccaatgtccaatggaaacacaacttctttgtcagggcccaccaggttgtcctcaaacttggaggtgggggtgacatccagcaacctagaggccacctcaggtatgccgttccgggaccggcacaggaacatgctgcagcggtcagcctggagcaggtgggccagcctctgcagggccctgtgaaccccctgctctggggtgcccccctcctcctgcacggtccacagcagctccaagcacagggctgactcctccacctgggtcagctcagagaaggacatgctggactggactggcacctggctgttcttgaagatttctcccagcacctccacccgcaacttcctgtcaaagtactccttggcaaactgagggttctcctccaggtatttctccacggcaacttggttgatctcacccatggtgtggcttgctttgctgcgtttgttcagaaaggacgaccttcagagcactacctgaggcagagtgatgagaaggaaattcatcctggtggaaattactgaggaaaccgtaaatggtccctcataggacttccaaaggtcaagcagaaagcagagctttcaaactgcctgtaactcttgggatgtgacagaaggccctggcttagggtgggattcaggaagcacaggattaaagagttcttcaggacactaaatccctgagcattagtagctcataagtccctagcgaatcttcagagtatcttagatcagcccagcaagtagcaagctgaggtgtctattccagaaaaataactgaatgtcggctgctgtccacagcaaggaagaatcactgacatatccatgaatgacacgacattggcaacaattggcactttgaatcgttcttgtatgatagctataggaagtaaaactatttagacctcggaagtgcttggattttttttgtttatatagcaactgtaatgaacatctgggagatatggaacagtttgcatcactgcaacataaaggtgaatattaatctttccttttcttaaaagtcttttgatcaccaaggttgcttggcctcctctttctctagaaccttcacctctcaatccctgtcacttcagaaagcttgacctcagaagtgttttaaaggagtaaacctcaagcttattactaaagaggtgaacatagcaaaatatttgccaatgatccaaacctaatcaagtcatgaattgaataataacccttgtcgagagactgtaattacaaaaggtaacctacatagttgctggctgggtttttctgctaagtatcttagttaggattttgttttcaatagtaatagccagaggtcatgcgattttgctacaacatacagtctactaaatctactagatgatagatatcttgtctgttgctaggatccttaacgtctcaggggctactggcatagaaagaacacttaccactacttagttttgtttaatgttcactttactaagcttttacatctattaaacacatttcctcaaatatttaaacactattatgcaactaataattcaaactattaattcatgaaccaattgccttcgatacttaaatgttggtttcaaacttagtcaaggtgttttaaacacttcaataaagctacaaacctaatatgacaaattctcttaagtggaaaacacacacatgttacagtgactctaaaaattattgttacacccacatttaagtttgcttcaaaaatagaaaccctatgagtttcattgagttctctaagatttacctctctagatagtaatctttttctttttttttttttttttttttgagactgagtctcgctctattgccaggctggagtgcagtggtgcgatctcagctcactgcaacctccgtctcctaggttcaagtgattctcctgcctcagcctcccgagtagctgggactacaggtgggtgccaccacgcccagctaatttttgtatttttggtagagatggggtttcaccatgttggccaggctagtcttgaactcccaacctcaggtgatccacctgtgtcagcctgagagatagtaatcttaatagtcacaaaagaaagagagatccgttgaggttgcacattccctgtcatgaattgagagattcttggtgggaaacatggttttcccaggggtacagaaagagtcatttgttgagttatgccacttcttgtgattgagcttcacctgctacctcaaagcaccttgtcaggtgcacatattttcttggactgtcctatgtcacactcaactctactctcaggaggttcctctttgggtgactatttacttcataacaccctgttattataaataggataatgcagaagtgtatttcccaggagagagttgagtcaactgagtcacccctcctatgggaccatcttccttatctaacaattttggacactcttttttacctagttattttgtgtgactcatggtacagttcctacttctcctgtaagtatgtggtgtgctcacgatttcctggtttcatccttccctcttgaaacagagagggaaaaacacatatttgcatttcatatacagacttatacttaatagaaaaagaaaaaacaaaatgcccatatatgttcaactttcataatctttttttttttttttttgagacagagtcttgctctattgcccaggctagagtgcagtggtgcgatctcggctcactgcaacctctgcctcctgggttcatgccattctcctgcctcagcctcccgagtagctgggactacaggctcctgccaccatgcccggctaattttttgtatttttagtagagacggggtttcactgtgttagccaggatgatcttgatctcctgacctcgtgatccacccgcctcggcctcccaaagtgctgggattacaggtatgagccaccgtgcccggcccatctttcataatcttataaaagtgaatattaatttgaaaaagaaacatcctattatagtcagcattcttttgtttttataactagttagagattcattcatttgttcattctttctttcttttttgtttttttgagatggagtctccctctattgcccaggcgcgatcttggcttactgcaacctccgcctcccgggttcaagcgaatctcttgcctcagcctccggagtagctgggattacaggtgcatgccaccatacctggctaatttttttgtatttttagtagagacaaggtttcaccatgttggccaggctggtctcgaactctttaggtaatctgccctccttggcctcccaaagtgctgggattacaggtgtgagccacttcacctggcctcatttgttcattctttcaacatttgtctattgattgtctgttacaagcaaggcaccattctagctattgtgatagagacttcaagttccccttatattatatgattgtttccttctcccagttacatgggaagattactcttcctccctctggtacagccatgtgactgattttaacaaatggtttgtgggcagaaatatcactttcagacaggaacaattaattgccaacgggaggctctccaggtctctgttccctctgctgccacatcagtttcagatgaaagggcccctgaatcccagagtgaggatgtcatgtaacagaggcccctggatgacccgagatggacatgtagcatgatgagaaataaacttgtcttgttttcagcctcggagacctgagggttgttgttactgcagcatcaccaagacaattctgacagttacacttctactgtcggggactcagggggtggtcccagcattacaagcacttgtggtgtgggaagggaggtaagactagtgcgtaaaaagcccatgagacatagaacagaatacaattaatgctggaagtgaggcacatgtacatggctatcggagttcacgaaagggatcatatctagtgtggctgaagacagggtagaaatcaagagtgttcagaagcaatagcatggggtgtagggtaatacagggaggacagtgagaggtgaccctgaaaaggtgggccgggcccagattagaagggcttcaaagcctagactgaggattttgaatcctggacaatttttgaagtgggaggcaacattattagtgttcttctttacaaacttaaggaggaagataagttggaggaaaacagaatactggacattgggatacagattaagatactttattgcatttggcttattatcaaacaacctaaaaatgtgtataggctttgaccccacaattctgcttttatgaattcatcttagagaaataattaagaatgtatgtgattaatatagttgcaagggtgcttaccatgagtgtgggtataaaagtaaaagatcagaaatagcctagacacttaatagtaggaggttgagtaaataaatggtattagatctgtaaaatagaaagctacgcagctattaggttggtacaaaaataatagcgattttccccattacttttagtggcaaaaaccgcaattacttttgtaccaacctaataatattgttaaagtctattgacatgaaaaaatatttatgatatgcagttaattacaaacagtattgcagcataattccattaatatgcacagacagaggtatatataccaaaatattaagtgaaattatttcaaggcaggacacagtggctcatgcctataatcccagcactttgggaggccgagacaggcaaattacttgaactcaggagtctgacagcagcctaggcaacatggtgaaaccccgccctacaaaaaattacaaaaattagctgggcttggtggcacatgcctgtagtctcagctgagactgggactgagatggggggatggcttgagatcaggaggtagaggctgcagggagctgtgatcgcaccaccgcactccaacctgggcgactgaacaagaacctatctcagaaaaaaaaagttatttcaaagtggtgggattcaagacattaatttttttcttcttttttgcttacctgatttttgtaaagcatctacaatgaacatatatactttatgtaataaagaaattaagtcattcataaacaaagattttgaggttatctctgcagtctatgggtgaagttgcttgggaatgaaaaagaaaaggacaaatgtgagacacaatccagcaaatgtgtcatgacaattgacaggacgaggcaattgattagttagaaaaagcacacaagagaaggggtcactgttaactactttgagtgttgagcgaagttatggactgaacgtttgtattcccctaaaactcatctgttgaaatcctaacctctaatgtgatggtattagacggtatggccttcaggatgtgactaggtcatgaggatggaaccctcacaagtggtattagtgcccttattaaagggcccccagagagctctccagccctctttcttccatgtgaggataccaggagaagatggctgtctgtgacctggaagaggaagatggccatcactgaacctgaccatgctggcaccctgacctcagacctccagcttccagaactatgagccactccttctatgacactttgttatagccacctgaactaagacaaatgacattttatcaaagatttttaaatgggtaatattagaagcctccttttagcacacacaccaatagccttttctttctttcttgttcttgatgaagtcctgtgatttccatagctcttcctcttgggatagttctttgcagagcttcttgccagtgttagcaagatctttgtgtctcttattggctgtctgctactaggcactgaaaaaaacaaaatcaatttcagaaaataacatattttattttttaaaatgtctgattcaggtggtacacgtgtaggtttttatatgggtatattgcatgatgctgaggtttgagcttcagttgaacccatcacccagatagggagcatagtactcaatacgtagtttttcaaccctttcctttgtccttgtggaggccccagtgcctattgttcccatcattgtgtccatgtatactcaatgtttagctctcacttataagtaagaacatgtggtatttggttttctgttcctgcattaattcacttaggataatggcctccagctgcatccatgttgctgcataggacatgattttgttttttgtatggctgcatagtattccattggtgcatatgtaccacattttctttacccagttcaccgctgatgggcacctgggttgattccatgtctttgctattgtgaatagtgctgtgataaacttgtgagtgcaggtgtcttttaggtagcatgatctattttcttttgggtttctactggatagacacccagtaatgggattgctgggtcaaatgggagttctattgttagttctttgagaaatctcaacactgttttccggagggactgaaccaatttacaatcccaccaacagcatatgagtgttcctttttctccacaaccttaccaacatctgctattttttgactttttaataacagccatactgtctggtgcgaaaggttttgatttgcatttctctaatgattagtgatgttgaacattttttcatatgtttgttggctgcttgtatgtcttcttttgagaaatacctgtccctgtcctttgcccactttttaatggggtaatttgttttcttcttgttgatttgttttttatagattctagatattagtcctttgtcagatgcatagtttgctaatattttctcccatttcgtagagtgtctgtttactctgttgatagtgtcttttgctgtgcagaagctctttagtttaattaggtcccacgtgtcaatttttgtttttgtcgtgttttcttttgaggacttagtcataaattctttgcctaggctgatgttcagaagagtgtttcctaggttttcttctaggatttttatagtttgaagtcttacatttaagtctttaatccatcttgagtcagtttttgtagctggtgagaggtaggggtcaagtttcattcttctgcatatatttagccaattttcccagcaccatttattaaataggatggaaaatgacatatcttaaaatttaaacttaccaaacagatcacttagaataaatttttaacatgacaaaatgttgacttcactgtttaatttttacctcagtgcttctgtttcattcaaagcatagatttgttgtttgttttttttggatagaatattaactgatggagaaaatgaaggaaaaagtcaaaatcttaggtgctaatattttttaatgacaaatttatttagataaactctgaaatgataactaagtcaatgtgaaaactccactgcatttacatagaatttttttaagaaatgtaaaccacctggtaataataaaaggataataagaatagataacatacaaaatatatactctgtgacaggtaccctcctaagatccttacatatattatcttatttaatttttggggcgtttttttgagacaaagtttcactcttgttgcccaggctggagtgcaatggcatgatctccgctcaccacaacctccacctcccgggttcaagtgattctcctgcctcagcctcccaagtagctgggattacaggcatgcgccaccatgcccagctaattttgtatttttagtagagacggggtttctccatgttggtcaggctggtcttgaactaccgacctcaggtgatcctcccacctcagcctcccaaagtgctgggattacaggagtgagccaccgtgactggcctatctcatttaatttttacaatcttataaggtaggtaccattatcattttacaggtgagaaactgaggcacacagaaattaagttagcttgcccaaggtcatagccagcaagtgatagtaacctactctaaaactaccagtttaaatatggctcaattaaaaaatgtgcacatgaggtgaactagacttcgtacttgatgctagagggagatatacaaagactctttctttgaagattttgaaatctagacaaatatcataaaatgttaaatactaatacaagagtgaaataaaaattccagacaatctttttaaaaatccacaaagaatgatttaacttccttaaactttctgcttaaacaagttttcagtagtactctacataaatgagcacgcgtaatttctaattccatcattgttaaatttttttgctgcagttaatgacttctacaggaagttatgcttatacaatagccaaaacatatgcctacgaggtagaagcaccaacacagaaatcaacaatatcctgggctaattaagtgtatttcacattattatactgaacccactcttcagttccaccttagccagattatctgttcctataattacccatcatggaaaggaccccctgtaggtaggaatttcaggcacatctggcagccaactgcacaggacccttccatctgcacatttgctctcatgaaagccctgtgcctgcacttaattgggggtataaccaggtatctcagagacaatttggttggtgaaaaccatattatttttatccaaattgatgtgatggtctgatgactgcaaccactgagaacaccgtattgaaaaaattaatttatctctttgtacctgaaaacatggactgactaacctttccatttttcaaccaattattttgacatcttttaaatgcagtcagaagataaatgctgctccacttccttgtttttcatttttcttggcctcggtccagatgtgggtataaatgttactttgtataaaatggagctggttgctagtgcttaattttcatgagggtaaggacacaaatgtcttgcattagttctgtgagttatggtaaaacccttttcagtcttttttaggagttagtgatgtgtttgatgctgtgaaggttaaggtaacagcaacttctgttacaggtaacctctcaaatctcagtagcttcatccagtggaagctcatctctcattcacataaagtcagtcaccagtggggaccctggcagataagagaagaaaagagaggatgtgaacaattgaacgggcagcttttctgagctctgcctgggagtgacacagccccttccgctggccagaaggctcgtggccttacagagcttcgggaagtggggacggggaaggcaggggctggcagactggtagtccccaactttacaacatggaaggggactgcaaattttctggtgaaaggccaagtagccacctgtgctacaagtactaaatcctgaggaattatatattagaaagggtgaactctgaacaggtctttaaaaataaatgttttatggagtttgcatagagtgactaatttcagtaaaagaaattatatctattgattaagcacctactatgaacaagtctcttgatatacccagtggaaaagtggggagaatggggacaggtacaaagatgaatgaaagaaacatggtctgtctctccatgaagcatggcaaggaaatgaatgaaattttgtgtacattatatacgatctataagatgtaatttaaaacataattttacctacaggaaaaggagcaagaaaaatatttgtaaaggaaatatttgctttattttctgattcacgttttcatcatagaaaattttaaaaatacaaaaaggcgcaaagaaaaaatctttcagcgtccctaatcctatctcacagagatattcactatgaacatttttccttttgactttacatatacacatatttgaaaagttaatgtatgaggattttttccaaagtactgaagttaagaacatcagttgacctgaattaacttatttgtaatcatgaagaaatcctagaaagaatgccaaagtaaactgttttcctctgctggtatctggagcactaaggtccatgatttatcattaaaagaggaggggcagaggaatggttacaccaactttcttttttcttttttcacctcaaatttttactctgaaacaacctttaaacacccaacaaataaatgaaaacttgttgctgcatcaaaaccatcatcgaaatgaactgaaatacccttcattattcaacctacagtgtgtgcaagggccaccagaatgtgttctaggagaaatggctgcaaggccagggggtattaggagaacgtttctggcaggaataactgtccaaaggcaactgggctaagctaggagctctctatcactaaagaacctggagcaaaaactggaagacctctcctctggaatgccgaagaggggatccaagtattgggcaggagatagagaggtgccctaaaatcctttcccacccagggtgcatagatatataccccatagggtcctgcaggagacgatctgaagcagaacttatttgagctgtttgggattacacagtcttctataaaactggcccaatcagaagatttcctagtcagcttgttgtccagaaacaggctttcctagctctgcggcggttaggagttaaatgcatcaccgttggctccccagacactgctgggactcaaatgggtgcaagagtgaaggggaaggtgggaaaaagatggagaagcaggggggaaggaagccacagatgtcatcttttcaggatgctcagaattagccctaatgccctatagataaaggattggtctgagaaccaatcaactccttatttctgtttggcagccaccttcctcttccccgatctcctcttatttcaggtcgggctgcagcaaaatggcccaaattgatctcgaatctttccaatttaggccatggagacacaatcgatattgtatggaaagaatctcaagaagagatacttctttgccacatcatgaattctcattccgtcattctcatcctttgattggctgctttgatcaaacgagtggaactctaacttcgaacagaaagagaaaaacagggtcagtaaattgtgccatcacacaggaaaatacctaaactagtcacactgttttgattcaattggctactgaagttatagaatgttgtttactcttctctcctttgtctactccccagccaacaaaacaaccgaccttagctgttttgaaaataaatgaaaattccaacatgggtttgaaataaaattgcatcataaacaatcggtaggtgtttttcaaagtggtttcagggaagtgccacggagtaagcaggcgaccaccgaggctgctaaaatatttcctgtcctgaccagggttgcgtttctggagaatatttaacagggagggttttaacgcttttaaagatgttgaaactaaagaacaaatattgaccagagggcaccacaacgctcctgaaagagagtaaaatacatcctttataaaatgaaaaactacttggatgaattattccaaaattcctgcacaagtggacctcagaaggcagacggaggcgccaatttggcatggccagggcctgggcactcacgcaccagggagcctcgcgggtccgctctcgctctgtgaggccacggtcttcccgccaggttgactcgagcctcctgccagagccactggccccggaggccaccctagaccgcagctggcggccgctggcacgagtgcagggtaactgagccagggccgctggcgcatttggcctggccgaggccaccccgcgcggccgctccactgtgcccgaggctgtcctggaggtgaggccggcccacagggaccctgcccgtgcccgggctccggtgagtcagggcgcgttatgcaagtgcccccggcgcctccccttcggtctttcaccccgcgcggttacgaaagcgcgaccccctccccccggcgctataaagcagcggggcggccgcggcgcgctcgcctccctcgctccacgcgcgcccggactcggcggccaggcttgcgcgcggttcccctcccggtggtgagtcgcggccggggcctcggggccggcggcgggatgggccggggtggggtggggtggggtgaggtgggatacggcggcgggggtcggctgccgggcactgacggaggcgcgtctcccgcagggcggattcctgggcaagatgaagtgggtgtgggcgctcttgctgttggcggcgctgggcagcggccgcgcggagcgcgactgccgagtgagcagcttccgagtcaaggagaacttcgacaaggctcgcgtaggtatcggcccagggggcccaggcggcccaggtccccaccccatccccgccctccccgcggcccgccgtgcgcccccggacgccaaacccctgctgtcatccttctcacagttctctgggacctggtacgccatggccaagaaggaccccgagggcctctttctgcaggacaacatcgtcgcggagttctccgtggacgagaccggccagatgagcgccacagccaagggccgagtccgtcttttgaagtcagtggccgccggggcagctgcgccctttgcgctccagggttccccaagggccctgcctgctgatcgccacgtgggcattgtgaagggaagggagcaccgaatgggtggagggagggaggaagccctttgcccggcttggctgaggatccccttggcttttgcagtaactgggacgtgtgcgcagacatggtgggcaccttcacagacaccgaggaccctgccaagttcaagatgaagtactggggcgtagcctcctttctccagaaaggaagtgagtagtcagctctgtgggactgtcttgggaatggggcgcctaccgggccaaatcgctgggtttcttctccagaggtacctacccttaggaagaatggcctgcggaaaggtctggaagtgtcaggaacccgcagcaccacctgaggttaggggaacaagattgggagcagctacctaccccctccccaaacctcagctcaagaaacctggcctaagctcaaaaggacctttcggtttgtcaggtgtcattttccccaccagccactgtgccaaggtgtgtgctttctccatgctttctcctcctgtctttcacatcaccactccacctagctctgcatttcctccgtctctttgggctgaatccctgagacagcttgactatctggggctcccacagaggccgagagagccctatccaaggacggagggaacactgtgcataggggtggatgcctcccaagtgcctggcctgctgatgctgagattctgagccaggcacagtgtgctgtggctgtggcctcttccctttccactaagctgtgaaaatcagatgtggaggggagtgatgttgaggacttgtagaagaacatcctaaaatttggcctaatcatgagaaaacagtgtctacatgctctttttcccatttttttccccatttatcctaagtttcaaatcaggaatctacttggtagctagagaataatgcaggccaggggacacatatcatggaatcttagagagggagagttaaccttttggagggggttcaatatgtagatgaataaactgaggccaagagaactttgcccaaggacatgcaacaagtttgttagagccaatgtcagaagccaggcttccaaatctcaggccaggatcaggtggccctgaactgcagggactcctaatccagaccagcttttgcaaagtattgtttgagctcttctgtgagataggaccaagggttgttcagggagactctctctgctcggtgatccagggtagaagtgtcctttattgtaaccctttgctctccatatatggcacaccaccctcttggacttcctctaaagttgtgtgttggatgaaattgcatttttaaattttatttaatttttaattttaatttattattattttttttttagagacagggtctcactgtcacccaggctggagtgcagtggcgccatcatggctcactgcagcctcaacctcctgggctcaagccatcctaccacctcagcctcctgagtagctggaactacaggcatgggccagcatgcctggctaatttttgtattttttgtggagtcagggtctccccagcttgcccaagctggtcttgatctcctgggctcaagccatcctcccatctcggccttccaaagtgctgggattacaagtatgagccaccatacctggtagagaaaaagcttagaagctttatttttatttattatccttggaaataataaaaattatttcaaatagtgcagcaaaacatcccaaagtgatttatttagagtaaaatatacttttctgataatggattacaaaaatcaataccagaggtacaagattattaatttttagaaagaggaaacacatatgttctatagcattttgagatgtgctccttaatggactaggattctgttggcaatgcctttaggcacagggtcagagaggacccaatgagaagggagcattttgtttcttgcctcctccccctatcaaaccagattagtttgcttttgtctcttgtatattggtattttatcaggatttcatttggagggcgaaaaagtactgccatcttgaaagtgattgctatagatattaagtgagatgactataatatggaaggcttaaggataaattccttcttaggttacatttcaaaaaagaagctgtgcagtgttgtagttaagcccgcccggttaaaattagacctcctaagttcaaatcccaactccaccactacttgtggaactttagatatgttccttcacttctctgtgcctatttcgtcatctgcaaagtgaaacgatcatagaacctacctcatagagttgtgttacaagatgcaatgagtcaacaggcagaaagcactcagaacagtgcctgagacatgagttctttgtaagtgtttgatatgatggctgcttagttatctccctggtcgtgaaatcatagctttagattctgggtctagaatgggaggacccatggagaccactgggttcaagtctcttgttttagaagtgaagaaactggggcccatagagaagtgactggcctaggggcacagggtgaatttttggcacttagtgacacctcttaacccatggcttgtaaaaaggcacaaacaatgcctttgttttctgagtatctcgcaaatggcatggcttgatgcacctaccttgttctgttttacatgcttgttttggggtcatcttaacaaactctactttcattcctcgtgccagtttcttccctgaccatggtcttgctttaaacactgacttggacagagggatttgaaggccactccaagagtgggctgcatcctcagcctctcccctgctccacacactgcatctcaccaaacggatgtgtttaaaatgaggtgcgcttatggagagaaagtaactcagggccaagcgatcatgaaatttgttgtcgaattattttaaaattaaatgtgatcaatctctacagttgaatgtcagtgttaacagactgatgtggcttgctgctccagccttgggcatgctccatactggtcttcccttctggctccaccagcagcaagcaggatgtctcaggggttgaggatactaccatcagcaggtcttggttgaatacaggctagcctccctgagatttgacttccttcactatgaaatggggataaagaatagtttctatttcatagaatcattggaaggactaattaaggtaatttgtgaaaatgcttagcctagtgcatagtaagtgctcaataaatattagttatatcatcattgttttgtgctcttgtagaaagacctggacaaagactctccttgtgtccttctgtcagatgaagtctgtcactctgctagtaaaggggcccttgtcagactgaataacaatgcaagcctgaatgtttacattagtgttggtcaaagtcagggttcctgctccatctatatctaaatacactagggtgcttgttaacaaatgcacatttctggactcaaacccagaattatggagtcagaaattctaagggcacggccctggaatctgcattttaagtatgctccttgggtatgctgtttctgcacaatgaagtttgagaaccactggtctagataattcaatctgaagagcttggcttactcaggtatcaaggcctcagactccactcacttttctggggcctgttggggtattttgacaatgcatcagaaatagcattgaatctgttgcctggctggctcagctggactgttaggcctgagaaccacagggagcttcccacctggtcttgctgctttagatgattggagcatgcaggtttagggagctgaaaggacacatgccaggcccacagcagtgagcaacagaacagaccaatggaaccaggttgcctgagacagcgccctctaccaagcattttctttggttttgggactggcagtccaaaccgctaaaccagtctgtgtaggtacagtatacacacagctgcagcatgaccccacttcctaggatggtagaggggaggcaggggctcccagccacacagccactgcctccaacgctctctgtccctagctccactgcatgcggttagctggagtctggaaatggctgggggtgtctggttctccagaggagccctgcccagctgccgggtgtgaggaggttagagaaccaacctcattctcgcagtgctctggcagttcatctcttgcaaatactcttaaaagggagagcctggtcaaggtcactatgatttaaattcctcgtctttgaattattcagccaaaagagcctggagattaaccaaaccaacttaggccttcttttaaagtcaagaacagtagccaattttactaaatccaagtattgaaagttacttaattcctctgtcaaaatttaaatgatggcgaccattttggaggaaaaaaaaaaaaaaaaagttaagctgccgatcggccaagctaatagctgcctggatcatgagtcgaggtaacatttcaaaggcaagtgtttttgtgtctgagggtgcctgtgacagacactgtgatcctcgtaaccagggaaagaatgacttcatccaaggatgaggaagaccacccagatactctggagcctgtgaggggagtcagtggttagggtgaggcccagcaggcagccctgtggcttctgttcccagcctttctgctgaataactttatggttcctgctgagcagtcatggttctggaacatctcctcagccccacctctgacactgttaccctggaacagcctcaaggcacaggagtggctcattctcctggcaggcctagggtgagttgaagagaggggctccacacccactcctgtgacagcccccctgcagagcctgggtttgggctgaaccccatcctaggctggcactccaggggttctcagagaggcacacccagaggcaacttaggaccagcattccaggtggccttacaccctctaacgctgggggatccagttccctctgcgcttctccaactggaacactgcagagggagcatcaccccttgctccaacacctgagcctgagatggagacacaaagcctttttgtttcttgcccctctcccgtcagtgtactgattgtctggagacagtgtggtgtagaggtgaagcatgtgggctctgggatcacactcccttgcttgaatcccagttctgccctgctctttgtgaccctaggtgaattattaagtatctctgtgcctcagtttcctcacctgtaaagtagaggatgatagtgtgcagttttggatcaatgtgagaggtaaccgagaaaacaaatgggagtgtccatacagtgactggcacataattaagtgctcagaaagtcccaatcatggtattgtgtcaacaagaaggttaaattaagtagagatgtggcacttttatctcaatacagggtgacactgttctttctctgtggcaaatcgctcacatacattctttttttctttcttttttatttttttaagacagaatctcactctcactcaggctggagtacagtggtgcaaacctagctcattgtagccttgacctcctgggctcaaaacgatcctgccgcctcagccgcaagtagtggagaccacagacgcatgtcaccccacctggctaattattttcatttttcatagataccaggtctcactatgttgcccaggttggtctcaaactcctggcctcaagttaccctcccacctcagcctcccaaagtgctgggattacaagcacgagccatggtgcccggccacacatatactctaattaacattctttcctctcctgccttcgttgatatttttaccactttcatttactcttattcttcatggcttacatttcagccttgaggaatacatataatctaaattcagtggctcagctctgcctctgtgagttgtgaagaggacaaggtctgagaaggaatatctgatgccagatggtgggcctcttgtgtcctcaaggcaaaacctactctttgccggcacaaagaagtgagtagcattaataagcagaattaggatggagccagagaagccgtgaccatgggcgtggcatcctccagaggactgagagagcggggggcagcccggtcagtgagttgattaggaaccagcgatagagatcgagaaagacataagccaatattgggggtaacataagttggtggccatcagatattagccacaaaagacacagatattattggagagtagatggtgaagcgacagtagaacggtttattctgtggttttgatgagcccacattcttggtggttctttggaaagatgctgtcacattatgctgacataatcacagggacagatgatgattgaagtgaatgagatttccctgactccaagatttttttcaataaaggagaacaagatcctttctgatttgccaaattttataaaagttgtcagaattctctgaagtgtcctgcttcctaaagaaataaaaccagcttctggaagtcactgtgttctcaggcctggtcgtgagtttctccgacatctgagcccatgagggaaaggcattgatcggcatggtggctttctggcttgcagatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggtgagtcaggagcagggtgccttctggctcttcctgcagggcagtgggtttggactaaggggcccacgtgctagtgaaattcattttgtccgtaccccagagaaaacaggggttcttgggagcccctttctgaggccaaatccagatcctgcttggccagatttttcactggccttctcatagggctcatgcaggtgtgggtaaaggcctttgtccagttcactggcactaacactgccgtgggctctcttttctttttattctgcttcctcgggccatttctgtggtcacccctggctacactgccccaaaaaaccattgtgactgaattaagattgtttgggattgagcagcccagtaaagaggtgggcagttcatgtggccattgacgtaaaaactccacagggggcatcaatgtagtaagctccaaagagaatgatttcaacgcaccttcttttttctatatgaaaccaaatagccatgacattgtctagctgggtttcctcagttgggggttttgagattctctggaacaaccataggatcttttaggagatattacccttgtctgatcttgattttaaagccaggaacattgtgcaggaaagagctccatttagtttgagtggacactcactcattgctatgggatactgggtttcaaaatccaaatacagtaatgctaaaatgtagagaaacaaaatgggccaggcatggtggctcacacctgaaatcccagcacttttggaggccgaggtgggctgatcacatgaggtcaggagttcaagattggcctggccaacatggcaaaaccccatctctactaaaaatacaaaaattagccaggcgtggtggcatgcgcctgtaatcccagctgctcacgaggttgaggcaggagaattacttgagcccgggaggcggaggctgcagtgagttgaggttgcaccactgcattccagcctgggcaacagagcaagattctgcctcaaaaaaataataataataataatcaaacaaaatggagcatttctgttggtcacgaactgacccactacaccaaacagatgggaacttagaccaaaatcaaattgattttgaagcttcacccttcaaaattaaatgtagggccagcaaggattccaccacagcagggcaccgtaggaagcagattatgcacattgtacagatgagaaaacagaggctgacaatgaggaagaaagttgccctaaatctttaataggtagctgagttggatgcaaacctagagttttgtgactctgaagtcccttgtgccacaccatctggtgacacatgacatgagacatagaagcactttataaaaccatcaccagtgtgtcccaggtcaggctgccttggctcccacttcctgaaagctgagggtggcctccgacactttgaaatgcaataaggcagacttaagagaaatcaaaggaagccctgttcatccagcaagtcatattctctccacccccattacgtccagagaaaattcagtgggtttcagaaacagccttgaaggtgtttatgaattacagccacctgtatccgtaagggttgcaatctgctgtgatgcatttgaattaagaagcatttgaatgaagccagctctaaggccatcatgatgttcattatctacataaaaactgggtccactttctgtcgttaatggctttgttttgtattttccaggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgattttagttttcatttgtgtttatgtctgtgctgcagacggatgggtggggtgcgcttctttataccaggagcacgtggctctttctgacctttggcctgttctagtgcctaatctccattattaaatactggcttctcccaacttcctgaaaaggaagtttcctctttaacttagggaagccttacctaccagcctggccaaagcactggtgccaaaagaggaagtgagtagacaggtcagtccagtgagcccaagtcctcagtcagccctaggcctgtgagtgaggtgggcgggctggcagctcaccagtgctggatttgagaggctgagccacaggggacaaagtgagctctaggaaacactccttagccctttattgtctctagcatgcagctcacctctttcaggtgtaggcaaaatgttgatggggaggagggaggcctctggggaaattcgaagatggggctctggaatctcattctataggaaagatcagagcaccccctacccggaatgcagggaggggctgggtagggggtgagttgcaggggctgggacagagcaccagcatcctgcatcattagcagcacgtgggaaccctagtgtatgggtgcaaggccacttgcctcagttttccaggcgttcccaggggcctccatttctcatcttgaaaaaagcagcaaggctttggtaccagagggtcttggtgtaagtgcaaatctgcttcagatatatattagctgtggatttggggctggttacaaggcttatctgagcctcactcttttcttgggagataagggaaaatagtccttgcctgatgggctgcagtgaggattcaattaggcaatgtcccttagagctctggggagctgtgaaaccggtgatgccaggctgatgtctatgaaatgcactgggagtgaggaaagggtcacagatctccgcctgggtgttggaatatccagggaccgtgggaggctcccgggggccccatgctagtgttctccaccaaagacagaggagacaggtgatgtgcatgggagagctttgccttcctctctcacggaaccacaggctgtcagagccttgctccgcagcttcagtttgacaacctcagagaaccataatgatataggagttaaaaagaaattactcgggcagatagtgagggtatggaagtccttggtaagattttccttttaatgaaaagcagcccctaaatccttttctaacaaaaagcagctgtaaaatcgtgctgcagacatagacaagcaagttggaagcttgcatgggtgaatgccagcagttgtgtccattggaatgtactacctaagactaagcatgttcaaaatggcggctccgtcttctctttttgccagctatgagtgcagtaaggagaagacaagatggccaagtggaaagtccatttgcataatcagatttgggtggggtggccagcctttctcgtgcactacgtaaacgtcacacctggtcaaaccaatctgtgagccctatgtaaatcagacaccacctcctcaagcctgcctataaaatacgctgtggtccaccacttttcccttttcagatgcctctgtctcacgagagagagagctgctctcctctctcctttcttctgcctattaaacattctgttccttaacccacccacatatgtccgtgtccttaatcctcttggcgcaagatgacaaaccccggttatttaccccagacagcaatgccgcttcaataagatagccacacatcacttccaaaaacaggtttaattgatcaaatctattaactaaagtgagcaaaacatctctgttcgtttgtcttcgagcttgtgatatccatgaatctgacttcagaagcaagctgctccagaaactgcataagcagtcactactgctggtgctgatttcctcagcaacaaagatttgttgaacacctactatacaccaggccccgtgctgctgtgcattccagccactggcccagcctccaagtggtggagtgaccctgggttcggtctttggctctggtttctctctatctctccaagggatgtattataaaaccataggtctataaacaccatttatatctccaaacaatgtgcatctccaggcccaagctccacatctctgcatccaactgcctattcaatttggaagtctcactgagatttcaaactgatgagctccaaatgaaactcttggctcccccccccctaatctttgcccaggcccccccatttttgttgcctgcttcaccatccaaccaatgacaggctaaaaaatcagagtattccccttgagttctccctttccctcacattctatcaattccatccttcccatcaataaatcatctttgttttaccttcccaaggtatatttacaagtcatttctcacaatccctccctaatgccactcacctccaaggtcccatccccatgtcacacttcagcagctgcccaactggtctccattttcactcatgctcctcagagtctattccctgcccagcagccagggtaatctttgcacacattcatcaggtcacgtcagcctccagttgccaacctccaggggcttggagaacagaataaactcctaggccctatgtgatctaaccctgcaatttctctggcctcaactgacaggccccagccgggtacccctcatctcagcattaaaggcagtgcctagtgcagaggaggctccatcaatagtcggcttacgccactctcccttcaagcgtgtcagcctccttgcactaacatctcttctgtgtcccttcccccattcacacaggtggccctttcttgtcgcttaccttttgatccaatttgtcactcctcagaaaggtctccttaggcccctccccatctgatctaaattcccatcactaccatagcccccgtcccattttcttcacagtgcttattcgctctgtgatgctatactatttattgacttgtagccaggcgtggcggctcacgcctgtaatcccagctacttgggaggctgaggcgggaggattgcttgagccaaggcatttgaggcttcagggagccgtgattgtgccgttgcactccagcctgggcattggagcaagaccctcatctcaaatatataggtatctgtatatagatatagtttattgacttttatttagtttttctgcccctgactcgaaggtaagttccctgagagagggccatggctgtctggttcaccactgtattcctagcacaaaggacactgtctgccatggctggtgcttaagaggcatctctgctggatgcgtcaggagtaaaccactcctgaactcactctcaaacatttcagagccatcctactttctctctcatttcatgatgccgattctcttaaaagggtccatagcatttttataaatgaaaaaaaaaaaaaagtaagtcatctttaactgttccttagaaattcttcaattgctcttgacatcaacgaatgatcctaaacccttgcgagtccaaggtagggcacagggtggctgtgacccttcagaggagaaatctgcgtcctgaatcggttctaagactcacttcagaaaccactatggtgtggctttatatgtaggagatgtgattgctgaacagtcataaataaatatttattaaatttgatcatattacaaacacactaaaaaagttcacatttaaaaggaacccataacaaatctttttttttttttttttaagatggagtttcactcttgttgccctggttggagtgcaatggcacgatctcggctcactgcaacctctgcctcccaggttcaagagattctcctggttcagcctcccaagtagctaggattacaggtgcccaccaccactcccagctaatttttttttttatttttagtagagacgggggtctcaccatgttggtcaggttggtctcgaactcctgacctcaggtgatccacccacctcagcctcccaaactgctgggattacaggcatgaaccactgcacctggccaacaaatccttttataaagggaaaatattatgaaacttggtgatcaccccttaatttaccgacgctgtggatgtctatttgcataggttcattttcttaaagcagggtgcactgatggagggtactggaaatgaactctgtttaaaagcatgccacagctcgccaggtgtgagaaactcggctataaagaaaaattagccagaaataatcgacaagtcatttcttttgacagatgtgtctgttaaaatggctcccttttctgggaaccagaagcagcaaaaaattttcttccactcattcctgcacagtgtcatgttgtagaggatggggtttagggctgaattagcaaatgtgaaggccaccacccagaagaagagggacggccagatgaccaggtcttgcttgaagttctggatcaggatgaggaggatggtgatgatgatggggctccacatgatgaagaaggagaccatgaggaggaagagggtgcggaagagccggaagtcctgctgggacacgcggatctggtggctctccgagtaggccaggcttaccgtgagcctcttccttgatgcctttgtgatctgtggaaaaccaaaacaggactggagccacaggtgaccgagggttgttggggattttgagttaggggcccaagagttggaatctgctatccccaaggcactgaagctgtgtgcctctgggactttgtgtgcccgagcttaggatgtgctggagaaatgggaccccggctgcactcctgagaaataaagcagaaaatcacctaccttctaaacagcgttatgaggggaagtgaaaagcctgaattgggtggtctacaagagggacatcttccctgttatttttttaaaagagatgtctctttaattgtttgcaagcacaatgtgcttagggttcaaactcaaacaatgctatactgatggggaacaaatgaagaacatctggccttctctaccctctatttccaccctgggaggtgactaacgtgagtattttcccatatggctttctggaaatgcaccactgccacacacaatattcctggcgtgggattgcaggcatctgctcttttacctggtacacagatgggcccacaccacgcaccacactccgggccttgctcctttttcacctagcagtatatcatggtgctcgggccatatctgcacagagaaggcacttcattcttgttatcttctgtaaatggtggttgcaatttatctagcccctattgaggagtattttatttctttggccttgtttggggaggtagcagctgaaatagcagtgtgcatactcttcccctctctccctatattattccgttctcatgctgctataaggacatacccaagactggataatttataaagaaaagaggtttaattgactcatagttctgcggggctggggaggcctcaggaaacttacaatcatggcagaaggggaagaaaatgtttcctttctccacacggtggcaggaaggagaagaatgagaaccaagcgaagggggagacccttataaaaccatcagatttcatgagaacttactattacgagagtagcctgtgggaaaccatccccatgattcaattacctcccaccgggttcctcccgtgacattatgggaactacaattcaagattatggggattatgggaactacaattcaagatgagatttgggtggggacacagccaaaccatatcactcccctacaggttgttgagtgggagatggcataccagtgtggcaggccaggcagaagggagcactggaccccaccctaggttcctttccttttgcaggagcgggagaaaatggatcctagtcttgcctacaggcccctgagtcaggggttaaggaaagatgatgtgatcagaggctgctcatttgctggggcagcttctgtcaggagccaacctgaaaatgaagctgagtgtgggaagggtctgcccatacctggtgggagtgggtgtgggaagggcctgcccatgggttggagtgggtgctgcttgggaatgatcccctcatcaacagggcctgttggcaccatcaccagacacagggaaatcagaggcaatgaccaacagaagggggcaaccacctcatatgggcaatcatgcaagttccttgtccttgtgggagaccagaccactgccagggcagcccatcctccttctctgtcctcctcccagctccagcaccacaaacccacatcctacgccttgggcaggggaagctttgaactgactatgagattgacattgtaaaataatcaaaaaatgactggaaagctctgtaaatcagacataggtgtcattaaaggtgcccctgccccagcaagaaagaggagcttgtcagagcactgctggtgatatttgtggaaaatgaccattttacatttatgtcccctgttgagaggtggcaactgggggaataagcctcctcatgcgtatccttgcacacctaggtgagcatgtcagtagaataaattcctaccagtggagctgctgggacctctaatattttgtattaatgagcagggctggcagtgaagcagaggcatggcaggcaatgaaggcagccctggttatgtgggcttagaaggggattctggactcttctttcaggagatcctacaggtgtcccccaagactcctgaatctcaagagggggagtaatggaaggtaattaacatcattcacagttcaggtaaatttaactgcaagatcagaatggctgaaaatattcccgttagaatacttgtaactaggctgggcgcagtggctcatgcctggaatctcagcgctttgggaggctgaggcgggcagatcgcctgaggtcaggggttcgagacaaccctggcaacatggtgaaaccctgtctctactaaaaatacaaaaaaatgagcagggtatggtggtgggcacctgtaatcccaactactcaggaggctgaggcatgagaatcgcttgatcccaggaggtggaggttgcaatgagccgagattgcgccactgcactctagcctgggtgacacagtgaggccctgtctcaaaaaaaaaaacaaaaacttgtaactagctaattaaaggatagttgtttgttttatgattcaatgtggctgcttgctctgtgcaggagtttaggtccacctgttgatggtggagaccagggcaacagatgctgagtgaacagcctcatagtcatacagatctctagctttactgagggcttccgtgtggccggcactgtgccgcacatttacttctcagtcgtcacatttaatcttcatacctactctagatttgtactatcattgttcccacttcccagatgaggaaattgaatttcaagaaatttaagaaacttgttgaaggtcactccactgataatacagggtcagagcccccatctctgaaaatctagctcagtgggattaaagatgagacaaattacaaaagtctcaaaagggatggccacactattcagctctcccctcccctcaatggctctgcagggtgaaggttgctcaggatacacagggcaccacctcgggctcaaacgccagaggccatattggcacatccaagtctggaagtcattatgtagaatcaaaactagaacttgtgttccggtgaaacctggttaatctaaggaagctgccttggctgttagatctaagagaatatcagttgggcagggtgtcaggtgggtgggctgcagaggaattggtaccgcctctgagtaaggatatcgctctaggcctaagcacaggctgggggacccacaagggctgattctgacagcagcttcatccctcttgctgcccacaccatcctaagaagggcgacaatgtacccagggtccctggtgtagtgtcgcaaaaatactttttgatgagtgatgttgatgaaggctcacatttatggagcacctactatgtgccaggcccttacctatcacttagtttacctttttaaattctcccaacaattctgtgacatatgtactgtgatgatccccattttacagatgaggaagctgaggctcaaagagcttacaaaacttgcccaccagtactcagctaagaagctgccgaggtggactgccaacttggcagcctgacgccagcccattgtctttatcataaactagttctttcccactctctactatctctgcccatgggaatccttctgcccaggctttaactccaaactctaatgccaggaactctgagaaggattcctggttcatctcccgcttggcatcttgcagcattttgtttcaggcactcatgcgacagttgccacatacactatgtggtagatgtccaggcgtcctacttttttttttttttttgaagcggagtctcgctctgtcacccaggctgaagtgcagtggcgccatctcggctcactgcaagctccacctcctgggttcaccccattctcctgcctcagactcctgagtagctgggactacaggcgcccgccatcacgcccggctaattttttttttttttttttttgtatttttagtagagacggggtttcaccgtgttagccaggatggtctcgaactcctgacctcgtgatccacccgccttggcctcccaaagtgctaggattacagacttgagccaccgcgcccggcccaggcgtccctcttacctctgacccggatatggtttggatctgtatccctaaccaaatctcatctcgaattgtaattcccgtaatccccacgtgtggagggaggatccaggtgggaggtgtttggatcatgggggcagtttcccccacgctgttcttgtgatagtgaatgagttctcatgagatctgatggttttataagacagttttccctcctcctgctcactctcttctctctcctgccaccatgcaaagaaggtccttgcttctccttctgccatgattgcaagtttcctgaggcctccccagccatgtggaaccgagtcaactaaagctcttttctgtataaattgcccagtctcaggcagttctttaaagcagtgtgagaacagactaacacagacccccaccagactacaggttccttgggggatgggagctgaagcaaggcatgcctgtgtcttctgtgacccagagccctagcaggtacctgacaatggctgcgggtgacagacaaagtgggctcactcatggaccaagtgcttaagtggatggattttttttttttttttttttttgagatggagtttcgctcttgttgcccaggctggagtgcaatagtgtgatctcggctcaccgcaacctccacctcccaggtttaagcaattctcctgtctcagcctcctgagtagctgggattacaggcatgcaccactacacctggctaattgtgaatttttagtagagacggggtttctccatgttggtcaggctggtcttgacctcccgacctcaggtgatctgcctgccttggcctcccaaagtactggaattacaggtgtgagccaccgcacctggcctggatcttttttagcactgagagatgctactatctccttctctccacagttcccaccactggtagggtgcgaggaagaaaagggggctttataatcaaatgtggctcctctcctcctcctctccccatgctagatgtcaaagataattaacattgatccaggatttcaaatgtcttctgcactgggcagaatgcttgatgtgcttttagattaaactaaatgctcaattaacttttgaggattaatcctaatccacagaacaagcctctgggataggttctgtggttgccgcagttttggaactaagaggccctgagaagagaagtgatttgcttgagcctcacagtcaagtaggggagtgtaccccatgccaggtgccagtgtcttctccggtgaggcacagcacctcagcagaggtggacagcatctggggaatgtggtccacggccaccgagtacatgatgacatgcaaatgctggggggccccttcagacattcggattgtgtggggctgggtgaggcccagaaatctgcaagtttcctaaactccccgggtgattcttgcccactgaagtgtcgcagctgctcatctaggacaacagactcagtctggagttcccctcagtcctttgaggacagacctttttgagactcactgcctccacacccacatgagcttctgaagaccgtggggtagtctccaccctacctcacacccttctgccaccccatgccagcagaccgctgctgccaacatgtggggatgggtagaggatgttcccactgacaaagttgggactcaaccctgaaggttgagtctcctctgggagctgcttggtcaatcaacagcctcccttctagaatcactggacagaaaattccatctttccagagattccacctacccttccacgaccagcatgcaggcccccaaagctggggaatgcaggtcaggcgtggagaaagggctttgtgttcactgtctaacaccctcatgttcagcggaaacagattttgtttctcagtttagccctgaggcaggctgagggttttccatctgcaagccatagactcacttattcgacaaatatttatatgcccctgctatgtgctaagcactcataggtgctggacacacagcaataagcaaggcagctccacccacgctgctcttccattctggtgcatatgtgggcaatgagagggggatcaataaacatccactgttacaaaagggtagaggcatctcagttgtcatggcaacagttgctgggcgatgacgtcaagcaagccccaaacagtggtgacagcctgatccgaaggcacttagaagtcgctgggaggttattcccttgggaaaactgttgattggaaaaaatattgaagatgtatggcatgtttgagtcacaaggaaagaggaagcagggagggcagaaggatgaataaggccactgctccaagcacatgaagcagcccctgaagggtgggcagtagggaaagagccagggcgaagcctgctctgaattcttgcccaggtcagaaccaggaaggagggtggagactttagagcagggtttccaaaaaggcatttcttggagcaccagtgcagagagatgctctgtggagaaaagggggttctgtagtcacgtttagcaatgatacctattctattactgtgtgggagatcctcaaagtatattggcataataaaggtcctgagaagtcctgcagcaaagaatccaatctagcctatcccagcatttcccaaaccctttctaacacctaacattgccatggcactctacagagcattctaggagacacactgctttagagcaatagaagaccagggtgatgtgaaaaagagacacttctcaagcctggagatgagacctgggttacaggaactagtgacaggtgagaagtgggactggtggtgctgtagtgtttgtatcccatggtgtcaaacaatttgtgaattgtctgttattatgcctaattaacattgatgttcaattgattttacagagttatgtaaaaccaagcttcacagaaaaagcttggacagaaaagctgactcagtatctctgagttacgtatatcttcacaggggaggagatgcaaactgaggccctgcttgcacactccatccacctggtatagcttgtctgcttccaaattatcagcctggcaaactcatggtaccaagtgaggacaaatgtcatagtcctcctgggaaatgggcaacagtggattttgctaataacgtggaaagtaatttttaagtgatatttggattaaaattgtgatttttaaaacattatcatatctgctctttcattttattgtgttaatccactgaggcatatttggctcctgcgaaactgaggttcacattacttaagtgacttgcccaaggtcacacagtgataaagcctggattagaacttctgtcttaggactctttgtccagtgattttcccactgtccaagaagagacgaccctgtagacccctttcaatgtgatccaaggctcatgcctcattcattcaacaaatatttattgagcacctacaatgaatgagccaggctctgatctaggcataggaatatagcagtgaacaaaccaaaacctctgctctcatggagcttgcattgtagtgggcaagacagatgactgtcataaattgaatatgacaggtgtagtaagtgtttgaagagaaataaatcaggataaggaattggagattgatgggaagactttttggtgaagagctttttgagtaaaaactaaatgaagtggggaagtgacccatgcagaaatctggagaagagagatcaaggagaacaagtggcaggtgcaaaggccctggggcagcagtatggtggccagtgcgcagtacagcctcaaggccaatgtggacacaagggagggtgaaatatgaaggtgagaacggcagcggggccagaccacacagggccttaaggtgagggtggtgatggaatgtaaattacatatttgctctgttactctgttactcagagtgcccttttacctcactgtgagtcacgacagctcttgcatccaggaggtgttccgaggtctgtaatggggagaagtgaaggccggctgtgggtttagacacaaggtgcttcgagagtaaactgctgtttagaggtgggtggctaaaaggacagctgccccaactcctcaggtctcagaatttttccaggtggaccctggccttgagaaaaagatgggggtgggtggaaaatcattccttcctcagcaggcagctgagaagcgtgaggtacgagtgaaaaggggcagaccagagccctcttggcgcctaaggaactcaggagtgagacctccaggaaggaggtcaaatgctgccgccccttccagccagccctgctctagcatcaattccttgttcttgatgtgctccaaatctgggctgttgtttatcctcttgcaaatcttagcagcaccttttcccagcatgctctgagacaggggtcggaagagcagccttgcctaacaaatcacgaccgtcataatttattcatcacctgctacaggcaggcatggctctctctgtcccatcagtagcatctcctacatgcctcacaacaactctgtactgctggcattatgtttgctattttgcagatgaggaaactgaggcccagagatggtaactaagctggccaaggccacacagcaagtaagtggcagattcaagactcaaacccagattattaaaataacactgtcaagtctctgtgtctgtcttcatggccttttgtttttctcgtttttttttttttttttttttttttgagagggaatctcactttgttgcccaggctggagtgcagtggcacgatctcggcttactgcaacctcctcttcctgggttcaagtgattctcctgcctcagcctccacagtagctgggattacagacgcccaccactacgcccggctgatttttgtattattagtagagacgggctttcaccatgttggcgaggctggccttgaattcctgacctcaggtgatccactggtctcaccctcccaaagtgctaggattacaggcgtgagctaccacacctggcctgctcttctttcttataccccttattcgtcccttacgtttgtgtagcatttaacagtttgcaaagtgtttgcaaagtctcagtatcattccaccttgtgttcagtttctctcctttcgatatcagcacccttgtctgtctcctccctcttccccttttatgtcaaagcttcttctggatagagaatgtgtcttgctcggtttttagcccacctcccttcccccaagcacttcgcacagagcaggcccttaacacatgtctgaggaattaatgcattgggactctagggtcagactgcctgaatttaaatcctgattgccacttacaagctgtgttaccttgggtaagttacttaacctccctgtgcctgggtttcttcatctgtaattcttatcagaattaaagagtcagttcctggcatatggtcaacactatgtaaatatttgttaaataagttctacatttatcttcctttttctctcacctctttccttttaacttaatgataatagctaacacttacatagcactatcatatgcctggtcccatcgcaagcactgtccagaccttaactccaggcctgaatctgcctcctgcacttgaacaagcctcaggctgggtgtcactttagtggtcattgggtgggcaagagtctaatgagtgacatggaggggccatctcccacaggacccagggattagcagacctggatggaggttggcctggctatgggttctgagcgtctaagaaggttacagacccttagctgcaaagaaagggccataaaagtgaccagagagtgagcaggccctacagggcaccacttcaagtgcctacttgccagatgacccacacatgagatgctataaaaccaagattcaacaactataaacctccacgaggattcaagggctttgcattaaaccttctaaaatgggcataaacatggatgcacccatgctgtttgcctgggcaggcaacttactcacaaatgggctaccttacgagatataaaacaggctgactcgtcctttttatgtccctgtacatatttgttttaaaggtagagatcatttcctgtttcagtgcacatttgaaatgggcattccctgggggtgggtggagtagcaactggaagataataggagggacttctggtaatattccatttcttgacctgggagctgctttcatgaatgcactcagtttgagcctacacctatgctcagtgtgctttttatatatgtatataatacttcaataaaatgttttaaaaagtatacattctccagtactgcagtgtttgcgatggggaaacaatggacacagcctaaaagaccataaaataaatgaagtcatatctgtagccactaaaaataatgagttagagatataggaatgatgtggaaagatgttaagatataatgttaagtgaaaaaaggagttacagagcagagagtattatctcatatctgaaaagaacattgaacagtgtcagataaccatttgaccattttaacctgcaatttcatatggttcatcaaatacacacacagtatacatgacatatacataagcttataagaaaaataacctgaaaaaatacatcttgaattgttaagaaggtagagtaagttttcagtttctgtgttatttacatttatgtgtctgctttcattttaatttaattttttgtaatgacctagtattactttagtgatgagcaaaaacataatcacaaagatataacttctaaaaaaatcctctccttcctcagtgttgtagacctgggcagtgaatcaagattgagctggcgtgaactcttaggtgttctccgaccccaaattctaagattctagcagaaataaccccaagcctgggtgaagttcagtggcagcacttgcagaaaacatacctgtaaaattttggagtaactgatcacaatgaccagtcctggcaccaagaagttcaaagtaacaaaagagacatcccacgagatctctccaggaatggtgggccaaatcagtgtgcaaatcgaaatttcctagttacaaaaaggaaaagaacatcatgtaaatgctggcttcttattggcctctggctcagtcttattgagggtttcctgacacttacacggttgcattgcccagttacacaactagcatgacagtgaaccccagaatccctcccactgcccaccacaatcccacttgcaaagcacttgcccctgaccctcagaatagccatgattatgttttctgttctccagggacagcaactgagcctcaggcttacagggtggtaagagctagagtcggttcctaggtgtggtctttccacttccctgggctgacatgcaaagggctttcgagccttctcttccaagcctgccattttacaaaggagaaaactgacccctgaaaggttacagagatcggaaaggacatgctacataacaaacatatcaaaacaggaacgaggtttccctgtagtcacaactgtgtaagctgaaggacacagggtctttgctaaagcattaagtattcatgctgggggtgctcaggtgtctaaagtgtgtcgagctgcatcaacctggccatctagagccccaaggcaaagatcagcctccactcacagacagttcaagatgtaaaaccaatggaatatggcagaagaatgtgaaggtttgtgatcttgctgctatcactatgttgtattgatccaaatgtttaacactaactgcaagaactgcaacatatggagaccttactgaatagttacaaatagcttctgcaacaatttcatccaatgaataaataggccaatgaaaacagacatatatctgtgtgtctgtatatactaacttcccacatataaacttcctatgcccacttgactacagaaacaaaactgtctagaaaacaagtggccctaacacacacatatagaatagattatttttaagagcacgtgctgtgtaaaaagaccacgttattgattttgaagggccaaggcatcttaaccaatgtctaggagtagcatgatcatctgaagtaccattcattcattcattcacttgaccaatattcattgaacgctctactaggcaaaagcagagaatttttagcagtgaatcaagactgggctggtgtgaacacatggtagggggaagttcattaaatccttccacattttggtgactggaaagaaacctgttttgttttgttttttttctttgagacagagtctcactttgttgccagtctggagtgcggtggcgcgatctcggctcactgcaacctccgcctcccaggttcaagcgattctcctgcctcgcctcagcctcccgagtagctgggaccacaggagcacgccaccatgaccagctaattttttttttttgtatttttagtagagacggggtttcaccatgttagccagaatggtctcgatctcctgaccttgtgatccgcccgccttggcctcacaaagtgatgggattacaggcgtgagccaccatgcccggccagaaacctgtttctttcaaggatcttctgattactggcagtgaggctactactgctctccagaaaacccgcaccacctccttttgtactcaggcctctgcccactatggacccctcattccaagacagcagtagcaatacatatgagcaggtatgctgaagcatcaatcggaagaaatggattccagccctgaatgtgacttggtctctcattcctattcttgtgatggaaaaattttaagggagagtagaaaaacagaggacacacagaagcttttcttaagacccccaactctttccaaaagccttttccagaatgtctgccaaaatctctccagggttagcaagacttttgtggagggtataatgatagagcaaggtgttctctctacagtaggagtgaaagaaaaaagcaggtccctaaaccatgtgcttctatgatcccagtgtgttgaagagaatgtatatgtgtgaatgagtatatggccatccaacacacacacgcacacacacactttctctctcacatacactcacgtgctcgcatgcacagaaaaaaacatggaaggatacaatccagaaagtgaagtgtctatttctaggcaggactctcaaattgtttttattcttgtggcttatctgaatttcctaattttccatgatgtgcctatattacttttataaaagaaaaaagttcatttataagtgaaatgatgatcaaacatgaaacacagaccaccatgatagttctgccaactttaccagctatttttcaacagaaacaatgaacctgtcccaggcagctcccaaattccgtgactttaataaagacgctcgttctccttttgatttgtggctcttgctcagggcaggaagtgtgataaggaagtaagataagaactctgcctggcacccccacacatgaactgagaggcagtgcaactggcttgggggcctgaatgatggattgacatgctctttagaaggttttgtatggtattgttgactaaatgcactgtctggtctcattaaaaaataaaataacaggtgccatgcccacagagatccaagttggtgtcataacttggtttctgtgggaaaatccatttggcttaagtcgttttgattctaggtattctcccgcaggctgtgacatgtagaggagttaggcagcatgtcaagtctggaaggtggggatgtgagtcctattatattctctgtactttttctgcacatgtgaaatgtcccctgattttaaaaagggaacttggaaaacaaaagtggcaggcctgccttgttactgagttacagaagcagaattggcagagtcaacaatagtcttctttaattcatttgctcaaccacccgactccagacgtggtggctgaccacagcgaagccacagtgaggaagagcaaggcgctggccctttcctccaggagggagggaggcagagaagcgctaggacacttcaggacaggacaagcagctggaagtgcccagagagcttcagaggaccagagagggtagagccacccagggggggttgtttctgctatgcctggaaggaccgcggccaggggcatagggaggctggagctcagctgtcagagcagaattgtgggatgaaattgggaggccactcacagtgaagggataagtgtgacttggatcccccaaatgtgttctgcctcatcccagtctccacttctccctggccatctcactcatttccacggctccttttgcaggtaaagctccaatctactcttttcagctgcatgctttcctgaaccccagacttgcccaatagccatgaggacatctcagcaggaggcctcataggcgcattaagctttgaaggtcccatcctcaaatggttccacctgattcctgcactccctgaatcagggcacagggccaccattctccaagctgccagaaacctgagcactggccttctgcccacctcctcctccccactcagaagggatctctaaattcctccttcatagccattgacttatccacctattgcattttcactggcctacccccaacccttaccaagaccaggccatcaccattaagtctaaacttcctaccaggatgactctggtccttctccctctcctctgccaacgcttccagcaccgtcttttgcccccactgaacctcaggctctacacatgtgtggtggagaaccccttgcaagtttcagaacagcactcactgctcctttggcctccatgtggactctcctctgcctacaatgtcctcctcgtctccatccccttgcctggtttacttcctctcatcttcacactcagtggggacactgccatctcccagtagcttcctggactccccacacccagcagagacctttccacagctctccaaagcttgtgcaatcatccccttccctgtctggagtccccactgaagtgtgttactaagggtggggaccaagcctgcctttttccagccagcatcccagcacctagaattctgcctaatacacattaggtgctcaggacaaaattgccaaatgacttttctaaggagactccccttgaggatggggacatctgtccacaggcactgtggaaatgctgaccctccccacactgcctgacttatttgcaaacactgcctgtttgcaaataagttctagctgtttgttccagctgtttgcctatcagtctctctgatgattcttcctgcagtacctctggagacccttggtagatccttgttcctgtgtctcacctctgccatcaacatggaagacttcaagattattttaagaacctaggagtcctagttggatatttcatcttctatcagcttcccagcaaaaaagagagaaaatattaatgcaagagatgcttcctttcttatatttcaaaagtattctctaatcataacaaaagcaagcaaactgtgtttgtttcctcagacaatccacactcagcagagacacatgaacgttcacatgactagcctggtattaaattagggtagggtggggcagtgggatcaagtgccgcaagggagtataaacccaagggtgacggtatccagagggacccaaaagagtggggctaaattctggttccatctcttgcaattctgtgaccttagggatttcctcttttagaataaacaaaagaatatggggtggggtgactgtgaggaccaaattaggccagaatctaggaccatctgtgtgcttctccttgaagagaaggaggtggatttacgtgatttgtggcaggggcaagaggggaagggtgcttagtaaatgtttgcagaatgaatgggcagcacattctggccaggatagacagtcttctccacctgccgatgtgggtcactgcccagccaggtccacagcacacacaggctggaatcctgttgaagcagggtgagctgacctggctgagatgtcaacgttgctaggatgtgttcgccctcttaaaatggcagtctgttattttacagcaatcagaagaattatactgtttgaagaatgtttaaaatgtctatgttcaaagataaggaaactaataatagctagcaattcttatgtgcttaactgtgtatgtgccaggtgttggcccatttactgaacatgagtgcccatgatgatccggtaaggttggttgatactgtaatcatgcccattttgcagaagaggaaagtgaggtattgagaggttagacagcttggattctgtcatgaagctcccgaatggcagagatgggatttaaacagaatgtttgactccaaagcccactccaaataccaagttgtctcacatttctaggatatttatcacctcatcttctcttcagtgaagttttagagtctgattaccatgaactactgggcacccacagcccacatggacaagagattgagtttctgtttcaggaaggctcttgggtcggcagaagctctaaggggcagtttccttggccagcgctccttgaggggagggagccagtatctgcttaggcttggttgattctctcagcgtgtggtttgggttaggaaaatatcccccatcccaaacctccatatttagtctctaagtgggatggggcagacagaatccacaagcagaaagctgggaatatggggattgagaaaacaagcctttgctaattttaaatgtgagactcagtcagtctagaccagatcctcctgttgcttttttttttttaatgactacactccccctttgtttttttctgtctctcattcttttcaacttatttcttcaactgctgaacctataatattggatgttttctatgtattcaggcaacaacccttaggaaattgggttttttctgtttgttgggttcctgggcaggtaggtgtgaaagtgtgtgtgtgtgtgtgtgtgtgagagagacagagacagagagagagagagatgaggtggatgtggcagacaggtaggaaagaagacaaagaagatggagagccagaaaggattgtcccattttttttaatttaaaaaaaattttttttttttgagattgagtcttgctttgctggccaggctggagtgcagtggtatcatctcagctcactgcaacctccacctcctgggttcaagcaattctcctgcctcagcctcccttgtagctgggactacaggtgcatgccaccacacccagctaatttttgtatttttagtagagatggggtttcaccacgttggccaggcttgtctccaattcctgacctcaagtgatccgcccacctcagcctcccaaagtgctggaattacaggtgtgagccagcatgcccagggatttttttttttttttaatttcaagctttcccacctcacctctactaatttcagtgagtagggctcctgtgggtaactaactcacctggcccccagtgcacactgcagcctcattctctcccagtggctttgcccaaatccctctccgaagctgcttaaaaccaaggaagtgtttcaacattaaaacaaaggaggtctgtgtgcccagccatcacaacacagacctccacggaagcaccttacagcacaactgtggccactctggaagcaccacagagggctctaaccacacccagattccctaacagtggtgcggtactaagtggccaagacatggaaggcccctgcctatgccaaggccttctcacccaaacagtcacctgtgtccctgtcagcacacaattttagtctgggctctggctgggaagtgacaagagtcttattttttaatgtcatttgccaattaattagggttatacttgaaatcactgaaaaaagggagaggcacaaaatacacatctgaaaacttaagataccttcaagatacattctatctggtctttcattccctgaacatcattttctcctgtaagaaagaaaatgaggtgaaatacctcaagttctgtgagaaatatagaagtactgtgactcactgagagaataacttttaaaaaaatcaaagaaactgatggcagaagcccagccccctcctgatccttgcttttagaggcatctgcgtggcccaccttgattctcaggtgtgtgtgggctaagaacaagcctgtccactaagccagagcccttggtctgcccataaatggcacccaccagctcagctaatcctggcttctctgggccccacttgagtggacatggccacaagcttgcatgttatttgatcaagtgccacaggcttgatggggctcctgcctattagtcattcaagctcataaacaaacaaacaccccacaatgtattccacacaagcattagaaacaagtgtttaagtttgatttatgtttaaaaaaaaaaatctcgcacaggatacaggaggcagactccatccatcctacccccaataaaagggctgtgtgagagactggtctgggaaaacccccagagaagctccacctctctgtctcaggctctggagggtcacacagtcagggggtgtccctggtgggctgtgtgcatctccataaccaagccttcccctggtgacatgtcatttctccctccctactcccctctctgaccacttcgaaggtccctctttgggaccgtgattcctgtttgtgccacgattactcagggcgccccatattcactcctaggtggagagggagcttaagggtagggggttccaggccggaaaaccagtgaccccggcagggaaggggaggccaagaacccagccacgggcagaagctcctggaggctgagcccccagcgcacagacctaagtcctttctctatctctctccgcgaggcatggagaaccaaacacactgggaagacagccagacggcggccactgtcctccaccgtgactccgcgtctagattccctcttccgtgtggatcccggcgcacgaaccctgcaaccaccgggcaaagcggcaagagaaaaagacccgagctcgggattccggaccgcgggacttgaggggaacagagccaatgtcctgcactatccgcagaaccttattccgatcatggtcactcccacccctatgagctaataatgacaactattgacccgctatgtaaaacagagctcgtcggtccagcctctgtaatctgcacatttcaggcgcccaggacacctcgaaggtctagtgtaatccttccgttttgcagctgaaaaaactgaagaccccggaagggaattctgtcacaagtcccctaaagacagcattgcatctggggtccccgggtctcacatgcctgtccgcgcgctttcaaagcaggaccataacccaaccctggacaggagcccaactcctccttgaattacgggtaaacttctggaaggagcccatctcctcctcgaattacggataaaatactctgggcaagttattatacacttcggtgtgcctctggttctcatctgtgaaatgggtgtgataataacagtattgtagcacctggcgaggaatcatgattcaatacaaagtgtttggccaccctgcacccccaaagttccgtctcgctcctaaactactcgttaattaacctcgcaacagtcattgcattttgcaagaatttgggggactccacttacatcatttaggagggcgtgtgcacagcgttgtagtgagatttaagagattaaacttcacagccatgggcacaagatttggcacaacgattaagtgcaataaatggctattgttgttcttgatcatcctcatcccagcttccgtcggggccccgcttcccagcctgcgcaggacacctgcccggcacacacagaggggcgctcacctggtcggcgccggggagccgttgcgggacgactcggaagaagacgcagagaggcagagcggcgaccgccgaatagccccagatgagcgccagcagcactgcccgcgcccgccgcccaggaccccgcacgccgcgctgcaggtgcacgatgcacaccatgcgctccaggctgaccgcggccagcgtgaggatggtgacgctgccgctcagggtcatcacgtagaagagcaggtggcaggcaacggggcccagcagccaggcctcagtccagcgcacggccagcaccagagggatagcgctgatgaagagcaggtccgcgcagaagaggttgagtaccaggcaggcagtcgcgccgcggcgtcgtcggcgcgccaccagcaccagggcgcacacgttgcccagcagcgacactgcaaagatgagcaccagcacggttgtctccaccgcggccagcaccagccggtggtcgcccttgacgtcggagaagaagggaaagcgggtgcggttggcttgctccaggctgcgcaagggcgcgtcgcccgctgcccgcgcgcattcaggggacattcccggcgcctggcggcccgcagcggtctgagagagtgctcatctgggaggcgactgagtgccaaggcggggaaagagggagggaggcggttgcgacatctcgcctctggccccctcccttctgaggagcgccagcactgggtgcagggagctgcacccggggcgcgcgggaaccaggaagtgcccggcaacactggccgcgaacaccgcagctggccggggaggtggcggccaaggcggaagcctcgtgccctctggccctttgaaagtgtatccagaagccagaaaactcacttagcgaattcctcgagcccccgcagggcctgcccaacctcctttatttttcagggacactggatgtgcgaagccttttgtgaacggatttagctaaaattgatttaaaagggtcagagctggcctttggagattattttggcctgtgtcgttcaggctttactaaagaaactccatgggtctggaggtagatcctaaaacaacttgtaatgagtccatattttttgtgggggagagagggagtggagatcttttatcactacttaataacaggtctttaggtggattatctactccctctaccccagatttttaatctataaaatgggaataataataccccattaggttattgtgaggctcacctagagttttgcacacttggcacacagtaattactcgttaaatgttatcaaatattagttattgtaactaaaatgcatatacattttgcattctgaacaatgacataaatgctttcttataaaaagagtgagtccttccaaaatttttaataaacttgccatccaaggaagacagatatttcaaggctggcagattcacacacaagctatgaatgtgccccaggtgccacagtttgaggagcactgggcaatccagtcccgttagagataaggaaactgaggcccagccagagtgacttgtctaagctgtcctctggttagtaatgaaagccagtcacctgtccccgtcccacacatttccatcacaccactgcagtctcgttttctgtaaatgaggaagctggagatggaaaagtatgcctgtggcctaagatccagtggccacttccccaaccagccaccctcctgccacccacaccttcaccccctcttccctctgccatattaccaggcctctcccagttgcccactctgtcttctaattgtctttcttaaggttgggtcttaagaaatctaagcactgactgggcacagtggctcatgcttgtaatctcagcactttgggaggccaaggcgggtggatcacttgaggtcgggagctccagaccagccatggccaacgtggtgaaaccccgtctctactaaaaatacaaaaattagctgggcatggtggcaggtacctgtaatcccagctacttggaaggctgaggcaggagaattgcttgaaaccgggaggtggaggttgcggtgagccgagatcaggccactgcgctccatcctgggccacacagcgagacaccatcttaaaaagaaagaaagaaagaaagaaacctgagtacttcaggctggttgcgccagagtctgaagtactgtctggggagggggtccatttgtgtgtctgcttttcacggtatcaaacaggtctgagctgatgatgtgacttctaacctgagaagtagatgctcagcttgaacattgactaggttcaagttgaaaaacagaactggtttgcttcctgaaacagttgaaaaagggcaaaaaattgaaataaagggaactcagacaaatggggttttggcaactgtctgattagggtcaggggatattagtgtttgtgtgagggaaaggaaactataggtatatgtatgtgtgtgtgtgtgtgagagagagagagagagagagagagagaaagtaagagggaaaagcacagacagagacggagagagattgattacatcacaggctgatgtgatgagatagacacagagaggtttccctagaatgtacaaccagggtgggctctttgcactaaaaggccttctccaacattaacctcctgggttctaccaatggcaaaatgttgagtgcagaggctcataaactttctccattcactgcaccttcatggcacccctaggcaaaaagaaaaaccaaacagaaacgtttcatttattaagtagttgggtccaaacaacttaataagactttatgtcctaacaacttagtaactatcttggaaaataataatacatataaattggggtaaaaattttattgtttcattttttttttttttaatttttgagagggagtctcactctgtcgcccatgctggagtgcagtggtgccatctcagctcactgcaacctctgcctcctgggttcaagcgattctcctgcctcagcctcccgagtagctgagattacaggcacccaccaccacacccagctaatttttataatttagtacagatggggtttcaccatgttggtcaggctggtctcaaactcctgacctcaaatgatccacccacctcagcctcccaaactgctgggattacactcacccggcttgttgtttcattcttaaataaccatagtgaggctaagtgcaatggctcacccctgtaatcccagcactttgggaggctgaggctggaggatcacttgatcccaggagttcaaaactagcctgggcaacataaccagatcctatctctacaaaaaaaaaaaaaaaaaaaaaaatagctgggcatgggggcttgtacctatatagtcccagcttcctggaaggctaaagtgggaggatggcttgagcctgagaggtcgaggctacagtgagctatggtcattatactccaatgtgggcaacaaagcaagaccctgtctcaaaaaattttttttaaaaaaccaacaacaatagcttcctgatgggctgggtgcacttgttgtactctgcacagtttttcaaaacaaaatcatattgagcactgctccatgttgattttcatgcagttcctgctttttatcacagcaactcctaaacactcagctttgtaaggtacaatgtcatgaatctaatgctggaactgtgaattacctagtagagctagcagttcatgcagagccggatgggtgttgagtagtgccatttccctgcagtacccgagcccatgtgggcactagcctttggggaccagagccctggcaggacaactcactgtgtgaccttgggcaagttactgtagcttcttagagtttcagtcttcccatatatgaaaggggatagtgatagtactgacctcgtagggtttggggaagattaaatgaagttccttaatgtaaagcatttcgcacagtggtcactgagtggacactgtgggtcagactctgtggtcaacactgtatatggattatggacacaactctgcttgctgacagtcccagttatgatattattattattattattattggagacaaggtcccactctgtcacccaagttgggtacagtggcatgggcatagctcactgcagtcttgaagtcctgggcccaagtgatcctcctgcctcagcctcatgagtagctgggactacaggtgcataccaccatgcccagataattttttttattttttgtgaggtgaggtctcgctatgttgcccagacaggtattgaactcttgatctcaagcaatcctcccaccttggcctcccaaagtgctgtgattataggtatgagccaccatggccagcaccagtttatgaaattattattagaacctttttcattctcaaattgccctggtttggaggataaagtatatggccatccttcctttgtgtttgttaactcattcaattcccctacaagttgcaaacattgggatttgaaccgagacagtctgactccggagtctttgctctgaaccgctagagcagtgcatcttaactgggggaggttttgctgcaacccccaccctcggacattttgtcatgtctggagccatttttggttgtcacaactgggagattgctactgacatccagtgtgtagaggccagggacgctgctgctaacatcctacaatgcacaggacattccccacaacaaagaattgtccagcccaaaatgttgatagtactgaggctgagaaatcctgtgctcttgagacctcacaagactttacttcttatttttaaccctgtcgtggggtcacatctagtggcaaaagccaaaaatgttaccattttttctcagagatgtttcactgcaacctctgtgacccctttaaccaacccactgggctccgctttgtgtttgggccccagatgtgcacagccgtgaaatccctttcatacacagggctgggtgtggcatcctcagggtagacagacttcacgtattccctggagactggacagtagatacccattggctgatccatcactgtgaaagtcatatttattgcccatggtattagttctttacctcttccactctcagataaagccatagaaactgagacaaggatttaccaagcgtaaatctggacagtctcgtttctaagctaaagagaaagccaacattgcaggtggcttctgtacctctttacatttccaaccaaacaggaggggagaggggcacaggggactttctctgtgtatgcttttcttttcttttctttctctccctccctccctccttctctctctctttctctctttctttctttctttctttctttctttctttctttctttctttctttctttctttctttctttctttctttcttttcttctctttctctctctctctctttctttctttcacttttttttgagacagagtctctctctgttgcccaggctggaatgcagtggcgtgaccttggctcactgcaacccctgcctcccaggttgaagtggtcctcttgcctcagcctcctgcgtagctgggttcgagacccatctttttagtagagatggggttttgccatgttgaccaggctggtctctaactcctgacctcaagtgatccacttgccttagcctcccaaactgctaggattacaggtgtgagccggttttcttatttttcctctggaaaaatgttataaagttagtatgaaaatgcttactggttcattactcgacctccaaatctccctgtgagagtctgtccatctgtctgtgtatgtatgtatctgtctgtctgtctgtctatacctatcagttctgagacatatgcctttgcaggttcagggtatctctgtgcaaaattaggatatattatagagcagaatgcaaaggttgctcaccctcgtgcaaagatttcaagtctctctcctgcctctgttcctcccatcctgtcaaggtgagacccctcccagatccccagacccaactgccctgagcattcatagctgagtaaccacctcagccaggccagagtggggtgacggggaagaccaccttgcaccctgatggtggtgcaaggctccttcttcaaggaggcccaagagttcccagggagacagggcataggcattcagaccaagggaacagcaatgcaaaggtaggaaggcccgagagagcaacacatgcctgggaaggggcaagtgctctggcatgcccagcactgtgatcttctccactgtccatagcacatctatccaccaaaagataggaacccaagtagaagctggaaaataagagcaagactcaagtgagcagctgcctgtttataagttgttcacacactaggggcccagggcagggatcatactgtgtctactttaaacaagatacagaggccgggccacagctagcacactcaaagctttacataagttagaaaaaaagggacttccctgaacagatgagttggaaggcgctccttccccagggttgatgcagccaaggctctgggcatggctaacagggcctggctggggctgagcccctgtgcacgcccctcaggtgggagtccttggcaggccgaaacctgcaatgtggttagaagtggctgtgcctcatggtttgtgggcttgagggcagcaatggcccttctcacgggctcttcctgcccacttgattgcggtttctgctcaagccctcaaagcccacctcataccttaaactgcctttgtaagattataactgaggaaattatgacagtgaaagaaatcagacctaactgactccatcttgcttctaaactttaagcaagctgtccttgttcattcctgggcgtaggccgaactaactatgggaaggaattcagttcacggtttgactctgaaacaaaattgatagcagcccttttcccgaaaagaccctcgtcttgcctggggactagtctgcctttgcaggactaacaagttagctacaagattagaaattacagttcagatgtcatgctggctccaagagtctgaacctccccaaattgctcctggggtaacatcactgttgcaaaacctaagatcagggcttgagatattttgcagaccctgcactcgatggatcagccaccaccacccagaccggtaatctggttcaaccagttctgccatcacacccaggaatagaaaacagcaagaaaaactcacttcgaccctctgtgattctatctccaacctgaccaatcagccctccccatttcccaagcccctacccaccaaattatctttaaaagttataatccacaaatgctcgcagagactgatttgagtaataaaaaaactgcagtctcctgcacagccggctctgaataaattactctttctctgttgcaattcccctgtcttgataaatcagctctatctgggcagcgggcaaggtgaacccactggacagttacataccctatcacagcgggggcattgacggggcagggcccatctgtgagttccactgagccgactttgtctgcctgggagtttcctcaagctcatttctgcgacaatcttgcctgaggagatgaagaaaggagagcaagggccagccttttagcaactgtgagggcggggatgtccgcacactggacggccaggcctgaccactgtcgctggagtcctggggtgactaaactctgttcctcccagacagacagaagaggtgaagccatgcctcaagaagccccagtgccttgaggaggccttaggagtcaatagaccagaaaagatcagccccccactgctgaggtaactggggaaggaggaacactgaggagtagggggactggcaagggggggtagaaagaacaataacaataataataggagtggctgggagcggtggctcacacctgtaatcctggcactttgggaggctgaggtgggcagatcacgaagtcaggagttcgagaccagcctggccaacatagtgaaaccccatctctactaaaagtataaaaattacctgggtgtggtggcacaagcctgtagtcccagctacttgggacactaaggcaggagaatcgcttgaacctgggaggcagaggttgcagtgagctgagatcgcgccactgcactccagcctgggtaacagagcaagactccatctcaaaaaaaaaaaaaaaaaaaaaaaaaaattagtagtagtggccaggcactgtggctcacgcctgtaatcccagcactttgggaggccaaggtaggtggatcacgaggccaagagatcaagaccatcctagccaacatgatgaaaccccatctctacttaaaatataaaaattagctgggcatggtggcgcacgcctgtagtcccagctactggggaggctgaggcaggagaatcacttgaatccaggaggcagaggttgcagtgagccaagatcgtgccactgcactccagcccgggcgacagagcaagactttgttgcaaataaataaataaataaatattagtaagacaagtgagttctgtttgggggctaaagctcaggggctcgagcagtggtccctgcaactcagcgctctcagccctgcctgttttatcacctgggctctgcagccttcctgtccacagtggtagctaccaggatctttcccagtgcatttctttccagcttaaattggccagaatttattaactcctgttgcttgccaccaaggagtctaatcaatagaagatccaacatctgacgcctcccctcccccccatgttttaaagacagtctttattttaatgaggccagattgcccaatacgggagctcaaactggataagtgggatcttggtaatcacctttttcccattcttccaaggaaagatgtaattaaagcccctaaatacaaaatgttcaactcagagagaagagcaattttgatatggtccatttctacttaagcggtagtgtttctctgtggccctctctcggccaggagccacagtggccagccgaggatggcaggcagtccattgagcacacactgatggagcacgtactgcatggccagcaccatgcccagtcctagaaatggccagacagcaggtaaggatgtgagcacaagcccagaagagctttctacagtacaagatgtagctttactgaaattccgcacatcccaaggagaccattggccaagatattgcagtgttgcgcgattcctcttgcatcactttctttttttcttttctcttttttttctttttttttggcttctttattagttctatgtttctattatgaaatgcaagaaaaatataaatttgtccttcattcttctacacagcgataatcctgtgagattgtgctgtgtaactttccagtgtgttttctgtacatccggggctgtctgtatgcctacaggtattttataaaatgggaattgtgttgcacacactattttgtaatatgcatttaaaaattgttttcaggacctggcgcagtggctcacacctgtaatcccagcactttgggagactgaggcgggtggatcacctgaggtcaggaattcaagaacagtgtgaccaccatggcgaaaccccgtctctactataaatacaaaaattagctgggcatagtggcgcgtgcctttagtcccagctactcaggagactgaggcaggagaatcgcttgaacccgggaggtgaaggttgcagtgagctgagatcacaccactgcactccagcctgggtgacagagtgagactctgtctcaaagaaaaaaaaatttttgttcagtcacattattcttctattctatccctcagtttcctcaatgcacacaactgtcccgtgccatatttagcccccagcttggctgcaaggtgaaaggacagagctatgcaccacacccaccctccagcaatggctctcagaggccagcctctgctttagtctccgctggtttaaagtgaaatgggaaaagtgtcaactgtgtagttttccccaaggctaaccacatccatttttacttgcaagattatgtcctgcttattttgctgttgttaaacttctctttcttttaggacagagtatgtgtggcagtcattaaaaacaaacaaacaaaacaaaacaaaaaatcctatgttaaaaacttgactactgcttcaatctccagagaaactcagtcaagactcaccagcccgtcacatggcgataataaggacacatattcatacaagcaaagacctccaaatttccagacccttttatatccatgcttttatctcatctcgaggacagctctccagggcaggtggtatgctctcccgtttcacagaggaggcagcaggtggcccccgtgcagcaaagggagatggtcccgcttacatggctcgttagccccagtggagcagactcaggttctcgattctcaactcagtgaccttggaggggctcttccctgagctgcagctttgcaaccatgcatcactgaagaatggaacctgatggaacattctggaattccactccgaaagtcccaaagctacaacacacttcagtggccagaacctggcctctgccactcctgctcacccattggcccttgcttggggctgcatgcttcagcactctggcgctgcctgtggggtgcagctgaaggggaagagcaagcctcacaattgaacacttgcaggaaatgtctgatacttgggtgtggcctcctgggtttgattcctgtcctgtagctcactggctgtgcactcttgggcaagtgacatcacttctctagatctctgtttcttcatttgtaaaacgaaaataacaatgcatccttcaaggctgggcacggtggctcacgcctgtaatcccagcactttgggaggctgaggcaggtggatcactcaaggtcaggagttcgagaccagcctggtcaccatggcaaaaattagctgggcgtggtggtgggcacctgtaatcccagctactcgggagtatgaggcagggagaatagcttgaacccaggaggcggaggttgcagtgagccgagatgacaccactgcactccagcctgggcgacagagcgagactctgtctcaaaaaaaaaaaaaagaaacaaagaaagaaagaaaatattaaacactgaaacactaaaccacttctacaatagatataaggtcaacagtaagggggaggtaaatcagttatatgtcttcagtagaatactacacagtcattaaaatgcttgtgaattgaatgatatgggtggcaggtacctgtaatcccagctactcaggaggctgaggcaggagaatcgcttgaacccaggaggtggaggttgcagtgagctgagattgtgctactgcacttcagcctgggtgacagagcaagactccgtctcaaaaaaataaaaataaataaataaataaaatacttccttcattggcttgtgtaagataatatactaaatgtcacacctttagtgtagtaagggcttaagaagtgtaagtttgtgactttttttagcatctgacacataggaggggcttaaaatattttcaatagttgaataattaaatagatgaatgaacgaaaatggaaatttgaggtttagtgagcctcttgatgtctctgctatctaagtcgtggtcctcaggagcctgctgtaaagatggataaggataggggtgggggtgggaggggccatcaccaccctggtactcccccactccacccccactgcccccaaagaaacaggcagtggaaattaaaaagcagggctaaaggggatgtaacacagacgtaaattttgagaagagagggatcatttattgtaagatgtgttctcagcgtggggtccttcctttcctgggaaatatgacctccaggtgatctggattccaaaaggagagaaaagacatggctagggaaggggtgtccagtgagggccctaacatgcagcccttcggaggggcgaagacaatgactcagcctggccaacgccctgaactctgactgtctgtttcctctatgctgattgagttcagcagccggcaaccgatgagactcctaggaagggctccagaatcactgatagctgacggaggcttggcagcgtgggggccctccgagcctgggaaggtgggcttatgtaaatactgtaatgcagagggtgctggagccgcatcaagagccagctcagctgctgtgcgctactgacacagccattcctgtcttgggcctcaacaacttcctcacaaatgaaaatgttgaacaaaatgagctctccaagccctgccagccaggtctgatggaagagtgtagggagttaggccttgaaaagctgctccgcactgccccctggtgtcattggctacagtgaccattgtcctcaaacctctggtgtccatccacccaccccctcatccacctatacgcccatccatccgtccatccatccatgagcctggtacatctctgaagagtgtgtcagcttttcatttcgggggtaaggggagaaagggacctgggcccacatatgggggcaatgctgacctgaacaagcagagccacaaggagaaggggtgaccagacggtacctggagcttggaacagttgtctggactcagaggtattgagtgacacccaaatgagggaactgggctccctgctcctggtggcagcttgaatgatggttctttggatttttaaggatgaaaccatcctggaaagtggaccttgagatatagatcatttgtctatttcatacatacacacacacacacacacccaatatagcaatgctattgtggggatatatatcagacttgatggttgtccttttgaactctatcaggtgacttgcaaatttcccacagtatgagtcctgcctccccaagggaaaggtcaacactggctttcccatctcccttgcaccaaggcatgtaccctaagcttagaccaccagacataccgtgagagacttgcctttgcaggagaggacaagctagggtttcacagaatccatttatgggcaagagtttagggcacaatcaagaggcttctaggatctcacatccagaaccagtggtgcaagccaggcatggtgtctgtgctgtagtgtggtgacactgagtgttccactggagcagccttcatcatgtgacatcgttccaggctgggaagtcttcacggtcaattctctggccctcccatcggagagcctgtgaattacattatacctttttctgtttaatccagccagaatgggtgtgtgtgtgtgtgtgtgtgtgtgtgtgtgtgtaactgttgctcctcctgtgctaatgttttgttcagccttagaggcctctggcctggcttcattagactcctgactccccagacaaataaccagacttagctgagcagcttccgaatggcaagccccatgtcctctctttctacaacccatgcaggaaggacgctctaaggcctggataactttctcccagtttacttttcctctccccaaactgcattgcaaaaccagccatttctgtccagccaaccacttcatctcccctttctcctcctctctcgcaattcctgtgaaacacacacatacacacacacacacacacacacacacaagcaagagagtgagagaaagagagaaagacagaggcgtgaggtgaggtcagtgactcctaggccataaattctggaataatgactccctggtgaactgactgacacagtgctttctcttttctcataatttgcattataggaatctattcctcatattttgatgcatggagaaatctctttcttttttgcgggggaggggaaataaaactttcttttttctttttttctttttctttttttttttttgagacagtctcgctctgtggcccaggctggaatgcaatggtgcaatcttggctcacttcaacctccgcctctcaggttcaagtgattctcctgcctcagcctcctgagtagctgggattataggcgcgtgccaccatgcctggctaattttttgtatttttagtagagacggggtttcaccacgttgaccaggctggtcttgaactcctgacctcagatgatccacctgcctcagcctcccaaattgctgagattacaggtgtgagccaccgcccccagcagggagataaaattctctgaattcagctttttccaactccttaataggtaacatttactgacctctcactatgtaacaagcaccttacttgtggtgactcagctaagtctcacaacaatcctgtgcagaagaagaacattgttattattatcatccccattttacaggtgagaagactgaggcagaagaatataatgatcgggagacgttgggttacaactaacaggaatccaactcaaataaaacaaacagaaatggaggagaagaaaggagagaaggaggataaaagggaggaggaggaaaagaaaaagaaagaaaaaaagaaatgcactggcctggataagcaaaaaatccaggcagtgactttagctttaggcacatctggatccagggatgcaaacaacaacaacttatttgggcacctgtcctcacctctgactcttttctctgaattgggtttgtttcaggaagcccatccatcccctagtggaggcaaagaggccatagcagctcttgcccacttcctaccagctcagcagactcttccagcactatcctcacacttcccaagggtggctcttgtaggcagggtggggtctcatgcccatcaggaatctggaccgacagaggaagggcaggttcataagaaaagtcagggtgctgagaccaaaagatgggacaagggattctgggtgggctaaaacagggggtccccaacagattaagttgcatagaaagtaagctgtccaaattcaaagccaggtgtgatttcatctgaggtccatgaatggcccaggagatctggatctcgtcctggttttgtcactaattggctggttagaggctcacttgtcccatttgcaaaatagaaataataatacctgtccagtctccgtcactgagttattacagaaatcaaattagaccttgaattcgaaagcactttgaaaagtcagatacacagtactatattattcatttgtatattttccattggttggttgaaatcagcttaaaattctctatattttcccatagaaaatataattcccattcttattttctttttcaaaaactcattatgaaagcaacacatcctataagcaatttgaaaatatagagaagaaaaagaaagaaaagtgaaataaaagaaaaagaaaaggctgggcgcagtggctcacgcctgcaatcccagcactttgggaggctgaggtgggtggatcatgaggtcaggagttcgagaccagcctggccaacacagtgaaacctcgtctctactaaaaatacaaaaaattagccaggcatggtggcgggcgcctgtaatcccagcttcttgggaggctgaggcaggagaatcgcttgaacccgggaggcagaggttgcagtgagcagagatcgtgccattgcactccagcccaggcgacagtgcaagactctgtctcagaaaagaaaaagaaaaagaaaaaatcacccatagtctcaccatccttaaataactattattagcattttggtattctttctttcttatctcttctgtgtatatgcccacatgtatatttttgaaaaaaaaaatatgataatattacaatgctctttcaaaatctgctttttccccatcaataatattgcagtctttcatgtggcactaaatagttttctactacttcaatttaatggcagaatagtttcccattgtttaacaaaatacttcttgttagctatttaactatttgtaatttttccctgttagcaaaaatctacccaatctagaaaattttctagatatgaaattttggattgggttcatgtgcatatgtgtgtgcatgcatgagtgtgtgtgtgtgcttaacttttgctcctcctgtgctaatgttttgttcagcctcagaggcccctggcctggcctcatcagattcctgactccctagacaaataaccagccttagttgagcagcttctgagtgcaagccccatgtcctgtctttctacaacccatgcaggaaggaggctctaaggcctggctaactttctcctagcttacaaattttgcaaaactaaggctttaatatctattgcacttctggaaagtttgcaccaaatcacactctcatgagcagtggccacgtatccattccccatcaccaattatagtaggtatgaccatgttgtaaaactctaacaattgtgataacctttttcttttcaaatttagatctgtggctgcttccccttgattactttttgcaggtggagactcttgtctccttcctggtttgttcaaggtgtcaaaaagttctgagcgttggtggcttggaaaattctatagtttgcagggctaaatcggaagaccaaagttcacattccacacccacatttagaagccatgtgacttttgataatctactcaattttgctgagctacagcgtctatatgtataaaatagagatctatatccagaatgttctgagaattgaaaaaaaaataaaaggaaatctagtcctgacacgggcttgcctagctcacatacctgtgatcaaatgaaaatggatgtgaaagccctttcaagaggcatggtcctcagcacacacaagagatgccttgtgtttgctcattcagcttgctccactgtggtagtctccacaatggctcccagtgaaggatgtttcctggtattcatccccttgtgtgttgtcttctcctcttaaagcaaggctggtcctgtgccctgtttttaaataacagaatgcagtggctgggccagcactttgggaggctgaggcgggcggatcacctcaggtcagtagttcaagataagcctggccgatatggtgaaaccccgtctctacaaaaaatacaaaaattagccaggcatgatggcacgcgcctgtaatcccagctactcgggaggctgaagcaggagaatcgcttgaacctgggaggcagaggttgcactgagccaagatggcgccattgcactccagtctgggaaacaaaagtgaaactccgtctcaaaaataagtaaataaaggctgggcatggtggctcacaccagtaatcccagcactttgggaggccgaggcgggtggatcacctgaagtcaggagttcgagactagcctgaccaacacggagaaaccccgtctctactaaaaatacaaaaaaaaaaaaaaaaaatcagctgggcatggtggtgggtgcctgtaatcccagctacttgggaggctgaggcaggagaatcacttgaacccagaagtcggaggttgcggtgagtggagactgtgccattgcactccagcctgggcaacaacagtgagactccgtctcaaaaataaataaataaataaataaataaataaaagatggcagtcaaagtggtgctgtgtgacttctaaaactaggccttaagactatctgaagaaattgctgagagactcggagaggaagccacccagctgagccccatcaatccacagaaccatgagaggtagtcatacatttttgctttaagccactaggctttggggtgtgttgttacacagtgacggattagcaagacacctgctatgggttggtgcaaaagtaattgcggttttgtcgaagtaatggcaccactgcactccagcctgggtgacagagtgagactccatctcaaacaaacaaacaaacaaacaaacaactataatagtgatgataatccctgctgataaagcatctctcttatttggcttccttaattaaattaaatttcttaaagagtatatatctaactaccctgtaatttttacccattgcctcagccaccatccctgtggtaccttctctgggcatgcaaggcactcaacacttttttttttgagacagagttttgctcttgttgcccaggctggagtgcagtggagcgatctcagctcacagcaaactccacctcccggtcgggtgattctcctgcctcagcctcccaagtagctgggattacatgcatgtgacaccatgcctggctaattttttgtatttttagtagaaatggggtttctccatgttggtcagactggtctcgaactcccaacctcaggtgatctgcccgcctcgcccttccaaagtactgggattacggcgtgaggcactgtgcccggctcaatactttcaatctgggaaatgtagtcttgagtaaagccaggtcttttaaggtattttaagtgggattctaagtcagtttccttaaagaaatgttttacataggttgatgtcattgaccaaatatttactttatttatggccacatttttgaagtctgcattatggcatcttgtgtatccatgtttgtttaagggttgaatcatacttctctttcctcaatgattctaccagaaattcaaaagataaaaagccaggcagctctcagacacaaatgattgaaaccattgtttcaaaaagaccctctttcacttgctctaaaaccatctgctgcgcacctacaatgggccagatcctagtgtagctgtgagagatgggaagggaagacaacctgtgaccttaagaagtctacagtgtgttagggtcagggttggggagagggtggcaggccagtgaaagactaatactgagagagaagggttggggaagagggaggctgcagagaggaatttctctttttagcttcttagttgagtcactctcctgaaaacaaaagtcggattaacaaaagaaaaacaagcagaagtttattaatgtgtgatgtacccattatgtgaaagaggcctcagttttaaaagtattcctttccaccaggcacagtggctcacacctgtaatcctaacacttcaagaggccgaggaggtaggattccttgagccctagagtttgaaaccagcctgggcaatatggcaaaaccctgtctctacaaaaaacacaaaaattagccagacgtggcggtgcacacctgtagtcccagctacttgagaggctgaggtgggaggatcatttgagtccaggagcttgaggctgcagtgagccttgattgtgtcactgcactccagcctgggagtgagaccctgtctcaaaaaaaaaaaaaaaagtatttctctctcaaggcagtggccttgcttaaatagtattttaagaaagagccataaatcctacatagtgacaagacaagagagagagcagttccctttttaaaaggtagggaaaatgtggaaagattgtaaaatctgcttccagattcctctggtatctgctggtgccttctctgggtgcataagtagtatggaagatccattgatccatccacccacaaacccattcattaacccacccacccatccatccaccaacccatccacctgcccatctacccatccatccatccatcaatccatctactcaccaacccacacattcacccacccacacatccattcatctacctattgaaccctccacccatctatccacctacccacccatctatccacccaattatccacccacccatccatccacccacttatctacctgcccactcatccatccagctgcccattcacccacacatccagtttggaaggatttatgtcctgccatcaggcaagtagagggtgaggtagagtgttcccatgttttaagggtctttaatttaacaatcctcaatattttagggagaaatatttttatttccttcaaggccatggaaacccacagaaggggagcctcccctgccacatctgtgaccagacttgctggcctggttggggagtaagtggaagtgaggtggagtggcagtcacccacccagcagccttcccaagaccctccttccctgacatgtgggggtggcagtgtgcggcacacaatacaatgtgttcatcttgctgtttcctttcctgggtcaattgcccttcccagccacctctgcagtaggtgaggccatggggccaagttctgactaataggaatgtgagcagagatgcagcccttcccatctggggcagttaaaaaccggtgcacaaaggccgggcgtggtggctcacgcctgtaatcccagcactctgggaggcagagacaggtggatcacctgaggtcaggagttcgagaccagcctgaccaatgtgatgaaaccccatctctactaaaaatacaaaaaaaaaaaaaaatagccgggcgtggtggcatgtgcctgtaatcccagctactcaggaggctgagacaggagaattgtttgaacccgggaggtggaggttgcagtgagccaatattgcgccattgcactccagcctaggcagtaagagtgaaactccgtgttaaaaaaaaaaaaaaaaaaaactaaaacccaaaaaccggtgcaccatttccatctctctcttcccctgctgcagtgatggtggaggctacaagatgaaagggggccaccagcacacaaagattgtcaggcgagcaagaaataaacctccattgtgttcagccactgagatttcagggcttacttcttaccaaagcctagcctggcccatcctaatacaatatatatccatttctagtcaataacatgtaagggacatgtgctgtggagtttccttataaatatttccatttccaaagaatggactttccaataaaacaaaagaaacatattaggagtgctcattcatgaccgtggcaaggtgtcttcttggttttgaagaaaaatcttattagaatgtgaggcttggaactgtagcagtagagatgtgaacttgggcagagtgatagagatgagagtccagagccctaaccttgtgaaattgctgatctaaactgcgagcatctgattccatacttctttttaaaaagacaataaatgtcgtgatggtgtaagtcttttctgttatttgcatttgaatgcacctgcgttgatactagtttcaggtgaggatgacagatggtgataatggacaagtaaaatgaatggcagttctgggggcaggtcatgtcactttcttctctcacattctctccagctccgtccacactacagtcattgctgaaaaatgaaaataatctgggacagtatttgccatctgcaatgtgctttcacatacattttctggctttagggtgatagaagagtggccacataacgtagggtttgatagctcagcctctagaggcagacacacttgggttcacattctgacttgccaccctttttgctgtctgaccttggacaagctctctaaacatagctttctcatctgtataatggaaccattatagaaactcccatatagtgttactgtgagaataaaatgacatgacacttatgaagtgtttaacatatcacctgggatactaaaaacacttaatacacaggagcccctggaatactggattttgattttctttcctgtttttgagatggaatctcactttgttgctcaggctggaatgcagtggtgcaatcttgactcactgcagcctccacctcctgggttcaaatgattctcctgcctcagcctcctgagtagctgggattacaggcacctgccaccatgcctggctaatttttgtatttttgtagagactgggtttcaccatgttggccaggctggtcttgaactcctgatctcaggttatccacctgccttagcctcccaaagtgttgggattacaggtgtaagtcaccgtgcccaacctggataacatcctgggatgttatgggataggcattaatattcctattttggagttgaggaaactaaaatttgtacagaatttaagagactggctcaaagtcagaaccagaatttgattccaggtctggtagttcccttttcaaagctctttgcacagtaacatgatgtaaaacaagcagtaaaacaaaagaaaaaatttaaattgattgggctgggtgtggtggcttacacctgtaatcctaacacttcgggaggctgaggcggtgggaggattgcatgagcccgcgagttcaagaccagactgggcatcataatgagacctcgtctctacaaaaaaaattttttttaatttgaggtgcttctcttttgagtgccaataaacagaatcacttccgtaaagttcactccttcaagggaagaaattactactgtggcatatatgcaacatattgttaaactcatttaacagatcaaaatttaattaacagattgctaagtttatgctgataataatatactctacaagtttttttcttaatcctctattatcagcttctcctgccccttacctctaccttacaaaactgaagtgaaaatgcttgccttcataatccatgcaaggtagcacatgtgccattatgcataatttgtgaatcaaacagaataatagcatttttcccccaaggcttttcttctccttcattaaaacctttagtttagaggccatgcctgtaatccaagcatttgggaggcaggggatcgcttgaacccaggagtttgagaccagcctgggcaacaaaaccagaccttgtcactacaaataatataaaattagcagtcgggcgcagtggctcacatctgtaatcccagcactttgggaggctgaggaggatggataatgaggtcaggagttcgagaccagcctgaccaacgtggtgaaccccgtctttactaaaaatacaaaaaaattagccgggcgtagtggcgggcgcctgtagtcccagctacttgggaggctgaggcaggagaatggtgtgaacccgggaggcggagcttgcagtgagccgagatcccaccactgcactccagcctgggcgacagagtgagactccgtctcaaaaaaaaaaaaaaaaaaaaagagagtccatttcaaaaaaaaaaattagttgggcacacagtggcacctgcttgtagtcccagctattcaggaggctgagtgggaggatcacttgtgtccaggagtttgaggatgcagtgagctaagattacaccactgcactccagtttgggcagcagagtgagaccatgtctcgaaaaacaaacaaaaaactaaaaaacaaaaacaaaaacctttgtttactatctcctctgatagttcagcattcaaaataatttacttactgtatttttgaagctaagtgactctcaacatcaagttagtagaatatgaagcaacgcccttcactgtatcagaaactggattgatctactgcccttcctctacagcctcatcctttgacatcaaaaagtgaccaataaaatacaaggcatatttttctttaagctctgcctaatgacttacttgcaacctaagtccaggaacaaatactactagtactgaaatagcatttgttttcttaaacctagctcagtcatggccttgtttggaaagcctgtcctctcatccttggggtgactttaatgtggcatttacctcattgtgctgccattgatctgcattgatgtcggcctggccatggctctgctgaagacgatctctgctttactcttctctccatctctagagccttgcacggcaccttgcttgttgcaaatggtttaaatatttgctgaagcaagtgacgagatcagtgcttgatacatcacctgaaagggataagatttcttcagcaaatttacctgtaatacctattaaaacgttttagtaggagatgtgccgctcctggggtgaaatcaatctagtgaacctggcgggcgaggaggtgaaggccataatcaggtgctaactctttctcctcggggcgtaccattccttctttctatggttgcttgatttgggtgacacaacatgaatgtgattctgagtgctcctatctacttctggatcatgggacagtccccagggctcagtcctctctactcctttctttgtcatctctctggattctgtctatgcactctacaaaaacccctagcttggtcttgatctttcacccttatttgggtgttaccacttatttgcagtgttaccatctgcaggcaggatggcagagaggacgccccttggatgtcttgctaatatttcctactcaaccatcaaggccaaaaataattagattcaaaagcagagagcacagcacagaggacaaagaagaagggaatcaagccaataaaccgctaggtttgccttaggaagacgaagcactggggggcttggaaagaacgaagttgctggaattgtgtcatacaagcccagatggtaggggccctaacaaccattgccttcgggagcctgggcctccttccctctcctgcaaatctgctctgtgatcttggaaaagtcactttcctctctgggactccatttcatcagggttaaatgagatcagaggtttccaatcttagtaatgcatcagatgttttggagatgctttggagagcttgttaaaaatgcagcttcttccagatgttctgatttaggagatttgggggaagccaaagaaccaccgttttcaacaagctccatgagtgagggatttcctggacaaaagacactggagtagatgatctcacagttcctttccagccctgacactccctcggttgtctgattaggggagcagagggtagccaggaaatgctggcagccagccagctctctgtccaagaagtgtagccaggaaagaagccagatggcaggtggaaggggagggtcagggagggtggtgttcacggtgtcattgacatcagcactctttaattgaactggacgtggggagacctccggcgtaagactcgggagggaaccaagaaccttccttggttttcctcccaccccagcctgagcgaatcactcttcttttgccccattcagatgctccaaacaaacgttacgaaccgaaaaatgagtttgtcccacagtgttaaaacttttattagatttcatattttaaaattccaacaaacaaacaaacaaaattccagatttctcttggaaaatctaaaaagatcagttacactggactcagagcgccctgggacatcagctggcgctgagcagctgcgccccctttgggtgaaagcatgcatttccagcctctgcgatcgtcagtggccagcctgactcatggtccttaacctgtcaggcccccgtcagagggggcgttagagggggctcccttcaccctgaaatttattctgggataagccagaacagcagagaactgctggatgtaactggacattgagaattatggagtagcctctggtactgaggtttcttgcctatgtggaaaggtattaagaaatcagtggggtctggcgctgtggcccacgcctgtaatctccaggactttgggaggccgaggagggtggatcacgagatcaggagttcgagacaagcctgggcaacatggtgaaaccctgtctctactaaaaatacaaaaaattagccaggcgtggtggcgggtgcctataattccagttactcgggaggctgaggcaggagaatggcctgaacccgggaggcggagattgcagtgagctgagatcgcaccattgcactccagcctgggcgacaagagtgaaactccgtctcaaaaaagaaaaaaaaaaatcagtgaagtgggactgactgctgtgtttacgacaggactgctgtggagaacatcgaccactacaccacatggtttcttctctgtggaggcccagtggaggaatggatttctttagtctcagtaccaacagtgcttctagttgtgtttcttctgaggatcagttgtgtttttaagtcctctaaatggtgtacaggatggtttctttttttctttttctttttctttttttttttatactttaagttctgggttacatgtgcaaaacctgcaaaacctgcagttttgttacataggtatgcaggtgccatggtgatttgctgcagccatcaacccgtcacctacattaggtatttctcctaatgctatccctcccgtagccccccaccctcaacaggccccggtgtgtggtgttcccctccctgtgtccatgtgttctcattgttcaactaccacttatgagtgagaacatgcgatgtttggttttctgatcttgtgatagtttgctgagaatgatggtttccagcttcatctatgtccctgcaaaggacatgaattcatcctttttaatggctgcatagtattccatggtgtatatgtgccacattttcttaatccagtctatcatcgatggacatttgggttggttccaagtctttgctattgtgaatagtgccacaataaacatacatgtgcatgtgtctttattgtagaatgatttataatcctttgggtatatgcccagtaatgggatcactgggtcaaatggtatttctagttctagatccttgaggaattgccacgctgtcttccacaatggttgaactaatttacactcccacaaacagtgtaaaagtgttcctatttttccacaacctctccagcatctgttgtttcctgactttttaatgattgccattctaactggcatgagatgctatctcattgtggttttgatttgcatttctctgatgaccagtgatgatgagcattttttcgtatgtctgttggctgcataaatgtcttcttttgagaagtgtctgttcatatcctttgcccattttttgatggggttgtttgcttttttcttgtaaatttgtttaagttctttatagattctggatattagccctttgtcagatggatagattcaaacttttctcccattctgtaggttgcctgttcactctgatgatagtttcttttgctgtgcagaagctctttagtttaactagatcccatttgtcaattttggcttttgttcccattgcttttcgtgttttagacatgaagtctttgcccatgcctatgtcctgaatggtattgcccaggttgcccaggttttcttctaggatttttatggtcctaggtcttacgtttaagtctttgatccatcttgagttgatttttgtataaggtgtaaggaagaggtccagtttcagttttctgcatatggctagccagttttcccaacaccatttattaaatagggaatcttttcccccattgcttgtgtgtgtcaggtttgtcaaagatcagatggtggtagatgtgtggtgttatttctgaggcctcagttctgttccattggtctatatatctgttttggtaccagtaccatgccattttggttactgtagccttgtagtaaagtttgaagtcaggtagcgtgatgcctccagctttgttcttcttgcccaggattgtcttggcaatgtgggctcttttttggttccatatgaagtttaaagtagttttttccaattctgtaaagaaaatcagtggtagcttgatggggatagcattgaatctataaatttttttggtcagtatggccattttcatgatattgattcttcctatccatgagcatggaatgtttttccatttgtttgtgtcctgtcttatttccttgagcagtggtttgtagttctctttgaagagttccttcacatcccttgtaagttgtattcctaggtattttattttcttagtggcaattgcgaatgggagttcactcatgatttggctctctgtttgtctgttcttggggtataggaatgcttgtgatttttgcacattgattttgtatcctgagactttgctgaagttgcttatcagcttaaggagactttaggctgagatgatggggttttctaaatatacaatcatgtcatctgcaaacagagacaatttgacttccccttttcctaattgaataccctttattgctttctcttgccttattgccctggccagaacttccaatactatgttgaataggagtggtgagagagggcatccttgtcttgtgctggttttcaaagggaatgcttccagtttttgcccattcagtatgatattggctgtgggtttgtcataaatagctcttattagtttgagatacattccatcgatacctagtttattgagagtttttaatgtgaaaggctgttgaattttgttgaaggtcttttctgcatctattgagataatcatgtgttttttgtcattggttctgtttatgtgatggattatgtttattgatttgcgtatgttgaaccagccttacatcccagggatgaagcccacttgatcgtagtggataagctttttgatgtgctgctggattcggtttgccagtattttattgaggattttcgcatcaatgttcatcagggatattggcctaaaattatctttctttttgttgtgtctctgccaggctttggtatcaggatgttgctggcctcataaaatgagttagggaggattccctttttttctgttgattggaatagtttcagaaggaatggtaccaactcctctttgtacctctggtagaatttggctgtgaatccatctggtcctggactttttttggttggtaggctattaattactgcctcaatttcagaacatgttattggtctattcagagattcaacttcttcctggtttagtcttgggagggtgtatgtgtccaggaatttatccatttattctggattttctagtttatttgtgtagagttgtttttattattctctgatagtagtttgcatttccatgggatcggtggtgatacaccctttatcattttttattgtgtctatttgattattctctcttttcttctttattagtcttgctagcggtctatcaattttgttgatcttttcaaaaaaccagctcctggattcattgattttttgaagggtttttttgtgtctctatctccttctgttctgctctgatcttagttatttcttgtcttctgctagcttttgaatttgtttgctcttgtttcttgagttcttttaattgtgatgttagggtgtcaattttagatctttcctgctttctcttgtgggcatttagtgctataaatttctctctacacaccgttttaaatgtgtcccagagcttctggtacgttgtgtctttgttctcattgatttcaaagaacatctttatttctgccttcatttcgttatttacccagtagtcattctgttcagtttccatgtagttgtgcggttttgagtgagattcttaatcctgagttctaatttgattgcactgtggtctgagagacggttgtgatttctgttcttttacatttgctgaggagtgttttacttccaattatgtggtcaattttagaataagtgtgatgtggtactgagaaaaatgtgtattcttttgacttggggtggagagttctgtagatgtttattagttccacttggtccagagctgagttcaactcctggatatcctggttaattttctgtctcgttgatttgtctaatattgacaatggggtgttaaagtctcccattattatcatgtgggagtctaagtctctttgtaggtctctaagaacttgctttatgaatctggttgctcctgtagtgggtgcatatatatttaggatagtcagctcttcttgttgaattgatccttttaccattgtgtaatggccttgtttgtctcttttgatctttgttggtttaaagtctgttttatcagagaccaggattgtagcccctcctttgttttgctttccatttgcttcatagatcttcctctatccctttattttgagcctatgtgtgtttctacacgtgagatgggtctcctgaatacagcacacagatgggtcttgactctttatttttgagacagagtctcactctgtcgcccaggctggagttcagcagcgtgatctcggctcactgcaagctccacatatcgggttcacgccattctcctgcctcagactcctgagtagctgggactacaggaacccaccaccacgccaggctaattttttgtagagatagggtttctccatgttggccaggatggtctcaatctcctgacctcatgatccacccacctcggcctcccaaagtgctgggattacaggcgtgagccaccatgcccagccgggtcttgactgtttatccttttaataggggcatttagcccatttacatttaaggttaatattgttatgtttgaatttgatcctgtgattataatgctagctggttatttcgcccattaattgatgcagtttcttcatagcattgatggtctttacaatttggcatgtttttgcagtggctggtactggttgttcctttccatgtttagtgcttccttcaggagctcttgtaaggcaggcctggtggtgacaaaatctctcagcatttgcttgtctgtaaaggattttatttctccttcacttatgaagcttaatttggctagatatgaaattctgggttgaaaattcttttaagaatgttgaatattggcccccactctcttctggcttttagagtttctgtggagagatcagctgttagtctgatgggcttccctttgagggtaacgtgacctttctctctggctgcccttaacattttttccttcatttcaaccttggtgaatctgaaaagtatgtgtctttgggttgctcttccttacaagtatctttgtggtgttctctgtatttcctgaatttgactgttggcctgccttgctaggttggggaagttctcctggataatatcctgaggagtgttttctaaattggtttcattctccccgtcactttcaggtacaccaatgagacgtagatttggtcttttcacatagtcccatatttcttggaggctttgttcgtttcttttcactcttttttctctgatcttgtcttctcactttatctcatcgatttgatcttcaatcactgatatcctttcttctgcttgattgaatcagctattgaagcttgtgtatgcttcatgaagttcttgtactgtggttttcagctccatcaggtcatttaagctcttctctacactgtttattctagttagccattcgtctaaccttttttcaaggttttttacttccttgcaatggtttagaacatgctcctttagcttggagaagtttattaccgaccttctgaagcctacttctgtcaacttatcaaactcattctccgtccagctttgttcccttgctggcgaggagttgtgttcctttggaagagaagacgtgttctggttttttggaattttcagcctttctgctctggtttctccccatcgttgtggttttatctacctttggtctttgatgttggttacctacggatggggttttggtgtgcatgttctttttgttgatgttgatgctattcctttctgtttgttagttttccttctaacagacaggcccctcagctgcaagtctgttggagtttgctggaggtccactccagaccctgttttcctggatatcactagcagaggctgcagaacagcaaatattgctgcctgatccttcctctggaagcttggtcccagaggggcacccacctgcatgaggtgtctgttggcccctactgggaggtgtctcccagtcaggctacatgggggtcaggaacccacttggggaggcagtctgtctgttatcagagtttgaacgctgtgctgggagagccactgctctcttcagagctgttaggcagggacttttaagtctggagaagctgtctgctgtcttttgttcagatacgccctgcccctagaggtggaatctagagaggcagtaggccttgctgagctgtggggggctccactcagtttgagctcccctgccctttgtttacactttgagcatagaactgcctactcaagcatcagcaatggtggatgcccctccccacaccaagctccagcgtcccaggtcaatcttagactgttgcgctagcagcgagccaggctccatgggcatgggacccactgagccaggcatgggaggggatctccttgtctgacggttgtaaagaccgtgggaaaagcacagtatttgggcaggagtgtactgcttctccaggtccagtcacttatggcttcccttggctaggaaagggaaatcccccaaccccttgcacttcccaggtgaggcgatgccctgccctgcttcagctcgccctccatgggctgcaaccactgtctgatcagtcccaatgagatgaaccaggtacctcagttagaaatgcagaaatcacctgtcttctgtgtcgatctcactgggagctatagaccagagctattcctattcggccatctttgaagcgaccaggatggtttctttgtgccaccatctgcaaagctcagcaccaaactcatggctgtcttggaaaggctccatggcctgcctggggagctacccttgtgagtggctctattttcctttcttagatgtgtatttttcctacttattttttattctatgttagtctaagatttgtgtctttgaagagtcagatctttgatctttgttagaataaaccagagtttaaataaactcctctaccctatatataccttgattatagcactttctacaatgtattatacttacctgtttagatattggtctcttccgctagactgtgaagatcaagctgcattttatctttatcaagctgcttatcgctaatactgagcccagagctttgcatttaataaatgtttgaagaatgaaagtaaagatgttagagaactggcatagtgggaatccaggtaacagatggaggggttgaacaaggcaggccttcttctcagatcagaggggtgcaagagaccagttggtgttttcggtttttctctctaacctaagaaaaattctattactctagttaaggttttattaaggctcatttaaggttatttcactttacacatttcacttaaggttactgagtttggagaatatgtaaggggttttctggcatggtagaaagaagatgggctttggctatggatttgggttggaaacccaggaatgtctttttgttgttgttttttaaatgttagtgggggatttgcttcagttttcttggctgtcaaagtagctagctgggccgggtgcggtggctcacgcctgtaaccccagcactttgggaggccaaggcgggcggatcacctgaggtcaggagtttcagactagcctgaccaacatggagaaaccccgtctctaataaaaatataaaattagccagtcatggtggcacatgcctgtaatcccagctactcgggagactgagacaggagactcgcttgaacccaggaggtggaggtcgcggtgagccaagatcatgccattgcactccagcctgggcaacaagagtgaaactccatctcaaaaaaaaaaaaaaatacaaaaaaacaaaaaatccaagtggctagctgtagcccttgacaaagtaacacataaccacaaatttagcacatagtgggaaactcagaggttttagtttttcccatgaagttctcttctttgaatgtatttttctatcatgtagcccctgcctttaaaacattaagctcttggtgaaagcaatggatcctataactcatttatccttccctcccttctccatttacctccatctgccttctatctgaggacgagagttacgtttgctgatattaaagtcaccaaggaatcaccagtttgtgggtttgttggaggctggacatgcacacacagaatatggctcctagcataaactcctgctcaaatacaacagacttcttaagaaaaaaaataaaataaaataaaaaaggaaaacaaaacaacaacaacagaaaataccaaaaccagtagatggttccagttctggtaatgacagtgtagcttttatcagactaacccactattcaataacaattataaactctggacaaaatatgaaaaacaactgttgatggcaatgaagaacaaccaaaggcaggcagccactggaatggccatggctcttgaaagaagggaagcaaagtgagttctatatttaactggttttcccccatgagtattatttagtcctgacagtgcatggtgaaatacagcctaaacaaatgtggcaatttgagtctccaagaacacaactgtatattctcaaaaggaaaataatccagaatttctgtaatgtatcatctacaatgtcactcctatactaaaaaatttaatagacatgtatagaaacacaaaaaatgtgacccataatgagaaaaattagccaataaaaatagacacatagatgacctagatgttggaattagcatctatgttaactgttttaagctgctatgaatatgctaaagaatttacaggaagaaatggacagaatgggtgaatagagaactcagaagagaaatgggaactctagtaaaagaagagagatcctagatccatgctatccaacatggtagcccttagccacgacagccacaatgtggctattgagcatttcaagtgtggttagtccaaattgagatgtgcagtaattttgaaatactaaatttcaaagatttagcataaaatagctcattaatagtttttatattgattatatgttaagtgataatatttgggatatgtatagttaaatgaaacatattattaaaattaactacaccaattattttactttttttattttttgtagagatggaggggtctccttgctgtccaggccaggctcgaactcctagcttcaagtgatcctcctcccttggcctcccaaactgctgggattacaggtatgagccactgcacctggctattttactacttttgttgttgttttacttttcttttctttttttttttttttttttgagacagggtgtcactctgtcactcaggctggagtgcagtggcatgatcttgactcactgcaatttccagctcctgggctcaagtgatcctctcaccttagcctcctgagtagctgggactacaggcatgcaccaccattcccagttaattttttttttctttcttttttttttttttggtacaaagagtttcgccatgtttcccaggctggtctcaaactcctgggctcaagtgatctgtctgctttggcgtcccaaagtactgggattacagaagtgagccaccatcccttgtctattttagtattttttaatgtggctactggaaaacaaaattacatgaggcttgcatatttccattggacagcactgttctagaactgtaaaatacaatatttgaattcagagaggtgaaaatactaaaattaattaataaattaataagattccaggatgctactaggtcaatatacaaaaatcagttgcatttctaaccctagcaacaaacaattagaaaataattttttttttttgagacagagtctcactctgttgcccaggctggagtgcagtggcatgatcttggctcactgcaacctctacttcctgggttcaagtgattcttgtgcctcagcctttccagtagctagaattacaggtgcacaccaccactcctggctaatttttgtattttcagtagagatgggttttcaccatgttggccaggctggtctcgaactcctgacctcgagagatccacccacctcggcctcccaaagtgctgggattacaggtgtaagccactgcgcctggctggaaaataaatttttaaaaggccatttataatagcataaaactcagactttcaagaataaacttaataaaaggctaagctctatgcactgaaagctgtaaacattgctgagagcagctaaaaaagaactaaatgaagaaatgtttctggattgtgcagatgtcaatttttgagaaattaatctatagatatatactatcccaatggaaattccaggaaacttttgtaaaaattgacaagctgattttaaaatgtatatgaaaatggaaatgtcctatattagtcaagacattcttgaagaataaagttgggggacttaccctgatttcaagacacaataacactccagcattagtcttattaattttgttaatttattgtggcatttagtaatttagttaattagtgtagttattaatttagcatgtgttaagataaatagggccaggtgcggtgactcacacctgtaatcccaacaatttgggaggccaaggcaggagaattgcatttgcccaggagtttgagaccagactggacaacacaatgagaccatgtctctataaaaaattaaaaatattagcaaggcatggtggcatatgcttgcagtcctaggtacttgggaggctgaggcaggaggatcacttgagcccaggagtttaagactgcagtgagctatgactgtaccactgcactccagcctgggtgacagaggggaccctgtctctaaaaataaatacataaataaaaataaaaataaattagattgcctctgggaggaggggattctggactagaagtaattaaagaaactttcagaaatgttggtagagtctataactttatttggctgatgattacaatgatatatatatacatctgtcaaaactcattgatctgtacattttattttatgtaaaataattgtgtaataaaatatgtaacataattttttaataaaaagcaacagagtggagtaatcctggcatggcagccccagcatgttggttgggaatgtaactgtacaatggagagagatgaactctgcgacacactgagctgagtttatatcctttctttactacttatcagtggtgaccttgggcaaattgttcactctctgcaagccttagttttctcatctgaaaaatggtgctggtgctagcactttacttcacagatttgcaaggaagagctaatgagtataagtagttaaagtatctagcatggtttctggtagtttacagtcccacagaagaaaacatgccctaagggtaagcggttatctgccaagaaaaaaggtggacagtgaagggggaaaaaaaagtcttcaattatgagaaccttgaagattttcaggtcttgaagatgccttttattgacccttgctttggtaacatgatctgggaaagtagaatccttcctgctctaaatcatctactcttcggaaatatataaattccccctctacagtagcagagctccacaagaagcctgcccaatttttccaaagttatttttttgatattggtgcccagatgtaggtggctaaagtgagcagggaaagctaagtacagccctccagtgaaacacagaaagtacaagagtcttgaaacaaactccagatcaccctgtggctctgggaatcaaacttcagaggtcatcaggctggcgcttctgttatggtttatgtcctggccagttatcccatgagaccacatctcttgttccatacaggcacggaccaaaggcctgggttctgcttgactccactgctcactggatgaccaagacatgttccacatctacaaactagaggtaatactggcttgctttaaagttgtaaggggagcaacttccttatggcatatatttatgatttaatactatggtctttgctataacattgtggatcggaataagaactatgcggctgaatatgtccatatcttttgttcaactgtagttgaagatcttgtgagcctgggattaacagtaatggcaaaattttatttccatcaacagatctgtataatttctatggttagaaaaaaaaaccctatataatttggcatgcttattgttttgcctctgtaacaaataactcaaattcatatttattgataaagagttatttatttaagaaagatgcgtgaaagcatctactccttctaactccttcacatagttttcggttctgatgtatccttaactgccttatcatcttacactgagtgttaatctgtaacccctgataagtccttgggggtaagaatcttagaatatctatttattgagttgtaatggtgctttatatattctggatactagacccttatcagatacatggtttgaaaatattttttctctttctgttggttgtattttcacttttttgataatgtgctttgaattatgtcttaaatattttattgtgaaaatcttgaattttgattatgtccaacacatttgtttttttaaacaagaatcttagaatatctatatatacacgaatacactagacatattaaaacattaaataattttattcttttctcatttacagtagcccagtggtaagcatgttagaaaacctgaagaaatttaaaagtttttggtttacaaaaagcatgtataaaaatacctgttcagacaaacaaagatctgatcattacattgcccagctttaagaatgccaaaaataactaaaatactgtcaatcaaatgagagggctacatgggtttattaaagtttattttaacaattttagctaagcagaatgtgctaatgtaattcaagttacagttactgccagataacataagagaaaacattgtgtgtggccacttaagattatgcctcaaacagatactgtttcgtgcgcagaacagagttggggaacacagctgggttaagtttcaatggtaagcagcaataaagatcaagaaaatccccaacttttctaataaccgctatacaatatgaaaaaaaaaatagtatctatcaccacctcttaacaatggacatcaaaattaggattgtaggttttctaagtgcttggataaaaaatgcgaacacagttaagatccttggttaattatctttgatttttcaaaacccccaaaacataaaatattttgcttgctggtgcattaacccattagcaataacctgagctatcttttcctcaccaagtattttgacagtgcaaaatgttagtagtctcagtagacgctgctcaccacattctgtcattgcagcctgatgatgaaccatgtcagggaggtatcactgccaagagaaatgcacagcagcctaaaagatacatgattcactagcatgctggagtgtcaaaggtagataggcagttttatgcaaaatgtgaaatatataattcaaaatgcccacaagctaacagaaaatacagtattgaatcttttaatatcaaaacaaatacttattttgctactttgaacagtattccacatggacaagcagatcgcgatgctcagtggctggatactgtatattgcacttgggacattccaccaggctttcattgagtgcagcagtgggactttttggtgaggcggcaactttttctctgttttcagtctctccttggaaagtgactaatggctctgtgatggcaaactcatgaagctgtttctgaaaaataagtttcaaataatagaatttgtaaatagggccaatgttcagctttttttttttctttttttgaggcagtctcactctgtcacccaggccagagtgtagtggcacaaacatggctcactgcagcctcgacctcccaggcttaagcaatcctctcacctcagcctcctaagtagctgggactacaggcacatgtcaccacgtccagataatatttctattttttgtagaaatagaaaattctacaaaaaattaattctatgttgcccaggctggtctcaaactcctaagctcaagtgatctgcccacctcagcctcccgaagtgttgggattacaggcatgaaccactgcacccagcctgttcagcaattttaactgttccataagtattatagctgcttcagcactgtagacagattttcttttgaatttcagctcatcagtattatgagggtaatatatgaggtagttgtgaatttatccagataactactgtaattatccaaattacccagatatgggagttgggtgtatatatgaatatgttttattaggacacagagtcgaatattaggtaggcctatatgcaaggctgattaaatttgctagttttgtaaaacagaggcaacgtcagcaataaagtactacatggaaattaaaggcagcaagcaattttagcagctcaaacagcttatacacagaaatgactaagatattctatcatacctttgagactttccttttttgtgttttttttctaagaacttggagtagttaaaaatgagtattttacagcacagtgaagagggtggatagcaggaacaaagtacaggaaaattacaaattcttttttttttttaattatactttaagttttagggtacatgtgcacaatgtgcaggtttgttacatatgtatacatgtgccatgttggtgtgctgcacccattaactcatcatttacattgggtatatctcctaatgctatccctccccactccccccaccccacaacaggtcctggggtgtgatgtcccccttcctgtgtccaagtgttctcattgttcaaatcccacctatgagtgagaacatgcggtgtttgattttttgtccttgtgatagtttgctgagaatgatggtttccagcttcatccgtgtccctacaaaggacatgaactcatcatttttatggctgcatagtattccatggtgtatatgtgccacattttcttaatccagtctatcgttgttggacatttgggttggttccaagtctttgctattgtgaatagtgccacaataaacatacgtgtgcatgtgtctttatagcagcatgatttatactcctttgggtatatacccagtaatgggatggctgggtcaaatggtatttctagttctagatcctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttttcatgtgtcttttggctgcataaatgtcttcttttgagaagtgtctattcatatccttcacccactttttgatggggttgtttttttcttttaaatttgtttaagttctttgtagattctggatattagccctttgtaggttgagtagattgcaaaaattttctcccattctgtaggatgcctgttcactctgatggtagtttcttttgctgtgcagaagctctttagtttaattagatcccatttgtcaattttggcttttgttgccattgcttttggtgttttagacatgaagtccttgcccatacctatgtcctgaatggtattgcctaggttttcttctagggtttttatggttttaggtctaacatgtaaatctttaatccatcttgaattaatttttgtataaggtgtaaggaagggatccagtttcagctttctacatatggctagccagttttcccagcaccatttattaaatagggaatcctttccccatttcttgttgttgtcaggtttgtcaaagatcaggtagttgtagatgtgtggcattatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcgttgaatctataaattaccttgggcagtatggccattttcacaatagtgattcttcctatccatgagcatggaatgttcttccatttgtttgtatcctcttttattttgttgagcagtggtttgtagttgtccttgaagaggtccttcacatcccttgtaagttggatttctaggtattttattctctttgaagcaattgtgaatgagagttcactcatgatttggctctctgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcctcttttcttaattgaataccctttatttccttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcataaatagctcttattattttgagatatgtcccatcaatacctaatttattgagagtttttagcatgaagggctgttgaattttgtcaaaggccttttctgcatctattgagataatcatgtggtttttgtcgttggttctgtttatatgctggattacgtttattgatttgcgtatgttgaaccagccttgcatcccagggatgatgcccacttgatcatgatggataagctttttgatgtgttgctggatttggtttgccagtattttattgaggatttttgcatcgatgttcatcagggatattggtctaaaattctctttttttgttgtgtctctgccagtctttggtatcaggatgatgctggcctcataaaatgagttagggaggactccctttttttctattgtttggaatagtttcagaaggaatggtatcagctcctccttgtacctctggtagaattcggctgtgaatctgtctggtcctggactctttttggttggtaagctattaattattgcctcaatttcagagcctgttattgatctattcagagattcaacttcttcctggtttagtcttgggagggtgtatgtgtcgaggaatttatccatttcttctagattttctagtttatttgcgtagaggtgtttatagtattctctgatggtagtttgtatttctgtgggatcggtgtgatatcccctttatcattttttattgtgtctatttgattcttctctcttttcttctttattagtcttgctagcggtctatcaattttgttgatcttttcaaaaaaccagctcctggattcattgattttttgaaagtttttttgtgtctctatctccttcagttctgctctgatcttagttatttcttgccttctgctagcttttgaatgggtttgctcttgcttctctagttcttttaattgtgacgttagggtgtcagttttagatctttcctgctttctcttgtgggcatttagtgctataaatttccctctacacactgctttaaatgtgtcccagagattctggtatgttgcatctttgttctcattggtttcaaagaacatctttatttctgccttcattttgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgttttacttccaactatgtggtcaattttggaataagtgcggtgtggtgctgagaagaatgtatattctgttgatttgaggtggagagttctgtagatgtctattaggtccgcttggtgcagagctgagttcaattcctggatatccttgttaactttctgtctcgtggatctgtctcatgttgacagtggggtgttaaagtctcccattattatcgtgtgggagtctaagtctctttttaggtctctaaggacttgctttatgaatctgggtgctcctgtattgggtgcatatatatttaggatagttagctcttgttgttgaattgatccctttaccattatgtaatgtccttctttgtctgttttgatctttgttggtttaaagtctgttttatcagagattaggattgcaacccctgcctttttttgttttctatttgcttggtagatcttcctcaatccctttgttttgagcctatgtgtgtcactgcatgtgagatgggtttcctgaatacagcacactgatgggtcttgactctttatccaaattgccagtctgtgtcttttaattgtagcatttagcccatttacatttaaggttaatattgttatgtgtgaatttgaccctgtcattatgatgttagctggttattttgctctttacttgatgcagttttttcctagcctcgatggtctttacaatttggcatgtttttgcagtggctggtactggttgttcctttccacgtttagtgcttcctttaggagctcttgtagggcaggcctggtggtgacaaaatctctcagcatttgcttgtctgtaaaggattttatttttccttcacttatgaagcttactctggctggatatgaaattctgggttgaaaattcttttctttaagaatgttgaatattgaccccccactctcttctggcttgtacagtttctgctgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctagactggggaagttctcctggataatatcctgcagagtgttttccaatttggttgcattctcctcgtcactttcaggtacaccagtcagacatagatttggtcttttcacacagtcccatatttcttggaggctttgttcgtttctttttatccttttttctcaaaacttctcttctcacttcatttcattcatttgatcttccatcattgatactcattcttccagttgatcaaatcggctactgaggcttgtgcattcgtcatgttgttctcgtgctgtgattttcagctccatctggtcctttaaggacttctctgcattggttattctagttagccattcatctaatcttttttcaaggttttcaacttctttgccacgggttcgaacttcctcctttagctcagagaagtttgatcatctgaagccttcttctctcaactcttcattctccatccagctttgttccattgctggtgaggagctgcgttcctttggaggaggagaggcactctgatttttagaattttcagtttttctgctgttttttccccatctttgtggttttatctacctttggtctttgatgatggtgacatacagatggggttttggtgtggatgtcctttctgtttgttagttttccttctaacagtcaggaccctcagatgcaggtcttttggagtttgccagaggtccactccagaccctgtttgcctgggtatcagcagcggaggctgcagaacagcgaatattggtgaacagcaaatgttgctgcctgattgctcctctggaagttttgtctcagaggggtacccggctgtgtgaggtgtcagtctgcccctactggggggtgcctcccagttaggctacacgggggtcagggacccacttgtagaggcagtctgtccgttctcagatctcaagctgcgtgctgggagaaccactactgtcttccaatctgtcagacagggacatttaagtctgcagaggtttctgctgccttttgtttggctatgccctgcccccagagttggagtctacagaggcaggcaggcctccttgagctgcggtgggctccacccagttcgagcttcccggccgctttgtttacttactcgagcctcagcaatggcgggcacccctcccccagcctcactgctaccttgcagtttgatctcagactgctgtggtagcaatgagcaaggctccgtaggtgtaggaccctccaagccaggcgtgggatataatctcctggtgtgctgtttgctaagaccgtcggaatagcgcagtattagggtgggaatgacctgattttccaggtgccgtcagtcacccctttccttggctagaaaagggaattccctgaccccttgcgcttcctgggtgaggcgatgcctcaccctgcttcggttcacgctcggtgcgctgcatccactgtctgacagtccccactgagatgaacccagtacctcagttggaaatgcagaaatcatccgtcttctgtgtcgctcacgctgggagctgtagactggagctgttcctattcagccatcttggaaccgcccccacaaaattacaaattcttttgcataccctctgctccctaagctttgaatggtcaataacaaaaatgaattataaattttcatttcaaatattataaatgggtaaaatcaattatatacttaagaacagagccaaaaatatattttctttcttttattcatacagaagttacaagtgatttttacttttatcattgtttttttttcctcctttgaaaactgaggaatcatatttgtaacatttcactgtctccaagtattctatagtagtagaataaaatttaaaatatgtactagtgggacagacatatattcaaatgcagacccccaacaagtttggtccaaaagcttattagtaaggtgagaataagtaagtgaaaaaccatttcatcatagaaacaatattatttaaaaggttcatgttttaaaagattatgttttcagagtgactcacacaaacctcataatacatctaaaaagcatattaacagtaatagtccattatccctaaaaacagcatttttttctttttcttttttttttttttttgagacagagtcttgctctgctgcccaggctggagtgcagtggctcagtctcagcccactgcaacctctgcatcccgggttcaagtgattctcctgcctcggcctcccaagtagctgaggttacaggcacccgccaccacgcccggctaattttttgtatttttagtagagacagggtttcaccatgttggtcaggctggtctccaactcctgacctcatgatccgcctgccttggcctcccaaagcgctgggattaaaggtataagccatcgtgcccagcctttctttcttttttaatagataaacacaatttcagttcaggattctgtgactaccctctattctacccttttgaccccagctcaggcactatttagtgcctccagcatcacagcagctggggtagttgggggaatgtttccagatgtgatcatgtccctctttcatgtcctctgaattgatgctcaaagggcagttgcttcaaatgaggcagaggctctacctactgatttgagatacagctagctgtgtgttaagctgtatcctcctaagttcggaactgatttggtatataaatggaagacgaagacaaattttagtttaatcattccagactcaccaaggattccaactgtgttatttgatttcttgcttttcggagctccttaagaattacatgcaattgatgctgcacatgttgacggtcgagtttttcattttcaaagtctaaagtacatgcctgcatctggaaaaggcccagaacaagaccattacagctgatacagactgtctagttctcttgactggatgctcacatttttttattagcacatgaagaaaatatttattgtaccatcgtagcaagaattcacctaagcaccatgaaatgttaataaacgaggcagcttatggctgaggatttggtttatccaaggagcaaagccaacgctgaggtataggtgaatgaagagcagcttaagaagttgttgattagaattactcctccctatccaccttttttaagggggaagaaggagaagggaaagagatagctattccctggtttggaatatactaaaaatctctgctttacaccatttataatacattctgagactaaatggtgtctctccaagttctgcttgaagttataaggtagccctacttaggagacattgttaggctaggagctacagccactggggaagagcaaaatttgccaaggccaacatctacctgtcaagaaaactgccatcacacctcaagaatctgtttagcctaaggtcagcaacaggaataagtggctagcagagtctcttgaaatatcttttttattgaagaagaaagacttttattgaagtcttttaaagacacttttcacaactttcaaacagttctccatagaacagcataaacatgaggaaaaactgcattttctaacaggcagaattgaatttagaagcaacccgaatgagtacctgttgttccaacagagctacccttgtttgttcttcttgctgctttagcagagatgtgtaaagaaactggacctgtaggacataaagagaaccaatgctgtcacatccaaccttttccggcttgacctgggatgcacggaaagctcacatcacaagtctcacatctctaaccaggacaacacctgctagtcaggggtgaatcattccagctggccatctgatggctatctatgccagcagctaagcagtataccaccgcccttgccgagagttccctgaggcacacagactgaatgctgataaacagcactgaactctgcagcagccatgccccctttcctggaggttctgacacttctgagtaggataacatgggtggcagtgctgggcccttagccagagctgaagcaaaatttaatcagcagacttaatctctccctagtatcactgctcatacctgtagacagaagaagtgtgagtggtaaagactaagatggcaggctggacacagtggcttgcacctgtaatcccagcactttgggaggccaaggcaggtggatcacatgaggtcaggagtttgagaccagcctggccaacatggtgaaaccccatctctactaaaaatataaaaattggccagccgtggtggtgggcacctgtaatcccagctactcaggaggctgaggcacaagaatcacttgaagacaggaggtggaggttacagtgagctgagattacgccattgcattccagcctgggcgacagagcaagaccctgtctcagaaaaaaaaaaagaaaaaaaagactaagatggcaaatgttatagatggacttgttactgtcccatcaccagcaccctcaacttttgtaggactgttaaaaattattattaaaatagtagcaataactagcatttacctcgcttagtttacaaagcacttttaccttctctcaactgacgctcaccaaagccctatatggcaagcagaggttattattaatttgacaagggaataaccagtgagtagtcagagaagttaggtgatttgcctaaggccatatatcctggactagagactaggcatggattccaaataatgttccttccatgatgccaggctgcaaagcaaaatctaaattaaagagttccatcaaagtactgttcaattccaataatcctaacgtagtaactccaacattattatgataccatagcataaggctatgagcataacaagaacatggaagatgccatgtgaattcacttgagcacatatcatcaccattaagatgccagtctaggaatcagcctcgattcctctcattacttcacttcttcttttggcttctcacatatactgacctcctcctcactcagagcctttgtgtgtacaatttcctccattgagaggaaaagtcacccacctcactgggtcctcctcatcatcaggtctttgtccaaatgccatctcctcagagaggcctccactggtccccaatttccctttgtcatgtcaccctgttgcattttctttagtttccttatttattgtttatggtctgtttctgttctggaatataactcccatgaggggcaggaatttgttttgtccctagccagttctctagtggtcaaatagtccctgacacttagaaagtgttcggtgaacactctgaattatggatctggttaagtttacctgagataagagctcttcggatctcttcttctcttcttcaagttttcccctagcaatatcattctcttccctgagtttttgtatcttctctgttttatgcctatcatcttccagatgttgcacatctgcccttctttgtgaatacaacagctgatttaaattgtgaacttctttttgggtttcttcatattttcttcgaaattcactcagttcaaaactcagctgagttatggtttgtcgttcaacctcaagatctttttttgcacttgccaagagatcgttgtaacatttctgcttctcttcttgaagataacctatgacaaacaacattacggcacaactcactttataaaataaataatattcctgaaaagagaaacatcaaacatctaaatgaatcacactatttccttagtttacaacatgaaaagtcaagagatagggactatggttgatatttgatgaaataaaaaacaagttcaggtatactatttgaagttataaaactcacaaatagaagaactaaaaacagtaacatctattctgttgggagggaaagtctcaagaagttcaatcaacaaataggaacacaagctcattatttatatgtggagataactatcaaaattaaaaatagaaatattaagagcagttgcctgatgggaggaagaaacggggattgggatgggaaagacagggcaaggtccttcttaactattacattattctaacaagtgcttatattgctttgataaaacagacacacagagaaagagagagagagagagagagaactgtattaccaaagaaaagaaattagacttagcccataactaaaatcctgcttttacataagcacatattttatagaagcaacttagtgccattagggctgacagctttgaagtgcctccagagacatttatagtttctttttagcattagctttgttttaagtattcaaatatgattctccaatcttatgagtcttgttcccctttctttagacttctctataaaattcaaggctttggtcccctccaaactgtcagtcttttaaggagagcattgcatggagtttctcatttttcttttcttagcttgtcatctagaattgctaaacctatttcttcatctgtaaaatgagaatactgacctttcctgccccgcctcttagggttgctctaaaactccactaagatctatgtaagggaaactgcaaagtgcttggcaaaaagacagcatcgtgaatgagaaatttcatctcaattctatacctgaagttcaaatgatttaaggatcatctaaaaaaggcattctttctcctggggttgatatgaataagtgctgaagggaagcaaagtgaaaagagaattgtgacaaggccaactctgggggaagtaaaagctggagaaggactttgaaaaaggggaaggacattcatgggtagagagaactgaatgtgatttcagaactgccaaagatcacccattagcctgtgttggtactttcttttgatctgaaaacgttaggaaataaaacttgcaaaaatggtatttcttacttcagggctataagacttgctcttattttactttctaacacatatctataaaaatctaaatttgatgaatcattccttttggaaaatgtcaggcctatccctagagaacatttttataccagtcagtaccttctgattcaggcttttttgtctgctgtgggagtgaatgagcagctgtttccgttttcttttccaactcaaagatctttgctaaaagtccttttacatagacttcccgctgctgatcatacacgagccactgctgatttttctccagagccttaatgggaagatgaaagaaaatcaacagtaaaataaaaaaacaaaatcttaaaatgggcaagagagtccaagtgatgtagtcttttccaacaaaaactctatggctcatagactaattctgggcaaccattctatgttacatgccttcagaatacataacaacatgacaccatcgtagtttatgtgggattaagttcatttgtttgcttttttcagtacacaacttgctttgtgtgtgcgtatatgtcattctctgtaaactaaaacacgttttatgacagacatggagatgaactgctcagaatcccccttcaagagccctgcccagctggctgggtgcggtggctctcgcctgtaatcccagcactttgagaggccgagggtggtggatcacctgaggtcaggagttcaagaccagcctggccaacatggtgaaaccctgtctctaataaaaatacaaaaattagccaggcatggtggcgcgtgcctgtaatcctaactactcaggaggctgaggcaggagaatcacttgaacccgggaggtggaggtggcagtgagctgagatcatgcccctgcactccagcctggaaactccagtgaaactgcgtctctcaaaaaaacaaacaaaaaaaagaggatctctgcccagctgcatggtgagtgattagctgattagctgacagcctccatctgttaattccttcaagtccctgtcagcttttgagctgagctggattggccccagccaacaactgaacaagtgcctaactattgctgcccaacgaggactctgcttttcagcactctctgctctggagccccccatggggtgacagagaccttgttaggttttcatcatggtctgatggtctccctggcataactacttcctttttccttgcacagatcttgctccccaataaaccgtctgcactcctaacatcatctcagtgtcttctttagaggatcaaacttaacagctaccttctctctttactaccaactttcatcctttatatgatcttttataacccaattaaaaactccaagctgccgtcactcacctgtttgtataggggtttcatacttacagtgagttgaataatgtcccccaaaattcatgtccacttgaaacctcagaatatgaccttattcagaaatggggtctgtgggctgggcagtggctcacacctgtaatcccagcactttgggaggccgaggcgggcggattacttgaggccaggagttcaagaccagcctggccaacatggcaaaaccctgtctctattttttagccgggcatggtggcacgtacctgcagtcccagctacttgggaggctgaggtagcagatcacttgaatgcgggaggcggaggttgcagtgagccaagattgcgccactgcactccaacctagacaatagagtgagaccccgtctcaaaaaaaaaaaaggggagggggaggctttgcagatgcaattagttaaaatgaggccatactggagtagggtgagccctaaatccaatgactagtatccttataaaaaggagcagacacacagatatacatagagaatgaggccatgtgaagacagaagctttgtatggcagggattgtaaccagttcatttcacaccagaggacttgctataaatccagagctcatagtaatctgaacttcgaagaacctataacagtatcagcaaagctcattttttcaagagtggaatacagatttctgattactatttggagaacaacacagtagctcttaaaatgatctattatgcatagataaaattcttctatttaatttcaatctgacaatacaatatagtgtttccttttatagcagccactctttccagacctctagttccacaatgaagaggacataaggagcttaaaggttttgggtgtctatcagggcaactgctttccggtaagaatttccatcctttaaagacattgattgagtcccatatccagaaagatctacatgtatggaaactcttattaagtctagagagtttctctaagctttgttaggctctttctactagcaccctacaaactcttgagcaaagctcctgggtatggcacttaaaggattttcagtgtctgtttgctatagaattagcaaatgaattaggaagacagaaacagtctctaaaatcaaagacttagcccaggagcctcagccactttaccagacacttttctctctgcatccattagggaacagtagtcctctttacatggcttaagagtccatttgtcaagtggagatattgtatatccattttgtattatatatcgtcaatagtgtaaagctctgtggatggctgttttcactgtagtaatttgatttttgatttaaagagtctgtcttattgaaacttcgtggtagatatatgattgttcaatgtattttcttttaacttttgtgtatgtttgacatttttcgtaataaaaattgggaaaaataatcataaaagttgggaaaaataatcagtgaacttagtacagttgagaagattgctaggattcttggcctatcttaaaacaggctgcagtagtcactctcttattcagctccactgccatccccagtgaggttcttactcagaacctatgcatctttcaaaagaaaggactcatgagaaacccaggatcagatttaaatttacttgataagagaggaagcactgtatgactcacaatgcacatgtatatccaaatacctataaattatagtgtgttagatactaaagatacctaattttatactaaattttacatttgtccacatttaagtagtattttaatacaaataatttaagtcaaaattaaatggtcatgaaatttttttttttttttttttttttgagacggagtttcactcttgttgcccaggctggagtgcaatggtgccatcttggctcactgcaacctccacctcccgggttcaagcgattctcttgcctcagcctcccgagtagctgggattacaggcatgcgccaccacacccagctaattttgtatttttagtagagatggggtttcaccatgttggtctcaactcctgacctcaggtgatctgcccgccttggcctcccaaagtgctgggattgcaggcatgagccactgagcccggccaattttttttttttttgaaacggagtctcgctctgtggccccggctggaatacagtggcatgatttcagctcactggaaactctgcctcccgggttccagcaattctcctgcctcagcctcccgagtagctgggattacaggcgtgtaccaccacgcccagcttttttgtatttttattagagacggggtatcaccatgttggcccagctggtctcgaactcctgatctcaggtgatctgcccttcttgtcctcccaaaatgctggaattacagacgtgagccactgcgccagcccaattttattttatttattttatttttcttttcttttaaaggaaccagctgggtgcagtggctcacgcctgtaatcccagcactttgggaggccgaggcgggcatatcacaaggtcaggagttcgagaccagcctggccaatatggtgaaaccccgtctctactaaaaatacaaaacattagccaggtatggtggcgggcgccagtggtcccagctactccggacgctgaggcaagagaatcacttgagcccaggaggtggaggttgcagtgagttgagattgtgccactgcactccagcctgggcaacggagcgaaactccatctcaaaaaaataaattaattaattaaaaaaaaaggaaccatacatcacttaagtatgagaaacaaaaatacatgttagttgaagattcaaggggtagtattctaaaaggccacatgatggcgatgttccctcaataaacatttccttatgccacctcttctcactgtgtgcatcggctttctatcagtatcaatacacggagttgatagctatcataaatattgattgtattagttttgagtttttagagtcaaacatcattgcattagatatgccttccagctttgtgtcatctatacgtttgttaggcatgcatttaacaatttcctccaagttaccaataaaaatgtagaacaaaagtgggcaaaataacatgtcctgtggagtccgggcatggtggctcacgcctgtaatcccagcactttgggaggctgaggcaggcagatcacgaggtcaggagttcaagaccagcctggccaacatggtgaaaccccgtctctactaaaaataaaaaaaaattagccaggcgcaatggcaggtgcctgtaatcccagctactctggaggctgaggcagaagaatcgcttgaaccagggaggcagaggttgcagtgagctgagaccgtgccactgcactacagcctcggcgacagagtgagactctgtctcaaaaaaaaaaaaaaaaaaagtcctgtggaatgctataaaggtcttcgcccaggtttgacaagaatccactaaatattctgtagacaaaaattccaaccaacgtagattaaaatgttagcctatactggaggaataaaaaatgtgggtcaattgacaaaactgcagtaggaatggtagattatagaagtattgtatccatgttaaatttattaaagttgctatctgtgctatagttgtgggcaagagtatcctcgttcttaagaaatacacattgaagtctacggccataccaccctgaacgcgcctgatcttggctgatcttggaagctaagcagcgttgagtctgtttagtacttggatgggagaacaaacacacattgaagtatatgggtttaaacggctgtggatatgtacaattcattctcaaatggttcagaaaaaaatactacatgtatatgtgtgtgggtgagggttgaaagaggaaaaacagagtgcaaaatggggtaacatgttaacaacggttgaattttagtaaaggggatatgggcgttatatgttattatatgttatcatactcattcttgtaacttttctgttaatttgaatgtttgcagacaaaataattttaaaacaattattatttatcttccctaagttctatgcttaaaattcggatatttgaatttaagagcaagaaacgcctattaaaactgtcttttggctatttggtttgtctagtttatactaacataatgcttaaataaatactaaaagtactgacatttgacaatgcttacgacattaactctacgtaattatttcaactgtcggccagagcgaaatggtaactgaacaatgatacaactgggcctaaagaagctgtacgtagcttttagggcttatttaaatataacaaatactaattctgaaaatacgtgggtaagcttctacaggaagtttctgcgaactttgagagggtgatggaactagaactgctgagctctcaaaagccaaataatgtgccagtgtcggtgctgcaagaagtgagatgtctctttccatgttccctaagtcctccaactacaattttccccctggtctcaaagatttgctgaaattccaaagggaaaaccagagctaaaccacttcttgctcctcaaatataagttctggctgggtgtaatgactcacacctgtaatcccagcactttgggaggctgaggcaggtgggtcatctgaggtcaggagttggagaccagcctggccaacatggcgaaaccctgtctctactaaaagtacaaaaatcagctgggcatggtggcacgcacctgtaatccctgttactcaggaggctgaggcatgagaatcacttgaaaccaggagacggaggttgcaatgagccaagatcgcgccactgcactccaacctgagtgacagagtgagactccatctcaaaataataataataataataataataataataatgttaatggttctcaaagcgtggtccaagggccagcagcagcagcagctaggagtttactggaaatgcagaaaactcaggcactaccccagacctagtatattagagtctgtgaatcttgctcagtctagaccaccatttgtagaagagttgggttaaattttaccccatttgtataaacgcctttctaagacagaggagacaagcacaatgtgacccttaaataagctgagaagatagaacaaaaagcttgggcttacatatgtagtatttcaaagttaatttcataaaaaagaatcatcattatctaaaaataccctcaggtgatatctgaagcagttagcactgagatgcctaaaaagcacatgtaagcttaagataatggcatctattttcaggtacttttctagaagagacaccagtaaaattcaagaaacttcccaagattccatccagtcattctttcaaatgttctagacactgaggatatagcaatgtacaaaacatgcaaaaatccttccttcatatgacttctattctgatggaaaggttgaacattaaacaagagaagttaaatagattgtaaatttagctgtagaatgtgatgaggagggaaaagcaggagaaaagaataggaattgtctgggagctataattttagacaaagtggtcaggcagcccccattctgtcctcccccaaccccaagaaagtggcatttaaataaaaacctgcatgaggtagggaggaaatcatgaagatatctggggaagagtgtcccaggcagagggaacagaaagagaaaaggtggtttattcaaggagtagctggaaagccattgtggtgcaggtggagtaaataaagtggaatgcaggagctgtgtaagatatttctaaatatgtgcatctaatgcataggtatggatatacatagaataacaaacttcagtgtaataagacatagaacttttccttttcattccagttacctctaggtaaattacgtattctgataagagtacttggcacctggctagacatccaggagatttaaattcttcttttgaagatcaaaaagacttcaaaggatacttgatagatgaagtaaaacagaaatcttaagaacatgcttatatcaggatagacatgccagtaatatttttggaaccaaaataccaacatactgacctaatacttaagtcagaaactttatacttcatatctctaaaacttgaaaaaaatacactgtaagtagcagtcctgtgtcctcaatttattccattcccaataaaacccaccaatccatttatcagtttgcaataatacagctttactgtataactaaaataacctcataccaaattctagagaaaggaagtactgagtgtacaaagaacgtttccttttcaacctacgaaagcaaaccttagtttcaagagaagtattcaaaccaaagagagcatcttgcatggataaaccaaaagagaagatactacaaattaaattacattataagaataaaatggaggccaggcacagtggcacacgcccgtaatcccagcactctgggaggccgaggcaggcagatcacctgaggtcgggagttcaagaccagcctggccaacatggtgaaaccccatctctactaaaaataaaaattagccgggcgtggtggtgggtgcctgtaatcccaggtacttgggaggctgaggcagaagagtcacttgaacctgggaggtggaggctgcagtgagctgagatctcaccagtccattccagcttgggcaacagagcaagactccatctcaaaaagagaaaaatactgaaaaaacaagaaacaataaaatgattgggcaaattagggaaattagatttagatagaaaagggatgttattgaggtatttggtggcagtgataatttctagggctgtctaccctacagagaccatgatgccgggcatggtagctcacagctgtaatcccagcactttgaaaggctgaggtgggcagatcacttgaggtcaggagtttgagaccagcctggccaacatggtgaaaccccatctctactaaaaatacaaaaacttagcggagtgtggtggctcgtgcctgtaatcccagctactcaggaggctgaggtagaactgcttgaacccaggagacagaggttgcagtgaaccaagatgccactgcactccagcctgggcaacagaccgagactttgcctcaggaaaaaaaaaaaaaaaagggactatgcttagaagaaatgattctcgaatgtatagaaagagacttaaatgaagctctcaaaccattcagtttttctgtcacagcactaatgttgccaatttctgtaaaacttaagaataaatgaattagccctctttacccataacttaaaaggaaatgaacttacatctttcagctgtatttccatttcatgaatattatttattgatgagttgaagcagtttggagccacagtctgtaaataatccaacattagttaacatcagacattccacaatagaagttgcctcattacattcaccataataatacagtataactcacgggggcatcccgaaatccagatctaggctgggcacggtggctcacgcctataatcccagcactctgggaggttaaggagggtggatcatttgaggtcaggagtttgagaccagcctggccaacatggcgaaaacccatctctactaaaaatacaaaaagaaaaattagctgagcctggtggcctgtgcctataatcccagctacacgggaggctgaggcaggagaatcacttgaacccgggaggtggaggctgcagtgagccgagattgcgccactgcactccagcctgagcaatagagtgagactctgtctcaaaaaaagaaaacaaaaaatccagatctagtagatggtggtaaaccatcaagccaggtgagagttaccagagataaccattgtgaaaattaagatcccctgaagtttcccaaacagactggaaatcctgagattttctatctaatctgacttctgcagtcctctagaccccaggattgccagaatagccctcagtgcatatgaatagcccagtgatttttaccaaaaagacaaacacaaaacaactaggctatttaaatgacacctagaagacattaaattgtcaaacaaaaggtaaaattttttttctagaatcatgttttgtattaataatagtattaattaggccgggtgcagtggctcgcgcctataatcccaacactttgggagggcaaggcgggtaggatcacaaggtcaggagtttgagaccagcctggccaatatggtgaaaccccatctttactaaaaatacaaaaattagccaggcatggtagcgcacctgtagtcccagctagtcggggggctgaggcagaacccgggaggaggaggttgcagtgagccaagatcaggcttatgcctgtaatcccagcactttgggaggccgaggcaggcagatcacctgaggtcaggagttcaagaccagcctggctaacatggtgaaaccccatctctactaataatacaaaaattactccagcctgggcaacagagcaagattctatctaaaaaaaaaaagtattaattattaattagtattagttcatatagattatatggaactcaaaaattatttctctcctcttcattttctcagagaaataaaagagaagtgggtggctaggtagccaggctggccaacaaacatagaaaaagctgtatttcagtcttttaatagctataagagacttgtgaatactggcaaagaagctcaaaaaaattatttttctccaaagatgctctattcattcactttaatatgtagccctttctctctctcaattcagtcctcgaggtggaaactatgacaaagatagttctctaaatccctttccttttaccctgggcacactgtagactgattccagccttccctgtggttagtggagccatgttccagtggaatgtgagcagaggtgagatatgtcaataccaggcctggccccagacccctcctaggcagttctccacaagctccatctcacagctacatacagaggacttggtgggggaccctaccctaaaggaaggtggagccactagaaggaaggaacctggagtcaaatgactctgtggagcaaagcttcctctactccaatctggactagaccagcatgagagaaaaataaacatttgttgcataagacactgacatttggaagttgttataggagtcagacatactagttaataaagaaatcaatacgagtagcccacaaaattattataagaatacatttttaaaaattataatttcaggccagatacggtggcttatgcctgtaatcccagcactttgggaggctgaggcaggcggatcacctgaggtaaggagttcaagaccagcctggccaacatgttgaaaccccgtctctattaataatacaaaaatcagcagggcgtcgtggcaggtgcctgtaatcccaaatacttgggaggctgaggcaggagaattacttgaacccaggtggaggttgcagtgagctgagattgcgccattgcactccagcctgggtggcaaaatgagactctgtctcaaaaaataaaaaataaataaaaattttaaaaattataatttctaccaagtttgtatttcacattccaaaagtggagaaactaactcttgaacttcaaagaaaaattttagtcagctactttgaatctgactgtaacgttttatgagtttcagctctgtggaaattctctagaaaaacttcaactttttgaactcatctgcagaaacactcaaacgcccatctatgaaaatacacataaatgtataggtctgatcactatctcccctaaatgggaaataaagtacagagaaagatccttaacagcactgagatatatttgaaagctacagattttctactatagatgatttttttttttttgagacagaggctcactctgtcacccaggccggagtacagtggcgcaatcttggctcactgcaacctccacctttcgggttcaagcgattctagtgcctcagcctcccgaatagctgggattacagatgcgtgccgtcacactcggctaatttttgtatttttagtagagatggggtttcactgtgttggccaggctggtctcaaactcctgaccccaggtgatctgcctgccttggcctcccaaagtggtgggattataggcgtgagccaccatgcccagcctatagatgatattaatgttagtattattcgaatctccaaatctccaaaagaatcaaaggtctgatcaataagtaaccatttaccgaacacctactatatactaggcactatgcgaggcaatttacatacatatttacatttaattctcactattcctatcctgattttactgatgtggaaactcaggtttagcttatatgtttaaaaaaaaaaaaaagaaactaagatttagaacaggggtctggagaagtctagtattgtctctaaggctataaaggttaacaaatttgttcagagtcacagagctggcaagtacaaaaccaagatctgaactcacatgtctatttctgtatccttgttctttctatgacgctagtgcctctcaaacaaaacggggagaaaatgcaagtgcagttaggaaaagtatacttgatattataattgtatgtttcaaatatgaaaaataaccaaaaaaatgaagcctactgttttcatgatacaaactatagaaataagagctcaaaaaaaatcttggtaattgtaaatacacagtagatgctgtcttctgaatattcctccaggcaaatcaatggtacaaggagtggagggtaccatattaactatttttgcttatagagaagggactgggctattaaaaaaagtgaagtgacctgatagtatactatactaatcatttgtctcatcatttgggaagcatgtcttaacaaactcattcctcctaagaattacaaactgtatcagaaagaaaaaaaaaatctgggtttaaagaaatgattagcacctgtgataaacggagtgtattggttttgctttcaagttcagcaattcgtgaggttgcagcagacaactgttgtttcaatacgtctttctcttcagataaggctttcaacacctgctccctcctttctccttctctcgttgtctcttccagctgttcaagcaatgtggtagtactatatctggccttcagttggtctctcagtcgctgtatttctttgtccttctctgtgagttgataagcattcttctccttctcagcctcaaggactcgaattttctagacataaactaagaagaatcttagaacaaagccaggtcaaacatctagctaaacaatatatacttcaacaagcatttatgaagcatttattatcaagtcagcattacgctaaataccaaggccaaaaaagattaggaagccaaagttttatgttcagatagctcacagagaagtaagccaatgtattaatgcaacgttgtaagtgctgtagttaagacagattaaaaaatgagcacagacacaaagaaaggagaaaccacctctatcaagggtggtgagaaaaagctaaagaagggctagctttcccatgagtatttggtaatcattcttccataacactggatcttgtaaaaactaagagctaaaagtcggtcacacaagatatacatgctccttaatgaatttgaatcagtggaacttaaaagttacagaatatttcagcaggagagggatgcattcattaacctgcttactttcgataaatgattcagtattgaatctagaaggtgatctctaaaggaatgcttaacatcttcaaagattcacaagatatacataagtaatgttttttaaactgctgctggcataaaggaaaaagtaaaataaaaagataatagaaataattattaaaattataggctaacaggatcaaaacagcatgaagttaaaacttgaatttaggaagaaaaaagcagcagttgttcaaatataaaatggggaaaatttaagtttaggggcatggttattcatttgaaaataatgaggagattatagttggccacaagcttaactcaaatcagtagtatgagacagataacagagccatacaattttaggctttaatggagtacagtatccagctaagtagatgtaacactactatttcaatctgtgttttccagaacatatttaggatactgtgttcaattctaagtgcataattcaggagggatatgaataaactaaaaactattcaagatgataagaagccagaaaagctgaagaatatgagcttggtctgcagaaaagttaagaggaagcaaaatttccttacatatctaataaattgtcagtttgcataggaaaaataagacttgttctgtgtaactttaataggcacaattagaacaaatgggtagaagttataggaagtttaattgattataaaggaacaaaatatccagtgcttctcaaaaagtggaatgaaatggaaagctatctctcagggaagcaataagattcctttaccagattgcaaaataaccttcatatctgtggactggtgatgactgttctctaagtgcttgaaaaagcatttacctcaatgtatgttgttacaaaaaataaatcagtttcattatgtgcctgtttagagaatttaaataaatcaaatggtatactgtttaaccatttattttattttatttatttattttttttttgagacagaagtcttgctctgtcacccaggctggagtgcagtggtgcgatcttggctcactgcaacctgtctcctgggttcatgcgattctcctgcctcagcttcccgagtagttgggattacaggtgcacaccaacacatccggctaatttttgtttcgccatattggccaggctggtcttgaactcctgacctcaggtgatccacctgtctcagcctcccaaagtgctgggattataggcatgagccaccgtgcccggccttaaccatttattttctaaatacaaacaataaaagcacttttgcaaaataattaaatccaaatttgtgattatatttatgattacatttttaagtccctctagttctaataagttcctaacttccttactgtctatgccataacaaattataaattagggaatccgaaatatagttgaacagagtgtaaatgccaacatgtctaataatttttccttcaaaagcctgaaaaccagaattacttggatagcagccaatatgcatgataaaatatgttttaaataaggaaatctgaacactatttaatactctgaaatggacagatctgattttttacatttagtaaattaacaggaaaaccagattatataactattgggtaaatattttctcctctcccacagtaaaaaagagatataagcccagcacagtatccttaaagtacatcaacgagtaatttagtactccaaaaaagcatggaatggccaggcatagcggttcacacctggaattccagcactttgggaggcccaggcaggaggattgcctgaggcccagagtttgaggctgcagtgagttatgatcaagccactgtactccagcctgggcaacagagttgagacccagtctcaaaaaaaaaaaaaaagtatggaaaatcgaatgcttctaagttatgctatcaatttaaaaatagcgaaaatagttagccagaatgtttcacaatcttaaatacagcataacaaaagttatcaagaatattcatgtagttaagctaaattaccaagaagctataggaagaatgatgaattaggttattactttgttttaaataactgagaaacagagcatactaaaggtgaaacagaccatgttaaaggtgcaaaactattaatcgcaatgtctttatttccagaacaaacttagtacctggtaacctcaaaacacatactcaattacatttaaaaggtgagaagttagtaatgactaaagtacatctaagacttggcaaagtcaaagtaggaatttaagattctaaacccaatgtcagctttccaaaactaatcaactggacaagacagggaacacggcaagagtaagaaggtagcatcaggaaatcttcatgcatcgctttcttggagagcttacaatttaaaggatcagaagaccatttacctccaaaagtctgtgtctctctttatcagtcagctttcctttcccacttgtgatttcatccactgatgtctttaagtgtgcaatttctccctttaatttttctaatgtagtttcggatttggagttactaggcttcgatccccacttacttttaattaaatctttggtacttctggaagacatctctgaaatggtctgtaaaaataaaaatcaactgtataattctgagtttaaaaatttaaatctcaagtttgaaacaggtctaataacctatctgctctaaatagaaatgatatatccaaaccagcagggtatggagaaagatggatggaggcttctggggtattgtaacttttttttttaatctcagtggtagataaatgggagtattcaccttctaaaatatgtcaacttgggctgggtacggtggctcacgcctgtagccccagcactttgggaggtcaagatgggtggatcatgaggtcaggagttcgagaccagtctggccaacatggtgaaactccatctctactaaaactacaaaacttagccaggcgtggtggcaggtgcctgtaatcccagatgctggggaggctgaggcaggagaatcgcttgagcccgggaggtggaggttgctgtgagccaagatcgcaccaatgtactccagcctgggtgacacagcaagactccgtctcaaaaaaaaaaaaaaaaaaaaagtcaacttgtacatttatgttttgtgtagtgttctatatgtgtaattatatgtgtaattcttttgtggaaaagtttggtttaaaaaacaatgaaggggtctccaaccattaaataaagcctgaaagaagtaggtcacaatcaaggacatatcttggcccaaaataaaaagctgttggtaaataatgtaattctgagtatataggcacgaaatgtcattacttaacataggtcctctgttttagaaggtagcctagttcagatccatcttaataatcatttgagagagcacagtgggaaaaagtgaagagaacctaaaataagacatttactggaaaagaggtataacattcaggggagtcaggcatgaaaggaattaagaataaggggccaaattaagtaaggagaaactcagtatctgctaacagtactggatgacagtttagaaacaagtatataatataaactttagcaggcaaaaatctagtgaagcatacgatgcatataaatagtatataaaagtaactctaattaaggaggttaaaaaacatttttctacttcatgtatcccaagataaaataatggcagtgtgattaaaggatataaaggagtatgagcccattagtgcattcaaaaattactataaagcctactatttaccaggtatcctaatacatgctgggtgtaaactggtttaaaaaaaaaaaaaagacatgttccctaatgttatggggctttcagtgtagtaaaggcaggcaataacaaggaaacaaacaagggttcatgaatcctcaaactgtaataaatattacacaagagaagtacagggataaatgatatcagtaaaaacaggagagacctccttagaatggtagtgaagtgacttttaagattgtcctgtgtgaaatcagaacgtctaaacatattagaactgtggagattgagtagaagaaatcatctatcaaaaggttagtcctggatttttgccattataaggtgaaagattgcagtagctcatccatcagttaaagaaatgcaaggttatggcgtctctcagtcacctgctgccacaggaagttctttcctatgtgtttctgttgataacacactgttgacttgatatcgtgggtcgtaggacagaaaactactaccaagtcattgagacacaaaatgatggaaatatagatctgcagaacgtgaaagaacccccaaacatctgcttcctaacctttgcacagaaactctggcagtgaatgaatgactactagtttctagcctctggcccagacggtttggatctcccccaccacctagtcccaccaacctcctttccctgtattttcttttttctgtttctgtttctttctttttttttttggcgggggcggggcgttaggggcggcagagtctcgctctgtcgcccaggctggagtgcagtggcactatctcagatcactgcaacctccgcctcccgggttcaagggattctcctgcctcagcctcctgagtagctgggactacaggtgcgcgtcaccacgcctggctaatttttttttatctattagtagagatgaggtttcaccatattggtcaggctagtctcgaactcctgacctcaagtgatctgcccgcctcggcctcccaaagtgctgggattacaggcgtgaaccaccgcgcccggccacctttccctgtatttcctattccagtcatccacagggttcccccagttcaaaccttcctcagcatgccttccctctgtgaactcttaacaaacgatatagctgccccacccccacccctacacaatctagtacccaattacacttcctgctaaccttttattttttcaattgttcaactattttttcaaggactgcactttgatttttgttgttgttgttgttacccacagagcctaacagcaagccctcagatatgattggttgattggggccgggcgcggtggctcacgcctgtaatcccagcactctggaaggccgaggcaggtggatcatctgaggtcaggagttcgagaccagcctgcccaacatggcgaaaccctgtctctactaaaaatacaaaaattaaccgggcgtggtggcgcacgcctgtagtcccagctattcaggaggctgaggaaggagaatcgcttgaacccaggaggcagaggttgcagtgagccaagatcgtgccattgcactccagccttggtgacagagcgagactccatctcaaaaaaaaagaaaaaagaaaagaaatgattggttgattagctgaagtgacctaagtcatgctggacaggtgaccaaacaagcgcttccatccagtaaatggtacaaggcctcaattacaagccgcatcttctacaaggcgacgccaatctttaaaaattcccacataaaatctcacttgaggagacagacaggaaaagagaaactgcaaaaaaaggcacaagttttctcacttctaaaataaagatgtttgaggaacacacaacgaaagtgcctgccaatcggaaaaagccgtcctaacaaaagaccttgggcaagtcacttggcctctctgcgcctatctgtaaggagatgatacccaccgccaagtccaaagaagcgatcgaagagacaacggtcttgaggcgcccagccgggtgccaggcacgaagtgagcgccagggaaaaggactgttatcagagcgggcagagattgaatcccgcggacgcgatctgcccactgacctgccctccctggcggtccggaccggcccggccccggggctgcgggtcctggccgcccctcgccaccctccgcggtcgcctcccttgggccagctagcagctgaagcgaagcgcggcgctcgcgtcggccgagtcacaccatcaggtgtggatgccgcttccgggagtttgaatcccgcggctgcagggcggggcacgtcactgccggcagggcgcggcccgcaagaaggaggagcagcgcgcgcgcggcggggacgcggctccccgattggctgccgcctttgaagggcggagagtaaacctgagggcgggccgagaagtggctggggccgcggggcgggacagagggcgggaacacttcctcccgggcccgccagctaattctgggatcgggggttctctgcgggcttagacctaaacaagcttggtgtctcgcagtcaggggctggttttgtgtttatacgcttttaggagaaagcaaattactatttttaatgggataaaaccagtgacgatggaccgagacgaactagttctgcgctcttgagcatagattctccctgtgtgaagtgcggcccctcctgccctgggacaacgggatttcacaaaggagcacagcccccttgtcatcccctcgggtctcactctgtcgcccaggctggagtggagtggtgcaatcatagctcactgcaacctcagtctcccgggttcaagcgatcgtcttgcctcagcctgccgagtagctgagactacaggcgcacgccaccacgcccggctaattttttattaaaaaattttatacagacagcggagtgggggggggggggggtggtctcactttgtttcccactctgatcacgaactcctgccttcaagtgatccttccacctcggcctcctaaagtgctgggattactgccaaaaatcagcagcacagcagggagtgttaacgggagagatgagaggcacgcccaggttgaacgctgagattatgaatgctagcggaccggctttcagaccagactgctaccctccagcctgatatctatctattgatcgattctagctcttgattagccgctttgagaacgttactgctgagagaagaagcacatgaaatgtttagcagggcctccctttctctcctagacccagcataaactcgctggagatttaaaacagtagatacacagtagcaaaacatcctaggtacacaatattgtacaaaggttataaactctagattaggactttctagatttaattccttactgccctgactagatgtgtctccttggataaatttatttaacctatttgagcctcggtttcccgatgtgtaaaatgatgcaaataataatatttacttcacagctcggttataaggattaaatgaggaaatccggccaggtggaatggctaattcctgtaatcccaccactacgtgaggacggggagcgaggattgcttgaggtcaggagttggagaccagcctgggcaacacagagagatccactctcaccccacccaatccctgtctctaattttaaaactttaaaatttttttacatgaaagaaattcatgtaaagtgcttaacatttagtaaatgttcaattgatgttagccattgttaaacaaaaggcaacactcaaatgttactgaatagaatggatgagaaaaccatgtggggaattttaaagaatcagagaaacaaaaccaaaacagaatgcaagataacgtttggtacctgcttccaaggagctcccatttctgaagggaaggtaaactaaagtatcaagtgggattagggtgggaaaaatcagggcaaaagataaatcatcgtgtgaacattattcattgcccagagttgaggggcaaaattaatttccacagagatttacaaagattcttaaagagatatagagaaaaacatttccctgttcaccttcaagccaaatggggagcaaaaaatgggggagagggaggagggaccctggagagaggtggcacctggcggactggcacctgggtagccagcacccaggcctgctgtgccagacactccaattccacacctgccctccaggaccttcttttctggctaaaggtcgccctgtgagtggggaccttgaggaagaggagcaaacaagaggctcattggcctggggggcttgttaaattccctaattgccattgctagccctgaaaattaatgtttgctctttacagataggagctgccagtcatgaggttgtgaagagctggtagtttccacaagatctcacaagtactttgatgttgatagttcactcagggatagtctaggatgaagattgggaaactcatctttattcatgtaaagagaaatgtaacagccaagcagactagatatttatctaagcaggtgagctcattttcttcccagtaggaacctgttcttgggaaaccaaaacaggatcaaaaggctgctgaatgggtttaaagatattaaatggaaatagggaggctgttgtaggttagagcacctatcacctttgaaggttacatcttccaaggcaatgctaatgaacacacagggcctcaccagcgtgtagatctgcactgtccaatacaactttctgcagtgatggaaaggtccctcctgatctatccaatatggtagcactagccatagatggctactgagtgcttgaaatgtggccaccgttattgagaaactgaatttttaactttatttaatcttaatttaaaaactaaaagtttatttattgaaaaacttttgattttcttatttttttcttttttttattattattattttattggaaaacttttaagtatgtttggaacaacctgggtacaaaaacctgttttttcaattgtaaattttatgaaatctacatatagatcaagtatttctgaggaagattttatgtccaaattgaggtgtgtgaatatacacagcagatttcaaaaacttagtatgaaaaaagaatgtaaaatattgcactaatacttgtttatattattacatgttaaaatgatagtatttttgatatattgggtaaaatgaaacatattaaaacggatctcacctaatgtgttttactttttttgatgtgactagaaaattcaaaatgataaatgtggctcatactatatttctattgcacagcactggaatgcacacaataaatgttctctaaattcagaacaagaagaaatgaatgaactcttgtctcctttcaatctgatttctccttagcagggattttttcttttaaataatgcaaatgcaatcttgtcacctatttcccaatgcaaacacaaagcatttgattgatttaccattgttcttaaaataaggaaaaaaaattctccatctgtcctctggggcctagtggagaccaaagtcccaaaccagccatgcttgacacctttcattccttgaccaggcagactccttcctgccttcggggcttttccacaggccctgtctggaattctccactgttatctcctttcctacttccccggaaaatcttagttctcactgctgcagggatgtcctcgctttagcttgtacttctccaaccactcaccacacttataattgcacatttatttgagagtgattctttggttggtatcttttcccctcactaggctgcaaaatccttgaaggtaggggccacatctgattttgccagccaccatatcctgagcacctagaagaaccacagtgattgagcgaattagatcaaggatgaattgatcagagtctcgtctgatctaaactattacggagaaacagacaaatgctttactctctttcctttctgttatcgatattccttaattacctaaaaggatgcaccttacttaaaataatgcaccagaagcatgcttttagagctcagcaccttttcagggtagaccccctgctctttcctaaagtttatcttcagccaggaagggctgcattttaaatcggcaaatagggagatcccctcagcacttagctgtgatcactgcagctctatcagcaagcaacatatctgaaaatcatttcaggggcaggcggctaatctcatatgagagaattcttcttaggcagtcagtgatacttcctgacttggttcttgatttggggtgcatcctattttgagagggcaggccctgactgctctgcccgctttaggtcctttttttttttttttttttttttaagagatgaggtctcactatattgcccaggctggtctcaaacttcttcaagcaatcctcctggcctggcctcaagcaatctttccaccttggcctcccaaagtgctgggattataggcatgatccactgagcctggcctattttagctcctattaaaatttaagtctgcatggtaactaaaacatttcatttgtaaccagggtattaataggcaatccaatcgctccacttccctgctgaaaaatacatctccaataggtccctgtcaccatgaggtatgtgtaagaatgaagagcacggactctggaaaaagactgcctgcattcagatcctggctttacttaccgtgagaacctaggcaaggtgcttagccaaaccaggcctcagctttttcgtctgtagaatggggatcctaccatagcagggacttcacagggtagggtggtggaaggtttcaatgagaaaaaatgcttaggatagtgtttggcacgtagtgagtactcagtagatgttactgagcaaataaggctctctgagctggtaactgcctgcctgcctaggctcagtgcttgactgttttatgtcatacatgatgttccaccagtgtggaatgtcttggggttccaaatgttcaccatatgtatttaactctatttcagatcatacagtcaggcacacacacatacacacatatcaatccaaccattaagattcagtccagttttcagctgtcacctcctccagggagcctaccatgcttgccctcccctgccctacagatacctatctcttcagtttatctctttctatcattgccctcaccacatgatgctacaattatctgtgagcttcttgcagagcagaaatgtgtcctattcatttttgtagttagcattgtgcctggcaccaagtagcgtttaataagtattagctgaataaggtgcatatgtgcgtgaatgaatgagggctcttccagaagaacagctgggagccatttgtctatcagacattttgatgaagaattattgtttctgtaaaggtgagcacaaggcttaaaattattccacttttgcctgttctattttttctaggttgattttagaaaatatattaatatcttcttagagaagtcagattaattcctatcttatatttagctcccccagttgccttgaatgatgacaatatgatggtgccaaatgttataaaataatttatctcctcctgccctctacgtggactcagttgctgccaagcactttcttaaaggaatgaaattcaaatatactatatattaagttatttaaagatagtgtcttccactgtgagaagccctgtaattaagccaccaaaaatagtattttagctctaaaaagcactttggttatcaactgaaacaatggacccttctgtgcatgccaatttgaaaaatgctgttaggtaatacctaagattctgtaaaactggaattggaataagatgttacgaatctatcttcatttctcttccactaaatcctctttgctaccccagcactttgctcttcacatctagattttttgctgagtctcccttctcttcctctcacattcctctttctccatctcttttgtctcactgttccagggcaagtgtaaggccactcacctagattaatgcttgagtttacttgagacaggtaagaaacaatgaaacagaaatatgagatctcagctgaggtgaagctgggaagggagtttgactcggaagacactaggtttgaatcctggctcaagttttttgtcacttctgtgcctccattttgttagggcagtacaggtatttcttcttaacttaagatgggccattgcttttctcatgttcctaggagccaccttagtagtgcgtttgcaccatctctgggggccttgcggcatatgaaatcagcatcttgggggagcgcacccatactggtcaactctcttttatccaaatttgtgttctgcactgcccttcgacacagcacacttagaatccagccccatgtgaactcttccagcttctgccagtccaattggttgtgtcctgcagtttgttcaaggggtgtcccctttctgtcttcagcaggcaggcctagcacatcccaggcagcaatatgttgttaggacttaaccgtagatattggtaacggccggggtgggaggccttcgcagatcctgagaaaagaacaaggtgtcttgcaggggggaggccttcacatcatctccaagcaaggtggagtggtgcttgtctttaatctgagctcccccaggctcagagggctcagagaaatttggggatttaagattctcaaggacatcaaccagatatccccatcctatgtatcagggtcccagtccttccccaagcagagccttgatcttatcagagtcaacttgtctcggttgggggttcaatcttccttggagcttgtcgtcttttgtgactaagttctggtgctgggcctgagctttcccagttctcctgctgcaggagaggccacctggctttcattcatagctatttattgctgattaatcactctcaaccttttgttacttttccagagtgtcaactgagtttggcaatggctccctaaatccaaatccttagttactgttttccctgcatatttcaactgcttgacatttcacgcagctaatgcgttcccttccattggtgacacattttactattgtactgtgccagggataatcattgatgagattatcaggggtcttcattcccatctgggtggtggaagatcaagctcaaaatcccatcttaggatctgctttcttgaaccactcctggcacccaactctgacaggttgcattccccagggaaaatttctgaaatgatatcagtatacaggtatttcttaagaagtattcatgagatcaacaccacagatgcagggagaaggaagctgggtccatcactggatcctgctgactccatggggaacccagacgctggaatggccctgtagattgtcaccacttggggcaaggggaccaggccttcatatccctgcgctgatcagtcattgggaggtaggctgcttctggaaggaaacatgatcttgggtagggcaattttcttcagcgcaggcaatccctgaagagggctaacagctgagggaggttttctggcagctctcccagcagctgggggtattttatccttcattcctggagggaaatctgggtggtgtattgtagcaacagccacattcccacattccattaaagccagtcccatggccatgtctgccacaaatggggtagaggacaacatgctttgcatagaaaagcactgcaagtcacacagcacaggtgcaggtatgtgatactctcctagagatggcgggagcaagctatgtgggaaaccagaagacaatggaacaatgctttcaaatattgggaggaaatgcttttgaacttggaatcctgtgccagccatactgccaatgaaataggagagtagaataaagctgttcaaacagggaaggtctatgcttcagcaatacaagaaagtaaaccaagaaagaggaagacacggaatccaaaataagagagatgcaaagagaggtggagaaaggcagctcagggatagcagctatgcttagctcccgagcaaaaccctccagatcagagccatttggaagaccccaagcgagggttcaagatgaaattgatacaattccaatatgtttgaacatgttggaaatttacacaatttgggaagagtttaaagtacaaaaaaacaacaaggggctaggggcagtggtatacgcctgtaatcccagaactttgggaggctgaggtgtgcagattgcttgagcccaggagtttgagaccagcctgggcaacatggcaaaaccccaactctacaaaaaatacaaaatgtagacaggtgtggtggtgtgtgcctgtagtcccagctatttgggaggctgaaatgggaagatcacctgagccaggggaggttgaggctgcagtgagctgagatcgcaccactacacaccagcctgggtgacagagaccctgtctcagaaaacaaacaaacaaacaaacaaacaaacaaacaaacactaaaaaccaccaccaacaaggtattaactccaaaagaaagaaaagaacaagttgaaacaagatcaaaatgtatgaagcacattgcagtatacttcatggcttgtgaacagtgtttatacaatcacaataatgtatctatgcaaatttatggtacagctatcctgggggtgatgggatacagaaagtgtacacatatgtgtttggatttgaggaggggcaaaagacagctaagtcctcattttccttgttaggaaacagatgatgcctgatgctggaaagtgaaaaatagaagaaagcatgttacttggagatatggatataaacaccaaaataatcagatgaaagagctgaaagttagggcctctggaaatggaaatgctgtcaggaaatgctagaggtaaggagaggtgaacttctaattttataataagcctggtagagtttacttatttattttgagacagggtcccactgtctcccagactggagtgcagtggcaaaattatagctcactgctcccaggcctaggtgatcctcccactgcagcctcccaagtagctgggactacaggcacacgccaccacgcccagctaatttttgatttttagtagagatggggtcttgccatgttgcccaggctggtttcaaactcctgggctcaagcaaccctcccaccccagcctcccaaaattctgggattacagtcgcgagccactgcaccagcctctgataggatttcttgaatctttaaaataaatacaggtatgaattttgtgaaagaacaacaaacatatcagaagaaataattccaagttcacaagcttttccaaagaattaaaaaagaggcaacagcacaccccaccccattttatgatgctagcatgacctccacaccaaagctgaccaggacaaaatgaggacgggcaattgcaagtcagtcttattcataaatatacatgcaaaagtcataaatagtatataaacatatttgcaatctaaatttagcaataggaaagtataagatatgacaaccaagttgagtttatctcaggaatgcaaagttagtttaatattagaaaataaatgtaattggcagggcgtggtggttcacacctgtaatcccagcactttgggaggccgagatgggtggatcacttgaggtcaggagtttgagaccagcctggccaacatagtgaaaccctgtctctactaaaaatacaaaattaactgggtgttggtgtgcacctgtaatcccaggtacttgggaggctgaggcaggataattgcttgaacccaggaaggggaggttgcagtgagctgagatcatgccactgcactccaacctgggcaatagagcgagattctgtctcaaaataaaataaaataaatgtaattcaccacattaaacataaaattcatatgatcatttcaataaagtgaaaccatctgataaaatccgactttatgtcttataaaaagccttaaaactgggcatttaaaagtagctaagcacttgcctgtagtctcagctacttaggaggtggaggcgagaggattgcttgaggccaggggttcaaggctgtagtgcactatgattgtgcctgtgaataatcactgcattccagccagaaggacataacaagactccatctcaaaaaaaaaaaaaaaaaaaccaaaaaaaaaaacctcaaagttttagcaacctaggaataaagagaactcctttaatcttaaaagggctaattatgagaaacctacagcaaacatcatactttatggtgaagtatggaaatctttccctttgaaatacagaaaaagataaggatgtctgttattaccacccctagtcaatattataatgaaaggtctaatcaacatagaaataaatgggaaaataaagtaagcacaaagattgaaaaggaagaaacaccccaggcgttatttgcagattctataattgtaatggtagaaaatccatgagaatttactgctgattacactctcaccagcggtgtatgagacttcccgttgttccacattcttgtcaagcttggcaatgttagatttttacatattttcccatctggtgagtatataataataactcattggagttttaatttgcacttttctaattaccaatgaggttgagtaccttttcatatttacatttcctaatttatgaagtgcctattcaaatcttttacctatttttccattgagttctatgtgtttgtcttactaatttgctggagctgtttatgtactctgaatactagtcctttgtaggttgtgattttaatataattgaatttatcaatatttcctttatgatttgtacattttttcatattaagaaatcctttcctatcctggggtcatatagatattcttctatggctttttttgttgtttgatttttttctttacttatttgttttagagaggaggtcttgccatgttgtctaggctggatttctatttctggcctcaagtgatcctcttgcctcagcttcccaagtagctgggactacaggtgtgagctgctgccaccacctggttagatttttttttttttttttttagagacagggtctcactctgttacccaggttggagtatagtggcacaatcatggctcactgccaccaggacttcccaggctcaagtggttgtcccacctcagcctttcaagtagctgggaccacaggtgcatgccaccacactcgattaatttaaaaaattttttttagaggcagggtctcactatgttgcccaggctggtctcagactcacctcagcctccccaaagtgttgagattacaggtatgaaccactgtgtctgggctgaaacatgttttatcttgcttatttagatttatactccacctgtaattgattatgtattatgtaaggttggaagtcatttgtctttttctcccacatgaataggtaaaaggcaaattaaaactccagtgagatgctattatatgctcaccagaagggcaaatgtaaaaaatctaacattggttaagtatgacaaaaatttagaacaacaggaagtctcatacactgctggcaagagtaccattgtggaatataatttggaattaccttgtaaaggtgaagaaatgcatacattctctggcccagcaagcaattccacccatagattagactctaaatagactcatgcacatttgtgccagaacagtcttggactgttcagaacagcactgtttgtaatagccccattccctgaactgtccaaatgtctggcagtagtagaatgaattaatcaaatctggaggccaggcgcagtggctcatgcctgtaatcccagcactttgggaggctgaggcaggcggatcacgaggtaaagagttcgagaacatcctggccaacatggtgacaccccatctctactaaagatacaaaaattagccgggcgtggtggtgtgcacctgtaatcccagctactcaggaggctgaggcaggagaattgcttgaacccgggaggcagaggttgcagtgaaacgagatcgcaccactgcactccagcctgggctacagagcaagactctgtctcaaaataaataaataaataaaatgtcagaaactcatacaatgaaatgccatatagcaacaagagtgaaggaagtagagctacatgaatgaatttcacaatataatactgagaaaaaagaagtcaaacacgaaagaatccattctgtatgagtccatttctataaagtcataatacagcaaagaattcacaaagtatgaacacatgtatgtgtgtacctatatatatgaatatatgtgttgtatgtaaagttcataacatacaaaagaatttatatcaccaaacaaaggtcatgagcaagcaaacctaaactgttttgttgttgttgttttcggtaaaaactacaaagaaaagcaaggaaatcattaccataaaaatcaggagagtgggccaggcatggtggctcatgcctgtaatcccagcactttgggaggccgaggtggatggatcacctgaggtcaggagtttgagaccagcctggccaacacggtgaaaccctgtctctactaaaaatacaaaattagccgggtgtggtagtgcacgcctgtaatcccagctacctgggaggctgaggcaggagaattgcttgaacccgggaggtggaggtggcagtgagccgatcaccccacttcaatccagcctgggcaacaagagtgaaactccatctaaaaaaagaaaaaaaaatcaggagagtggttacctctgggagaaggaggtggatatgatatatggggtattccaggggcttctggaggactggcaatgttctgtcttgacctggatgcttgttaaactgtcacgtttatgtagtatgcatttttctgtaaatatatttcacagtaaaaatggcaaatagaaagcagccagataaaataaaagtaataatctctatattccactaaaactgccaacatgtccactaaatacaataatgaacacagcactgggtaattggttctttgctttaagccttggagaaactcgtggagacagaagaattcttgtaggttaagtcatgcttattcaatgtacttgaaatgtttatttacaggtgggtctgcttgatgtgtgttctaaagcaaaaagaagcccaatgtttcttcatcccaagttttagccttttcttctgaaatataacgagatcctgatttaaagtcagcctgcactaacagaaacgctgtgagaccacaaataagcatgaacttcttacatgtgcaaattactgtgtgctttgtgccagctcctatgctatgacctttatcttataacagcctttatccccagttcatagatgaggaaactgaggaagagaggggttaagaaacttgctcgccagcacggtggctcaagccagtaaagctcaagccagtaaagctcaagccacggaggccgaggcgggcggatcacaaggtcaagagatcgagaccatccttgccagcatggtgaaaccccgtctctactaaaaatacaaaaaaaaaaaaaattagctgcgtgtggtggcgcacgcctgtagtcccagctactcgggagactgaggcaggagaatcgcttgaacccgggaggcagaggttgcagtgagccaagatcgctacactgcactccagcctggtgacagagcgagactccgtcaaaaaaaaaaaagaaaagaaaagaaaagaaaagaaacttgctaagatgacgtagctcagggtggtgaggcagagtctcacactcagatctggctgactaaccccaggccgcctcttgtgatctcagccaagctgcactgtcttcatgcaccctctgggacagaaagacaccatgggcagctgtaggtccagaaacagtggggagtcacttctccattttcactgaaggcaattggcagcatttgaagagccgggaaaacttaggcgcccagctctcacctctgaaggggttttgaagaaattctatgttcagtcctttatatatatatatatatatatatatatatatatatatatatatatatatatatatatataattatttatacatatatgtaattatttatatatcccatgcctggatcgcgtttacttgaaataaacgctgtcattcgtttgccgtccagtaagaggcaccctttagctgctttaaaaaagctgaacatagggttactgagtgggtgtgttcaatggcgtgagaagtaacagcgaaaagtcaaaagcaaataatgactaaagttttaaaactccttgaaactcagaaaagaatgaaagcagtgacggaaaaatcaattaattcagtttcacgaaccattgctaaaaggcagcaacattttagtggtttcctgacctacccgtatttcttagctccaaattcatgttggtttcatttgtcgcacggaattatttttagtttagggtttgtccttttcacttccacatttcccgaattcataagtctgtgcctgcggcactgcgtagacgcggggagttcggtatcagtttacacgttgccttcagtaaaatccgccagaggtccacccattttgccttttccccttccttgccctgggagaaatcctcccttcactgggagagaacttctctcccagggcggtgcgacccggagctccagcgccctagtctccacttcgtttgctgaaacttgctttctaccagctaagaaccatgctgcgagtgattgtggaatctgccagcaatatccctaaaacgaaatttggcaagccggatcctattgtttctgtcatttttaagggtaagaaaaagttttcttctttttctgaagtcctgttttggaatgttagtttcttgagtcaccttcttgaaaagtctgcatttagacagctgatgaagccaagtctctccagcagcgtttgttacctgcgcaggacaggggagaggacccgtttctggggaaggcatttaattttctccagggcttgagactcatggaatgacctgatgttttagctctaagagtgtgatttctgtaagctcttggcagaaaacgtatttgcgaatcactaaatttcaggtatcaacaaacatctgtattggttcaaagtaagtttcagtagtcttagatgcattttttctctgcctgtgagaaatgggtaaaggaggaagaagagcaattaaattgttggagacaccattactccttgaaccagcctgacgctgctttgattgtcactgggtttctgggaggtgggatgggtgaagttcatagttttattgagttttcctgcccttttgtgcctttgtaattgtttttatatctaaactgttggggagctttttttgtacattctgtagcttttaaattgctcattgaggaaagaactctggacagctagtttgcaatttggggatctagttctatcttgcctgctgaatgaccttgggcaagttacttcatttctctgggatctcaattttcttttctgcaaaacaggcgagaagggtttagacaagatcatctctaaaaacctcatggttggctgagcacagtggctcctcaaccctgagccaactttgggaggccaaggcaggaggattgcttgagcccaggagtttgaggctacagtgagccgtgatcacgccactgcactccagcctgggtgtaaaaataaataaaaataaaaggctcatggtaattttaaaaggctatttttctatgacacttgattgccattgcaggggaggggacaggaatgcttggtgtcatggtacaatttgatgtaagtgacttagttttggctaaagtggggtttctaaatctcagtgtggaggctttatctattttgtttgtcattggtaagactgccaactcacttcttggcaagagggatgggaaagagagggaaaggcagagagagtgggagcatggatagacatgtgtttcctgaccatgccttgctacatttctcgtttcttccaggagcctgactgctactccctgtcagttcctgaggcatctatacctttcgcctttctgtttcccgtttttcccctttatttctcttcttaaacctctctctctgaggatgagcaagaaaatgaaagaaatgaaactcaaagctggctggctgggtgtggtgacttctgcctgtaatcccagaactttgggaggctgaggtgggtggatcacatgagggcaggagttcgagaccagccaggccaacatggcaaaaccccatctctactaaaaatacaaaaattagccgggcatggtggcacatgcctataatcccagctactcgggaggctgaggcaggaggattgcttcaacccaggaggaggaggttgcagtgagccgagatcatgctactgcactccaacctgggcaacagagtgagactccgtctcaaaaaaaaaaaaaaaaaaaaaaaaaagctggcaaattgttggttggttaaaaaaaaaatctaaagggcaaaaattggatttaaaaaaaatttaaaaaaatttttttgaataagactgggtcttgctatgttgcccaggctggttataattcccttgctcaaactttcttcccatctcagcttcccaaagtgttgggattacaggcgtaaactaccacgcccagcttaaaattgggctcttaaaggacaatgaggtttgaaaatctggctagtgaatatcatggactcacgttatgtcagagtttatttacatgtgttaggttttattaattttttgttttcttgaagcagttacataatagagacataatatgaagattttacatccttcatcattgacatataaagacattaaaatatatttggatcagtccgatcatgtaattatttaagtattatagattatagaggaattggagttaatactatattgaaatctgacttgttatttgtctggagtttgtatgcattgatgaaacattttaaatgatgaaaaatatatctaagtcaatgaatgcaaacaatcaattgaaagtggaaaacttcagttaagttggcaaatatagtctatacaaacaattacacatttaactttagtctcttttctggcctccttttttcatacaaatcgagtggtaaagtcattcattcatttagctaacaagcaacctgacagaggaaagggcactcaactcagagtaggaacatctgcattccagctgacattaactcaatatctgatttaaccacctgggtctccaatttctcagctgtggcatgatgggaactggtctttagatgccttccgtcttttagattctaattttctagttccaggtattgagttagctgctctcagcaagatgtgaaatgcattgccttaggtgctggaggggatatagcaacaaacacagcactcttcttgctttcagtctatgtcggtggtttaaaatcctggtgatggcaaaccctttacaggtgtgttcccaattttgagcactgcgtaaaattaagtaacattaagttctgactgaactgaggatacttatagcaaaatactgtccatcagagggaacatggaacaaaggcagacacacttcatagtgtggagtggggcagggtatggtaaactggaaaaagccctaccatgcctgtagtcccagctactcaggaggctgaggcaggagaatcacttgagcctgggaggcggaggttccagtgagcagagatcgcaccactgcactccagcctgggagatagaacgagactccatctcaaaaaaaaaaaaaggaaaaagccataccagaagatcaaggcggcatcaaagaaagtccctgtgttaacagaaatatgtaaacattttgcctcttgggtaaataaacaaagtcagggcagtaagcagctcttctcaaactataagacggtgaagaatggccaggggaagtgattgttaatggtgaagctcgcatagacactgtgaggccctattaggctatagctacactgtacttgggattgtgctgtactgacaaccaactggtttacagttgacctcagtttttcgtgttcaaaccctttctttctttctttcttttttttttttttttttgagactgtttcaccctgccatccaggagggaagagtgcagtcagtggtgtgatcatggtctcgaactcctgggctcaagcgatcctcccacctcagcctcctgagtagctgaactataggcacacaccaccatgcccagctaatttttaattttttttgtagagacagggcctcactctgtttctcaagctggccttgaactcttgggctcaagcaatcctcctggcttggcctcccaaagtattgggattacaggtatgagcgcccagttgtgttcaaccgtgagtgacccttctgaggctgtcaaattactcagggcctggtaggaactaggaggatctgggggttgctgtagtcctggtgcatggttgttggtgatgttcagcagcgcaggtgtagattatgaaagccacaacgcttatgtaatttttcatatccttcgggtacaccaggttccatgagccagatccgaattgaggctggagtgagtgcctgtgagccaggggtggccattctgccctaagttccatgcggacagccaggctgtgaagctgaatctagctgagattagactacacagacctctgagaccaatttcaactctgagacttgatgattcttccaaacagtcctccaaacagaacaggttgttaaaaaactttttaattttaaataatataatatttttaatttctaaaattaaaaatgcatgtagacataagataaacaacccagaagggattatgcaactaaaaagtgaaaattctccccacacctcttctattctttctctctcccactgttagtccttcagggtcaccactctgaacaatttgatttgaatccttcttgatcttttgctctagacatataagttgtcccaactactgcctgttagcaacagtactgcagtgggtgtccctgtggtgcgtgtctttgtgaatatgcatatttcatttttatttatttatttattttttagatggagtctcgctctgtcacccaggctggagtgcaatggtatgatctcggctcactgcaacctccacctcctgggttcaagcgattctcctgcctcagcctcctaagtagctgggattacaggcgcccgccatcacgcccggctaatttttgtatttttagtagagacagggtttcaccatgttggtcaggctggtcttgaactcctggcctcatgatccgcctgccttggcctcccaaagtgctgggattacaggcgtgagccactgcgcccggccatgaatatgcacatttcaaaagcacagcttctatctttgtgtgtgtttgtgtgtgtttttcttttttctttttttacacagagtttcgctcttgttgcccaggctggagtgcagtggcataatctcggttcactgcaacttccacctcccgggtttaagtgattctcctgcctcagtctcccgagtagctgggattacaggcatgcgccaccacacccggctaattttgtgttttttagtagagacggggtttcaccatgttggccaggctggtcttgaactcctgacctcaggtgatccacccgcctcggcctcccaaagtgctgagattacaggcatgagccactgcatctggccttttcttttcttttaaaggtgcttttgctggatcttgccttaggcttccattttccctttgacctatcccttgcttctgtgtccaatctcttgaaaaggtgattgagcggaggttttcttgcatacttttatattattgtgcctttacaatgtggcaacattacattcacataaaacatccatctccttgggtacgtagttgttgctactatagcatttttctcattctctccttacaatatcccccattccatcagccagaattttctctcccttctggtcttgtgtaaatcttttccttgtggaatggctactgctactgtccagatggccaccagataattgtcatgttattacttattttttccagattcctgtcattttacttggacctgtttttggaatgtgagcctagatatttctagaatatcccccctctaattagcatatcaaactttgtagtcttgagcaaaccagttaacctctcagagagtccttttttcttttgaaaaatggggctgtaatggcttatctgaaagggagttaatctctagacatcccaaaggctgtgatgtatccaatagacacatgtgtatttttagtaaaaacctgctttgctatttgaaattataaagttgattttttttttcagtgggggacattaacaccaagaatatatcttttaaagcatttttaaaataagctccaaagctatgcgattccacttaagaatggggaagtaacttcctggccaacatggtgaaaccccatctctactaaaaatagaaatattagctgggcgtggtggtgggcccctgtaatcccagctacttgggaggctgaggcaggagaatcgcttggacctgggaggcggaggttgcagtgagctgagatcgcgccactgcactccagcctggcaacaaagccagactccatctaaaaaaaaaaaaaaaaaaaaaaaaaagaatggggaagtgatgtgagaaagagctcatggatagtattcactgtggtttgtccaggcacttggtgcgttccccacagagagccttggttcacccagtgagcaccataggactcatcaagaagatccctatcagctcaaactgataatcacactactcgggtattcccataaaaccactgtattgtattgacaaaacaatcaggaaggcaaaagtgtttaatctcctgagtcattcccatccctttctggagaacaaggcttagagactcactgcctaaggaaagtggccccaccctatggaagcatgggaattctcaaaggtacactccccaaaggcacattctgcagggtctcagtcatctataaagctacaatggcccttaaaaaattaattaacgtgccttgtttttctttcctccttcacaacacatctcacctgcgtgccctcagcttaggggtgctggtatttgtctggtatgggttttcctttctaatcacgggtgtgtttctcctttactgtaggatttggccctgccaagaaggtgtgggattgttatatcctctgcaacacccagcacatcactgatgttgaatatacattttaaatattgagcatgtagcaaagaactggcaggaaatttcagacaccttaatgtgacaaagtccttgatgcttagtcctgaaagagaccctgggaagtcatccaattgccctttacgtttaatatcctctcaggtgtttgtgaatgaggcttagcaaagaaccatgtcaagtattcatgaaccctgagtacaaccagttcctagcacctgttctctgggggcaaattggtgtataagacattttgcattcttgttcctggcaaggaaaatatgaagctgccagttttatgttgaaccttcatacatgaaacgtagtatatagaatgccatgatatggcagtggtcagctgactcactgtgtaatttctattgaacagctgttctgttgcactggggtgtgctttgagcaggtctgagcacagttctcaatcagaaaaagttatgggacatttgataccttaagccttatcaattaacttcttactgggcatgagggtacaaaggccctgagctctggggccagggatgcctaaatgagaattccagtggccatccctagttgctcatgagcaaatacaatctgcagcttcaagcccggtcatgatggctcacgcctgtaatcccagtactttgggaggctgaggtggacagatcacctgaggtcaggagttcaagaccagcctggccagcatggtgaatccctgtctctactaaaaatacaaaaaacttagccaggcatggtggtgggcacctgtagtcccagctactcaggaggctgaggcaggagaattgcttgaactcgggaggtgaaggttgcagtgagctgagatggcgccattacactccagcctgggcaacaagagtgaaacttcatctcaaaaaaaaaaaaaaatcagcttcagtgttcttaataatatctcctgccttgcagggctgtttgaggattaaattaatgtacatgtgacattgcacatggcagtctataaatctccttacctatttgataacagtttcatggagcactacagtgcaccagagagtatttctggaactaagtctagaaaaatatgcataagatggcttggattttcaggcctaggtgaccgactagttagcacacaagaatgagatgcaaaccagaatagacatgaaaagttacaatctgagtagatgaaagagtgaaaaagcttgtggagaaagtgtcatttggcttggttttaaaggatgagtggaaatttgacagaaataatggaaaaaagacattccaggctttggaacagtacaggaggaccagagagccatggggaggagtaacgtggtatgaatagggattgaactttactcatcaaccattggggagccgctaggccgcaatgtgaacagcagattagtactagtcagggagactagtaagaaggcttactagttgagtcaaatgcttctcagcacagatggagctcatcccaggactggaatcagaaggaaggcactaataaggaaagacactgaggaaacaacctgattaaattaaagtgataagggagccacactggacaggcaaatttggccatccttcctcacactgtactgtgaaatggaacatcagactgccttgcttccagctggagtgtgcaccctgtgggcgagtgcagggctggttggggtagctcagcaagaggccagcacgagggcagtagccacctgaggcggcagggaggccaccaagagatcgaacaaaaacagaaatacaaagtgatctttgaagacaaattttgctgtcttcccaaagatcaaatgggggagcatttcctcaaccaagctgagccatggttcatttgcataaggtccttctctccctagcctgttgtactatctgaaaggatagggagtcatggttcagaattgcttcattacaaggagcagatacccacttcagcgtgctcaaggaaaccttgatttttctaaagctagaaagaaatctggagtccagatcacagacctcacaagagccagaatcatgtcagctcccctctcctcatttcccagggactgtgcagcctcctgcctctgcttctccctgcacatggcagccattacttttctgcatattgtctataattgttggctctctgcaaattggctgtccttagtgaggcctcttgcatgggctttgggttgctgcaaggtgactgggtcttgactctacatccaactgcagtggcagcgtctcgtgcatgagatagctcagagaaaaacaccaattgccttggttttggtcagatgttcagccctgctccaattaactgtggccaaggggcatggaaggccaagacaaagtgggtagaccagatgtgtctactcacagggcagccttctgggggcctagagtatgaactctgcagcctgtctccttccagggattagatctgttcttttccatctttactctgttggttgacataacctctcacttaaaagaacccccttctttctgtaaccaacacaatacttggaaagggatgacctttggattcgaaaaattaattttcactcctggttttatccctaggagctgggtgtctttgggcaactatatttccgagccttcatttcctcatctacagagtgtggagaataatctatacctcacagggaggttgttgggagcaattgtgataaaatatatagagaacttgtcgtagtgctgacacagaatgttgcatgacaggtgctcatgtcttctggcttttatgccccacttcttcccccattgctgcagggacatacagagtcctgggggacatttccaaggggtggcccaggcttagctgttcagaataaacaggatgctggtcagctgtggctgcacaaacagcttgaaggcattgccaaagtaggttctttgtttttaattgtggtaaaacacatataacgtaagatttaccatcttaactattttaagtgtacagttttgtttttgtttttgtttttgtttttgttttgagatggagtgttgctctgtcacccaagctggagtgcaatggcgccatcttggctcactgcaacctcctcctcctgggttcaagcgattctcctgcctcagcctcccaagtagctgggattacaggcacatgccaccatgcctggctaatttttgtatttttagtagaggaggggtttcactatgttggccaggctgatcttgaactcctgacctcaagtgatctgcccacctcggcctcccaaagtgctgggattttatttctaatttcctgaggaaatggcctactgttctccatagatcctgcaccattttgcattcccaccagcactgcacaagtgttccaatttctccacagccttgacaacacttctttttttcttctttatttcataatagccatcttaatgggtgtgggcatagtaggttcttagcaactctctgacttggattttcagctcacacttgctgcattagctcagagtgagaattgctgcagtgcaggcctcgtcctcagtgatcagcaggaaggcagctctcctgtgatggaaagcccacctcgcaggagcccagcagcagcctgaaagagcctggtggcctcttggccagtggagcccagctctgaggtccatgtggccagagttgtgctgggaaccatagtagagccaaagacgtgtgggaaatagccttggtcctctgcaataccaggtcttccagttggccaccgtgccgagccttttttttttttttgagacagtgtttcactcttgtcacccaggctggagtgcaatggtgcaatcttggctcactgcaacctccacctcccaggttcaagcaattctcctgcctcagcctcctgagtagctaggattacaggagcatgccacaatgcccggctaatttttgtatttttagtagagaaggggttttgccatgttagccaggctggtctcgatctcctgacctcaggtgatccgcccaccttggcctcccaaagtgctgggattacaggcgtgaggcaccacgccccgccttcatttcgtttttaggaagtaggtattattgacatcttcattttccctatgagggagctgaggcagagacaggtcaggatttaactggattccagatggtccatgcgtcttcactgagctcagcatggatgaagaaacaactcacaacctctgactacacaaccaactcacataaacagttcctctctctctgaacagattgagttgtttagtggttggagtcattaggatccagtctgaaaaaggaagaaagtgtaccaagaacaaaagaacttaaaaaaaaagaaaaagaaaaaaaaacccatcccccctggggtgagtttgcaacagagcaatgaaagcctttatgacatgctgtgactcagaagctcagaggtgacatagcttagcagtgaatcagttccactgatagtcaagtttgagccattttattagtggagactagaaccataacttcttgtaatgtaaagtattaaaaatctaatatttgactggcagggcgaggtccacttcatttcacctccgtttgttagtttatgaccttcatcatctttttcatctcaatagtgcagcttataaattgaaaaaaaaaattccttgcccttctctctctttctttcaataaataaaatgttatgtttttgcttacccctcctaacagactgaattcattgctaggacactccctgtctctgtccctcctatgtttagcagctccttcctcattccaagcatgaatccattcaacaagcattgatccaagcattgattgagagggtactctgccaggcagtgtgcttagctctgtgtatagggtggggaacaaagcaagtttggccctgcccacatgcagcttatagtctaggctgtaaatggggccagcgttcagtgaattaagagtgtaggctgggtgtggtggctcacacctgtaatcccagcactttgggaggccgaggtgagcagatcatttgaggtcaggagttcgagaccagcctggccaacatgatgaaaccctgtctctgctaaaaatacaaaaattagccaggcatggtgttgggcacctgtagtcccaagctacttgggaggctgaggcaggagaatggctcgaacctgggagacagaggttgcagtgagccgagatcgtgccactgcactccagcctgggtgacagagcgactctgtctcaaaaaacaaaaaacaaaaaaacaaaaacttctggaaaggagacattatcattattggcaattatattgatggtgatggtttactggctgttaagcactgtgctacatgcttcacatgtacttagttatttaattttaacatattcctttattttctttctttctttctttgtttctttctttttttttttttgagatggagtctcgctctgttgcccaggctggagtatagtcacgtgatctcagctcactgcaacctccacctcctggggtcaagcgattctcctacctcagcctcccaagtagctgggatttcaggtgcgcaccatcatgcttggctaatttttgtttttttagcagagactgggtttcaccatgttggccaggctggtctcgaactcctgacctcaggcgatctgcccgccttggcctcccaaagtgctgggattacaagcgtgagccactgcgcccggcctactcctttattttctcaccaaaaaagtaaaaataaaaataagaaagaagtcctcacttgagagctgaacaaactgagtctcgggtagagtgggtgaaatgcctcactcaaggtcttacagcagggtctaggtggagctggaacactaatgcttaccgccaaggctgtaccacctgtgctgtcccttatgcagccctgagtgcttggtcttggtcgcatccaaatctggcccatcctgtggtcaggcacgtgaactcagcccacattgctggcaatctgggctctgctgcttactcttggcagtaacttccctggacaaagccagccctgagggcatctggtcacaccatgctggggcctggggcattggtgcctttgagctggacatctctggtctcagaggccttgtctggggccccaaattccctcttgtttgccctagggtgttggacacattatgatggcttccatgtgtgaaattgccttgcagggtactgacagtgtagaaagctttttcatgggtgtaatcttttttttttttcttcagagatgcagtctagctctgtcgcccaggctggagttcagtggcatgatcttggctcactgcaacctctgcctcccaggctcaagtaattctcctgcctcagcctcccaagtagctgggactacaggagtgcaccaccatgcccggctaattttttgtgttgttaatagagacagggtttcaccaagttggccaggctggcctcgaactcctgacctcaagcgatccacccacctcggcctcccaaaatgctgggattatgggcgtgagccaccatacctggctcatgggtataatcttatctgttctccacaacaacacaagcaggtgctgaaggcagatattcataccgattgtgcagatgaagatatttagactcagatatcaagggaggccaaagctgtgtagccagaaagaggcagggaaggactagaagctgggtcttgggatgcttggtcctttgctttttcccactgcttcatatatggttggttttctttgtgcttggcgtcttctcattttaattccaccctctgtccttgtcccaggccccactgacaaacaacagctcacaaacactcctgactcccagctctccctctgatctgcagcaaacaaccagcccagcttgctaaagcgcccagaggtgaaagccatgcacagcataggaaggagggttgaggaaagtagattaaactgctggcagggcccaaaattccagtgaaagagatgactaatgatgagacaccagggtctgaagctgaggttaaattcaactggaaattcttggcctgggagggataggatctaattatcaagatttttcactccgcgctttgcatttgttttcaaggttgttttaagtgactattttattttctcttgataccatctcttggagcgaggaaggacagaggactggatcctcccaaagcttgcctgaaggaagcagttgatagttctgattccaacacctggtaatgtcccctgtgtcttgggcatgggtatgctttctcatttgatccttgctgcaattctaccaggtgggcttttgtatcccctttttagaggacactcgggacttaagaggcactgtaggccctacctcctcagctgggtttgaaatgtatttgctgagtacttgagacttaattcattctctagcaaattatgtgaaatatactagtcagaagccagagaggttgagtggctccagagccagaagacctatattcaaattctggctttgtttcttactagcaggtaatcctggacaagctacttaactttcttgtgccttgaataaggatcataataataataggtaacatttacaaagcccttagaagagtgcctggcagatggtaaaccctatagttggtaggaattattcctgggcattagataccaatctttattaatgaagaagtctagatatgaagagctggagtaagtagaccaagttcacaccactggaaggtctgaaaaagtgacaggtcgcctggcaccctctgcctgcagtggcagttaagagcacaggtttgctgagaatgatggtttccagtttcatccatgtccctacaaaggacatgaactcatcattttttatggctgcatagtattccatggcatatatgtgccacattttcttaatccagtctatcgttgttggacatttgggttggttccaagtctttgccattgtgaatagtgccgcaataaacatacgtgtgcatgtgtctttatagcagcatgatttataatcctttgggtatatacccagtaatgggatggctgggtcaaatggtatttctagttctagatccctgaggaattgccatactgacttccacaatggttgaactagtttacagtcccaccaacagtgtaaaagtgttcctatttctccacatcctctccagcacctgttgtttcctgactttttaatcattctcagcaaactatcgcaaggacaaaaaaaccaaacactgcatgttctcactcataggtgggaactgaacaatgagaacacatggacacaggaaggggaacatcacactctggcgactgttgtggggtcgggggaggggggagggatagcattaggagatatacctaatgttaaatgacgagttaatgggtgcagcacaccaacatggcacttgtatacatatgtaacaaacctgcatattgtgcacatgtaccctaaaacttaaagtataataataataaaatttaaaaaaaaagagcacaggtttggaaacaaggctgacttgggtctgaagctcagctctgccacttactggctctatgatctcgggcaagtcagttaacaaccctgatcctcagtttccttatctgtaaaatgagcatactcatatctcctatttttgttgttgttgtttgtttgtttgcttgtttgtttgagatagggtcttgctctgtcacccaggctggagtgcagtggcctgatcacggcccactgcagccttgatctctagggctcaagtgatcctcccacctcagcctcctaagtgagtaattgggaccacaggtgcaagccaccatgccaggctaatttttaaattttttgtagagatggagtctcattatgtttcccaggcaggtctcaaactcctggactcaagccatctcccacctctggcctcccaaagtgctgggattacaggtgtgagcactgcgcccagcctcccttgtagggaacagacgtgaatgtgtttaatatgcccagcacacaacacaaacaccaaggcagtcaagccaggtgcctggccctcctgggagcccttcccagcagccctggcagtgagcagagctgggacatgaccacgccccagcatcagcttttaggaagcagattctggctgagtcattcaaatggactggacttcactgcagctcccttggaaaatgtgggtttgattcaagagcctgtacatctgaaaggtcattcccagaggccagtggggcactgggtgtggagaggggagcagtcacccctcctgcctttttgctggggcatttctgtttatcagtgatatcagtgactgtttcagaaatgtcccaaacagcctcgctttgtatcctgttgccacttgcccaaaatgcctttctcctagaacctgtttggcagcatcttcctggaacgatagggcagccaaggttggaaagccaaagtcagagacactcctggagaggggtccacctgatgggccctgtgtccctgtgctcccccaggtgtctctcaagtccccagggtggaggcgtttctgccagcccttctcagaaacttctctgccccttgttgatagtagaaattagccagctcctggaggctgccaggctgcctgccagagaggagcagtcactgctcacatgccagctgccccagggaaactcagaagcctggaatggagccacgtggaagaaatattccaccagggcggtcccagcctcacagggcacttcctccagtcacaggggccctgccctccggagctccacagcctgggaactccctggggggatgcaaggaggctgccctggtgctgtaataagaaatcatctagctgtgtgcggtggctcacgcctgtaatcccagcactttgggaggcggaggtgggcggatcacctgacgtcaggagttcgagaccagcctggccaacatggtaaaaccccatctctactcaacatacaaaaagtagatgggcatggtggcacatgcctacagtcccaactacttgggaggctgaggcaggtgaatggcttgaatccaggaggtggaggttgcagtgagccgagattgtgccactgcactccagtcatctcaaaaaaaaaaaaaaagaaaagaaaaaaaagaaagaaaaaagaaaagaaaaagaaagaaatcatctgatagctctcatttgtttagtgcttactgtgtgccaggccctgggctgggcactttgtattcattctttcatttaatcattaaagccgcctagtaatcacacttatatgaacttatgaagtccaatttactccgtcatggagaaattactatgtagtaagcgttgtggggggaataacaatattaataatacatagtctcagccttcaaggcatcaccctcttgtcttaatcctccaactttggaaactaattgctttttgtctctttcgaccggggtttgaatcccagctccatcacttactagctgtatgacctctaataagttgcttaacctctctgtgtcttggtttcttcctctgtaactgggaatgatcataatagaatttatctgttagagttgtgaagattaagtgagagaatccatgggaagtactgggaacagtgactcagttcagagcacttaataataagtgctagccatgtatgggtgtggttcaggggtgtgtgaaatgttaggcaaaatggcagatgaattcatatggggctttatatatctcaaaagaaaggaggcatgacccagagacctagaaaaggggaagaagtacttctgaatgggagatcaaatgtagactcttggctgaacctagagatcttgttgttctattttgtctaccgaagagctgagttacttagggagcttttgtagacagcaccctaacttttcctgaggccatttcagaaagacacagcaatctaaccgttcaggacttggggggcacatcataaaggttatgtaccataagtctgggggaaaacttagagattatatatctcgtctgaatgcatcagtttatatatgagggactctgagcttgggggttcagccttatattttcctaagataacagctcaaaggaagagaagtcacagatatgaaagttcagtcagaggggctgggccgacatctgtgcttttccctgcaggatttttaggatcagtgagacggtgtgtatttggaagcatttcaaatgtgttaccatcgtgttacttccgtgggcacctggtgttattggttggactagtcaggattctccagagcagcagaagcaatgggatgtgtgtgcatgtgtttgtgcagagacagaaagagagattttaaggaactggcttatgcagttgtgggggctagcaagtctgaaatttgcagggcgggccagcaagctggaaattcatgtaagagttgatgttgcaatctctagtctgaattccacagcttagaaaactcaggcagggtttctatgttagagtctagaggcagaatttcttctccaggaaaccagtttttgcttttaagaccttcaactgtttggatgaggcccatctaaattatagagggtaattttgctttacttaaagtcaactgagtgtaaatgtttatcacatctacaaaatacctcgacagcaacatctggacttatgtttgaccaaacaattagacaccaccatagcctagccaacttgacattaaaatgaaccagcgcagctgaccaccggcacagatgtagcaagccagtctcaggagtcctgatgtctttcaggccttttttttttttttttttttttgagacagggtcttgctctaacacccaggatgaagtgcaggggtgtggccactgcagccttgacctcccaagctcaagcaatcctcccacctcagcctcctgagtagctgggactattggtgcatgccagtatgcctggttaatttttaaatattttgtagagatgggccgggtgtggtgcctcacgcctgtaattgcagcactttgggaggccgagacgggtggatcatttgaggtcaggagtttgagaccagcctgaccaaaatggtgaaacccccatctctactaaaatacaaaaattagccgggcatggtggtgggcacctgtaatctcagctactcggcaggctgaggcaggagaatcacttgaacacaggaggcggatgttgcaatgagccaagattgcaccactgcactagatcctgggcgacagagtgagactccctctcaaaaaaaaaaaaaaaaaaaaaaatttgtagagacgaagtctcactatgttgcccaggctggtcttgaactcctggactcaagcgatcctctggccttggccttccaaaatgttgggattacaggtataagcaccgcactgggccaggccttttcaataaggttctgacacactggctggtaggtgaacagcaaaggaaatggttccgcgcaagagggcgggtggtttggctaagagagctgttcagttctcccggaaaccttgtttggaggctggcattggggttaattactgcagtggtgacctccgcagaactgagtgagaggcaggcgtagctaatcggaaaacaggaaatgtcctgaagaacgacttgagcccttgagcacactcagagtgtgctctgcatttgagtcagttgttatgttctgagctgaaaatattttattgctttccataggaagaaacagtcatcttaataaaattagacgcaggagccaggttggggggtaggtaatgtggagaaaggggagggagtttcctgtaattcaatttgatgttcagtgcctgcaggtttaaccttttttttttatttttacagaggtagaataaaataattgactaatataaatatgtgactggctgctgataagaaaaataatttatctactttttttttttttgcctgatgtgtttatgtgtgagaataggttttcaataaaatgtaacatatacacattttgataaacatcagagcctccttcttgaaagagattgagctgggtttctccagaagggtaggagccaatgccagccacttagtttttccttattagctagggaaatgggaggtgcagtggttaaatgcatgggctcaggagtcatactagacctggttagagggcttcgtcctagccctgtgatcttgagcaagttacctaaccattctgggctctctttgcttctctgcaaactgaggataataaaacagtgcctacgtcataggcttgccaggaggattcaatgaaatgatgcatgtaaagggcttagcaggccgggcacggtgtctcacgcctgtaatcccagcactttgggaggccgaggtgagcggatcacttgaggtcaggagttcgagactagcctggccaacatggggaaaccctgtctttactaaaaatataaaaattagctgggtgtggtggcacacacctgtaatcctagctactcaggaggctgaggcaggagagagattgtagtgagcaaagagcgtgccattgcactccagcctgggcaacacagtgagactctaactcaaaaaaaaaaaaaggtggggggcttagcaatgcccagcctgcagtgagcatcccctagaggtaatgccattagcatcaacctcacacaatgagtgccaggagctgcaggaagttctggttgaatagctccacctggtctgtggtcaactggcatctgcctggactcagccactcccctttgttttcaacacacaattgaatcatgtgttcaggaacatgcattgggagaattgttgggccacttggtttttctcatgagttataaaattttgaagttataaaatccagtttctaataccctcctcctttaagtacttatatcagccaaatgaagcttagcctggtacttgaggcttcacagtgagaccataaccttcccacaaagcccgtttgccccctacccagttctatgctctttggttccagctggttgggtcctggagtgtccccagatgtgacataactggttctccctcctccatgcctgatccacccaccctattgtgtctactggagtgagctcgtcttctggctccacattttcaacccctccttgcccttgaattctcatctagctcagcctctgcatcttctgtgcacacagcctgaagtcacctttctttcctctgaatttttctgtgcattgatacccctctgatagcaactgaagtcctttctctatcagtcccgtatagccacatttcctctccccactagaccccctgagggcaggaaccatgtcttgggtatttttgtgtctcctacagtgctcaatgcctggcaatttcacaaacatttgttgggtggaagaatgaaggagctgattaatgtttgcggaagaactcactcagtgaaccatttctgtgggctgagctgtgaggtctcttggcctgagctgaccagtcattatttctgtttattccccctctgacaggcaggaagaaacttcaggatgagaatgagacaggcaaaagcctggtggagctttgtgctatttcttttcttttcttttcttagatggagttttgctcttgttgccaggctggagtgcaatggcgcgatctaggctcactgcaacttccgcctcccaggttcaagcgattctcctgcctcagccacccgagtatcggggattacaggtgcccaccaccatgcatggctaaattttgtatttttagtagagatgggtttcaccaagttggccaggctggtctcaaacttctgacctcaggtgatccgcctgcctcagcctcccacagtgctgggattacaggtgtcagccaccgcacctggcctgtggcactttttttttctttttctttcttttttttttttttttttggagatggggtcttgctctgttgcccaggctggagtgcagtggcttgatctcggctcactgcaacttccgcctcctgggttcaagcaattctcctgcctcagcctctcgagtggctgggactgcaggcgtccaccaccatgcccggctaatattttttgtattttagtagagacggggtttcacccatgttgtccaggctggtctcgaactcctgagctcaggcagtccacccgccttggcctcccaaagtgctaggattacaggcgtgagccgccatgtccagccagcctgtggaactttttaagactaagaattatcttacactcttctgtttcctgttactggcacacagtggatgcttaataaatgtttgtgaatgaatgaatgaacaaatgaatcttttcacactccccagctgctgactctggaacaatcctgtgcctcctgagggcagagaggatccatggtcccaggcttggcctcaaggtagcttgcagcgtgtcttccgtgttctctgtttcctgggtcaggaaccaggcttgggacttgtttcatgttgacaagcgctggttttttctgtgacctccctggagcccttgtccctgccttggctccctggttggagtcttggggacttggagactggaattttgcttcagtgccatctttcagtgatgcaaatcctaccccaagcctgggtgctcagtttctattgcattattttctgccttctccttgctttcccttcttgctgggacttcttggaatctcctatcttctctcttgaaggaccgccatggtctcagggtccagatccactcctttgagactcagttctccacccccccaagccccggttatgggagcagggtagtggtaaggtagagggagattggtggtactatttcatgcttgttgaatgctgggattcctaacctttttcaagcacatttgagaatctgatgagaacaatgagctctttcctccaagaaaactcacagatgcaatattttgtgtattagagcaaataatcttggagagtttcaggataccctggaacgcaaccataaacttccttatggacattttccaagacgccaagcccatcacatgtgttacatttacgaatcttcattatccagcatttctgacagcttccaataaggcactgtggcatggtggcaaacacacacaaacacagattttggagccagagggatgtagttcaaaatctggctgtttccttattagctgtgtgattgaaggcaggttaactactctccattttcttggcttagaaatgggaatgaccatgtttacctggaagaattgtctcaatggttagagacactgtggtagaatgcacagcctggcacctagagatgattctgtagagggagcagctacaattacacatagaaaccattttgtccagttctatttaagttaaaaattctttgcatgtctcctgtttctctcaagagcactttcttatactgtaaccagagaggaggattgggagtttctgttagatgaggagagggaagggtggggtcaaaatggaagtgtgggaggggaagtttctggacagcgtctaggggacctcagagtcagatgcagtgaggggctctgtaggccacatagagagagcacaggcagaaccagccaggataggtctgggcacaagccgacgaggagcgtcacgctgaagcttaggaagggaagccattgggctgtgtgttgccctctcaagtggaaaagttaatgcttagcagagtgaggtccatgactcacggccttgctatgctgaggtcttggaagaatgaggtggttagtcccacaggcagctgtgtgctgggagccaaagcaatgtgacattagctaaacaaaacccactacctcctacattccacagcagcagaggagaagcaaaggctgaggagtgattcaaagtgtggccactaatgtgagactgcctgggtctcaaatcctagcaagaccatttattaactgggtgacttatttgttttttgttttgagactgagtctcgctctatcctttaggctggagtgcagtgacacgatctcggcttactgcaacctctgcctcctgggttcaagtgattctcctgcctcagcctcccgagtagctgggataataggcacccatcaccatgcctggctaatttttgtatttttagtagaagtggggtttcaccatgttggccaggctggtctcctgacctcaagtgatctgcccgccttggcctcccaaagtgctgggattacaggtgtcagccaccgcacccagccaactgggtgactttgaatgttactcagcttctcagtttccttagctgtgaaagggggatgaaaatagtaatatatacctcctagggtttgttttttgtttttggacagggtcttgctttgtttcccaggctggagtgcagtggtgtgatcttggctcactgcagccttgacctcctgggctcaagggatcctcccacctcagcctcctgagtagctggaacctataggtgtgtgccaccacacagagctaattgttgtatttttgtagagatggggtttcattatgttgcctacgctggtcttgaactcctaggctcaaacaatcctcccaccttggcctccataagtgctgggattacaggcgtgcaccacctcacctggcttctcctaggtttttaagattagatgaatgccgggcgcagtggctcatacctgtaatcccagcactttgggaggctgaggcaggtggatcacttgagctcaggggtttgagaccagcctgggcaacatggcaaaaccccatctctagtgaaaaaaaaaaaaacatagaaaaattagctgggtgtggtggtgtgcacctgtggtcccaactacatggggcgccgaggtgggaggatctcttgagctgggaggcagaggttgcagtgagccgaaatagtgccactatactccagcctgggcgacctcgcgagaccctgtctcaaaaaaaaaaaaaaattagatgagataatgctgacaaagcattttgtactcgaagattagcttttatttgggtaggtatttggggacttggggacccaaaagaagcctctgctctttggactttgctacaaggaaactttaagcacttgctggatttgctcgtgtgctcatccaggtaggtgtactgtccaggctcagacacagagaagaaagatcttgtgtcttcagaaaaggtggcctcggagtaaaggaagccccaaattatccgctggtcttagaaagttttcatctactaatgaccttgtaccgaagcctatgggagggagtccagcttaatattgaagctgtgttggcatcttagcacactcagatgcagcatgagcttcagagctgaaattccaggtttaaatcagggcatcactgccaggtgtgagctcagataaacgtcttaactctttgagcctcaatatcctcatctataaaatagcaatatcagcatctcagaggttagctttgttggcttctttctgcagcaagccagagatgcagaggctctgggtagccttggtgagagaagggcagaacatcacatcccttaactccatgtagacctggagatgggaaaaccttgtagaccaaaaaatgccatttcatttggaaaactgtgattcaggtaaacacccatcctaagcgatgaatggggagatgtgggtgcaagtagacccttgggtaatgttcttagaataaatgaatggcccacgctctttaatttttttataaatgattgctgtctcttcctttatctcttttgcagatgagaaaaagaaaacaaagaaagttgataatgaattgaaccctgtctggaatgaggtgacttcattgttttttcaactttgttttaatagataagctatttctgattgtcctatctttgggtgagaggttacctcttcccttcggaaggagaatctctacatttcacccccacccactccgtttccctttgtgttcaccaagagagcagagcagttcaaggagagtagctcaccagcgaccatcttctgtacagcagtggcgcggcaagggaagcctggactggcaggagagttgagttcttaccaggcaccgccacgagcttgctgtgtgagcttggtccacttatgttgcatatctggggcacatgtgcagagcaagggtgggattagatcatctccagagtctcagaaggaaggcctcataattaaaaacatgtctgcatgtgacaaatcaagagtgtatcacatgattctctgtgtgtctagctgggtaatgacatgtattggttttatgttgataaaagtgatgtccagtatgcttcatgtggaaacttttgaaaacttcaattaatctttaaaaaattaacttgggtcccactctctagaggcaactactattaacatctgtgatgtatcactaagtgtttattggaggaatatatttaatgaaatacgacatctgataacacaaactagcagcatatagcaaatgatttcctctcctacactttcttgctattatatcctaagcatatgcccatattaattcaaaattattttaataattcaaaagtattttaattcaaaagcataaaattattttaataattcaaaagcataaaattcaaaagtattttaatgactgtgcaatattctactgaagacatataacttatttacctccccccactgtcgaccttatatctattttagaagtggttcagtgtttaatattttcacaaataagtgaaaaaatttaattcttcccactgaataggattttcctactctctctctgtctctctcttttaaaccacccaattattcatgaaactttaactttttaacagttgatggccagctccattgtgtttttcaaaagctgggtcaaacctccctggacaagagcaataatgaatgtctttgttattttcaccaagtcactaggccatgaaggctcccctccacccacccacctttctctcccaactagtttcaatatctctataagataaagactagaaccttctgggtttttttttatttgtttgtttgtttttgagatagggtctccctcaggttggagtgcggtggcgtgattaagattcaatactgccttgaattcctgggctcaggtggtcctcccacctcagcctcctgagtagctgggaccacaagcgtgcaccacacccaactaattgttttattttttgtagagatgggcttttgccgtgttgcccaggctggtcttcaactcctgagctcaagtgatccacctgcttcagactcccaaagtgctgggattacaggtgtgagccattgcgcctcgctagaccttattcttgaatgaagtgaaacaaaaaactttttaatgccttgggggttttttttgttctttttttgtttttttgttttttgtttttgtttttgtttttttgagatggagtttcgctcttcttgcccaggctggagtgcaggttgctcaccgtaacctccgcctcctgggttcaagcaattctcctgcctcagcctcctgagtagctgggattacaggcatgtgccaccacacccagctaattttgtatttttagtagagatggggtttctccatgttgatcaggctggtctcgaactgtcgacctcaggtgatccacccagcacccaaagtcctgggattacacgcataagtcaccacggctggccttttttttttttttttttttttttttaattaaaaaaagacagggtctcgctctgtcacccaggctggaatgcagtggtgtaatcatatcttactacagcctcgatctcccagggccaagcgatagccctgctttagcctcctgaatagctgggactacaggtataagccaccatgcccagctaattttaaaaaacatttgtagagattacatcctgctatgttgcccaggctggtcttgagttcctggtctcaagccattttcccatcttggcctcccaaagtgctgagtttacaggcgtcagccactctgcccagcctttttaatgcctttctgaaacgcccagcaggtctcaggcaggttgagagggaattccacttatctgtaatttccccagaatccagaacacagccagctggactacaagctccatgagagcaagaggccccttgggttggtcattgtggattcctagcacctgacagaactccaagaataaagcaaataaaaaatgcatttatgtgagagtgcttcctacttcagattttgaatcatcccaactcatctcttcaaatttgagattgagatcaagccacgtgaccaatggcagagagagatgtgctgtcatgcgagctggcatgtcctctgcagggaatcagccatcttattccattttgtttccaacatgttttttttttctttcctttcatattgcagatgtacttatcaagtaaactgttttataattgaaaccaaacacaaatgaaatgtcaaccccaaacccactgggattgctggtgctgggtgtgttcttttttttcttttttcttttaagatggagttttgctcttgttgcccaggctagagtgcaatggtgcgatctcggctcactgcaacttccgcctcctgggttcaagtgattctccttcctcagcctcccaggtagctgggattacaggcatatgccactacgcctggctaattttgtatttttagtagagatgggatttcaccatgttggtcaggctggtctcgaactcctgacctcaggtgatccatctgccttggcctcccaaagtgctgggattacaggcatgagccactgcgcccggctcttttttttcttttttgagacagggtcttcctctgccacccaggccagagtgtaatggcacagtcataactaactgcagccataactaactgggctcaagcaatcctccccactcagcctcccaagcagctgggactacaggcacacaccactgcgctctgctgatttttaaatttttcacagagacagaatctaagttgtccaggctggtcttgaactccttgcctcagcctcccaaagtgctggagttacaggtatgagccaccattcccaggctgggtgtgttctaagagaagctctgaggccacgtgtggtggcacatgcctgtaatcccagcactttgggaggccaagacgggtagatcacatgaggtcaggagtttgagaccagcctggccaacatggtgaaaccctgtttctattaaaactacaaaaattgtccaggtgcggtggctcacgcctataatcccagcactttgggaggtcaaggcgggtggatcatgaggtcaggagttcgagaccagcctggccaacatggtgaaaccctgtctctactaaaaatacacaaattagcagggcatggtggcaggcgcctgtaatcccagctattcgggaggctgagacaggagaattgcttgaacccgggaagtggaggttgctgtgagctgaaattgtgccactgcactctagcctgggcaacagggcaagactctgtctcaaaaaaaaaattagctgggtatggtggtacacacctgtaatccccagctactgaggagactgagaacttgtttttttttagaagtgctaaaaataattttttaagaagttctgaaacaagttttccttccattccaagcccactacaaggaggatcaagtcatcatttaattattacctaatcagtcaaaggcatcagtgacgctttatcaatcttttttttttacttttgtcattaggaagcaacttactgcattaaaatgagagtctcagaaaggtcggtatattatagcattgaccgaccatggtggaacttaaaatgagaggcattttagaaaatgttttcttagattattcatcttctttgtttgatagtagtatgattaagaagagcagataatttaaaactagccattgaagaaaatgttttcacatataccctgcattttattcttttttaatttttttatttttgttattattatactttaagttctagggtacatgtgcacaaagtgcaggtttgttacatatgtatacatgtgccatgttggtgtgctgcacccattaactcatcatttacattaggtgtatctcctaatgctatccctcccccctccccccaccccacaacgggccccagtgtgtgatgttccccatcctgtgtccaagtgttctcattgttcaattcccacttatgagtgagaacaacaccctgcattttattcttgcagcagttgtggtagtcgttgagtccagctcttgagtatgaagcaggggtgtggtcacctggttgaagccacagaacctagaaagcaggaagccaggagttgtctacaggtcctctaagtcgacatctggtttgctttcctgccccctcagctgccttcaggtttagaatttaatcatttctgcataacttcaaaagattgtcattggtgaaaataatgacccaacatgtagtactggtgcatcttagtgtaatctctgctccttctaacagcctttttttttctcttttttcaaaacctttctgtgaacagattttggagtttgacttgaggggtataccactggacttttcatcttcccttgggattattgtgaaagattttgagacaattggacaaaataagtaagttgttttcacctgtttttctcattttaggtattactatctcactgttgtttattttgttgaagagacacatctttaataacgtattataatacttccaatataaatgtgctttaattccatgccccgctcccttctaagccaatagcagatgtggctaatccatcacagcactttttcccaatgactgcttttattccaaaaaagctgcaaacaccgagccacctagactagtttatcaaacttggcacttagagtgaagcctgttcacatgcctacaacttcttggtcaactgcacttcctacctctggcagtttatctgaactgtagtgatattggatacaacccaaatcacttcttctgattatttgtggcctatacatgtctcattcaagttttactttcagccccatttccatgttaatgtctccttcgccttttaatcccaacagacctaaacagaccttaatccttgccttactgcctctttcctttcacatggggaagggtcacggtggtgcccgtggtgacactgagggttgtcctctgagtaaaattgggagacttcccaaacaggttcccgtgggacagaatgatcttagtattaataaattcaccctagtcctggatctggactttggccttgtagacccagtcgtatgttaccaattcaaactaaccaagttcacaagagactaaaggtttttttcttttttttgactctgtcacccaggctggagtgcagtggcacaatcttggctcactgcaaccttcacctcccaggttcaagcaattctcctgcctcagcctcccaagtagctggaattacaggcgtgcaccaccacgcccagctaacttttatatttttagtaaagacagggtttcaccatgttggctaggctggtcttgaactccttacctcaggtgatctacccgcttcagcctcccaaagggctggaactacaggtgtgagctaccgtgcccagctgatactaatacttaaaaccagaatacctgcttattttccttctggtggaagtcaattgcctagtgacagggcatttctaccctccaacccatgaattttccttcaagtcataccacatgggaagccaaattactttgtatcctcgatttcaagatgttattgtttataaagtatactatcaaattaataaatggttaggggccaaaaaaagcgtgatatttaatgcccccatcaattgtaagaagcatttcagtttttagtaatgttagtacatttaaaaatgtatgtcttaggcacatctgatataatctgaaggctgcagtgagagcaaaaatttaggataaattagttgaggtaggtggtcacatgctctgattgcttgagacagtcctggtttgctgtcctagcacagtgattaataatgccccttttgcagtcaacgtggctgggtttggacagtaaattattattattttttgtttttgagatggagtctcactctgtcacccaggctggagtgcagtggcgcaatctcagcttaccgcaacctccgcctccttagttcaagtgattcttgtgcctcagcctcctgaacagctgggattgcaggcatgcacctctccacctggctaatttttgtggtttttgtttgtttgtttgttttttgagatggagtcttgctctgtcgcccaggctggagtgcagtggcacgatctcagctcactgcaacctcagactcctaggttcgagtgattctcctgcctcagcctcctgagtagctgggactacaggcgtgtgccaccatgcctggctaatttttgtacttttagtagagatggggttttaccatgttggtcaggctgttctcgaactcctgacctcatgatctgcctgcctcggcttcccaaagtgctgggattacaggtgtgagctactgcacccggcctatttttgtgttttttagtagagatgaggtttcaccatgttggccaggctggtctcgaactcttggcctcaactgatctgtccacctcagcctcccaaagtgctgggattacaggggtacagtaaattagatggtcactccagttattggggtcttctgcttaccggcatcaaaataagagagtctgcacagacatggactccctggacagtgctttgataggcactcccatcttcgcctttgatgacatcctttttaccattctctgttgctgaccgatgccccctgcatatttttctgtaactatataaatacattctgggccaggtgtggtggctcatgcctgtaatcctagcactttgggaggctgaggtggaaggatcacttgagcccaggagttagaaaccagcctgggtaacatagtgagaccccatctctaaataaatgaatacatacctgcatacattctagcaggttctggtcccactctcttgcactggaaactattctagctttttaagtttctgtcgcatatctcagctgcgaactattatatgattatttattccccaccccaactcccaaaagccagttttatttcccatatttcaaagttttggggaaggggaggagaggggagggcctcacactagcctcctgcatgttactaagactaggccctcctcttctttgctttcttctttctgcaaatggtaccactgtttatattctagaccaggcctctccaacagaaatacagtgcagggtgcacatgcaatttaaaattttctagttgccagattaacacaaatatgaagaaatgggtgaaatcaattttaataatatatttaactcagcagattcaaaatgttatttcaacatgtaatcaatgtgtttgaatcactgtgatattctgcacacattctttctcttactcaggctttggaatctggtgtttgcttcacacttacagcacctctcaattcagagacttaccacatttcaagtgctctgtagccacgtgtagctagtggccaccatattggacaggatggtttcagatcctgggcttaaaacttcagacctctctgcaccctatccctcttgctttttttttgagacagagtctcactctgtcacccaggctggagtgcagtggcgtgatcttggctcactgcaacctctgcctcccaggttcaagtgattctcctgcctcagcctcctgagtagctgggattacaggtgcacaccaccatgcccagctaatttttgtatttttagcagagacagggtttcactatgttggccaggctggtctcaaactcctgacctcaagtgatctgcccaccttggtctcccaaagtgctgggattacaggcgtgagccactgcacccagctccctcttgcctcttatccagtctgtcctcagatcttatgttttcttcctttccaaagtctgtgcttgtgcctgtgtttcttccccaagcccacagccaccagcctggttgaggccttcctcattttatgccttatctattttagcatggcaatgggctggcctcaaaactctcatctatggtttaaagtccttgctttcctgaaggttacgatacttaaggaaagttagaaaataaacaaatacactaaaaaatatatacataatatgtcgggtaccatgaatgctgtgagctaaagaagaaactgttatatcccatgaagaaaagcaaatcagaggaaaagggaaagttgtcaagggtggggggaaaggagatcccattttatgtgaggtggtgataaggtgacaattgagcagagacctaaatataatcacaaaagtaattgcaattttgcaccaacctaatataatgaagaactgagccatgcagttcattggggggttagggagtaggggggaagaatattctgggcagagaatagcaagtgcaaaggccctgaggcaggagtgcactggggatgctggagaaacgtgagaaaggcagccaacctggggcacagtgagggttgaaagtgcaggaaggaggtgaggtcagagaaaccacaatatatgtggctttgggggccaaggcacgggctttggatttcatcctaagtggaatgagaatccgttaaaagcttttgcttatgatctgacatattttaaaaggatcactcaggctttctgtgtagagactggaggtaggaaccagttaggaggcaggaaaacaatactgggagaccattatatatttattttagacccattgaaaacacagtggggccctcagatgacagcagtgatggggagaggtcagccccccaccgtcaggctcaccctggcactcatttcgggcatttttgtgcatttctagagatagagtttgttgtaaccaagtgagttatagagaaacgtcacactttgagactaattcaggagtcctttattagctggcgaacgagagacagctagcgctcaaaattctctcagccccgaggaaggggctagatttgttttataccgtggtctaaatagggaaggggggagtttagctgaagcaatttttacagaagcataactggcaaaaagttaaaaaattaattggttacaaaagcagttacaaaaaataaccagttccaggtgtaggggcttaaactatcacaaagagataaatgcaggggctttaggtgccatccaccgagcacgtccccaggagctgctggtgcagcttgcctcaatgtcttatcggtaagtgcattcctggacgtgctttgagtcagtttacactagtcatgcccttaaggaagggaggtaaaggggctgtaagtgaaggaactaaaatggagtctgtctggctctttcagctaagagagacaatcaggttaaaacaaggtagagtatcacaagttcacgtgcagtctatctgaacctgcacattttcatatttttctgaacctatgacatgcataattctgaacaaagaaaatatgataggtcctgttctaagagggtccttctaaggttcaggggcaccatgcatcgtgctgagctatgttgcacttggtgttatgatgcctattgagtataaagaccaaacgaggctgggtgtggtggctcatgcctgtgatgtcagcactttgggaggccgaggcaggcagatcacttgaggccaggagttcgagaacagcctggtcatcgtggtgaaaccctgtctctactaaaatacaaaaattagctgggcgtggttgtgcacacctgtaatcccagctcaggaggccaaggcacaagaatcactcgaacctgggaggcagaggttgcagtgaactgagatcacaccactgcgctccagccctggtgacggagtgagaaaaaaaaaaaaagaccaaatgagcacgtggttactctgatattatgatgacgggaattgttaggcataacagaaaaaggtaaattctaggccaattatgaagctggtcttggttactttttcaatcttcccccctcccatcttccatccccctgacatttgctgggcacccagtgtctttaagtttcctggctcccactgtggtacccgctgaggcctgccctctgagccacaccctgcatcttctgccaattcttttcctgtacaaaacttacctgtcctgtggctcagtccttcaaggtcctgcttcaaggcactttctgagaaattaatcgggtgatgctataatagctgctaatagttaatttcccggtaacactgacttttggactgaaggccatcagtgacttacttgaaggagtgaacaagatgagaacttcagaccctatggccaggtcattggaggaggtgttttcactaaaaattagaacattatctctcatcctgcagattccactgcatagtttactgtcttgcagtggaaggccgaccctgcgtcagctctgtaatgaacaaggcatgatttcctgcccctccaccgcctctgctcttttgtaagcagtgtgcctccccatcctcagctgggaatcatgatcattagcttagtttccaccaactaaccaatacacacaccttggtcagattacctgtacatttcagaaacaaactttttttttttaaccatctgggaataaactatatgtgttttcaaaatatttgtgtattttgggcccagattttctttttggcttttctactaaagttctggcctttgaggatctgcttactgctcagtgtgggaccgcttccctcacctgaagtgcagggttggggcggaagggttttctacagcttaaggaatgtcctgcctgttgactttcctgttgccatggcgatggcctgtgcaaacatgagccctcactttgcatctgctgctccccggcctattagcaaacagttcccagctgcctcggtcagctgggctccatgcccacacccgcatgggctagacccaggcagtcccaggctcacagcgcctgtgggcagtgacacctccccacccctcaggcactgggagcgggttgccttgttcagtgtggactctcctcttcctcactttacagtcatccaaccagccattcagagggaatgagggtgagaaaggagacagaggagcctcttggtcacataaggaacatgaaatgttattttttagaggaaatgtcagagtggaaagattttcccagaggctgaagaatgaaagttccctttgcaggcagccaatggttatagctttgtgaggacttagcatgtgccaagggctgtgcccagccctttgcattcattaccccaattgatcctcacacacacctcatatgatgggtcctatttttcctcagagaggtttagtaacctgctcaaggtcacacagcaggtgtgtgttagagtcagctcatctatatccaggcctgtacacttgacttttatgttatactgaaagcctctgactacctatagtaaacaaaatgtaggtagaatgatcaattatctctgctgaaatagaagtgatttttcttcctaattttgacaaaaaaaaatttaattctcaatatcagtgtattgctaccttttataagctccaccctaggtaaaaattttaagcatttttatactgttgagtaggaagtcacttatgcctatattctgcaatggaccagatatatgaagagactatatctcatctcatttgctcttcacagtgaccttgagaagtagagagtagacttgagcctcagaggggtggaggctgggaccctgatctgttggcatcctggccctacccttgagttcctaaaagtgccatcttcaagaacctgtacatgtagaaataaaagatattgacaagttttcagatttgtgtgtctgtgtgtatgcacacgtggacacacatgcccaggagaaaaaagaggtactgcgtagagtttttgcatttgctgttccctttgcgtggaatgctccttccctcaaactgcaatagatgtaaaatcttgtcattgggcctcaccatgtctgatcatccagcctagagcagcccctccctgtcactctttatcttattactctgttttattcttccaaagcccttcttattagggagctcatgtgagtgtaagaatgggaaaaggagtctgtgtgagcaaatacatgctagaattgtgttttagacaagtactcagggtatgtgctggtccacacacctgctatatgtagctcagcattcaccaccatctgaaatgttcttttctatttacttattcatttgttctctctctactggatagtaaactccatgtcactcttgttcaatgccgtaagaccagcacttagcacagtgcctggcatatagtaggctctaaataaacgtttgttggatgaatgagtgaacaagtgagtttatgatgctcctacgtggatgacatttaccatttaagaagcaccttgcagctgtcctgtcagctcactggtaatgggccaccagtgtggaatctgtccacctcggctctctgaaacagcaccctagttccaacttgggtttaagctgcaaaggggtcaggatacaaaggtcagaacacaagagaaacaaacctctctcacaaagctcatgccattttgtagagagatgtggaactcaaggctgagctcacaggaaggcaggagagcatggtatttgaaagttgggattctggagccaggcagaagccgattagagacccagctctactgattactagtgggtgacctgggcaagttacttaccctctccaggcctcagaattctcatccttaaattgactgtagtttggaattgactgtagttccgttatgctaagggattagatttaccctcccacctgacacaactaaaacaaaatacatgcaacagtagttttcagatgttggactttgctggcacagaacagtgatctctaagagatgggagataaatgaggtgagccctgagagttcccagcttaatgcctagagagactcatttccatgctgcaatgcaagaaaagggatccttgttgtctcccagagttggagaggtgcaggtgggagtctagagatgccaaggttagtctaaagatgccaaggttactagtggaccaagaggagagaaacacagacacacacacacacacacacacacacacagagagagagagagagagagagaagaaagaggagagaagagagaggagagacagagagagcacttcagagacttgcagagaattccccttgaatcttcagctgagaactgagtgaggaaactgcttgaggcaggactagaaagagtttatgttcccgccaaccgggggaaacaccttgtaattcatagggaaggattttgcctccctaatgtaggtagaaaacaatcaatagaaactgacccagaaatggcacacaatcagtagacatggacagtaaaacaagtattataattctttaaaaaaaattttttgtgagacagagtctcactctgttgcccatgctggagtgcagtggcacgatctcagcttactgcaacctccgcctccgggttcaagtgattctcctacctcagcctctggagtagctggaattacaggcacacgccaccatgcccagctaatttatgtattttttttaccagagacggggtttcaccattttggccaggctggtctcgaactcctggcctcatgtgacccgcccccctcggcctcccaaagtactgggattacaggcataagccaccgtgccccgctgagtgttggaattctattctatagattcaagaaggtggagaattgcttgagcatgctagtagggacatggaagataatttaaaaaaattaacttggactgctagagatgacaattacaatgtctgaaataaagtgaccataattatctgtctcagaatttgcatgtctagtattctttctgccctccaaatacatgtacttgtgcatgcaaaaccaccattatatatacttccacaccaatgcagaacaaagttagaaacagtttctgaatataaatctcaagcaaggcatctgttttgccgtattgtaggaaggagataacaaaaaggcctgacaatatacctagaaggaaatgtattccagttcttgtgtaagaggtgtgggcatgtggccagctgtacaatcatgagattagacagaactttggttttgcttcttgttggttgggtgactcttggcaaatttcttaatctttataatggggactgtgatacttcctcaataaatagtagatatagggcaaatttgatataattaagaaaaaattacttcaatttcctgatgaacaacaaaatagctaattcttttcttctaggtttactgtgtgtcagggacgatgttaaaactgtttcagttacaatcgcatttaatccttatatcaactatgagtccgtcagacagtctgatcttcaactcacagatgagaaaaatgtggctgaaagaggttcattaaattgtaaaaggtcactcagctctttaagtggaagcatgtggattttacataggtatgttaaaatcctcttacacagagcccagactttccaaggtttattctgtgtgtgtgtgtgtgtgtgtgtgtgtgtgtgtgtgtgtgtgtgttcaggttgagggccagggtgctaaaacttgaaagtgagaggttgttcgggggaatatagaattaaaggaaaaggatatagaattaaataaaaaaaggaaaagacctagcttacgttgtgaaatgtactaactctcggccgggcacggtgactcacgcctgtaattctagcactttgggaggccgaggcaggtggatcacgaggtcaggagttcgagaccagcctggccaacatgggcaaacccccgtctctactaaaaatacaaatattagctgcgtgtggtggcaagcgcctgtaatcccagctactcgggaggctgaggtaggagaatcgcttgaatgcagaaggcagaggttgcagtgagccgagaccgtgccattgcactccggcctgggtgacagagtgagactctgtctcaaaaaaaaaaaaaaaaaaaagatacaaaaattagccaggcatggtggcgggcacctgtaatcccagctactccagagactgaggcaggagaatcgcttgaattcaagaggtggagcttgcaatgagctgagattgcaccactgcactccagcctgggcaacggcgtgagactccgtctccaaaaaaaaaaagaaatgtactaactccctagcttgttttaaattagaaaaaacaaaagactgcgtttggaataaaattaatttggtagggcaaagtgtggtattgcttataagacgtttttcattccctagtatatgaaataccttgtctttaagcttttattacttttatttctcctagttataaagctcatttctgaccttgccccatgtaaatgtgacagtgggagaaggtggtctttcttctcctggggttggttggtgaggaaggataggatagcccatggattgaaacaggttcttctcactggagtagcttctcaggctgtacaaaaatctaaactagaagcagatgttactgtggggcagaactctcagttctgatttctttttagttctgtattagagcaatgacactgaaatgatctgagctggtttgggctggctgtctctatacggggagaggctgaactgcactttttggaaggcagattaagtagctgctgcaatcctgttggtatctgttaagatcttgtgattaaataagattgggccacagccctggagaaagatacccagagaggctgaaagagaaaggcatctcataaaggcaagagctgtaattatcttctgatggctctttggcgggtgatctcttaggacaggaagatttacaacctgtaaataatttgcaaggtcattggactatcttcaatgatgtatcagctaatttattcatgccacaaatatttactaatgcctactatgtgtcagacacagctctagacactgggggtactccataccttttatggagctaacatctgagtagagggaacagataaatacacatatgacataacagatggtgataagtgatacgaagaaaataaaggaaggtaaaggagagaaaacagcagggtgaggtctgagtgggtgctggtttagatagggttgttgtataagggtttgttttgggggttttttttttcgagacggagtcttgctctgtcgacaggctggagtgcagtggcacaatcccggctcactgcaacctctgcctcccgggttcaagtgattcttctgccccagcctcccgagtagctaggactacaggcgcccgccaccacgcccgactaatttttttatttttagtagaaatggggtttcaccatattggccaggatggtcttgatctcttgacctcgtgatccacctgcctcggcctcacaaagtgctgggattacaggcatgagccactgcacccagcctggggaatcttttataatgggttatgaagtttacagacttcattcagattccactaaattggattttatgagaattcagctgcagctgacatttacctctggtctaactctgaaaagaaaaattgtttcccaaaaggatttgtggtatatgtagtattaagggtggggaagggctatttaatgtaggtaagataaagaactggttttaagaactttacatagtgattacatagaaatggatgtgggtagttacaaagggttcttatctattcattcatgcccacctgcccagccccctgctgattcagaccagctttcactgccaagtactagccaggagccctgtcttcatatgctttttatacatctctttttctagcatagtgtctgaaataataatacaaggtgactgttaagcacttgccatatcatccttttaatccctgcaacaataccattaagtaggagctgtcattatccccattttatagatgaggaaactgaagctcggagaagttaacctgtacgcagcctgagtctgaattagtcaggcctgcctgcctccacgttcctagtcatcaggcaaagctgtccctccttatcttacaaggttcaagttcatgaaagagtgaataaatggatggatgaaaaaactactactttgattctaacggttgagggaattaactggagacagagcatcggaactccactgaaccatcagagcaggcaggcaggcaggcaggcacagaattggtcaggtgaaaataacaaaatagcaggtgaccatttcttcaagaaataatattcagcatctcctccatgccagaggagttagcctgctcctcgcagccacagactctggcctcaatgcctcactgacccggagggctttggtgaggagacctgggcttccactcagccctttgcaggtgttacctgcaaaggtaacagtgataccatagtggccagagttgcagaggtgggaggggctgggaaaaagagcacagtagatgctggccacgaaaatcgtgcaaatcctgccacagccttcaggctatgtcagtgattccaaaaccagggcgtggagtgagctaaaagtagaggcgagacttgtgccagccaggtttgggaatcacggttgaggatcagtgtttctaccttttaaaaagccacaccccctttcgatgagcaggaaaagagccgcaaggttctctggcagtcctggcctggagtcaggagcggaagttcctggggggagcgcaggtcactaggccttcctaggaggttttcatggagtttgcctgctacagtttgttctattaaataattggacttcgatgcgtggttctcaaacgtgagcctggattcccatgctgaatgttttcaaaaccactcaagcccccctctccccagatcccgcgttgccttctgccttccctatccctagccctctacctcctccactttactcccacagccattgggagtcactgtctagaccattgtttctcggacttcctgggtattaagaattaccgaaaggaaaaagtcggactcagggatctgggaatctgcagacgccctggtgagggacgtctggggaagcacattctgagaaatgttttgggagacgatgcggaggccgagtgagggtgggcgggcaagtgcaagtggaggggtgaaccgaggcgcagccctttgcggggattttaccttagcaatagtttcctgtgatacgagctgctgccatgggcgtgttgagaaagaattattcagtgacacctggtacagtatgggcaggaaggcttcattcaggactgagttagctcaagtgacccctgcaacggagactcgtgggaaggaagagagatggggtgccactcagatacagcatgggcaagtaggaattgatagccaaggaggagtgtggggggtcagtggatggaaaattcctaagaggaaatgtcacagtcagggggattctggctaacccaacctaacaggattcttgctgaggacatcacgtgggggatggcagagaatgagaaacccgatcagatatggagggtgatcagatctcacggatgggggttgtttgctaaactgaccgagtaggattctctgctaacactggatttcataaggaagcacaggcttaggaggaggctcaggagctccactcaagtttggccaagcaaagactctttgtcagctgacacggcgtctcctaccagtctagttcacagggagcatccttggctctcctgccttttggcgggggatcagggcaggagcttgacagatactggcccaggagagggagaagtgctggggagggagatggggtccagccttggaaccccagggccataggcctgccaaaatgacaaggcacggccaactgagagcccctgcttcgagggtgggaagctcaccatctttttaggtttcctacaggggacctaggagcagcctggaatcgtgtttgtccccagtcaggttgggattgctgttcctgcttagaggtcgggaagttgagaccgtgctgcgatctctagaggcagaaacagtgcaacatgtgatttatttctcagcctccaacacattttttccttccttcatgaaggaatttccaagttactcctcctccagaaatcatgtgggctgtgtctctgctgcatagaggaacaacttcgtatacgtgagctcccctgagtaagagtcagccggcaaagcccttactcactccagaggcatgcggcccttcacatttgcgccgtgctaaaggggagaacattttccatttctcttttgtaaacaaactatactctgtctattttaagaagaagaagaaagaagaaaaaaaaaacagtttaagcggctcttaaccaatacttgcaagactaagttgactggtttacaattaaactctttcattcccccaatcataacatctcattttcaagtagttgctcccattgtgtaatatttgatgtcacatagagactcgactccaaactctatgacattcgtgggctgaaagacaaaggagcatgactggctttttcttcactttgaagacatctgcagtttattaattccacaaggaaagctggagggccagaggacgtcgagattctttcactaaaaaatttccttttgagacagtagtcctgttttagtgttggttggagttcatggggagacttacttttccatgaaaatatagagcaaggcttccccctcactgtcacactataatattctagcatttttatagcattagtaatagaaaagaaaaaagactcttggtttagtgtcacctcctttaaaggaaattggcttatggtcagaccaaactgttcttatcccctgtgtaagaggccaagtcatcatttcccagtttttcacagtattttgtatccaggcaacgtcacagaaaataggcccagccaggagtgctctgggagtcactgcagagctcagacttatccatggggcgtattttcttcaattcacaatgaaaactcctagaagttctgtttgaatttttcctgaagtcagcttgttgtaaaaatgtttttgggattaaagtctttgcaggccgtcatctaaacacactatctttacttcagaaaaaataataaataaataaatccagttttcttttatgtgtcccccctacaaaagcatcagaattttaggagaaagcaaatctttctttccaaataggatatggaactaaagatttctaaaagaagaaattgaggttagcctttataattggtttctgttattttactcccttcctggtcagtgatctgttactaccctctctgggggaagggaaactagcggatactgattgggtcagaatggaggttgtaaaaccactcaaggccataaaaggtcagcaggaaggctttgtgttttaggtaagcctgctctttccagttaaccataagccccactattgtattacatagcacgagttgcattccacatttctgttattggcctaaccttctctcctgacactcttgtgtgaattctagtttgattcacgacattataagacaatctctttgaaggcagaaaccctgcctagcattctagatggtctaacacgaacatgttctaggagatttttttccctctaaattagagagtaggactttaaaaaaaaaaagagagaaaataatttattattattattattatttttgagacaaggtcttgctctgttgcccaggctgaaatgcaatggaacattcacgactcactcagcctcccaagtagctggggctactggtgtgagccactacaaccagctaatttttcattttttgtgtgtgccaaggctggtctggagctccttggactcaagtgatcctcctacctcagcttcccaaagtggtgagatgacaggtgtgagccactgcacctggccagaaaagaaatatttaacattagatagtttcctgtagacatatatagaaagcatcacatatacaagcctagcaacagattgttagagctggaaagcatttgagaaattttttgcttcaatccacttgtttgcaaataacgaagagttgggtgacttagccaagtacttcaagaaagtggggacacagagttatgaatagaacaggagttgttttcaacctggggcagttttgccctccagggaacaactggcaatgtgcctcgaagtttttgatgatcacaaatggtatctagctgaacagtatagcctcccataaaaataattaacgggttcaaaatgtcagtagtgctgaggtcgagacacgctggtccaaccccaggctggccctctttctacttcagcattgtcccagcatgttgcactgtttgttctaagatttgtttattgatgacagagattcaggtcattttgactttagcagaagcaaatcagtacatattcaagtgtgcagtgttgctgtcttagtcctagggttaggctatgaattatgaaattgcaaggaatgaagtccagtttgtttccacatctttcatcgcatttagacatttaataccagttggatgacttttaaacctctagtttttacgttttgattttcttgaaaactcaatttgctgatttcatgacttaaaaaccatggaaataaattctccttaatactcgtgctgtgtggctgagagagatgtggaagagattttcggggctttcaccttgtttggaggctcatctgttttgtctggtggagatggagtaatgggtgtcttcagtatgtcacgggaataaaaatctaagtaaggagaaaaaaaatactcctgtaaaaaagcctaaaaaacatactgatctaaaaacatactctgtaaaattcccatccaatctttttttctgttaatgtaaaagatagttttatttttaaaatttccttaaaagataatttattgttttgagaaaaaaataataacaataaattatggttttgtaacatgtagaagttaaatgtatgacagcagcaggaaaagcaataacaacaacaaaacaggagaaaattcccaccaattctcagcattgactgagaattaatttctgtattgaccaaaaagggctgaaaagttccctattgtccctctggaggcaaaaattttcttttccattgccaactacagattcttttttgtttttttttttttttttgagacagggtcttgctctgttgcccaggctggagtgcagtggcctgatcttggctcactgcaacctctgcctcacggttcaagtgattctcctgcctcagcctcccaagtagctgggattacaggtgcgcaccaccacacctggctaatttgttgtatttgtagtagagacggggtttcaccatgttggccaggctggtcttgaactcctggcctcaagtgatccacccaccttggcctcccaaagtgctaggattacagacatgagccaccgcacctggccccaactacaaattctgcttgtgatattagaagggatgagagtccatcgcagttgttgatcgtcttgtgtggtgttctttacaagaaagtgcacttttccaagaaaccatgtacagggggctcctgtcattgggtaaattgggtgaaacagggtgctatagcaatttcctggtcttgtgcaatatcctattcatagaaagtgaaggcacttattaatattgccaagtctctggacctatgtggttgggttacagaccccagcgttaaaatctagtcctatttctgaagactgaagaggattggggagaataatacagttgctgctaacatctatcacttccaaaagatgtgcctatgctgccatgtggcgtacccggagcacctctgagaaacaacttttactttctaatttttaaatatactgtattatattttaaaataaaatgcatttccacaagatgaattttcctgattatcatgtttgcccaaaagcccagagttacatagaaatgttcaattacagtttcctcacccggatattttggcataaggaatctcttctatcactttaaggactcaatgtttagctttctatttttatgctaatgattttctatgttatctgctagtacaagtcagtgccgatgtagacaggatataagtaagtaacagttaaaaattctaaatattgggccaggcgcggcggctcacgcctgtaatcccagcactttgagaggctgaggcaggtggatcacctgaggttgggagttctagaccagcctaaccaacatggagaaatcccatctctactgaaaaaatacaaaatgagctgggcttggtggcgcatgcctgtaatcccagctactcgaggggctaaggcaggagaattgcttaaacccgggaggcggaggttgtggtgagctgagatcacgccgttgcactccaggctggtcaataagaacgaaactccatctcaaaataaataaataaataaataaaacattctaaatatttcttctgtccgttttcgggatacatactgaaagcatgtgactctcttgtctttctgattggatttcacacaaggaacttcctcgctttacctactctcattcatgtttcatgttataaccccaatttacaggctctttttcacaggttacatttttatatagactggctaatgtgtgttctatatgtgtttttgatcatgttccccaactataaaaatgttttgagtattaattctcaatatatgtagacttatttattctttccttcattcaggaacctgctgttaagtatctactataatctggtactgtgttagagtagtgagtaaaacaggcaagaatccctgagtcgagggggctttcctcatgagcagagacatgagggtacttctgtaccaatatgttaggtatgataggagatagatgggtaagtggcagaggctgatattatccaccaagttctaggaagagagaagtacacacactgaacgtttgaatgctgcaccatcaaacaggggacagcaagctaaccctatcagtgaactagcaacctatttacaaccctagaaggtctacttggggggatattttcacagtgggcaaagatttatgggtccttttacatttctattacagagaaatgccttcctctcttactgaattttgtcctacttttctctcttcctggattctggcggggggtagtggggtgctatatttagtctttcttttttctttttctttttttttgagacaaggtctcactctgtcgcccagcctgggtacagtgatacaatcatagctcactgcaagctcaacctcctgggttcaagtgagcttcccatcttattcttccatgtagctgggattacaggcatgcatcatcacaccccattaattttttaactttttgtagagatggggtctcatgatcttgcccaggctggtctcaaactcctggactcaattgatccttctacctcagcctcccaaagtgctgggatttcaggcataagccactgtgtctggccactctattcagtctttacctcttgcccctctatctcattcatgactgttgaaatttcaggctgagagtggtgactcacgcctgtaatcccagcactttgggaagctgaggtgggcagatcacctgaggtcagagttcaagaccaccagcctggccaacatggcgaaaccccatctctaggaaaaatacaaaaattagctgggcgtggtggtgggtgcctataatcccagctatttgggaggctgaggtgggagaatcacttgtacctgggaggtggaggctgcagtgagtggagatcaccccagtgcactccagcctgggtgacacagcaagagtctgtctcaaaaaaaaaaaaaaaaagaaaagaaagaaatttcataggcaccagagtttgactcttgtaatggagaagtgatggcagatatgtttactgccaaaatgccctgcgaggctaatagcaaaatggcccacatctcattatagtgacttcaatgatttaacagatgaagaggtaggggttgagaggtcctgagtcattggaagcctatctcctacttaggctgctatgtgctttcctgttttccctgcagattaattggcacggcgactgtagccctgaaggacctgactggtgaccagagcagatccctgccgtacaagctgatctccctgctaaatgaaaaagggcaagatactggggtgagtgttttctctcttattgaatggctttgaagtgagatgattgagcaaaatttcattaagaaaaaggtctaaggccgggcgtggtggctcacacctgtaatcccagcactttgggaggccagcacttttgggtggatcacctgaggtcaggagttcgaggccagcctggccaacatgccgaaaccccatcccaactaaaaatacaaaaattagctgggcatggtggttggtgtctgtaatcccagctacttgggaggctgaggcaggagactcgcttgaacccaggagatggaggttgtagtgagccgagatcatgccattgcactccagcctgggtgacaagagagaaactccatctcaaacaaaaaaaaaaaaaaaaagaaaagaaaaatgtctaaattgtcagaaccaattggtaaaaaagaaaaaagaaaagaaaaggaaaaggtatcaattggtaattagctaaccacacacacaaaaaatctggttttgagatttttctggtgatctttctcaagtgtgtgtgctttaaataaaaaactgggcccgtttgcaaacgacatggaccttattttatactttcaatcacagaactagcaaatttgatagatttgattttctatgagataattctatagagtgagggtgaccccctctaggtgtagctctgtgcttagccatgtgggtgttaacatttgtgtggttatgtataattctgtgtgtcagatattctttgaaacattctgtagaaggcagttcattgacataagcttggaatatgaagactgtaatatcataatctttttttttttttttttttgagatggagtctcactccgtcacccaggctggagggcagtggcatgatctcggctcactgcaacctctgcctcctgggttcaagtgattcttctacctcagcctcctgagtagctgggattataggcacgtgccaccatgcccagttaatttttatgtttttagtagagatggagtttcaccatattggttaggctggtctcgaactcctgacctcaggtgatcctcccacttcgacctaccaaagtgctgggattacaggcatgagccaccacgcctggcctcataatctttattacattgggtgctggatgttttctggtcacagcctctctcaataagtacatcttgctgggcgcggtggctcacgcctgtaatcccagcactttgggaggctgaggcgggcggatcttgaggtcaggagatccagaccatcctggctaacatggtgaaaccccatctctactaaaaatacaaaaaattagccaggcatggtggcacgtgcctgtagtcccatctacttgggaggctgaggcagaagaatcgctcgaatccaggaggccgaggttgcagtgagccaagatcgcgccactgcactccagcctgggcaacagagcaagactccatctcaaaaaaaaaaaaattaaaaaaataagtacatcttaatattttctgatgcaagaccagaattctctttctctagtgcatgtgctttaaaaaaaaatgactcaagtgtcgcaagtcccagatttcatataattaataagaagcactcataaagatactgtacttggcccataacttccaaccccttcattttccaatcaatttatttttcttgggagcctgggcaaagggagagaaatttacattaaaagatgcagtccctgtaagcaaagctaggctctcaacagccatatgagagaaaggcagttttgctgatctggtctctaaaacttatagatttgccacaaatcagcattgtaatcaaaacacacatttaaaatgttggctatcatctgtttacccaaaacctagctgagagaaatgattctgaggaaagatggtataagtcaatgatttttctgccttctttttttaaagcacagaagaaagcatatgtagacccctagaatggcagaactgttgtgattcagtggagtgtgttagtccatttggcactgctataaaggaatacctgaggctgggtaatttataaagaaaagaggtttatttggctcacagttctgcaggctgtacaagcatggcaccgatatctgctcagcttctggtgaggcctcaggaagcttttactcgtgggggaaggtggagaggaagcaggcgtgacacatagtgagaaagggagcaagagagaagagggggaaggggccagaccctttttaataaccagaccttgcaataactaatagaatgagaactcactcattactgcaagaatggcaccaagcccttcgtgagggatccgcccccatgacccaaaaactcccaccagggcccaactccactattggaggtcacatttcaacatgagatttggaggcaacaaacatctgaaccatatcatggagtaaggaaagtaaatggcctcaagccctgccccctgtaattcctcttacccttttgggggtccctggagcacctctgggaatcctgaggttatagaacacagcatgaaaaccacagatcaagggggtggttgtctgtgtgttcttctaggtttgaaaagtttgattcttagattcagtttagcaactaagcccttcagtgctccctgcgttcagccatgagatgctgctcttatgattctttgtgtgctgtgaaactgtggctagggtcgtattccttatcctgttcagtcccttccagagcagtagttccaagacacacgatgtgccagtatatgagggagtattcactgatgaacagaaaaatggaaaaagggcaatgcactgtgtgtgtgtgtgtgtgtgtgtgtgtgtgtgtgtgtgtgtgtgtttaccagatgtaggaaaagtggcaaatgaaagcataggatgtgtatttaaattcacatacaggctgggcaaggtggctcacgcctataatcccagcactttgggaggctgaggtgggtggatcatctgaggtcaggagtttgagaccagcctggccaacatggtgaaaccccgtctctattaaaaaaaaaaaacaaaaattagctgggcatggtggcacgtgcttgtaatcccagctacccaggaggctgaagcaggagaatcactggaacccgggtgtgaggcggaggctgcagtgagctgagattgtgccattgtgctccagcctgggcaacagagtgagactctgtctcaaaaaaaaaaaaaaaaaattcacataaaaaacgaataatttctcagtgtaactatgtcctaaatatgatgtcctgtccagatgtccagattttatctggtcaccttgtgtgtgtgtgcatatgtgtgtgtgtacgtgtgtgccatccttatttgcaaaggactccctttattctgaggtttgtctcttctcatttttggtgttaaaatgcctctcttttataaaatgattgtgatagtagatgatagttgtgggcaggtgtttggcaaaatacaagttagcaacccaatgtcgatttcccctagcaaattgtttgaaattttgtgggtccatgaaattaaaaagtactgtatacagcaaactctgccctaaaataatgctccatgtgagaaattgatctcagctcttataagtaggaataacattgtctcttgtaaggaactagtatgtttccttctgttggtagtgaaagctacataatgttttcagtttcccttttcatttggctctaggcatttcggaggtcacagattatgcaacagaaatggcaattatatttaactttatggtttgcatatttgtttcctctttagccagattcaattctcctttttttatcctattttatgaatcacaactttatatacatgttttgttagtcacttttttttttttttttttttttgagacggagtctagctctgtcacgcaggctggagtgcagtggcacgatcttggctcactgcaacctccgcctcccgagttcaagagattctccggcctcagccccctgagcagctgggattacaggcacctgccaccaagcccagctaatttttgtatttttagtagagatggggttttactgtgttggccaagctggtctcaaactcctgaccttgtgatccacccaccttggcctcccagtgctgggattaaaagtgcaagccattgcacccagccttgttagtcacttaaagttctctctgtttttttttgttttgttttgttttgttttaagacagagtctccccgggcacggtggctcattcctgtaatcccagcactttgggaggctgaggtgggcagatcacgtggtcaggagatcgaaaccagcctggccaacaagatgaaaccccatctctactaaaaatacaaaatattagccgggcatgatggtgcacgcctgtattcccagccattcgggaggctgaggcaggagaattgcttgaacccaggcggcagaggctgcagtgagccgagattgcgccctgcactccagcctgggcgacagagtgagactctgtctcaaaaaaaaaaaaaaaaaaaaagacagtctcgttcttttgcctaggcgggagtgagtggcacgatctcagctcactgcaacctccgcccccttcaggttcaagcaattcttctgcctcagcctctgagtagctgggattacaggtgcctgccaccatgcccagttaatttttgtatttttagtagagacaaggtttcgccatgttggccaggttggtgtcgaactcctgacctcaggtgatccacccgcttcggcctcccaaagtgctaggattacaggcatgagccaccgtgcccagccctaaaattcttctttaaaaagaagcatgaaaataaatctcagcaattcataatgaaataagcaatgagcaaacaaataaattaatcatttacagtgaccctctgtaattgtaattctgtgatgggagggcatctccagtctaggatggaggtgtgtgacaattcacacctgcttgtcacaactttactctgttgatgaggtggccccttagcaaggatacacttggcaacctgtgacagggagctacttccccaccctgccttggctgtcagtgggaggataggaacagtcgagcttgtgtccctctccccgtttccagcctcgcttacctactccctctctcttaccccttccaagactttggctcctgctgaagtcacttgcattgagtctataacatgctggtgccctgcactgataatatttgcaacgaattatttctacccaggccaccattgacttggtgatcggctatgatccgccttctgctccacatccaaatgacctgagcgggcccagcgtgccaggcatgggaggtaagctgacccttctgaaggcccagccacccccagggggaggctgctaaagacacacaggagagtgtctggagaaaccctgccattgatcacaagcctgtagctccctgcccacccagacaggggccccgagaggcaggtggggctgcctgaattgggacattgcaattgtttatgaaatgcccttcaaggtagaggggaagggtgaaccaaccctttactgaacaacctcacggtgagcacaaaaagcacatgccggctccagcagaatgtcccagggctttgcttcaggtttgtggcttccaccccatacagtgtctccaggctgtttggctcaaggagtggcccctctgctctcctctgtgtgtctcctcacctcccaaaggtgccaccaccgggctctgctctcagcaccagtctcatgggcatggctttcgactggaacctccttcactgtctcccctaaccccggccccatcttgtccccaaacagccccaggtcctctaagcaattgcttctcttcagcatagcccgcattgtccttggtctctgacatgggttgccagtcattcagggccatcaggtgccagtctaggtggggttggggctgagggctcagggagggagggcctacaagacaatcagtcctctcatgcagctgagtcggaccccctctcagtgttttcccaggatgacgtgatgctaaaagtctctgtcccttcctcagccgtaagatgcatgaccaaggcacagtctcggcatgtgtcccaggaagggaggggccccttatctcaccacactcacctgcttccttgaaactctccctcctggctgggcgtggtggctcatgcctgtaatcccaacactttgggaggccaaggcaggtgaatcacctggggtcaggagttcgagaccagcctggccaacatggtgaaaccttgtctctaataagaattcaaaaaaattggccaggtgtggtggtgaaggcctgtaatcccagctactcgggaggctgagacaggagaattgcttgaacccatgaggaggaggtttcagtgagccgagattgtgccactgcactccagcctgggcaacagagtgaaactccgtctcaaaaaaaaaaaaaaaaaaaaaaaaaaatggaattctccctcctgggaggaagtcctgcacttgttgctgaggtggctcctcggggctcatcttcttcttgcttctcttggttgggaacttggctctccggccgcccgagggttcactttacacctgcagcagcaccctccctgcctgtcctgcccagtcccacctgacttctcatcttgctcagcctgacctccgcccctgcccctgcttatgcacccattatgaatgttttggcccattttttgactaagtagttgtgagtttccagtgagggttaggtggcttcctcttggtgacaagactgagatggccccagcacatcagcagcatgctctgcccatcgccctcttcctagcggcaccctgagcattctacttggctttggacactcagccctgcgggagcgctgcagtggctcaagaacatccatggctccctttgcttccacagcagtgatgacaaaaaaaaacaaacaaaaaaccacgaaacacagaggacacaggccagcaccagtaacaccatcaggggcagaactgagtggtcccacccatttccctcagacctccgctgccgatgactattgtcaccagcatttgtatctgtgtgggaaaggcactaggcgctttctggcctgcacaaggcagccctcattgatgggctatctggagtagcctctgaattggaaagatcagggcatctttcttcatactgtcgtttctcctaagctagaccctgtttattagtttcctaggtctgctgtcctaaactaccgcaaactgggtggcttaagcaacagaaatattctctcgcagttctggaaatcaaaagtctgaaatcaaggtgtcagcagggctagttccttctggagcctctcagcctttctcccagcttctgttggttgcccgccttccttggcatctgtggcttgtagatgcgtcaccccagtctctgcctctgctgtcacatggtgttctacctgtgtgtcttggtgtctttgttgcttttttcccctctaggatatagctcctgagtggctcaaggatcttcctctctatgtgtctgtttttgattttttggtttgttttttttttttttagacagagtctggctctgtcgcccaggctggagtgcagtggcacgatctcggctcactgcaagctccgcctccagggttcacgccattcttctgcctcagcctcccgagtagctgggactataggcgcccgccaccacgtccagctaattttttgtatttttagaagagacagggtttcaccgtgttagccaggatggtctcaatctcctgacctcgtgatccacccaccttggcctcccaaagtgctgggattacaggcgtaaaccactgcactcggctttttttttttttttttttttttttttcagatggagtcttgctctgtcatctaggctggagtgcagtggtgcagtctcagcttattgcaacctctgcccctaggttcaaacaattctcgtgcctcggcctcccgagaaggtgggattacaggcgcccgcgaccacacccgcttaatttttgtatttttagtagagatagagtttcaccatgttggtcaggctggtcttgaactcctgacctcaagtgatctgcttgccttggcctcccaaagtgctgggattacaggtgtgagtcactgcacccgacccctctctgtgtgtccatgtccaaatttcttataaggcactggtcattggattgggacccacccgaatcaagttaagataaggtcactgtggattagggtgagtcctaaccttctcttaaggtccgtaaccttatcttaactgtacagaaaccttatttccaaataagatcacattctgaggttccagtggacatgaattttgaggggacagtattcaacccagtacactggcagataaaagacaatttcatatgttgattccattccaagagccaaaatattaaatgggtcctcttgtgttaccccttctgccaggcctttaggaaaaaaaaaatactgtggttcattcaagtaaaaagagtaaacttaaagagatcagcgccacaccatttgttagtatttataaagtaagaacattgcttgctgggtttattttattttatttttttgagatggaatattgctttgtcacccaggccggagtgcagtgacatgatctctgtttactgtaccctccgtgtcccaggttcaagtgattctcatgcctcagcctcccaagtagctggtattacaggtgtgcaccactatgcccggctaattttgtatttttagtagagttggggtttcaccatattggccaggctggtctcgaactcctgacttcaggtgaaatacccaccttggcctcccaaagtgctgggattacaggtatgagccaccacgcctggccccaactattgaacttttaaacctgctggcgagaaaatccctgccacccaaggctccttctcctttcctcttggtttaagcctttgtttgtagcaccagtgctcccagcaggacagtagactgaaggagtccaccatccccttaggagtctggctcacagcgggctcagcaccagggaactgcacaagcgcagcccagctctcccacggaagttctttagaatccctgactttgctcagctaagacaggaaatgaaccaaaacttgggttccttgtatttggatttcaaacaaagaaggtcaccaagtgttggtctgcaaatgagctgtgtctgcagggcaattttatttttaaatgcaagatgacagagtgaaatttctatgtttgatcttagccaaaagtctgagaagtaatgtgaaatttctttattacaaaaaataaaccgggctctttgatctggaagtgctgcctttgttctataaatgaatgtttgccggggctcggtcaaaggtggcattctgtgtgtcggcttcctaatctggctaagagaaactttccttcagcatttaaaaaaaaaaaacaaacctctaatagcctcgactatctagatgtttcaagggaaaacatttcttttccctaacatagtgtcttagtctgtttgcattgctataaaggaatacctgaggctgggtaagttataaagaaaagaagtttatttggctcatggttcttcagactgtacaagaagcatggtgccagcctctgcttctggtgagcgcttcaagaagcttccactcatgggggaaggggaaggggagccagcatcacatgatcagagaggaggaaaatgagagagaaggcaagggtgccactctcttttaaacaaccagctctcaggtgaactcattcattactgcggagaagccaccaagcctttcaggagggatccacccccatgacccaaacaccttccagtaggccccacctccaacactggggatcagatttcaacataagatttcgaggggacagatatccaaattatatcacatggtaattcagttcaactgagcaaaaggtatctttgagcacctactgcaaccccctgctagggaagacaccaggagaaaaaacaacttacaatcttgggggaatataagacaaacaaatatgagacagagaacagcaagacagccatacctcttggcattgcataccttaatgacataagcaggacatctggcccagaatttgctttttttcccttcaattaactttctttctttctttcttttttttgaagtggaatctcagtctgtcgcccaggctggaacgcagtggagtaatcttggctcattgcaacctccacctccccggttcaaacaattcttgtgctcagccacctgagtagctggtattacaggcatgtgccaccatgcctggctaattttttaatttttagtagagacagggttttgccatgttgcccaggctggtcttgaactcctgacctcaagtgatccacctgccttggcctcccaaagtgctgggattacagtcatgagccactgcacccggcctcccttcaactgacttttaaagaaaccctaaaactttaccattctatgtaaaagtaatgtctgcttcttctgatttatatattttcaaattcttaaaatttgagcttgtttttctttcctcgagcaaaaaagaaatatctgcttaataaaatgtaaatgtcacagagatacatgacacggaaagtgaaaatctctgcgtcccatcctcctgagataaccactgccagcaacttctgctattgattttaaaggttcttctccacatagtggctcctgcagaggagaaattagaagtatttatgctggaatacaaaagttaagatttttaggaaaatttgcccctgccatttgtagaagctagctatgatcacatatcacaggaagtgaacacctgagggcttcttttttaaggaattctttcttagagcttttatatgaagatgacaaaaggtagagaccttagggcactggtggcttgactgaaagtgtgtgttgtcaaagatgttcttttcactgacccccctggaagactgttcccatgacagaggggagggctgacccagtctccaggcttgacctgaaaacctgttaccatggcaacttaattcgccagatgtcagtctgcttaactggagcctacattcccgtagctggaagaaactatttttaaaatctcacgtctatttttgaagcaccatctgttaaatttgcgctctgtccaaacatagacattcaaaaactcattcatagccagacttcactgcttcaaatgtctttcattccacgaatcccaaagtcatttgcttaaaattaatttttttaatggagtttttgctctgttgcccagtgatctcagctcactgaaacctctacctcctgggttcaagggattctcctgcctcagcctcccaagtagctgggattacaggcaccggccaccacgcctggctaattttttaaatttttagtagagatgaggtttcaccatgttgaccaagctggtcttgaactcccgacctcaggtgatccgccagcctcggcctcccaaagtgctgggattacaggcatgagccaccatgcccagccttaaaattaaatttgatccagttcagaaaatatttattgacacctgcctatgggacatacagaggtgagaaagccattgttttaccaccaaggagcttgcagttcagtaggaaggtaagagataaacatgaataactatagcccagagctgaatgtaatacattcctccagagagattgaccaaattgttatataggaaacaattgctttcagaaagtactttttcagctgtgtattgcaactctgtattcatggtgcctagcacagcccttgagaagtcataattgttaataaatgcttggttggttgagtgaatgaatgagtgagtgaatgatagatgggcactgaatatggtttaaaaatttttttttaagaagggcattttggggccgggcacggtggctcatgcctgtaatcccagcacttcaggaggccaaggtgggtggatcacctgaggtcaggagttcgagaccagcctgaccaatatggtgaaaccctgtctctactgaaaatataaaaattagccgggcgtggttgcatgcatctgtaatcccagctactctggaggctgagacagcagaactgcttgaacccaggaggcggaggttgcagtgagccgagattgcgccatggcactctagcctgggcgatagaacaatactccgtctcaaaaaaaataaaaagaagaaaaaaggaagggcattttggggaacactagtgaatatgccaaagctcctggctcattcagaagtgtgttgaaagtgaagcatgttcctgagggtagtaggtcccaggctgggatatttgtccttgatgggaagaccatggggctccatgaaaggtactccatgacaagggactgacttggtcagagcctaactggaaaatgatccatgtgccagaagattgttgcaggcactgtttccaggattgggtttctaatcaagtggctttgtctagtaaactgattatattagtccaatttttctctaggatatttaggaaaatcaaagtgctcatcataaacaagtggttctcaacatttagacacagtgaaatcatcaagggatatctctaaacgtgcagtcatctggcgcccatctccagagagtttaatatagctcatctggaggggagccccgagtctgtatggagagcctgatgcaggcagatttcggagttcactttgagaaacgctgcagtcgtacattttgcctgctgaacgtgatgttgtccagagggagacatagatctctgggctttgttatctagactggctcacagcctgattcctcaattgccccgcaggactgcatttgcatccctgcttcttaggttcctccatggtacctttgctctggtctacatattggaacatgctagaaaattcttagggcacatttattgttatttacccaggaattggggtggggtaatgaattgcttacagtaggacacaaacatttatttataaaacttttaacattttagaaattcagaaaaaaattattctacattccagctaagaaaatgtgttatctccaaaatattacatgttttcctgcttcaaaacttaccctttcctgttctgcattgtccttttagcttacactgaagataatatgatatcagccctttgttgtgcttgggcaatgacctttggctcaaagtgataaaattctggcttaaccagtaccaccacttaacaagacttcatcttgaaaagcagaattaggatcaaaggcagaggccaggcaccgtggctcatgcctgaaataccaggactttgggaggccgaggcaggaggatcacttgagcctgggatcacttgagactagcctgggcaacataatgagactccatctctccaaaaaaataaaaatagttagctgggtgtgatgatgcacgtctgtaatttcagccactctaggggctgaggtgggaggattgtttgagcctgggaggagatgagaggagaggcagaatgtttggataaagggggctgccaggggctgaagtggggtctgtgttccagccaggaggatcccagtccagccagggtgaccagcaagtgctccttttcctcagccattcctaggagttgccttcactgggaagctctaacagggatccccctccctggcaaggtgcagacaaagtgggatgatggaggtggggggacaatgacctgcagctctggtgacatctgatatctgagtgactgatatcccactctcttctgcttggtagggagaagtggtgctagagaacagtatgggagcctggaggaagaagggacattgatatgcactggggaaaggcacagttggggatgccaaaggcaaacttgactgtatcacgaggtcctctagggctgccaactcttcagcactgagtgggtggacagatgccatgtaggcaagtgtcattatcacaagtgactgcacacaagggcagttggcaggaatattgctgctgagcgtctggaaagaggatcacaatacatctcaggaatgattacattgctggagctatgatggagaaccatttccaaatgttagcggaaacatcacaagtaaagaagagtggatcacatgcagttactgatattcagaaaggagacaggtcagtgttggatgcagtgagaagctttgtaggatttgaccaagtgacattataattattggagaggcaggatggcattcctacaagggagttgtgaagagcttgtcatagccggagatggacagtgaggaatcttgaaccactgtgaatcaacagatctggatttgagcattggctccactatcaagctgtgtgacagtaggcatgtcacttaacctctctgagcctcaagttcctttcttacaacatcaggaggttggatttaataatatgtagggtctcttccagctccgaagttctatgattctattaaaatggcctggtcatggccgggtgcagtggctcacgcctataatcccagcactttgagagactgaggtgggtggatcacttgaggtcaggagttcaagaccagcctggccaacatggcaaaactctgtctctattaaaaatacaaaaattagccaggcgtggtggtgtgcgcctatagtcccagctacttgggagattgaggctggagaatcccttgaacccaggaggtgaaggatgcagtgagccaaggtcatgccactgcactccagcctgggtgacaaagtgagactctgtctcaaaaaaaaaaaaaaaaagcctgatcaaagccagggttcatatattataagaagatgggatgagagaagtttctttttctttttcttttttcttcagatggagtctcgctctgttgccgaggctggagtgcagtggcgcgatctcggctcactgcaacctctgcctctgggctcaagtgattctcctgcctcagcctcccgagtagctgggattacaggcgcctgccaccacacctggctaattttttttttaaattttatttttagagaaggggttttgccctgttggccaggctggtcttgaactcctgacctcaggtgatccacccgccttggcctcccaaagtggggattacaggcatgagccacgacgcccggccgagagaagtttctttggtgattacttctgtttgcgaatgccaggatgagcagctgcgctttggttcaaataggctgaatcaaagagcagaaagtgtttcaaggattaaatgaacaaatgctgcagaaagtttgagtaagaagagacctgaggctggaccgttggattttgcaacatgaaagtctttagtggcctagacaagagcagttttggtggactaggagggcagagggctggctggaagaagcatgagaatcagagacagagtgaagaatgtgagtaaaaatgattcttctgaggagtttgctcccaagaggggcaggaaaaatggagcagtaactgtagggggcaccgtggagtcaatgaaagttttgttttttaatattctgggtgatatttcagcgtgtttatattttgatgggaatgatccagtagaaagggggaaaccgatgaacgtataaagaggcaaaactccttaagtagcaacaggagataggatctgtgcaaatgcggaagagttggcttcaagtcagggagcacagatagttcagtgactaattgtagcaggagagaaggcaacagatacaggtagatgattgatttggagttggaaagatgtggaaattatcttctaattgccaattttctcaatgaaataagaagccaggtcattagtggacaatgagaaagatagaaagggtgttggaagctttcaagatgcaaaacaggtggccgttcagaaaggtaaagtgatttgactgtgctggttaattagtggccatctcagaccaggattcaggaaagttttgggatagatatcttggaaatgtggtaagatggccaggcagccctgtgaggacacttacagtttgtgatcaggaaattaaagtgagatcagtccagtgagatgtgtgtgcttcccagccaagttcagctggctgggtgcagaggtgaagtcagtggagggttgaataaaccaggtaagcacagtgaagtgagagggggaaagggatcgaggggcatgcagtggggtggttgcagtgttaggtggcaggatctaacctggggtaggggtaaagcaaagacatggaggaagtggggtgcagggaaggcagtgtgctcattagattggggctgcttgtgggctggagtaagagaggaagcaaattggaaagatacaaaagatggcctctcagccaggcgcggtggctcacgcttataatcccagcactttgggaggccgaggagggtggatcacttgaggtcaggagttcgaggccagcctggccaacatggcgaaaccccgtctctactaaaaatacaaaaattagcagggcgtggtggcaggtgcctgtaatcccagctactcaggaggctgaggtaggagaatcacttgaacctgggaagcagaggctgcagtgagctgaaattgtaccactacactccagcctggatgacacagtgagactccacctcaaaaaaacaaacaaacaaacaaacaaaaacacaaaaccacaaaaaacaacaaaaaagatggcctctctagtggactgaatagtggccctctaaaatgcatgtctatatggaacctcagaatatgaccttatttggaaacagggtctttgcagatgtaattagttaagataaagtcacactaaattcagtgactgtagtttcttgtttgtttgttttgttttttgagacagaggctctctctgatgcccaggctggagtgcaggggcatgatctcagctcactgcaacctctgccttccaggttcaagcgattctcctgcctcagcctcccaagtagctgggaccacaggtgcacgccaccacacctggctaattttttaatatttttagtagaaacggggctttgccatgttgaccaggctggtcttgaactcctggcctcaggtgatccacccgcctcagcctcccaaagtgctgggtttacaggtgtgagccgccaaacctggcccacttgttcttatgagaagacgggaggacacagaaggagaaaggctgtgtgaccacacagaggcagagactggagttatgcagccacaggcagggcatgctcaggattgccgggagccactggctaggaagagacaggaaggatttttccctcgaggcttcagagagagaacgtctctgccaacatcttgattttatacttgtaaggtttggaactgtcggggaatacatttctttcttttcttttctttttcttacctttctttttctttccttgctctgtcacccaggacagagtgcaagggcatgatcatggctcactgcagcctcgacctcctgggctcagatggtcctcccatcttagcctcccgaatagctcagactacaggtgtgcaccaccacacccggctagtttttaaattttttttgtagagatggggggtctccctatgttgcccaggctggtctcaaactcttgggctcaagcgatcctcctgcttcggcctcccaaagtactgggattagaggtgtgagcccctgcgcctagccagagaatacatttctattgttttaagtcacccagtttgtgggacttcctgcgacagccttcagaagctaatacaaccagcagcttcctgttcagtgggtgattcctgacttggtgtggccctctgtggttgtgaaagagttgctctttgtagatccacttggctgtggatcacattcaggcctgggtctcacgaacagggcctgccagcacaactgctagcatttcactcatgacacagcttgcacatcagggtgtgtttaacagtgccataggggccccctcattctttgtggaacccatagcattctttgtggagcccgtaccattgtttaatcctctgcagcttcctgccacataaaggggaggtttcctgcttgaatattcttctgctgcaaggcacagaggctggctgtcaccatggcttaggctggtttcctctgacccatccctttagcctaaagtctgaatagcagaagacgttctttgttatctgcaggctgattctagagcatccactgagaatgtaataagtacttgtccagagtccagcattgcaaaggggtatgattgaccccgactttttctcctgcttactgccataaacaatcaccagcctaaaatgctgtaattatggcaaggaggaagtacaaatcaccagcctaaaatgctataattatggcaaggaggaagtaccacttaggcccaggatgatggaaggaagttcgtcttcgctgcttggaggaacccaacagctgtcagccccagccattgctcggtccaggacaggtttaccgaggggaagcgcctggcccccagtgcttccccgaggctggtgccaaggttgggaggagcaccccttcagccatctgggtgttctttcctgagagttgttcagtagtttttccaaatgtgaaggcacatttgtgcctgggatcctgttccccttcccatttgtttactcattccacatttatcaagcactttctatatactttgtgtaatgagttctgtaaggcatggggcagaaacaaagaagcaaaggcaagctccttgcttctgaaatgcctgggagtaggggaagcctatgggttgacaagcaggtgcaagactatgtggtgaggactagaaagaacaatgtgtggcgggtaggagagagcgggactaactccatctggaagaggtggggagggcatgttggaagacagtaagtttcatctgaaacttaagaaggagaggaacttacctggtagagagtaggatgaagaagattccaagagcttggatccaggtgccctaagagagacagcaggtaagcccttcttttgaagtctcttcaagaataggcaagaggaggtccagatcatcttgcagaggacaaagattccttatctttgacttccatgaggttttcccagtagcctgaaaaagatgttgaggtactaggagcataacatgtccttcacctacagcctggttttaaacccagttttataccagagaggcagtgtgaaaacttggtcctggttttagctcagcttctaataacttaaccacaggcaagttgccttagctttctggacctcagtttttctgtctgtaaaatggggtgaagggtaggttggatcaaggatctctaaggtcccttctaggacaacattctgtgggtccatggctacttgaaggaagtgtgaagtgaggatctacagagtgttgagtcaaaggatcagaggacagagtagggagtcacactcagtgagtaggagacaaaaacaggggcccacagaagaacctgaaaaagcagatcgggggaggagagctgcaatgatctaaaaatatgtatatgagcactggtgtccaaggctgtggaagatccaatatggagatacagaaaagggcacggagcttggcaaagagaggtgattgacttttgaagaacagaagccaggctaggatgggcgaagcatgaatgaatggatgatgaggagcagggcccaccctgggctaaattgcaaagcagtgcatgtggaggcccccttttcccttgtggctgcctcttcctcactttgggacccctgcctgctgtgctgcccatggactgctccagtgccccatccccacaccccccatagctggttccaggaagtgtcctgtgctccagaagaagccccttccaattgcagtggtctgaatggttgtgtccctccacaattcacacattgaaatcctaaccctgaacgtgatgatattaggcagtgaggcctttagggaggtgattaggtcacggggccagagccctcatgcatgggattagtgccgtgatcaaaatgggctcaagggagctcctttgcttcttccatcatgggaggcagagaaggctccaactgcaaaccaagaagtgggccctcaccagacactgaatccgccggtgccttgatcttggacttccccacctccagaactgtgagaaataaatttctgttttctaaaagccacccaggttgtggtattttgttatagcagcccaagcaggtgaagacaccaaccaaaactgattacacagcaaaactaaaaaataaacagttaatttattgggtgcttctgtatgccagatactgtgctaaaggcttcgcctatagataattacacctttacagtaaccctgtggtaaatactattattttcccctctttacaaatgaagaaactgaagcttagagaaattaagaaacttactcagactcacatagctcgaaagtggagggtggggagtggattgagcctaggccacgtggcttcagagcccaagatttcaagagctatgctacatagtaatctgatgaaactcattcataccaggatgtgaatgactgacaggtgactgtccttggaaattaaatctctttcataatcttgcatcgtagagaaggagtttcagaatccaaaagcagggttctagacagggtggcttgtcttctaggctctcttagattatattgtacagattaccagaagttctaactctttgtgtattaagaaaagaaaagctaaagtttgtcagcgagtttcaaagagctcgtgaataaaagaaagaggagaggtagtaggcagagttgatttttggtttttggttttgtagggagagaaagatctgtgtctacttgaaggcagaggaaaagctgcaatagagacggaacccccagaggtacacaagagagaggagacatttggggagcctgaaaataatcaggaggtagtaggatctgcaaatattcaggaggtagcaggatctaatgcatggcagagggttgagattttcactctgctgagcagggtaaaccttttcctgagtgcagagggaaggtagagggataaaggaggggacacgtgtgtgttaaagtgacaaaccaggaggaggaaggaagagcaagatgatcaccttggtgcttggcaagaaaatgaggagagtttctcttctgccattagggtggaaagagcagttgtgaattaggaggctcaagcaggaaacagtacaaatagatcacgagcagatctctagagagaagatctgcagtgggagggatggagttgaagcttgtcattgcaagactgcagtgttccgtgatgtttcttcctttttccatcctaacactaatgagaactcagcaatccctggctgggtccaacggtgccatctcctctcattgtccctgtgatctctgccattctcttggtctcttcgaaggcaacctgagcaacagccccgatgtactgtgaacacattttcctaaagaatttttccaagtcacaagaagtcccaagtcagtgtcaccaagaggatctccttcacctgccactttaggaacacttaaaacataatggcagacaaaaccgtgtcctggaaacctgagcctttggacatttacaggataagggctatccctcactgggtttctttctgatattttaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccaggtagcaacggcctggcgttctgcttctttgtttaatctttatattgcccatcttctggcaattgcagtgatgtttcagtggacctattccaatggacaatggctcaaccggtaaagagagatgtcagtgtataaacccagtaagaaaagctctccatctttcttctgcaggcacaagtgggtttagtctagccagctgatggtctccagagaaataaaactataattctccttccctttggcagaaggaaagagctaatcaaagaatagaagcgcaaatactgtgtttttcgcagctctgggccctgtcttagatttggaaggcagctatggagttagttcatcactaggctcagcaagaccaggtgcatgactggagtctgagcagtgacctccacctgccctgccctttcccaggccggctttgaatgatttcatccctacagctgctcttggtctctataacccaaccccagttcccatcttgggaatgaccctaggtggctccacccaattggtagcacctggtatagcacaaagctgccctggcctggtgttagcaatcctaataggtgaaggaaatgaagcaacacctgaggatcctaaggatcccacgtgctgggaaaggttgggtaaccatcccccttctgtgctgcagatccgcgtccgagtgattgagggccgacagttaagtggtaacaacataaggcctgtggtcaaagttcacgtctgtggccagacacaccgaacaagaatcaagagaggaaacaaccctttttttgatgaggtaaaggggttgagagggcatgtttctgctcatgagtcccactggggagggaaacacgggagcagcttcactggtgaagacaccactgagttccaagtagagatcacaggaacaaaactaggtgtgaccatgtgaacgcatggcagggtcttggaaaaagccctggagtttaagcttcatggtaaacccacttctgctattggaaaaggagaaataggtaagtaacaaatatagcttttttttttttttgagatggaatttcgctcttgttgcccaggctggagtgcagtggcgtgatctcggctcactgcaacctccacctccggggttcaagtgattcttctgcctcagcctcccaagtcgctgggattacaggcatgcaccaccacacctggctaattttatattttcagtagaggtttcactatgttggtcagtctggtctcgaactcctgaactcaagtgatccacccgccaacaaagtgctgggattacaggcatgagccaccgcgcccggccagcatttatttaaataaaattgttcacttgggacaatctaaaagatatctagcttttagatatctaaaagctaaatgatgtgaagatccaaggctaagcaggtatgggggtacacacctgtaatcccaacactcaagaggctgagacgggaggagtgcttgagcccagattttcaagaccagcctgggcaatatagtgagatgcctttaaaaaaaggaaaattacctggtcccctctgtcagtggttctcagagatgctgttgcctttctggtgtttttgtgataacttcttgatgatcccttcgacccttatgagagaggacatgatgtctcctaaatctacctttgcttattctaattagcagggtgtctctgagggacaactctcgtgactaatccagttttttagaggtgtcaaaacgtacttggctgcaaaaataatatatgttaaaggaaagcagttattagcacacaggggctttgtttgttttgccccccatactgataaatttttttttttttttttttttgagacagagtctggctctgtcgcccaggctggagtgcagtggcgtgatgttggcttactgcaagctctgcctcttgggttcacgccattctcctgcctcagcctcccgagtagctgggactacaggcgcccgccaccacgcccagctaattttttttttttttgtatttttagtagagacggggtttcaccatgttggccaggatggtctcgatctcttgacctcgtcatccacccacctcggcctcccatagtgctgggattacaggcgtgagccaccacacccggcctttttttttttttttttttttttttgagacagagtctctgttgccaaggctggagtgtggtggtgcaatctcagctcattgcaacctccacctcccaggctaaggcaatcctctctcacctcagcctcgcaagtagctgggactacaggcacacaccaccacgctcagctaatatttgtatttttagtaaagatggggttttgccatgtttcccaggctggtctcaaactcctggcctcaggtgttccacctaccttggcctcccaaagtgctgggattacaggcatgagccactgcgccctgcctcccatactgagaacttagcctgttctactgccctcttttataacactcctcaaaaatacatgataccttgacaatcatctcaaatgccacaaaactccatgactgggctgtggggagaaatgatatatttagggaacttttcagagtcttggccaactgtgctgaggagacacatttctgggattcctcaggcctatgtctcctgctctgttctccagcccaggcctgtcttaccacactacctcttcattccctacggctctaatcccagctctggcgtttgtccttttttttttcctacttctttattcagaaaagaaatgatttcttctatgccgcgtttctatttcttcctcttcgttcaaactggcttccagctctgcagaaggtcctattttcttctcacctctaacctctaacctctcccctcaaaggaatcgcagacgacagcaggcagccaagtacagtagtatacacattctcatgagaggtaggggctgcacagagatggggcactggaaatggacttcagggaaggcagagagattcacgttggagggcaagactggatgggtggggaggaggcaagatgctggattacttgggcctaacgcgtaaaccctgtctatgcattgataatgcaggcttcctgttgactcagctgcattcccaggagcccagcaaacatctccaccttcctcagaattttcccattttaatgagtttgagggggattagacctcttggcaaaagagaagtccagtacattaatcgataaaaaaattttacgggataggagaaacaaaagtaagatgataaaaacaaatatatatatatatatatatatatatataaaagaggtttactaaaaaaatttctagcctggccaggcgtggtggctcacgcctgtaatactggcactttgggaggccgaggtgggtagatcattggagatcaggagttcaagaccagcctggacaacatggtgaaaccccgtctctactaaaaatacaaacaattagccgggtgtggtggcacacacctgtagtcccagctactcaggaggctgaggtaggagaattgcttgaacctgggaggcggaggttgcagtgagccaagattgggccactgcactccagcctgggtgacagagcgagactctgtctcacaacaaaaaattagcctggcatggtgatgggtggctgtaatcccagctactcgggaggttgaggcaggagaattgcttaaagcctggaggcggaggttacagtgagccaagatcgtgccactgcactccagcctgggcaacagagagagactccgtcaaaaaaaaaaaaaaaaaaaaaaatcctagcctgtatatatctttttaaccaagtaatattaaacttgttatcaccaataataggaacaaaaatgatgtggtgtcctcatgtgagataatggaagtaatcaacatcacctgtgtcaagtcttgtcaaatggccaatttgcatccgacagtgaggaaacattcacacaaatctagactgtgggatattctacaaaacaacgggcatggtggctcacgcctgtaatcccagtactttgggaggccaagccaggaggatcacttgaggcctgtagttcaagaccagcccgagcaacatagtgaaacttcatctctatttaaagaagaacaaaaggcaagaaaaaacacaagaaacaaaaaaggaaatagcactgttctatatttttatatagcttccttttggaagctgaagagactcaaaaacgaaatgcaacgtatgattcttgcatagatcctagatttctttgaaaagctaaagtttttttgtagggatgattggagaaatttgaaaattgactctgttagatgttaaatttcttggttatgataatggtgttgcaattctataggaggatgtccttgctcttaggagatgcatgtaaatgtattttgaaggggtgaagtgtcatgatctctaaagctttcttgcaaatagttcagtttaaaaaagagataaagcaaatgtccaaaaatggaacaattggtgaacataggtgaaaggtggtatttattttaccattctttcagctgtcctgtagattagaaatattcctaagtaaaaagttggaggaaaaagtctcagttggagtaagtgttcaatcttttaggattaacatttattagcctaacatggttaaacctcctatatacctaatattcatatcccaagaatcaaccttcttaaaattagcttttacaatgtggtcaatattgactttgctgaggcactaacttaatctaatgggcaaaattgtcttgaaaggtgctttcttggagtaaaattagagtcactagacactaatagagctaaagatattagagaaatttaaaacacactccaggtcatgccagctctaagcgctcattttgataagcattgcagcatgaagtcaccttggatctttttccctttttttttttttttttttttgagatggcctctcactatattgtcctggctggtcttgaactcctgggctcaagcactcctcccatctcagcctactgagtgttgggattacaggggtgtaccccgatacctgcttagctttggatctttacattatttagcttttagatatctagccccaggtgaacaattttctttagttaagtaaatgctatatttgttacttacccttttctcctttttccaacatgaagaagtgggtttaccatgaagcttaaactgcagggcttaaactccaggccttgccatgtgttcacatggtcaaacctaattttgaatttgtgttttgcattttttaggagggcccccaaaattatagtatcagattcccctaacccgaatcccctgttaacatttaaacatctgctctattgttttggcagttgtttttctacaatgtcaacatgaccccttctgaattgatggatgagatcatcagcatccgggtaagggtcagcaagtaggaaggtactgctcactcactgccaggcaaagccaatcatttcttcactactcttctttcttccaggtttataattctcactctctgcgggcagattgtctgatgggggaatttaaggtgagtgacaacagtctgcttcattcaacttacagaaagatgagaactttcataatagaaatctgattcctatgtacgcatcttggtggcatcttgggaatgtgtaagggttcagcatgatgacacttgctgaaggctgcttggggcttgtctatttccaaagtataacagtgaacagagctctcaaagcaagatgccctgaagctgccatatcagggcccttcccagggttgtatctggatggaagcaaatccactgccacaaagggaaggggtgttgaccatggcaagaagtccaccatctacctccacttactgggggccccaaagctccatctgcaaagccaattatggtaaattcagagtgtgaaaggaaagccaaacaaggcaagaggttcagggtgcttctataagtagctctcactggaatgaaaggacaaatacttggttggcttcttcccagcaattctacatggaataggctgcctctccaagaaaggagcaccagtcactagaagtcctagaggatgatctgggtcaggcagacctgtgttcataccctgtctgccaccaagtagccacatgtcccagaggaactcaatctctctgatccttagtttcttcatctgtaaaatgggatcattgagaaaattaaatgagatagtatgtgtaaagcacctagtacagcacctggcacattgaagtgcccagtcaatggttatattaatagtagcattagctggaggagaaggaggaggaggaggagaactggacaggaaattgggccaggtgaatttctgtaggatgaccaatggtcccactttgcctgggactttagtggtaaaactgaggataacccaggcaaactgggtcatattggtcactctgcttctgtggtcccttccagccctaagactagctcattcattcaatagtgacttactgagggtcttccatgtgccacacatcagacaaggcactggggatacagagaggataagacggaaatgttgggtctcaaggaaatttaagtgtaatcaagacatgatatttaaatataatgatggcttctttaaagtgactagactgattttaaaatctacttagactactttcgattattgttttcccagattgatgttggatttgtttatgatgaacctggtaagtaatgttctccccatcaatatgaagtcttaaattcattccttctaactctgaagatgattctaagaatcaagacaatttgggggggatcaaagaattaaagttaaaggaattttttaaaaaatattttcttaatgagggagaggagaggatacttagtgggaataaataacagtagcttagaaaaaatgtctaattttttatcttaacattcaaaatagatgatttctatgttttgtgaggatattttgatcttatcaaaattaaattataaaactcgttggtacaacttagagagtcttgtttgagttacacgaggacagaatggtgggggtggggtgtagggagagtacaaaacagaagacgtgaaagtggacactcatctggggaatttggtgtgtcgtgaagaggcttccaagaaaatgcagcttatcttatggcagaggaatcacagacttatcagtacctttttagcatgtccatttccttttactccttctctattttaggccatgctgtcatgagaaagtggcttcttctcaatgacccggaagataccagttcaggttctaaaggttatatgaaagtcagcatgtttgtcctgggaaccggagatgagcctcctgtgagtccctacattctctactttctacacttctcactaaaaaagaaggccaagagttaagcatgtgggcatgggtaattgtgaaatggagcacagcttcccgtcaataccctcagattccccctattcttcagaagctgttcttttcttcatcatggaattattgttctagcttacttaaactcttatctgatgtctatgagtgagcatttaattgagaatcgatgaatgtgtttttacaacgtccttgcctcattagaaagactgcttttatctagaaagcatgacctacttgcagaattaggcattgctacctaaatagttagtgattattctaggaaactgggtggcaaactgcagaatataagtggccagagagaagttgaagggacatcaggatcacacacacacacacacacacacacacacacacacacacgcacaggctcttactatttggtgctcataaaatgacagaatgatacaaaaacatgagcattgattttgtggagcagttttgaggttgaaggaaaactggtggctgatggcaggctgaactcttaagccccaaacacaggaaatcttaatggaaacgattctgaatggtttcattttataagcattaatttggctttttccaagtgctgcttttctgtatgtataatttaaatcatgtgcccctaatagcctgagagacgagatcgtgataatgacagtgatgatgtggagagtaatttgttactccctgctggcattgccctccggtgggtgaccttcttgctgaaaatctaccgagctgaggacatcccccagagtatgtactgatttaatcttgccccagaattgttgattatgtgtgtgatgaaatgtgttaaaaatcaaactttaatagtgattcgtgtccctatcgtatgtttttcttctgaaagggcttcatgggcttattttcattcattctggcccagttgaaagctacctgagcaggctcatggcacagctagttggttgctgatcatgttccttgttgagtacctgcctttggcccatttgactctctctcttgctattctatatcttctctttattctagaggatgctaaagagatatgagcagtcagcacttccaaccccttttatcccaaatgaaaatgtgaactgttattatcaaatcaaggtgtttgctatccagctataaaaaaaaaatagcagaaattagctgggcatggtggcgggtgcctataatcccagctacctgggaggctgaggcatgagaatcacttgaacccaggaggcggaggttgccgtgagccacaccactgcactccagcctgggcaacagagtgagactccatctcaaaaaaaaaaaaaaaaaaaaaaacatgctgagcaaagggtagtaatgtcccaatgactagaagtctgccactattgtattatgaaatatattcagcaagagactggttgcatttaagggatcgcttctagtgattccatttataggaactagtgtggttatccctctgtcactgctgatggcccagcctcctatttgccttgctgggcctgtctggttcctgctgggctctgggacatgggacccttctccaagtccccaggaggctgcactcactatacaggccatggatctcttcaggatttgctgcttttcttgggaatccttttcctcttttaagatcctatggtcttaaaagatagtattgtagggcctccccatacccacctttctctcaaaaatgtgtcaaatgggctggaggcagtgggtcatgcctataatcccagcactttggaaggccaaggtaggagcactgcttgaggccaaaagttcaagaccagcctgggcaacatagcaagactactgtctctatttaaaaaaaaaaaaaagaagaagaagaagaagaaagaaatacataaaataaggtaaattaaaatcctgatctctatttactttttagcttaactatagattgtagttgattaaatatattatttgtgattatgtcaaattttcttgaatttctctgaaacagactaggactatatcattttgacctagagcacctttctcccaattgaaagcaggcctgagtttgagaatcatcttttactctcactgaatgaactttgttgtattttttttcctccataaaagatcaagtttttgttttattttattttattttgagatagagcctcactctgtcacctaggctggaggctggcatatactggcttgatcttggctaactgcaagattcaagtgattctcatgcctcagcctcccaagtggccgggattacaggcatgtgccaccacacctggctaattttgtttgtttgttttgagatggagtcttgctctgtcaccaggctggactgcagtggtgtgatcttggctcactgcaatctccgcctcccaggttcaagcagttctcctgcctcagcctcccgagtagctgggattacaggcgcgtgccaccacacccagctaatttttgtattttcaatagagaaggggtttcaccatgttgaccaggatggccttgctcttctgacctcatgatccaccagccttggcctctcaaagtcctgggattacaggcatgagccactgcgcctagcctgttgcaactattttgatgtataagagaacttttaaaattttgccaaatttctgggaattgaatttaatttctgctgtataactattaccttccagtggatgatgccttctcacagacagtaaaggaaatatttggaggcaatgcagataagaaaaatctcgtggatccttttgtagaagtttcctttgctggaaaaaaggtttgtacatgatctaaatgcagatgctgctagtaataaatatctaaaactactgtgctttccttggagtgaattcctgcttactctttgttaaaatagccccctgatgagccaggcactctgagggaacacagattatctgagtctgaacacgccagacttctccacaggtttattttggagtggaaagtatgcagaacacaaattagaaaattcaatcttttgagagattaaaatagggaaggctaccactgaatttctggaattgcttttcaggtccaaacgttatcttaaccttaggcaagctctctggccagccacacccatccctggtaaatgttgtaggacagagacccccccccagtgccctgttgccccttcctgtcatgtttctcaccttccatgccccagtaaactgttgaaaccagagaatgggtcagggaagccccatcccactcccctgaaaatatctgggagactcttggtgtagggacagctataaccaccacttttacctacagagatggtcaaagattggagagttgagagttgggtgagattctacagtagaataatagcacatcatggacagttatagacaaaaagaactagcatcttttatgtgttcgaaccatataattatgaaagcaagattcggcaaaccacatacacatacacatatgactggtgcttttttctaaaagattcagtgggtgtggtagaaaagccttcagctctggggcaaaatgaggcctgaattaaattcaggctttaccccacttcataggcaggcaaatcgtttaccctctgagtttccatttcctgaactataaagggagataataacaatcacaggattgttgagaggtttgattcattcaaaaagtcattaagtaccagattctgtcccatgtgctgggatatagaaacgaacacatgggaatagaagagacagacaataaacaagcaaacaagaaactgaataattttaaatggtgcccagtgctacaaagaaaacaaagcagggacaagaagtgattggtgcaggggaggagtgtttatccaggttatcaggtgagactcctggagaaagtgacagttgagcagaggcctggatatgcagagattggggagggaggcatccaggcagggagaagggcgatggaagggccccaaggaagaaaatgttagcagggaaggcctgcccatgtggctgcggtagagccagcaagcggggaaaactaggaggtcagtgagaagtagggttgggacagtagggcttcatcagcccagggaaggattggggctttatttgaagtgtactttgagggccccctgaagatgttacacagaagtgacatgaaagtcaggaggcaagagagggtgtggagttcagatagacaaccgcaggtgtcctggggagaaacatttcaggatcagcttgaagacattccaggatctgcttgaagacggaagtgtcagggtgtggctgattctggttctgagcctgaccacctgaatgaagagcgatggaaagactggaacaagagtcagtttggggtagagggcagggaggctggcgggcagggtcaaaagatctgtctggatgtgttaatggtagatgcttcccaaacggtatgtaacaaatgctctatcaaccttatctcttgcttttttacattaatctaatgttagaagcctgacaattgaaaactaattaaaaaaaggttaaaagcaagctcctagtgcctcgaaacagcaatgattaatattaaacccatgtcatattttacaaatcatcaagaaaaataaagtttaaccaggttcctaagtatataagtaaactgctaaagtcataatctagtatgcatagattgtaaacttttagaaattagaaacttgaaaacctacacttttgctttggtgattttacaggtttgtacaaacataattgagaaaaatgcaaacccagagtggaatcaggtcgtcaatcttcagatcaaggtttgactttattttctttctgaaaaagtaagaatacttacttaataattactaaatcattgagaaataactacttttttctgtctcatttttttagtttccttcagtgtgtgaaaaaataaaactaacaatatatgactggtgagttgaaaatacgtatgtgtctaattcaacataaaataaacattggatattgtgaaacattactctggattgtctctttctggtattttgctttccttccagaggagaggataaattgctcctggaactgggcgtttcttaaaacaaaatttaataatagtgttactgcaaaaaaagcttcgattatttcggttcaactgctcataaacaaaagaaggggaacgtgctgaaaatgccccaagataagaaatcagggatttaattatcattaggctgtccagaatagacttcagaaatacagtcaagcatttcttgggaagaatcaccaaaacattctgagagcaattcattgttattgtttaaaaagaaaatggtaaaactacctcaatgaaggcaaggaaaagtccttgaaatgttctgatagaatttttagtagaccagccttctagcactgattggccataacaagaccattcttggaatgttctagttggatgtagcattcagcaggcacccttagctccctgacagtggaaacatgacaaatatcgttaccatcatcatgatcatcacaatcataattatgtaatgtgcctataattgattaattcattttatgacaatggtattgagtgtagccataggcacatctcttggcctctctgtacaattgcaatttcataacttcagaataaattaccttactagaccagtgtttccaaagggtgactggaggaccatctgtatcagaatcaattgggatacacttataaatgcaaattcttagtccccactctaggcttattgaattaaaaatgtgggcaggagatgagggtgagaagtctctagttgattactaagtacaataaagtttgaggcccactagacgtgattatttctgaagtctggggtattttccagctctaacttttttttaattgttgaaatgaagacatatcttcctagatggagctctgaaccttttattttttatttttttatttttattttttacacagggaccgtcttactaaaaatgatgtagttggaacaacatatctacacctctctaaaattgctgcctctggtggggaagtggaaggtaagtcactcaacagatctagaacaagactggatacagaacttttctccagtctgagaaaaaaatgaactggggtagccacctcacagtaggtttggtttcttagaagccaaatgtgatgaacctagtgaaccatttcaatgatgttttggtgatggcctgcaaaacaattaatcattgaagtatataagtaaactgctaaaatcataatctagtatgcatatattgtaaacttttagaaaaaaatgaaatttacagtttgaagattttcagctttcttgctcccatccaaaacttctttcccaatagcggttttatgaaatttttgtgtcaatacagagagctagcaccttattttttagagtggcattgacccaagtccacccaaatataaaataatactcccttctcaaccgaatcccttggcaggaacagtaaggtcagatgccaatgaaccatgtagtcctcactccctaagataatgtgtatttggtctttactctgacaagcattgatagccaacacattgttctttctgttgttttccaaacaattttcttgagaactatttgcctatacctggcattatggttttgtgcatatgccagaaattgtaacagggaatgaaggaaagcagttaagatgataagagaaaaaattaatgttaacacagtaataccagcagcttatttattttttgagatagagtctcgctctgtcacccaggctggagtgcagtggcgtgatctcagctcgctgcaacgtctgcctcccaggttcaagcagttctcctgcctcagcctcccgagtagctgggactacaggcgcatgccaccacgcccagctaatttttgtatttgtagtagagacagagttttaccatgttggccaggatggtctccatctcctgacctggtgatccaccctcctcggcctcccaaagtgctgggattacaggcgtgagccaccgtgtccagcccaggagcttattttttgtgaccaaaacaaaaattattgtaattgccaatagattaaatatattgagagattaaacacatgaaacaaagtgagagactttgagacaaaattttatcttgggcaactcaaggttcctctcatccttatcttgtttaaggtctttttataggttttgaaaaaacattgttaattcaagcaatggataacataaataagaacctggttattatatatatacatataatactatatatacatgcatatatatatacacactatatgtatgtatatatagtattagatattagagagaaggtaaagaaggtattagagatatggtgaagaacatatagatttcctctctccagaagtgaaaaaaaaaagcaatcagaagacgaggtggtggccgggcccagtggctcactcctgtaatcccagcactttgggaggctgaggtgggtggatcacgaggtcaggagatcgagaccatcctggctaacacggtgaaaccccgtctccattaaaaatacaaaaaattctccgggcgtggtggtgggcacatgtagtcccagctactctggaggctgaggcaggagaatggcgtgagccagggaggcggagcttgcagtgagccgagatcgcgccactgcactccagcctgggcgacagagcaagactctgtctcaaaaaaaaaaaaaaaaaaaaaaaaaaaaaagacaagatggtgaccaaaggagatatagtacaattataaatgtacatggctgggcgcagtggctcatgcctgtaatcccagcactttgggaggccaaggtgggtggatcctttgaggtcaggagtttgagaccaggctggccaacatggtgaaactccatctctactaaaaatacaaaaattagccgggtgtggtggcaggtgtctgtaatcccagttactcaggaggctgaggcaggagaatcacttgaatcctggaggtggaggttgcagtgagccgagattgcaccattacactccagcctggacaacagagcaagaccccatctcgaatgaataaatgaatgaataaacaaataaatagctatatgtggcattattttaagcaaatggtagaaggtaagaaagagattccatctgaatgttctctgctgagtagcatagtgattataacactggagctgcaaggaaggaaatgtaatcacagacctttccttttctctgcagagaatatttatatggttgctagaatgtaagcactatttattgtattttgatttttaaaatttaacctatagccaaagctctgaacaaagtgtagatgtcatcacccattacagtgtaaaagtgtggaagatagagatgagaagcagaaggaggaaggggagtggaggtagggcaggggtgctaatagtctcttctcttcaagtcaggaatctaaatatgactatagatggaatcacaaaggtgaccattacacgaaataaaaatcatgctggaactatatggggggagggtaaagatgactgaaatccattattcatgagaagtcattaaataatatctaaagataattattcagaaatagtggcataagcattttgcttagtgacatggtggtaacatccagaagaactaaaaacagagattgctacaagcagttttagcttctgtctctggggcctctcattgcaggccctgcagaccatggggttacagggccttaaaataacaacgagctgtcaacatcgccctccccccgacaaagaaacaaaccatgctttcaatcaaataatgtgcaataaactccaggcctttgcttacacagcctcagaccacatttacttggattttctgatgttggtcccaactaagccgtaagataagtaaatgttttattaaaaacgtgaaatgctggtaacttcgccaggccccctctgtccccgggaagctagctcttctgcttcctggctgccttggtgctgggtgagattgagttattcatgtgtggtggttctgcccgggtcattttgcatttaaccgatgagaattgtatacattacaaaagggtcatatgtgacttgggtctgaatttgggatttttctggtgttgctaaatcacatacctggcactggatttgattaacgttttcaatgtctgttttataatgcccgtgttcttcttgtttaaccagtcatatttttactatatagatttctcatcttcgggaactggggctgcatcatatacaggtttatgcttcgtaattttgctctctgttatatcttcctagctaatattatcttattaagaatgtatcgactgtctttagaacttttttttgacattttgctgtctcaacatagttttgctaaagtaataatttttgtgtaagtgccatacggttgtcctgcacggctaagcttaaaagaaatatgctaaccaggctttgctccatgtcccatgctttcagctaaatgcacaccatcgtatttggctttattgcaaataattgattgtgagatataacattttctgttattgtttatgttcagtaagtagagaaatggaccactaaatcaattgttctgaaatgtatcaagtaactttcccccaatttcaacgtgaatctctaggttgaaaaatactgaacgttttttactttgcaccctgaagatcttcacctcccccaaaatgagggatcataacacattctttggtttgcacagaactcgtcattttttgcaagtttgctcaatactgtcacacacttgaccatcacaattctcctagggcagatgtttttgttcccctaatagatgaagactctgaggtttagagaggttcattatctgtcagataagcatgattcgccctgccataataatctcccagggttgtggtaagaagggaaagagatattgcatgtgggaaagctttgcaaactctgaagctgtgtgcaaatataaggtgatatcatgtaattatgtaattgacacaatgcccaattcttatttgctttaaacaatctatttcattataatcagactttatatgaatattaagtagtccttagatttgcagtggacttggcagatgtgcaagcactttattcctttatttgtttaaccaatcaatgaatatttatgtagtagtatcacatgatagaaccagtagtaggtgtttaggaaatcaaaataaaacatacttaaatcctgccactccccctgaaaagtgatactttagtcacagagatgtgcagctatgtaggattctagaaactaaaacatacagtaattatttgtaggaatccaaaacatgaaggggattcaaaaaggtaaaggaggcatggaaaatattgttggaaagtgggttgtagctaggtcagaggaaatccttgatggccagggtaaaggatttttattttattttatataggcttttcagcaaggacattgggaagtttgatgtgtccactgtgcattaaacggactaggaaactttggaggcaggaagagatttagcttatgagagaatgggttttctttttttgtttctttcttttttttttctgagatggagttttgctccagtcaaccaggctggagtgcaatggcatgatcttggttcgctgcaacctacacctcttggattcaagtgattctcctggcccagcctccctagtagctggaattacaggcacctgccaccatgcctggctaattttttttgtgtttttagtagagatggggtttcgccatgttggccaggctggtctagaactcctgaacctcaggtgatccgtctgcctcagcctcccaaagtactgggattacaggcgtgagccaccatgcctggcctagagaatgggttatcccaggagactatactaagatgtgagcacatagaaggagagttccttctgttaatgcacaatgaaacaagtcaaaggggtaacataccagaaaagagatttgttggacaaaaataattaagcccctggcattaagctgatatgcagtggatcattcttgacaatttgtgtttcaatccctggggatctttaacaaaaagcaaatacacatgacagcacagtcattcaagggaaccaggtggaggagaagtgaggttagaccaaaggaatggatggggtagtggagggtgtccttttctgagctttgaaactcaagatctggggttaaatctgccaatttgtgggacttttgacaagttgcatcacttctgtgggctttggcttgcccatccataatgtgacatgactatggtgccatagctttaacatccattcttactggaatattctgtgattcaacttcttcctcttttttttttttaaatcttttttgtgtgtgattcagcttctaaaaataacttccttttctctctgtgagtctctgctttaattctctattcgcacccaacatccctccactaaaacaaaatattctagcacacagaaagaagtccaaaccctacttattagtgatcaattaatcgtctttgcaatgttccatatgccacaatggataaagccaagccaatttatatgttcatgtataatagtcattcctcctgtttatctgtcttgaagatgataacatgattcagagaaatctctgttggagaaactgttggtccctctttgtgtttcataagagatttccaaacaagtgtgacatgtggcatcctaggctgttaccaagtctcaaccttaggctgcgtgcactagttttgtacatcttaattttctaaattttcatttaaatgtttctttttttcttgctgtcttcactgagattgctattcagctcttttctgcctgtgtccatgatttctgtctccccacaaatgtgtacacgcccatttaaacatgcagagagcttcacgtaatgaaaatgactgtgcagtatatgtctatagggttaggtaaattatttattaatgggcatcattctgatgacgctgctccacatttatctttctcccttagttttaagcatagagttggaaagggccatagatatgatctggtcaacctcatcgatagcaggaattatcctgagaacatgctgaaagataggctgaagcctttgcctcaacatttcttctaattgtccctaatgcagcctgtcccattgtttgtcatttcgaattcacagaaagttctgccttatacagagtgaaccaaagctgatctccctgtagctcccagcagtggtccttactctgcttctggagacaagtccatccctctcccatggggggccattcaggctattgaaggcaactcttatatttccccaccctcacccgcagtttccccattttcagctatttaattatattgcccttagtgcccttcattgaggagttgtcttgctaagaccaggtagcaaaaataaggagcttatcagatgaccaccagagatagaaagcaatgaatgggaatcttcatgtcatttatgaatatcacatggtcttacaaccacaggcaggcagtttattattacatataaaatttaaaaatgtcttatatttttaacagcatctgctagagttatactaactactgaagattaaatgacactttagaagaacaaataaagttcataaaatatgtcatttaagtgacttcccaaaacaatataatcttttgccccaattggcaatggcatgtttaatacaatgcccattataaacttgcaaaaatgtgaaggtcaacttcaaagtctaattgctctttatttaaatagcattatctttttataaaaataagtttatctgcgctacccccaaatgtttttatttaatattttatgtagcaataagaaaagagaaatatggcaaacctcatggtgcttacaacttgcattaatacaactaactcccaaaatggaggaaaatagtctcacctaactaactaataactaatatttatttcaatagattgaatgttaaaagcctaacacctcatgatgatgtttctctctcagtaaacacaggagaaacagaggtaggctttgttccaacgtttggaccttgttacctgaatctttatggaagccccagagagtacacgggattcccagacccctatgatgagctgaatactggaaaggttggtttctcaattaaggtggttattaatcagcattggttaaggtgattatttcttcttataatgtctgatcaagtattgcaggatagaagtttcatactccctaagacttagaatgcaaagataggaaaagactgtggagatcatctcactgggggatggccaatggccaatggccatttcccccaacttctatgcttatggtagacatcaataatcaatgctggctctctttcctaataagcccctgggctgccttggaattcttttcaacatcatattccaggaatttaccaagcactaggcagtggcatgcaccctgaaaccctttattacccttgatctgatcaatcctttcatttcatagatgaagacatggaagcccagagatgggagatgctctttttaccacaacagaagccaaatgtcttttaggttatctcccaaggctcaagaaagagaccaagctagagagaaaaagccctcagaggggaagggtaaaagactggctgtggaggtggggacccttccgtcctttccagaaggttctattgccagcactgctgggtatggtgggagaagtatccactcttcatcctcaggctcagctgcacccagaacttcttcctcctacatcttcctcctttacttcctggctattctgagacttgccctggttgccagcatggcagcctccctattctgagaagaggagaaaagcagccaagttaacccagataaatgcagagcttccctgctgaagtacggtgaagggagacttagagccccatccaccccccaccccccacctcccagcctccacaaactccttctggagctagagcatggtttgaagacctctgaccttggtcacagctaagatctttttcagccctagcatcccaaggtactctttgagatctgtcctaaagccaatggctctctttcaaacaccagagacctgaatccagctgggagagttgccgactgattcatttcgaaggttagggccatgggaaggagaaactttttgcagttgtattagcctgactagagacacagaattctttttgctgttgctgcctagaggaataatcctggattattgcctttcagggggaaggagttgcctacagaggcaggatcttggttgaattagccacttttcttgagaagacaccaccagataaaaagcttgagcccatttcaaatgatgacctgctggttgttgaggtaaatgttaaagtgtgagtaatgcatggtatagaaaaggagacctccagggactgaaggggtagctgggggagtcggaaggcaacccaactcacaatgaggccctcatctggatgtttctacaacagccctatgaggatcgcttcatcctttgagatgttaataccctattgaaaactggcaagaacactgatacccacaaactgaatgacctgtttgctaactggcgttgggggtcatggggaagtggccataacagccacttcttgctggcaccaagagctgtaggtgccacctctactcatttccattttcagaggtggctggtgggcctcaggcttcccagcacaggagggcaggtgtgctgagggcccacactgcaatggctgtgaaccccgcttcctccttgaagacaggaaatcttcccagttgacttccccaaccatttctgagaatccaggtcgatgcctgtgtgttccacaaatctgaatcatttgccagcacagccagctcatggatgcccctctgcccgcggccctccttgctgggttgcaaatcaccgccagccccccagctgccccaggctgctgttgccctctgttccaagcacacaggacaggccctgccctgatttcaccactttacagcagaaaccaaacagcaacttttaaaaagctttcactttcagtttttgggataagaatacgaaaatacagtaaaaagggtgacaacgtggttgcgaaatgtggctattctcaaagctcatggggtcaggctggtgttctgggtccctgacagtcagccttcctgtctactcgcagcctgtctccttgtggcaggactgggttctccatgctctcccccaaactcccgtggtacccagaacacgttttcatctgagtccaggcccaactgccgtgagttctccagcgagccagggccttctccctctagtcgtctgatgtctgcctgttacatctgccccctttgcaggatgattgacagggagaatagccacaccctttaacagaaactatcccttcttccccagagcaatgtggccttgctcattgactcccagaaggcagccgtatcaggaggttagcatccaaagcagtctgttctggattcctcagcctttacatgttgggaacatctgtggtccagtgcttgagctgcaccaatttcattcctgtctcctcctttgagaggaaaggagcaggctcctgagactgccctctctccaccccccagcctcaggaaggaacctagcatcaccacagcagcaagccacggggcatccgtgtaacttcacatggggaaaataaatagttcttccccatgaattactacagcaaagatgatcatttgttttgtttttttactaaagagacacggagccaaaagtcaataaggtcctggtcatagtctttctattccacaacattacccactctgaagtccaggaattgcaatagatcttgaggaaaaattaagaaaaggaaaaaagagggcgggagagtgagaaaagggacagtttgcatgctagttacagccaggatcatgcaaaagaatagccagaaaccacttggaggcctccgtggagacacatggtggttcttgacttgagtagttacagattggagttagctcttgaaatattggttggaattcagggttattcagaaatgccaccatggacactcaaccattatagtacctcttttatttggttccatcaccagaatgtaatttaagttcatgctgcttctctttgttttaaataaccatagttgcagggagaaggagaaagaggcccaagaaaatattttttaaatgctttattaactggaatgcaaaaccaaattagttttcttcactgcaaatagttaaacacatacaggcaaagaagcttatttcattaatttagtgtaaaagcaaaaaaaaaaaaaagtcaacaatatatattgcccacagtatatgtcaacagaataaaagaacagctttttattgactggtaaaacagaattcattttctttgctctaaattaaacacagacagcaaaatagctcatctttttaattaaataaatataaatcaaaagtgaaatgaagcaaaaattttaaaaacctaacagtgttacagaataggagagaaatgaggattctgaagacatagccacacttcaagcaacaggagccccaggagagagtgaaatgagcagatctgtgcacctgccagaaggacttaacgaatgcagtcaacctacaaacatgctcatgacccttgtctgtcttgcaaaggtcctctgttctggattatgtgcagctaacaaaactttttggtaaagctaaagaggctgcaacaaatgggcaaattttttgccaaactgccaagtgctccccatctttctaaagcagagctgagctattgctcccggtgggcctggtcaagagaggctgcagtgcaggagggatgcagcagattcagcctggccacttccacagtaagaatcaggcagacagaagatcaagtgttgccaacccagtgttattctaatacccgctggcttctggaacctctgccctgccactaaaggactccattttttgtctccaggatcaagagtctgttcttggactgctttctccctgctcctctttccccattttccttggatgtgaccgaatgtattttgggagcattctatgcacttgcattctctctcctactcaactacaatctccttgagagctctcattggtctggcccacattaagggctcaaaaatattgctagaaacagcaccttcaggttcttccagctgctccatcaggtatcagctcccttcagtagacataccgaaggtggcatgctgggcagtgttcattggtacctgatcttgtcactgacctttaatgtcccatgccttgtgtgtccacagccactttcaacaactcttagcccttatcggtatcttgcttgacagaaatcacctccttttgcaaatcgactgctgaaactctactttataccaccttatccacaaggtgcactagtcactgatgatcagaaagagagccccaaggccctaaccccacctaagtccaatagactacaacttacattcttcttttttttttttttttctgagacagagtttcactcttgttgcccaggctggagtgcaatggtgtgaccttggctcactgcaacctccacctcctgggttcaagtgattctcttgcctcagcctcctgagtagctgggattacaggcacctctcaccatgcccagctaattttttgtatttttagtagagatagagtttcaccatgttggccaggctggtctcaaactcctgacctcaggtaatccgccgccagcctcggcctcccaaagtgctgggattaaaggcgtaaaccaccacgcccagcccaatttatattatttcattttctcttgttgtaggcagatcttgtcccaggctctgtacttctctgaatggtgtttattgttccttcctctctctacctctttgtgccctgagggcagagaggaagtgggaaaggtctgagggagcggcagaattctcagctgcctgaatcatcgagggtagcctggctctggcacaggtgagcagatggtagcgttgcccctcctggaatctgggcttgcacagtgatccagcggctccatcttcagcggcttgctcatagtgagtcccttctctgttgggaattgtgctgatggccagaagcccaaactattgcttttagggctcagactctccagggtgagggtcctatcagggattctgtgggtcattttgcaagctctgcgtgagagcatccatggggttctaatggaatcctggctatgtggaggcctacggggtagagccggcccagctgggagtatcatccccgtagttcccaccccacctccaagcctccccatgatccttctccatcctgtgcagtccctggcttaacagatggctctggcttaaataccggtcattttctcctgggtcctgactcaggccacaaattatgtttcctatttttagctctttcccttttctcctatcatcctagttggtttacaaagaagttatgctgtatgtagttatgactaatccaaataacttcctactttttcattttgacacaattcaaacccaaacccagaatttccacatcattctggaccacgggtattccagggggcttcgctgtgggtagttaagcagagctcttgacaagtagcgtgcacccccaatcctcccttatcaaggtgacagtggactaagctagggaggcttttagactcacaatgctcccgtcaaagcttcctcaggtcattcaatgtgcagctcaggttacaaaccagtgtttagagagactttttagaaagattgaggcctagaggggatttgacaaaaccctattggagggttctattataccatgtcaaaaactcctttaaccaaaatggagactctgtaatagaaggatgtccaggggttcttcaagaccacaagcttcagtcactgtcagaagttcttaaaacagtccttaaaaatttaaaaattccagccaggcacggtggctcatgcctgtaatcccagcactttgggaggccgaggcaggcaggtcacttgaggtcaggagttagagaccagcctggccaactatggtaaaaccccgtgtctactaaaaatacaaaaattagccaggtgtggtgacacacgcctgtaatcccagctacttgggaggctgaggcaggagaatcacttgaatccaggaggcagaggttgcaatgagccgagatcaagccactgtactccagccagggtgacagagcgagacacagtctaaaaaaaaagaattaaaaattccacttctgggtatatacccaaaataattgaacgcagagactgggtaccaccagagttctagaatagacacaggatgcggatcgtattgcatggcagaatgcacgggacataatgaaacacagcaacctaaaccattgcatggctctttggtaaaagaaggcacagtgcctgaagatctgtggagatatggctcataaagaaggagatatgccagctgagcaaggatttggggcaggatatggattcaagagattttatgtgcccatgaaggaaggcttgaagggctcatggtcatttctggtaggctgataggcactcaatgtggttatcgttgaccctatcttcaactctcttagtaaaccagtaatttaaaaagaaaaaggaaggtttaatttcccatttcaatttaaaataaatttacccagtttccttatttttatttacatctgacatgaaaatctttattgttatttctgattagaaaatcaatagtttagctgggtgcagtggcacgcacctgtagtcgcagctagttgggaggccagagggtcacttgtgcccaagaagtcgaagctgtagtaagccgtgatcatgccattgcactccaacctaggtgacagcatgagaccctgtctcaaaaaaaaagaaaatagagaaaaaaaaattaatgcttcattcaaaatcattaaaaatgtataagttagaaagtaaagtttgccataatctctctaccttcttcaacataactactgttaacaatttgagttatattcctccagaccttctttatgaatatgcctttatgaatattaaaatatctatttaatagatttacttaaaatatactctctttttttgagatggagtcttgctctgtcacccaggctggatgcagtggcacgatatcggctcactgcaacctctacctcctgagttcaagagattctcgtgcctcagcctcccgagtagctgagattacaggtgtgcaccaccacgcccagctaatttttgtatttttagtagagacagggtttcaccatgttggccaggctggtcttgaactcctgacctcaagtgatccaaccacctcgggctcccaaagtgatgggattacaggcatgagccaccgtacccagcccaaaaaatatactcttttttcatggttgcacatatggacctaattaagtctttttatgaaccttcattctattttatggatataacataacttgtttaacaagtggtctactgaaagacttgtgtactgttttcatttcttcccctccatttcaatcaatgctgccaggaacatcctagtgcttctatctttgctcacttgtatgagtgcaagaggaacagctgggtccaagaacattctcccctgtcatttaattcagcactaattattaggtgtagaattgcgtctcctagaaatccacatgtaaataagaacaaatggcctttcactgaaccttatgtctgctcatactttatagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggtaagattggcactaacagttctctccacacgtttacaatgggtgcaccacgggaccggaagcaagcactgtgtcttccctctggcactgttctacgcagcctatggttagtggaaaggaaaaggttgaatgaggaagagagtgtggttggggttcaggcaccttaaagactggccagacccaagaagttgcaggtcccattgccagaggctgaaccccaatgctaccctctccccacccagctttaacaatggttttgccatgtaagaccccaaggtagccactgtgctaagttctgagctccgcaaagcagctcctacccctacgaagccccaaatctttcttaggctgagtagtggaaaatgaatgggactctggatcagctactgggaaatcatgcttctggtcttcactctgttactcaccagcttgtgaccttaaccgtgtcactgaattctaaccctcagtttcttcgtcttctctggagttgacatgaggattaaatagctgtatttgaacaaagatgggtgagaaacagtccctgattttaaggagcttacattctagtgtataaaataaatcataatagaaagcaaagtatgagaacttccaataaaactgtcaacaaatggtttgagagtacagagaagggagagaggaatactgatcaaatttcccaacagtattgccagagttttaacttaatttttgtacaagcagttttaaaatgtaagacatcctaggaaacatcagctaataattcttaatcacagtaaggctctagtaccaaaccctatgtagccagctaaagctttccaagaacagaaaattcttttcttttgccccagttccaacaaaaacatttatttagaataacagtttttagggactaacatgttcagtctagcttcctatgtcatctgtattttctactaccacgttaagaaaccatctttgatgttcagatgcatggccctgaatcactaaacgatcctgagattgctgtgctcagtttactagggtgtctcagagaaaatttcagaacagcctgaatgaaaaagagcttcctagtcttcagttgcttaattgagtcaaattaaagaaccagaccacctcaagctattccccaagcctgtggattaatcagcagctcagtctgcacatctctttaataaacatgctgtctattttaagtgttcagtgttcattgacccccaatgttttataccaggcaactactattattacttgccttgggcccacaccaagccagttgttaccctgacttcatactgggaggatattagtcatcgcctggatgcggtgaacactctcctagctatggcagaacggctggtaagtttctctttttctgcatttccttttcaccaagcagggtgaattaggtattaggatggaggccaggccactataacacaagaaagtgcttagtacagtgatcaataaggtaagagcaatgtctctaggaacagtggaggtagatggtcctaagttagtatggaggttcagtggtattggagacccaggctcttacccccggttgctctgccatcactcaggagttatcattgtctgcatggtagaggcagctcactactacatctgccctccagcctgaggggagggctggtaaacagtggggagaagatgacataggcctttctcttgaagggaaggatgcagaagtcatactcttaatttctactcactttccactggccagaatccagtcatacagccacatgtgactccaacgaaggtggaaaatgttagtcttatgcctgggcaggcatatgcccagataaaaattttcttactttggaagaggggaggattaaaaaggtaggagtggggtggaacaggaactcatagtttctgccgtaatttttgtgtagagagaatggttcattccaatagcaatatgaaactctgagaactttgcagtggaaatctccactgcaggaagaggtagctttgaggaaccagtgtctgacacattccactcttgctgcagactagaggaacttcttttgtttggaggttggggatttccttgggtgaaaactgcatacatatgatatctgtgattatctgtctagttgacattggtcaactagattggtgaggagaagggggatatgtctgtgatatttctaattaagcaaaaatactaagttacttgggccaggtgcagtggctcacgccagtaatcccagcactttgggataccaaggtgggcagatcatttgagatcaggagttagagaccagcctggccagcatggtgaaaccctgtctctactaaaaatacaaaagaaattacctgggcatggtgatgtgagcctataatcccagctactagggtggctgagacaggagaatcacttgaacccgggagacggaggttgcagtgagccaagatggcgccattgcactccagcctggacaaattgagactctgtctaaaaagataaatatatacatatatatatatatatatatatacacacacacacatacacacacacatatacacatatactaagttactcctatcaggtagtgctaaaatccatctggcattggtgttttgatttcaacattatgttaatattaattttttaaagatctaatctctaccagggctggaccaaaacatatggggtttcaggagtatacttgatctaaaactcgacggcaaaatctgaaatatcattttatgttataaaggcaatctgggaggataactataggtttaaattgacttaatcataactgtcctgaaaataaagttgcaattgataggcaatgtacatctcaaaggcatttgtggagaattagttgcacctgtgttctaattgtgtttgagatgctcttcagcaattttcatcctggttcttcttatcagctctctccactgaccaggctgcctaatctggacaggatggtggctttcccttttccctgattaggacttttgacagtcatggtaggctcttcctcaacttctctgttggcaggtgctcaatggaatagaaccatatgttttgagcttatcttgtactttctctgccccagtccgtaaatcgctatttctccaagcagctttttcctttgagtggggaatagcattttagaaacaaaatctgggtatacagtgctcactactactgaaatatcattgcttctaggccttctcagcaaacgaatttgcacagacacatgtatgtctatttatttctatatctatcaatatattaaaagctatgacttcataaagatacttccaattccagtccaataccacaaggtttatcctagtcctctgtatttctatgtctctaactttcttctccaacagtgagaaatctggcctttgttatcctcaatatatttactccttggttcaatcctaaaatctgtagataaaccactgtgaaaaataagcctactaattagagttcaatatgtttatgggttttttttttctgccttttaacaaagtgtacatagtcaaaatactgtgttccaaaagttacttgggttagtttagtgtaattatgttattcatctgaaatgtaattagatctgttttatttctggttatattccactttagggttccctctcctatctttgctggtttcattttatttgttttttgaatatacaaaaatatttacatgatttcacaggttaaactatatgaaaaggtataatggcataatgaacaattatcaattatttcctctcttttcaaattcttcagcaaacaaatatagaagctctaaaatcagggatacaaggtaaaattcctgcaaaccagctggctgaattgtggctgaagctgatagatgaagttatagaagacacgaggtacagtgatcttacgcctatctcagaattttcatccaggcgctcctccctgaaattctaagactgtaaatcctgtggaattgtttctagtgtttgtctaagaagtgattttgaattattcaaacttcgtaaaaagtcctcactgggaggagtgcctgaatcaccaccaggaaaagctccactttctgatttggtgccagttctcaagtagcctagggaggctgaggccccactcccagaagcacgtcccaggcagcctcaggcaagggatggggagcggagaaagaagcaagcctgagcctctgcttctcatcaacccaagaatgacccccaccctggagaagggtgacttctggctcctacggagaatgggatctgggagtggagcattgattttaccattcagaacaatatctctaattcataaacatatttttagaaacagcccttttacttgctcttttactgaatgcctgatgaacactgtggccaagcctctgttaggcaaaaccagtagatttgacttgaaccagcggacctttcataactgattcggggaaacagctcagatcttttagcatatggaaatcaaagggggaagtgattcgttccaaactcattttaaatattggttaataaagcagtggacagggaagttccgaaagaaaagcatattgaatgctttccacaagcaaaaaggcctttattccccacactgggctaacaccctaagtcaccctgtcttcttgtgcctcctagtggtaaagccaggtaattgaaacgcaaccaaaatcaaagtactgctggggtgcttgtttaagttctgaatgttagagctgggtcctaagggatcatgtccttcagtctccttatcttgtaaatgagaaaacagaggcccaaagaggagaaatgacatatctgatgcccagagctgggtttgccaactcagcccctcttcctgccatgtatttcacagtagacatctatttgttcaaggccccaagtgtgacttttgaactaacagcttccagatatctttttgcctcaaagtctcactctggggaattaacccttcaaatacaatgccgtagttatttatgaaaccaaacagaaacatttggtaataactttcatggagaaattgtctgtgaattttaagatttgcagagcaaaccacagtcatctatttatacttctgatatgagctgtttttgaggaatcaaattggaatctttctaaactttatgtaacaggaaattcagtgtctaagggaagttgtgctaggattttcttcattgaagaagctaggtgaaattcaagtgagtggaaattctaggtaaggacactgtgaatcagagcttcgtgaacctggtggaaatcctcaccctgtgtcccaccagatgccatggtgggaggcaaggcctggcagcagaaggctaattctggctctagctcagccattctcaggaacccttgggggtctcatcacaacacatccaagttctcatattgaatggagatttggcctacatggttggttcataaatctttctggagttcatgggcccctttgagaatctgatgagatgatggtgataataaagatgacaacgagatgatgatgaggatggcaacattgtttagacgttgctatgcaactattctaaatcctttccatacagcaactcatttccttctcacaacagccctaaaaagcatgtcccacatttgaaaataggaggacaaggaagtaagtgactggtcaagacaatagaactagtaaagaatggagccacgattagtacccaggttgttggctccaaagcctatgttcatcattacatcacactacgtgttgacacagatagacacagttttctttataagttccagagtttcacagaccttcgagacccacccatagattgcttaaaggcccaggattccctaagttaagtatgcttcagctaaatggtctctagcctcccttcttcttccatcattttgtggttctgtaaaatgattctaggaagcaaaagaagggaaagccagtttctctcagctgccactgtttccatcttctttccagtgactccttgggccgtaggttaaaccctaaggcctaaaatggctttgggattttaatctccctgtattccttatgaacatcaagagaccggcaggtctgctctggcaatgccagatacactctactccagcgtaaaccaggcagtgcttgtagattcagttaggaggttgatgtggtttgcaagatggaaatccaacataaatgtatttgacagttctgaagcctaaaattaggttattcttcaaatcctctgtttctttttttcttcatttttctagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagaggtaggacttttaaactacacaaacgtcacctgatatggaagaagggctctgcgaaatggcaccaagaataggatggtggaaagagaatctactacattatcttggatattgagcagctctgacagattgtaaaaatcagggagtaactgggctgaggatgctaatgatgaatgtgattgaaatcagagcaggggaagaattttgagttggtgatcttggaaatgtcttcaaaagtggacaaatcattatcattttcatggtactgtcggagaatattttgaatggtctttgcagttcacaggattaaaatgtcagctttggctggggttgggaagacctgaatttgaaccttggttctaccatgtataacattgggcaagttattcaacctctctgagcctcagtttccccatctgtaaaatggagataaacatagcacttactagttagctttgttgtgtgaagattttaaaaagatggtgggtgtacaaatgtccatgaatgatagactggattaagaaaatgtggcacatatacaccatggactactatgcagccataaaaaaggatgagtacatgtcctttgcagggacatggatgaaggtggaaaccatcattctcagcaaactatcacaaggacagaaaaccaaacaccgcatgttctcactcataggtgggaactgaacaatgagaacatttggacacagggtggggaacatcacacaccggggcctgtcagcgggatagggggctgggggagggatagcattaagagaaatacctaacgtaaatgatgagttgatgggtgcagcaaaccaacatggcacatgtatacctatgtaacaaacctgcacattgtgcacatgtaccctagaacttaaagtataaaaaaaaatggtaggtgtaaagggcttagcacagttgagggcatacagtaagtgctggataaatgctggcctccactaacttcggtggactagaagaatgaggaagtaaggagacgactcctcctgtctctcagaaatcagagggttgggtaggtagtcatatatttgtgggtagaaatacgcttgaaaaagcacacaggattataggtaatttcattttctactttgtatgctttggtactttcacagtgttctatagtggacttaggcagtttttttataccactgtgtgccaatagggacatttgcatatccagctctggaagctggattatcttctttataataaaaaaagaggtttttgaaaacaaaattaatatttcagatttgacaaatattggatggtgagccagagactctttatcctgtaaaatatatgcaatctgtaaccttttgactgctgctggtggctttcttcaaatgatgcttgagataagatggaatattttctaagatacctcccagagaagagtaggagggacttttgctaggtgaagctgcgcctctgcttctcgcccttccctttggccagccacagtctgcctcccagccctgcaaactcacagtgcggtcctagaagatgggagctcaggaatttgagacagagccctaaccacagcgtttctttgctaaatgaatccctgagggtccagcctgcagggtcttcggtccctctccatttagactaaccatggctgtgcttcctcttccatccaatcctcatgaccagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaaggtacatatcttcactgtgtcatgtgaaacacactaaatgcaaaagctgtattcctgagaagggtctgctttatatcatttgcaaatcattgaatggtaagggtgattgggatcaattctagcccatcctggtccctctctctggggcaataattctgagagagagtgatctgaggttggccagctttcaatcaaggacacctccttagatgtctttgtgacattaatataaacatggcattgtgaatgctttgctttctggcatgaatatttcacttctaatatttcacacaaggcaatgcctttcttcctttcattctagtgaatgttggggaaagaaagagaaagcagtagggatggttcatggaatctgttgctctaacctaatgagcaatagattgaatcaatttcaatttgatgaaccaatcaaattgaacatttttgacaatcgtaactttagggaagagattctgaatacttttagagtcatagactctcttaagtgcctgacgagagccacaggccttctcctccagggaaatgcacactgcatgttcagctaatattttgcatagaatttaggagcttcatacaacccataagcctgttccagggccccgtattaagaactctgtgtgtgtatatggggaatcaaaggtgagcctagggccgaaacaaagaaatcagaatagttcccatctatatgttttgacgtcatctctctggccaaccccaactggagttctttgcatttgggacagagaaataacaattaagaagagaaaaagcagagttggagagagtgttctcttcaaacaaggagattctgctaacttttaataaatttactcattgctctttaatcaggagggtgtaaatagaatcagagtgattatcttctttcaagtgtctcttggtagaataaattttacttaagatagaaccacaattataattgacctcagcagtgggtggaagcaaactgattaataaataaagcttcacagggggtgggagaggagacaaaggcaccttctctgtgttaggttttagaagttagtggataaacagcaaaatgcttttaagagaatgttttgtatatttattgattttgttaatactcattacacagtttagggagctgtttaactcatgagtttttttggtcttgagatccctttatactttaaaaaaaaaggttgaaggccccagagagctttggtttatgtgggttatacctatgaatatttactataatagagatcgaagctgataaatttttaaaatatttattgatttaactgtaacaataacccgttactaacataaattacatcaattacatatttaatttaaaatgttaataaactacatatttttacaaaatacattttgtgtaaaaaatcagaaagcagagtgagactgttttgcatttttgcaaacttctttaatgtcttgctgaacagaaacataactggattctctcatcttcttgtgcatttaagctgatggaattagttatttggttgaagtatatgataaggatctggcgtcacatagatatgtagttggaaaagggaggagtattataataaccttttcagataattatgaatattcatctttgatataacactaaactcaagtggtagcttttaaaaggttaattgcagtgtgacatctgaaaccatatcaatgaatttttcatactcagctacgttaaaatccttggtctttcttggactttgaatgactcttttattcatgcatgattttgtaacataatgtacaatcatttggaaaattcactgagttatgtagatcactgagttatgacacatttcatcatacaatattgaaaaaaacacactttgaaatcacatttgttaatatcacttatcagaaagtctatgtgttgggaagctatcaaacttattgttacagattcatgttttccaacactctattattttacgtgaaagctggaattttgtcatcaccaacaaataaagagttattttccttggagtgagaggttcactttgtttatgtttaaaaaaaaaatccttgccccatactcaaattggaataaccatgtttacctgtcaatcgcagttttaagtaaaagtgatatttcatttttcaaaaatctagttcaacttacaactcaaaaaattgcacaagagctttttctcaagacaaccatcatatgccaatatgcagcagaagtgcttcgcatgtacttcccatctcatcacacaaaatattaacaagacatgtattcaagggtcgagatttaataagattggtaatcttggctgggcacagtggtgtacgcctgtcatcccagcactctgggaggctgaggtgggtgggtcgtttgagttcaggagtttaagacccaccagggcaacatggcaagacccccgtctctacaaaaaaaatacaaaaattagccaggcatggtggcatgcatctgtgatcccagctactctggcagctggggagggaggatcgcttgagccctggaggtcaagggtgcagtgagccgagattgagccactgcactccagcaacagagtgagactctgtctcaaaaaaaaaaaaaaaaaaaaattagtaatcattactgcttgatcaacagaatccttttatttttatgtttttgcacataaaaagggaaagataattctttagtgaaactggaattttgtttctttactgagattgctgttattattactattacttttactgttactactaggtccagtttggcaatccggccttgattcctgctacagtgcaggagttttttccactgttgcttttgcaccaccagtgcaagtgtcaatacagtaaagaagataaataccatgttagtgttattagaaaaattgttttgaccttgtggacctcctgaaaaggtctcagggacaggcaggaatctatggatcacactgtgagatctgctgctttaattgtgattttaatctttgctgtagggtcatctggaaatgttttaactgaagcaaacataaaattagactggtgaaagcaatgattagatgttccctctgtttttggctttaacttaatgtcacagtctttgctgtgcctaatgtaacatcacatgctattgttcatctcacagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatggtacctttaatgatttcactatcttttcttctttggtcgggggaggggcacttttacttttcacctttatggaaaacatttacataccaaaaacaaccacagccctccttaccatcccctaaaatcccatcgaagggatcttaacctaagggataagagaagatgctcctgagattttatagtcaacattggaacacaccatggtgattaacacttttgtgtgataattccaagagatgacttagatgccttccacttctaccacaatcttactagcaatactgaaaatgggtgtctttctagctctcaaaactagaactctgtaataatcttattggttcctgatgctgggacactaagtagagtatacacacacacacacacaccaacccaggagaggggacacttgagatgttcagatcttgataagcttacttggggtagagtgtcttaaaacccctgaagacccatttcacacttaagggaagcctcagataggcttgtccaggggcaaaaaaaaaaaaaaaaaaaaaagctgtctgaatacttctaaaacaatagagataatttgtaaaaccttcactgagcttaaaatccatgtagttaatgaaaagtctcattacaattaaaccaatgaaaataatgttcacaaatgtttacagctaaaagtagaattgttttgattttttatgctatttttaactcaagtgcttattgacttaaatttaccagatgtattcggtgggtctcttctgataactttcagatgaacaccactctacagataggccttcatgctccaagaaatgaggtgaagactgtcatcattttagctagtctagaaatctattcctgctactcactgctatacctgacaactggttcaggattgtggctctgatctgcttgctaggcaagacaacccttgaccctcttttatttttactttttattcattcagcagttcctggcacataacaggtcccaatacctgtttattgaatgaataaataaatgatgacaatttatctgtcctactgtccacccaaccattcattcctccatccctccatctgtccatcggagcttttagggagtggtggcttcatgctaggcactgagccaggtaaccagctgctgaagatgatgaagaagccaagcctggtcctcaaggatctcacaatctattgcaatgattgcaaaactaggtctcttgttaagcatgcagactcccaggggcaccctggggattctgattgtgtagcttgggttagggattagcagcagtggtgattccaacatggggcgagagtggggaccactttaagaaacagtagaatgtgtgggaaacatacaagcccttgcagctcaggcttagaggtgctagtgaagatagagggtgtgctggaggccactagggaggccctgaatggaggatgttgatgtccagccagctggattgtgtggagtaggggcttcatggcataggtaaggagaggctcattcctgccttcctgtaggatttcttggcatctacctgccctccagctctgtggctgggtctaaactggagaaagcagccctgagcaatgatcgaccagcccagggcttccttccactctttcccatttttggatccttccctgcatagagtgaagcctgagcttcaacttatgtagagagatgatccactcatttctgttgttctgtgtgactcacctgttgagtaccagcagaggcacattaataataatggaaattttactggctcttgccttcatgtgctaataatactagcacgtaattttctacaaaattcccccccacccccgagatttctgggagtctatgaggtgcttcacatgtgcttgctcatgaatacttttttcttactgtcctgccccagtcctgctgactaaagccacagccctcaaagccacttgaggctcccatctccactgctgctgataccctcttgtccatgccaagtctttgcctggattttactaaggctatgctggcttccaagcagaacaggaggaatgtcttgctctccattctgtgtccatgtcatgtgaccccaagccttaaggtcccttaggataacagttcctttagtttctgcctgaagctcatctcccctccaggctgacagccagtatctgagataagcaccattgtgtcctcttgattccaatttcctaatcaggcccccactcaaatctcctcctttctccttcagccaaaagctttcctatggcttatgcaaatcatcttctcagtggattcatcagcagacaattggaaattctagtttggatccaaacatggacacccaccacactggcaaatctctaccctttccatggttgccatgatgaagagcagaccgtcatagatttatagattctaacttggaaaggaatgccctaaaagccagagtctgccattgccattcagcctgcttcccagagaggccttggtctccttgccacattccagatggaattaaggctcataacttttaggtctaataagggctgggtattaaaggaccttcatgtttcagatgggttttttggtggactgcctgggaaatggcaacattaattgtatattgtttctacagggaaatgtgccccaagttctcagcagtagacttacaaataaattttataaaatctgctcattcataagctgaggactttcataggtatttaaaagataaggttcgcgaactatcttgagccattcaaaattataatagaagcaactaggatgctatatcgctatttacaaagcacgttcgcaatcatttgcacatttaaactccagaatgactctataggagaggtagcattatcctcagatttcagatgagaacactgagtcctagaaagttgaatgatttatccgaagttgcataatcagtaatagctcaagttaggtccataccttctgagcataaagcttttttctgctttctgtagttgtctagcctaagtcctcgatgaacttgaaaatgtatgtgctagctttattttttgctctctgatggtgtttctccaattttatctcttttttaatagtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaaggtaagttgtccattttctgagtaaaaaggatagcaatgaaatctttctctagaaattgctaaatatattatatctccgtcatcatcttgataatagttatgtaacacccactgagcagaactaagtccattgaaatttgtagaaagttgaaagatgttccaccataagacaggctaatataaaaagcacctggtaactaacattttgagaaattattatgcttgactgtgtcaggcagtgtgctgggcactggcgtcatcttacttaatctttactacagccctacaagggaggcagtggcaagaaggatctgagatttgaccctacttgcaagcgaacaaggtcccccgtcagtttcacagatgccgacacatgactcctgggttagaataaaagaactttattgcccacagcaatagcaatgccagagtattgatatttgctcgactttttcatgcccgaattcccacagagtaacatgaagagggccagatgacacttgtacacacagtggattgagttatatgagagaactctaggcttaggggacttgaagtttttataatgggcagtaagcaggctggccctttgctgtgcagagagagactatcttagtgttccccatataaacatctttgagaagatagcccataacaaaggtagtcagtgcctgagctcacaagatgcgcagaaacacaagagactcgcagagaattatctcccaacaagtagtagtattatctccactttgcaaatgaggaaactgagatctagaaagattaaataacttgtccaaaggcacattgcttgtcaatggtatagtaggggctagaatccaagtctagcgtgggcacccaaaccagtactcaactattatgctagaatgtctgcaagaaatggtaggaggtatactgtaagtggatgaatttcatatatgtgaactatatctcaaaagctgttattaaaaagaaagaaaaaaataaacagtagaaggtggtaaagatggttcccctggagtctgggggacactgtagcctgtttgctaaatgttgccagtaacattagaaccagcattccctcttcttgccatcttatgacagcagccttgagttgggagggaaaaaccttgtgaagttgaattttaaggcctccaactagagtttggtctctctgttgttcatttcctgtaattgcataggcattagggagggaggagggaagagaaaatactgctctcttaagacccaaacgtgcttgcttgcatgtgattgctttcaattcaggcagcttgctctgggtggagttgggggaaattggtgagggaaaggaaaatggggtttgaattggctggaaggaaggaaggttagtgaggacagggaaagggtagggaaattgtgatagaaaaagcagaaggtcaaagcatgtcagggctggatggaatcctacaggcagcagccagggcttttattctccttctttgaggcccagagacgtgatgcccaattcatataagtgattgggactgtttgtttttttgattcctttcctgtgctggattctaggggagaatacagcagagaaaagatgcagaaacaataaagggaaaaaaaaccctcatttgagtaggtacctggcagaagacttgagtcaaagttggagcctctgtaactttcctctgcgggttgtccaaagaattccaaatccaagaggaaaattaacatggcagagagtcagtatggatttcccaaatgcccaaatggagtttggagtctgaaatgacctggtttggctgtctacctaggaactctccagaaaacttaaactcctcccttcagtttgtgttatgtagaccaagcaagccacatgtggcttcatgagaccgtctacactctgttttaaaaaatagtggggacagctcccttttcttttgaactgttagccaagagtttcattgagataaagctgagcagcccggaactgaaacagaaacatggaaggcgttgtctgtggtctctgtaagaagctgcccacaatactgttttcccagaccccatcctcattactgagaaggagcaaccttgttaatttgaggagttctttatgatttaggtcacattgttccagcaggctctttcttcaaaggaatgtcaaaagcgattagtacaaagaggaatttggagtcagaaccaacaggggtaaagcgaggagggaagtggtgccactcccagggtgtagatgcttcctgagtgttggcaatcgccgaggctgccggttacccggtctccttgggtaacttgagccctccccgccccacagcttgctgactgaggcagatgcaggtcacacggagttcactgatgaagtctatcagaacgagagccgctaccccgggggcgactggaagccggccgaggacacctacacggatgcggtgagtggcctgctccggagagaaactctcacctgtcacctctgatcgtgatctgcggggaacccagcagccacctggcttgggctttaacctctcctccgctccatcttatgttctgaagagtcttccacttatagcttaagccacacaagtgccacaataagtattttctttagaatagaaatgaggcctatttaactcgatgttggaacatggtatagtttggattgtgcaaattttttaggtaaatttttattattatctaattagggttctgttgttgtttgagggttttttgagataggctctttctgtttcccaggctggaacgcagtggtgcgatcatagctcactctaacctcaaattcctgggctcaagcagtcctcctgcctcagcctccccagtagctgggactacaggcacatgccaccatgctggactaattttttatttttttgtagagatgggttcttattatgttgcccatgcgggtcttgaactcctggcttcaagcaatcctccagcctcagcttcccaaagtgctgggattataggcatgagacaccaagctcagcctagtttttaatagtataacaaatgaaatgtttctgtctttaaaaaatccaagcagcattaaaggaaatcaaaagtaattattctccccaatccatattccactccccaaagataaccattgatgtctgttttctgttcataaacaaggatataacttcctttttccctgcctaaatagaattgtgttgcacacacagtttcatagcttgtatttttcacttaacaatatatcttggacattttttatgtcaatgcatatagatctatgagcttttaaaaaatggttgcagaatgttttattatatgtacctactataattcatttaatcccctctttctgggcatttaggtgcttttggttttgagtcgttggtttttataagcaatgtaacagtgaacatccttaaacatacatttttgtatgtttatgaacgtttatctgtagggaagatccttgcatttggttggtctaggtttaaatgcatataaaattttgataaaattttataaccttcaaaaaggttttataaattcatattttcaacaaaattacaagaagcccatttgcctaaatattcatcatcccgctttataatctttgccacatgaataagtggtatcctgttatttcaattttcactctcttaatttaaagtaaagctgagtattttttcatgtttatgggccgcctttatttcctttacttaggaactttcttttcataactctcttcatttttatgcaaacttaagtcaatattttagataaattttgctaattgtatataattaacattatgaacctccagtagcatttccccatactcaaaaacatgtgtctgccgggtgtggtgggtcacacctgtaatcccagcacttcgggaggctgaggtgggtggatcgctgaaggtcaggagtttgagatcagcctggccaacatgatgaaaccccatctgtactaaaaatacaaaaattagccaagtgtggtggcaggtgcctgtaatcccagctacttgggaggctgaggcaggagaatcgcttgaacctgggaggggaggttgcagtgactcgagattgcaccactgcactccagcctgggcgacagagcaaaactctgtctcaaaaaaaacaaaaacaggccaggtgtggttgctcacgcctgtaatcccagcactttgggaggccgaggtgggcagatcatgaggtcaggagtttgagaccagcctggctaacatggtgaaaccctgtctctactaaaaatacaaaaattagctgggcatggtggcgcacacctgtaaatcccagctactcaagaggttaaggcaggagaattgcttgaacccaggaggcagaggttgcagtgagccgagattacgccactgcactccagcctgggcaacagagcgaggctctgtctcaaaacaaagaaacaaacaaccatgtgtcttgaatgttttacccattctctgatgggttctatcccatgtaacccctcataaagagagttgcaccatttcataatattaagttgaaccataagaaattgctgagattcaaccactttgacctataacaacagcaatttcacatgattgaacctagtactattccctaatagtaaaaacaaaaggtagtttaaactaatttttatttagcagttgtgaataaataaagattagagatttttctgagtgaaatggatctctaagatggtatctaagtaaaggtgtgaatgccatagttaaatgaggaactatattggaccctttgcctcttactgacactatggcttacctctcttctttgtttttatttttgttttgtaagaacggcgataaagcagcatcacccagcgagttgacttgtcctccaggttgggaatgggaagatgatgcatggtcttatgacataaatcgagcggtggatgagaaaggtaacattgtacatctgtgacctgattggggctctgcagcagggccttggttaaccaggataaagtttccttgggagggaggggcctcacttctgttggtctatggcaggagtccccagcccccaggccagactggtaccagttcatggccttttaggaacaaggccgcacagcaggaggtgagcggcgggcaagtgagcattaccacctgagctctgcctcctgtcagatccgtggcagcattagattctcctaagagtgcgaaccctattgtgaactgcacgtgagaggggtctaggttgtgtgctcctcatgggaatctagccatcctccctctaccccacaaccctgtccatagaaaaattgtctcccatggaaccggtccttggtgacagaaaggttggggaccgctggtctgtggcatctgggtcatgtggtaccgtctgtgactaaccaaatgtagaatccaagggaaaggcaagtgtatggacaagtgctaagtgagcagggggtgttaagagtgaaaaacatcaggtgatggggccaactggtcaggttttgagatgcttggggatccaggatgagaatttgggagggagctggagtcaagattttctctattctaaccacaccccataacctccctgggaacatcacattcagggcccccctgacgcagaaaagagaactgtaaactacccttaaagtcttcctatgcagcaatgatgcagactactgatatagcttctgatatttgtctttttctgaaccataattaaagttaagtgaacaatagcatttggaattctcaaaagagaaaatctgattcattactttccttatgcatggtgcatagaactggcattgacccagaagatttcaaatcaattataagctcctcactgatctcgatgcacacaccagatctcagaataatcgttagcattgactgagcaatagctgtgtgctaagtatggccctaatgctttgcatatgtcattttgatagtgttaaaatactgtaaccctataatcccactttacagtggggaaattgggccataggcaggtttaccaacttgctggaaacttatttagttaacagccaacatgtggcgatgctaggatttgaacccaggctgtgcaaccgcacagtccacacgcttacctgctgtttcttcctgcctcttgaactgtgctttattcctaagtgcactcagttaccatgaatgactggaagcataaaagtaggggagaacatggccaccaaggaggcattttgaggagctgaatgggaatgaggctgtattcagtttggctgaataacccagcaaagtgaaaacagccacatattcggtcatgatagtacagaacatctgagggcagggagagtgaacaaatgtttcctcgaggtttatttggtgatctggcaaatgcatctcttctgggtaaccattcacaaactctgttccaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggtaagagaagcaagggaagggagctggactggggagctctgccctcctgactacaaagtcccagctaactagccatttctgcagaaattatttgcaaatccagagcctaacactccactcaagggttctcaaagtgagcccaccccagccagcaatatcatcatcacctgggaatttgttagaactgtcccaccccaaacctcctgatttagaaatcctgggggcaggcccagccatctgtagttcagcaaaccatccaggtgattcccaggcaggctaaatgttgagaactgctacagaggtgttaaatggaaatgattttggcagcataatctagtagtagtaataggtcaggacttggaacaagatgtgtaaagattcaaaccctgacttccctttctttctcatctgcaaaatgggaataatatctatgccttttaattagggtattgtaagctttaaatggaataataataaattaaatagaacagtaacactcaataataagtggcatgtatagaagtggctttctataatgctaggtactgagtatgcatcatctatgttctgtaaggtttggattttatgctcattttatagataatgctcacagagtttaaatagacttgctctgggccaagtgtttagtaagtgacaaagctggtgctggaacccgggctaagtccaaacaggaactctctctattccacagaatgggtaactccggtaggcactatgacattatttttattagatggtgagcttctggaagcaaagatggagccacagtcatctttgtatcctccttgctaactcagaaatatgctcccagtaaataatctagtcaaataaatgagctaatgaatgaatgagtctttttttttttaatttaagttccgagatacatgtgcagtacatgcaggtttgttacacaggtaaatgtgtgccatggtggtttgctgcacctatcaacccgtcgcctacatattaaacccagcatgcattagctatttatcctgatgcgctccctccacccgccggccccagtgtgtgttgttcccctccctgtgtccaagtgttctcattgttcagctcccacctgtaagtgagaacatgcggtgtttggttttctgttcctctgttaggttgctgaggataatggcttccagctccatccatgtccctgcaaaggacatgatctcgttcctttttatggctgcatagtattccatggtgtagatataccacattttcttcatccagtctatcattgatggacatttgggctgattccatgtctttgctattgtgaagagtgctgcaatgaaaatatgcatgcatgtatctttataatagaatggtttatattcctctgggtatatacccagtaatgggattgctgggtcaaatggcatttctggttctaggtctttgaagaatcgccacactgtcttccacaatggtggaactaatttacactcccaccaacagtgtaaaagctttcctatttctccacagcctcaccatcatctgttgtttcttgaccttttaataatctctattctgactagtgtgagatggtatctcattgtggttttgatttgcatttctctagtgatccgtgatgttgagctttttttcatgttttttggccacataaatgtcttcttttgaagatttatctgttcatgtcctttgcccactttttaatgtggttgttttttccttgtaaatttgcttaaattgcttgtagattctggatattagacctttgtcagatggatagattgcaaaaattttcttccattctgtaggttatctgttcactctgatgatagtttcttttgctgtgtagaagctctttagtttaatgaatgtctctctattgtttaattatccccgtctgacagggtgagaagtttctgaaggtgcttgaacgctcttcttccacacgagggcaccaagttgaagcgggaagaacactgagccatcagttagaaggctcaggatatggtccagttctaacgagtatttctgaggctttgatcatgtttcctaacctgccttactcttggctatgtgaaatttttcactgctactatttatgttactagagggtcaggtacaagattatgcttaacctgcattttacatttatttaaagtgaaaaaatagacccaacaataattacccacatggagctctcacttctcaggtcttgaatattattccacattgttttacgtttattaaatccagtcatatttttaagattttaaatcaaacttctgccatgaaaatgtcagctgcatgaaagcaaagaccctatctcttcttcactgtgtcctcagcccctaacacgatccctgtcacacagtgggcactcatatttgtcgaatgaagagaatataacattgaaaactgataccactggtaaatcaatagttcttaagctaaaaagtaccacacgaatttgttattagttattacagaaataacatattctgatcacttaattatcagttatggcagctattagctcaggcaagacatttaaacctgggagggggcatttaatttttttcctacatatgtaaaatggagatactaatgttttacaaactatatcacaatagcaacatttttatgaaataatgaagtgaggaaacagaaagcaatttgagaaagaatccacttgcttcacccacccccaaatctgaatgaggtgcacctcctgagggtatgtccacgactgtgctgtcattgcctggttatctctctgcactcctgcagtccatcagctctgcaaggcagaggtcctgtctgtttttttcttttctgtattcctgactctagctcagtacttggcacagagtagattttgaatactgtgtatctgttgattgatcatataacctgttttatcaaaataaggaatatcatcatcatcatcgtcatcattaacatgtttacttctgttttaggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttgtaagtactaggttgccagagcgcagatcatattggtgtagagaaaatatatgagtgttggatacagcactgccaactccatagaggtccctgtaaccctggtactataagatggcaaatattaacaggttgagggaaagccacacatcctgggtgctcaatacctcgtgtagaacgaatagaccattaacacaggagtgttctaagaaatactgctgtctacacacctgctttacctagtgttttccaaatatatctgttccaggacccttgtttcaggtgacacctattcacatcccaggcacaagttctttgaatcacatcttggaaactgcaactgttcaacaaaatattcatatgtatattcataaatatacagatgtcgggggaggaaatcagaagtctagctcacaaaattagagagcaatacggaagaacatactgaagcacagtaaagaagtcgggggaaaaagcaggcaggtggaaggaaggaataggagaatggcagtgggtgatctaaaacaatagggtggtcaggagccatttcccaacagcctatgtttgtatttctgcactctgaccccacagtattctgctgctgctgctctttctcttccttatcccatccttttactccctgtttatcctctacatttttcctttttttccctttctttcagtagcagggtttggcaaacctggactggaggtaggagggctggctcccacttcctgctcggctgctttccagctaagcgacttcagggaagtcacttgctatcctgggacttattcatctttaaaaatggggtgtttgcacgataacatctttaaaaagctagaattccatttgttattcttgcctcttggttggttgatttgcttttaggcagtgtttattgacttctctgctaattgactctgttaattgacttcagggggcagacactaccgaagatggggatgagaagagcctggagaaacagaagcacagtgccaccactgtgttcggagcaaacacccccattgtttcctgcaattttgacagtgagttttgttttatttttgatttattttattttattttattttttcaagactgagtctggccctatcacccaggctggagtgcagtggtacgatcttggctcgctgcaacctcccaggttcaagcaattctcctgcctcagcctcctgagtagctgggactacaggcgcacgtcaccatgcctggctaattttttgtatttttgcatttcctccatgttagccaggctggtctcgacctcctgacctcaggtgatccacccgccttggcctaccaaagtgctgggattataggcgtgagccaccacacccagccagcagtgaattttaaacatgactttgtgaattccacttctgtaactcttatcttaaggaaactcttcaaatcactgaatatgatttttaaaatctcttcatgcaaacgtgactttcattttcatccttgatgaaaggagtttttaaaactacagttgaaaaccatatcacatataaggtgaagggtggtcagatcactgatattaacagtctatctcatatgtgctcattctgtctagtaagcccccaaaattaaaattttaactataggaaaaaaggcaccaaaatttaaataatggttgatttcaataataattttcaggatttttggaatgagacagacctgctctacaataatattagcaaatgcttatataggtcttagcatgggctaggacctgtacatattataacttgtttaatcctcttaacaaccctgtaaggtaggtgctattattgttcccgttatacagaagaaggaaccaaggtacaggaagattaaataacttgcccaaagtcttatggcttgtaagcactagagagatttgaactcaggtagtagagctcccagaatctgtgcacggaatcataatgctctgctatctcacaaagagagagagagagagagagagagagagagagagagtgaatgtgtgagtgatagagacagagagaatataataataaaaggagtatgaatattttgaaatgtcaaagaatcttttagatgttaactgtttcccagatctgatgctgaagtagtatagaaagccccgtttctatagctgctggagacccagtttcattttaaaggtctgtgatgataagcagtaccctaaattcagttagtttataacaaaggtaatgttttcctgattgatacactttgcattgagcttactgtagtattttttaaaaataggatttttgtttttaagaccgagtctcactctgtcacccaggctggagtgcagtggtgtgatttcagctcactgaaacctctgtctccagggttcaagtgattctcgtgcctcagcctcctgagtagctaggattacagacgtgcaccaccatgcccagctaatttttgaatttttagtagagacacaagttttcaccatgttgaccaggctggtctcctaactcctggcctcaaacagtctgcctgcctaggactcccaaagttctgggattacaggcatgagccactgcacccagcctaaaaaataagttttattttacaggaaatagaactactttgggaggccacatcatcactattctatgtgctctttactgtggggaactataatagattcaagtgacccatttatcagaaacatgtattttttccaaatattccagtaaaatagcagtttacagtgttacgcttcttgtaagtaatctttatcctgtttttttaggagtctacatctaccatctgcgctgctatgtctatcaagccagaaacctcttggctttagataaggatagcttttcaggtaaaggaaaaaaaatctacatgctacacatgattacatagcatgctattttgcttctgtgtttcgagtgaatgctttttgtcatttctaacaacaaaaaccctttacatgttgaggttatttttgcatgcttgaagcaaactgctcagtcattagataaatcatcactgaatgctttaggcaccattgctgggtcctagtaatacatagaagatacttttggtactaatagatattaattgattaagtaataagaagcaccgagaaagtgatttctcatctctgtttatatacatggctgtgttttcatccctggaccctcaggttgattggtaagttaagatcctttaagtttttttgcaggctctttcaaggtatcaaaaagatgataagtttgcccatttgcctacagcaccaggctttgagcagtttggagttcattttaacctcctcctctgcctgctccccacattcccaataccataaaaccatgaggctttttcttctcttgcactgacacccagctgcttttgttgcttcggactggttctgagaggaaggctattggcaagggacaggggaggaggggagaacatgcctgtctggggatttgagtccttgccgctgaaccatggatagttcaggctatctggggagaattccagtttgggactcaaagcccagcagagtttccctgggccttctatgaaaacacctcttaacccatttcccatttgccccgagaaatgagtgctggcagcgagctgcacttttttattccaaacggaaagtttgttaaagcatttgactgacactctcatgtgctcacatcaattttgaagcgtgttccaagcactaatatttaccaatatttgtgaatggtttccttttcttagaaatttgagcagattcaaggttatctctgcaatatacatctccaacagggtctttgaagacattttcaaatattttccaccagggggcactctatcactgaaagttaaaaaaacatctttccaaagttcttgactaaagcttcataaaactctaagcacattccttgcagtttgagatagaagaattatcatcagggcaaaagcaaagggttcatatgatggctccactgctagaaaccaagcacttttggcttatacaagagtttcaggctagatattgtgttatttttcagataagtcagcccccaggcaactgcaaaaagtttgatgaaattatttagcaaggaggagaacatggattatttctccatacataatattgctttctctccattcttaagtatagtgagacaaagttttctgctgtcacagattgtaaactctatgagcatctgagcttttccggctgctgttatactcttgagacctggaactcaataaatatttgctgaataaatcgattaccatcaacattagaaacaactataataaaaactagcatttatcagatacttcctataggacaggctctgtcccaaatagctaacattccttatatcatttcatcctctcaacaccgtgaagcagatattactttcattgcatggaggaggggatcaacgtttaggaagattattttttccctcaaagttatgcagcaggggtgaagtgtgggtgttgaccccaggtgtatctgactgcagagcctcactcaaccatgagtgcagtacttttgcagagaaaaactatgggccccattaaccttggtggggacatactctaaagagtgacctctcagtacacatcagggtctcgcttcaggtgcctctgctgcagtgccagaaccttccatggggaactccctgctccctagaaaccctatctccaggcaggtggtcagagcccactgtcattatatccagaggaaaagaatatggttgcactgagtggttctggggagttagattttagccgtggccccgttgttattctctttttctgttttagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtggtaggtcgtttagaatttctaagataacttggggatgatggagatttgaagggatgattgtcggggaatttaaggatcactttgtttctctagggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggtacattgctgtgttcttcctcatgtattctgtcagctgcttaaaatgcatgttaattctaggcactgtttgcttgaactaaagtgaggcattgacatatccatgtttgtttcacaggatggctccaaccttcccattcttccccctcaaagggcgccaaatctatacatggtcccccaggggatcaggcctgtggtccagctcactgccattgaggtatgctgctccccacgtgttactcatcaaatcaaacggatgtgactgcaggacaggaatcttttgtatagaacatagaatcctgctgcatattttcttgctatctccaacttcctttacaacttgtccaaaaactggaggtattcatgggagtagaaggcttgttgaagcaacaaggacaggtcaattctaacattcctgagggcatctaaactcctcatttactgggagccagcaggtttctgagtttttcaggtcaactggagacctgggagagggaagatggacgagaagagaatgacggtgtatatgctgagagatgggggcatggcagggaggcagagatggaagttggatgggagcagtgagcaatgttgacatgtcagatacaagctgatgaccccaacaaggtggcttgatagacagtgtctggcccactctcaagactttccccgtccagtcaagcagctgttaacaccccaagatttcccttctctggctgtcctgctaagagttctcaaaggctgaggctatcacttcgaaatgcttccatgtcagacaccgtgttaagaagtttacaggtgggctggatgcagtagctcacgcctgtaattccagcactttgggaggccaaggcaggtggatcacttgaagtcaggagttcgaggccaacccggtcaacatggtggaaccctgcctctactaaaaatacaaaaattagctaggcatggtggcacacacctgtaatcccagctacttgggaagctgagacatgaaaatcacttgaactcagggggtggaggttgcagtgagcctagttcgtgccactgtaccccagcctgggtgacagagtgagactctgtctcaaaaaagaaaaaaaaaaagtttacaggtggtcatcaatataaccctatgacagataatacgatcagtcttgtttgtagatgagacatagggaggtgagttaccttgtcagcattgacacagctattagatggcacagccaggatttgattcctatactcttaactgcattgcttttttaggggctcaggcaggagaaagaaaggggcaaaaccactttctttggatgacctacaagcttactaggataatgttcaaattaatcttaaagactttgccagtaattaagacagaatttttccttttgaatattatttttaaagtgctgagttaccttcccctctctttaaatcgttttcatagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtggtacagtatcgattctctgtgatcacccatgcgcgttgaaatatgaaagtatgtgcctcacacacacacacacaaacacagagtttatttccaaaacctgacaaatagaaaaaccctgccttatattcagcttgtcagtgactttttccccttaaattctcccactgtagtgatgatttcttaaagcttcaaaataactccagtggcacagaaatatctgtgagcaatacttacttatttctccagtaaactttccatctattcagctatctattacaagctgttggtcaaccccatgaaggcagaatattaacccccagtcatgcatggaccagatataccccctacaactgtgcatggaccagaaccttctggataaggactggctgtctggggaaggggcagctgtgggggaaggtatatggggtgatagggccatgaccttggcagcccataactgtgccccacctccaggtgcccctgggatggcaccttctttggtccattgaggctaccctctggttgttaaagatgtgagagcatcagatccagttcacagctctccatcacagaccccataatacctggggtgagaagaggccacccagtctttccatttttaaagcagttaatttcttaactttaaaaaaaaaatctttcttttttactctattatataaataggtgacataaagacagtttcttaccttgaagtgttggaagacctagaaccttcctttccccaccccagtcattttcctgaccttgatgtctccaatacagtgctcttgaactctagggtcacgtgctttaacctcttattttacattacagaggaggaaactgaggcctaaagaggggaaatgatttatccagtgtcatagtgttaggccacaccttctataccacagtgactatgtcctaactagtgacagctgcagtgtagggcttggtgcattcttacttggtacacctcgtctttaatcctgcggggtgaacattttcacctctcttatgcccaccttggggaaaagcaagaggtaacagatttacacaaggggatgtcgctagcaagtgagtggccagagtttgcacataggtccttacaaccccaatgcccatgctcccctccctatcatgcgacagacggcgagccaccgggatgctgccagccagggtcccaaagtggttgtccctgggccactccacctatccttgtctactccccacacctccctcaccttccaagttctagtctggaatctagccttggtcagcagagatgagaaaaaccactcaggtgaccccagtttctattcctgtgtcaagccagagatagaaattcacctgaaccacataccaaatgggcccctaggtcagctcatgattccccaatcaggcattgtcaccaaagccaccaaattccatgagagggagccagggggagttgaggagaaagtagcaatccatttttacactgaatttccagggcaaagagactctcagccacagttatttcccttagaagttcagttttgtcttgaccatttctaaagtctgctcagaacttggctagtagatgaccaaagccctgggctagttagccttgtgcatgtcccctcccaggaagcagagcacagggaagagtatagggcagtgactgagagtaaagagcatgggtcagtgattccacacttacaggacacagcatgggtcaggtactattctaagtactcttcacatagagtaattcaacaatgttactattactcatgaaataatgggggcatggaagggttagccaggtagttcatggtggcagtgccaggatttgacccaggcagtctggctgacagctcacgctcttaagcacggagctccttgcctggcacatgagtaactgaactattgcgagtcctctgggctgtgtggcagagagaatctggactggtccatctggggaatttttctcaaagctgccctcgtctggtcttgagaaatgaaacctacctttgtgacccccagttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaaggtaacatgcaaggctgtgcataagtctgggggcttttcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgtctggggacttttcatgcatggctctgatttactctttacaaacctactcaaggtaagtcctggattcattgtctacattttacggatgagcaaactgcgtgagttgcggtgggttatggcactttcctaaggttctatcattcgtaagtggcagagctgggctggaatctcggccttgttttaggggtgggtggcatgctcgagggattcctctctgaagcgtcctgctcctgggtgaatgtaagacttcttttgaggaagtgttaagtgctcatgaatgttccctattcacctttcaacaagcagcttgcaaagcagggagagctgttcccacatcagtgatggggatgaagtcatttcctctgcctttcactgaatggttaggaagcactcactgactgccacgtgctgttctagatatctggggacagtggggaccaagaaaggcatgttcccctctcacaaagcaaaagtccagcagggaaggcaaacgaggaagtgtgcagttgcagtccagtgtgataaatatcttgatggggaaaacaggaagctccctgaccccatgaacactgagagaggaggagattttatttcagattgctttccacctgttggcctacctcattatcacatataattaatatgtaaatgatagagcagggcataatacttactttagatttccataataaataatagctagtgatacagcattttgcaattacccattcaatagttacttgcttttagcttaccatgtgctagggactgtgttaggggctgggggctacattgcatcagtgcaagagatcccagggcccctggcctcataaattagacaccgtgggagggctggaacagcctcattcggctgatccttggtggcttcaagactgaagcagatgtcttctatttaagcagctgtgtcactaactagttccattaaaactttcataagtgtgagtactgattttacagagcctctgaaattcatctgctgtgtaggtctgactaagcatcctggatccctgattcagagaagaggaaaaaaatccacagtcacatttaagcaaaactctacatgtgcttattaagaaatgtcccatataaaacattttatgctgaattgacggtgcctaaaatagcatttttgataacaacaaggattgttgtaattgcaggaattgtttcatttgaggttactaaatggagagaaaccactttcctggctttttttttcttactgttttcatgagagaaggttttttggtccaaatatgtgaaatcacccagagggtacaaatgctacacgctttctctggccccagaatcacttacgtggacctgtttgtgtctattgctcaggggtgggctgggtctaaggcagactgccctggctagcaattctatgtaatcaatgtagagtgtggtcaaggcttcagagagccccagaaaaggaaaatctggtcctttcataaaaccagtgataggttaagagttgagggcacttggatggcctcatgttggaagcacacagaataactttctcctcctgtcccttgggctttgtttccatgaggagggtgaagtggagaactgatcctctaggaaagaacttatgttcagttgtgttcctgtgaccctgccctctggttgtcttgttctgtactgttggacttgtcaggatctgcaggggagcttatcttggaagtgtagagactgcttacaggtctaggggtgccacgtggatctaaaactacctcacacagtaactgatatatcacagatgctcaggaaatgtcagtctcccctcctccccgctatccccctgatggttcctccaggctctggtgtggtggttaaaacacaagctttggagtcagccaaacctaggttacttactccccaacttaccactaattgtttcacctgaagcaagtgacttgcttgctgttagcttctgtttgttttaaaatttttaaaacagggataatggcacatattctacaggactattgaggtactaagtgaggtcatgtaagtaaagtgtttagctcagtgcccagcacatggtgggtaccgaaaaaggtttgttgtttctcctcctttatgtcctgtatgtcaattgccagggtggttaagcagaaagttctgttggcttggcagagtttgttctgtctaggttctggccttctgttaaatgtcttcctgtttggtgcttcctcaataaatgggagatgtacctctcatcctacccccgccccagggtgaggctttggtatcccccacccctttagctgaatcaaatgtagtaagcccagggactactcctgagtccatgctctaacccccaaatcctgagtcacagatattctgggaattgtacataaagtcagggcatgtgtcttctccctctgcatacgctgttgagaataagggctgaataagccactgcaacctcaggcctgaaatatacaacaatccaccctgcttttcttttcctttcctttcccttcttttttttttttttttttttttttttaatttaagttctgggatacatgtgcagaacgtgcaggtttgttacataggtatacacgtgccatgttggtttgctgcacccattaacctgttatctacattagatatttctccttcccctggcctctcacccctcctttcccttctttttcttatttttctcttctttattttctgtttcttaggaacaaacttcaagaaaagaagactcctttagatgtaggctctctgtatgttctcacttataagtaggagctaagctatgggaatacaaaggcatgcagagtggtacaatggacattggagactcagaagggggagggggataaaagactgcatactgggcacaatgtacactactcaggtgacaggtgcactacaatctcagaattcacaaccatataattcatccatgtaaccaaaaacctcttgtaccccaaaagctattgaaattaaaaaatgtcggttccccacttactcctgcaccctctaaagacatgtattgacacaattgttttttgagcactttctgtataggcactggactaattgtctaaaaacagtaatgaacatataatcccctagaaaatgtctaaaaccatattatgtttggggaaacgtgatggattgttggtttattttctacattcaggagttgtcctctctattctgtaagtcccatccaagaataaactctaccatccaccctatggctgttaaacttgaacttggagtagaatgttcaccactgtatttctctaagtatcttagattaagaaagtatttgtcttgcagcctcccttctgtctgccccaccatgccgggacatcgttatcgaaatggaagacaccaaaccattactggcttctaaggtaggcttcagagctgatcagtggatgctgtcagttttatcttctatgcttagatgtctaagcatttggtgaattcagtcaaacaacagtttgttgcaattataatcatcagccaatccatttattgaggactgagtacagacaagagtctaaatcttgcactcatcaacagttatgatgacattgtgtagactagtagtcttcaaccctcactaataagtcacccagaatacttaaaataaaacccatgcccaggccccacctcccaagagggagagggacctagatatcagtatgtttttaaatctcctcaaatgattttaatatgctggcaggtctgagaaccacaggtgtggacagtctgagaaagatcatttgctagaaagcgaagtctgagaagcaaatttatagcattgcaacattcagatcagagataacatgcaacacgccagattcttccccctacataaagcagaattgtttgataaatttctaatgaccatatttatcagtgtatgggacacccaggtttttttattttcactgtggttttgaagtgaagaaattggttgaaataatcactcaaggccctattttagaactagctattccagccacttctacacgaaggaaagggggcaaaaagcctcagcccagaaaaaaggaaacaccaaatatctccctgtttctcttggcagttatgatgaacattcacagcgtgttttaatgtgcaaactagcccaaaaatgcacatgattgcactttaatatgttatgtccataaacagtgccttaaaaaaaaaatctacttccatcccactgcattaaactcactaacaactggaccatataaaatatagtctccacagccagcactgtgcagcagtgtgtttgattctactctctgtgaatcctacacagtcacaaacgacaatatcaaatttccaatctcatgggccaaaactactgtgatcactttgtaaaccaccccaaatatccctaataagatagtagtagccttggcagaagttaatatacttaagatcttttctgtagatttttacaactgctctagaaaaagacagtttaagatctcgctgtataatctgcctccaggtttgccatctctcatcgtcagtcaattcttattacatgccttcagtgtactcagtagccctaagaacaactgaggaacaggagaagaataaagtcaacaagctatgccagtattttcgttcacttcttaaccatagttaagaaatgtgactatgttactgtagcaacactttatgaaagttcagtttacatcatagagttaaacattgcaacatagcaggattggtgatggtagtatcagtcattcccactgtattgtaaattgctttaatcagctcgctctcctaacatctaattgaggtacactgtgttgataagaaaggctggttgaaatctctaaaaatctgagtccacttgttcatcacagtagacatcgcacatctgtacaaagtcaaatgaacaaagttgcactttgaaagagccaataacaagcttgctgatgtcctgtattacatgtatatgtaatgtacatgtaatgtgcatgtattaccacttcctcaattcaggccttgtatctgggtaaatggagggaatgcctcaaaaataactatgctgttgctgggggctggaggctgtgtctctgagtgacagtgtcacactccggaaactcatggcattactctgtgatgtccatggaaattcttaacaaatgggctgagcactatcacaagaaaagtgagaaataagtcttcggggaaaattggtcaagtgctagccagataacatggacatgtgtacatggccatctcaacaattaccttccaattccagtgcttaagcagtatgtcaacagcactcagcaaaatggcttctccagcgacagtgcatgtatgtatgataagcaaatgcatgaggctgcctgggactgtgggaccttggcctaaagacttgaattattcttacaactctttccattagtagattttggagtgaaaagtgatctttaaacaaacgtgattgttttaagcctaaaagaagaatcttctgtgccatttaatgatttgattcccattgcaagtttattattagatataataaagcaagtcacatcagttgcttccataacctttccacatgaactaatgatcatgtaggcatgaataaattctcccatactaattctaaagtttaaaatcagcaacttgtcttaaataatgccttttaggccgggcacagtggcttacgcctgtaatcccagcactttgggaggctgaggcaggtggatcacctgaggtcaggagtttgcgaccagcctggccaacatggtgaaaccccgtctctactaaaaatacaaaaaattagccaggtgtggtggcaggcgcctgtaatcccagctactcgggaggctgaggcaggagaatcgcttgaacctgggaggcggaggttgcagggagccgagatcatgccattgcactctagcctgagcaacaagagcaaaacttagtctgaaaaaaaaaaaagccttttaaatcatgaactattattttccttgaaatggtttgaattgtgaacaaacagattctaaaaatctgatctcaggaaccattgagaatgtaagagtactttggaaataaaatcactctctccaaaatctcaattcagctgtgatgatttaacccttaatcttgctttggtatgaatctaatagaaagaattgatatatctatctgtccctctgcctctcttggcaattgcattgtgctgaacaaaaatcaatctggaaaataccaaggggcacctacggaagcagctccatggcctctcacatggcaaccggaggaagagcccttcaggatgaacataaagttaggatctcagaaaggggtctaggcagcatgtcttcaaactgctgctgaggacgagcttggctaatgctctaacagataccagaaccacattcaagccccccttcccagttcttcattctctcatctcctggatgggccctcagattggggtgggttctccattaaaaaaaaatcacatgaaaggatttggccaatggaaacttgacatcctcataataaagcagttttgatggatgagtatttatttggtgctgtaacataggcatggctggggggtacctgtatgataacattgcagtcaaacatatcttgtgacaggacagttttttgtggggaggagaattagaccaagttcggagatatatttaaggaactaaaacgaacgtaagatctggggtagggggatgagcagctccacaccctgctcctgtgtgagctgtgtgctcccgactgggaaatgtctaactccatcgaaaacatgagatgaggggcagggaaggggctacttccaagcctttcattataatactgtgtgtaaccttttgcatattttcagaaaagaaaccagtaaggtgggttcagttgtgggctcatcctgacttagaaaattttaaataatttagcccattgaaatgttgataatataaggcatgcatgaataataatttttgcttctttctctttaaacttcatgttcctggggtctccatatctatgtgacctgttatatggtttgccctcttcctcacgggacatgtgcacgagcagctgacagaaaaggtaactatggtatacattttgctacatttaagattcatgtattttctgcccagaatttttcttttctttttttgagaaggagtctcgctctttcacccaggctggagtgcagtggcgcgatcttggctcactgcaggctccgccccccggggttcacgccattctcctgcctcagcctcccgcgtagctggaactacaggcgcccaccacctcgcccggctaattttttgtatttttagtagagacggggtttcaccatgttagccaggatggtctcgatctcctgacctcgtgatccacccgcctcagcctcccaaagtgctgtgattacaggcgtgagccactgcgcccagcctgggaataatttttttctaaatctaggggggccgggcacagtggctcacgcctataatcccagcactttgggaggctgaagcaggcagatcacttgaggccaggagttcgagatcagcctggccaacatgcaaaaccctgtctctactaaaaatacaaacattcaccaggcgtggtggtgagtgcttgtaatcccagattttcgggaggctgaggcacgagaatcacttgaacctgggaggtggaggttgcaatgcagtgagctgagattgcaccactgtactccagcctgggcaacagagcgagactctgtcaaaatttaaaaaaagaactaaatccatgtgtaggttgctgacccataaaggggaagtaattctgtgtaagtatgtgtaacacacacgcattcacacacacacacacacacacacacaaataagaagcatataatgtaacatataatataacatgaataaaaagtagccttttaaggccgggagtggtggctcacgcctgtaatcccagcactttgggaggctgaggtgagcggatcatgaggtcaggagttcgagaccagcctggccaatatggtgaaaccccatctctactaaaaatacaaaaagtagcctcgtatggtggcacatgcctgtagtgccagctactcgggaggctgaggcaggagaatcgcttgaagccagaaggcagaggttgcagtgagctgagatcatgacactgcactccagctgggcaacagagtgagactccgtctcaaaaaaaaaaaaaaaaaagtggtagcctttcttgtcccttcttcctttcccccaagaggctctactgcaggtgacattctgtgtttttttgtttgtttttttttttggcgttattatttccaaggtaggttaaaataagcaaagagggggtctgataagaatctattcttgttataaatctgagtgggaggccttctatagtttgacaatattccacaagtgactctgacatgctgtcccttctgcccaaccaaggactacccattcaaaccagagattcccaacactgtctacgtattggactctcctggggaacttctgaaagcttattggatgccctggtctcaccccagactgattgcatctcctaggataggttgggagccctggtctaactgaaccatgatgcctcctgcctttcgtttcacgttttataattttcaaagctctttctcctaaagatcccatatgatttccagaacaacttttggaggtacatggaggcaggtagatgaaggcagcatgtgaatgctttgtccattgtgttattattgcattcagtggatgaagaaattgatgctcagagatgttaaacaacttgcccaagccagtacagcttgaaacataagggtatggcttataacataaaggaaggaacttgaattaaaaccagtttttccaatttttagctagtgagtattgtattacaaggcattactggctaaaagggctaagaaaatgagatagtagaaaacacatattggaggttttctttaaatttatatgtatatgtaaatatgaagtcaatagaataaaaatgtaaaaaccaacaaattaatagactgtgtgtaaaagacataagaacattatctagtatgattgtgggcattaaagccaaacacatttcatcggcccagaatggccatttcacctctagcttctgagtaggagagtcgtgaatgctttgtccattgtgcatgtaaacaaaagtcatataatctcacttttaacagggtcagaagaacctatttcttcttaactattacaaatgcattttcctgcatcgattggaaatccaggacatcactaaagatttttccattttggcatgtctttaggaggaagaaatcgtggactggtggagtaaattttatgcttcctcaggggaacatgaaaaatgcggacagtatattcagaaaggctattccaagctcaaggtacctggatctatgctgctatgggtggagaatcaacatcctttgaaactggccacaggcagagctaagaggatgactaaaaggtcccttgggtgggtgctaatgagcagggcccaggaaaacctctgtcttcccggagagccctcttgcatgagtttcggctttgccaagattccagggacttgaggacagctattgagttatggttacgtgactgccacattggggcttggaggcatctggcagatggttgggaatgggctggcaccacactaattaggccacgatgatccagtttgactcagggaaacccagaagtcatagtgctctttgcagaatgacacaagatgtcaacatgctttgttgtgtactttgaacagggattggtttcacaagctgaaaagttgaatctgtcacatgtatgcagcataaaatcacagccgtgagaacatgtatacagcaggaagacaagcgactgagctaggcacggctgactagctctgagctttctgttcatgttttgaattttctaattcttcattcaattttcagcctgtagtgtcctcaagcagaagcagtgctaaagttttcagaacagtgtatatgagaaaaaaaaactttagaatgagaaatatctggtcattgaaataattttccccatcaaagcaaaaaaaaaaaaaacccacaccttttcatgttattgtcataacttctcagtgtagcttaagaaatactagcatataaaggaccattcattcagaaaaatgatccaatgaggctgaaggatcagcctcacactccatcctccctcactccctcttcccttcctgcctgccttcttttcctcctgcctgcctgtcttcctacctttctttccttccttccttcctttccttcccttccttcctttcttctctttccttcctttcttctctttccttcctttctttccttcttccttccttcttttcttcctgccttccctcccttcttcctccctcctacctgcctcccttccttcttccttttctcctgccttcttccttccttctcctccttcatcctcttcccttcttgctttttaaattgagaaatattttacatacgataaagtgatccattcaacaagttgtgattattgtatataccctatgtgaaccaccacccaaaacaagacagaacattcccattcccacagaaaacttccccgtgtccctttccagtcaattttccactatcctcatccctcctaggagcaactgattggatttctctcaccacaaactgattttgcctgattttacacttgctctaaatggacttgtatgatttatgttttgtgtgtctggccttttatccccacgttgtagttttgagactcatcatgtggttgtgtgtattcatagtttttcccttgtcattgctgagtagtattccattgtgtggatatgccacaagttatttttccattctcctgataatgaagctgctgtgaacattcttctaccatgtgtacgtgttttcacttgtcatcagtaaatgcctaggaatgcaatctctagatcatagaataggtggctacttaactccaaaagaaactaccagacattttccaaagtggttgtatctgtctacactcccgccagcgatttgggagttccggtcgccccatccacaacctcaggcccacttgatactgtcagcccttttgattttagaccttacctgcattttaatgagaaattaagactctgttggtggttttcagatatataattgtgaactagaaaatgtagcagaatttgagggcctgacagacttctcagatacgttcaagttgtaccgaggcaagtcggatgaaaatgaagatccttctgtggttggagagtttaaggtgagtaagatgtgtgttggtcccgtttaaaatccaccttcattttctatataggcctagaataaaggacaaccaggctctagggaggggcacatcctgcagcctctgagggatgctggcattttctatataggcctaggataaaggacaaccagggtctaggtaggggcacatcctgcagcctctgagggatgctggaaggtgccagaaaggaaaagggggaggggggccagagcactcgagccatctccgcatctcttcctgcctccctgctcacgccaagcagccttgactgagccatctccgcatctcttcctgcctccctgctcacgccaagcagccttgaatcctaagatacagtctctccaagatctagttcctctcttcatcctactgcccctaccatgctttcagcaggatcatcgtgacaacttctcacttgacagtccttgtcacctttctcgtcacactcctctccagcctccatgcaaccaaatctgatcttctctctggactactgaaaggctttgcttgggttttcacagtcaagtcgcaactcctttcaaaggcagagccagtctttcccaagctacatggtcccctgcctccctccccctcacacactccaccctcctgcctgggagagcctcgcccaagccccggacacaccttgtcctctcaataagtcggaggcttgggacaggctcttcttccttccctgggtgccctttctacctgctttgtggtctgacgaagtcctactcattcttttaagcgccagctcaaatgtcactctctttgtcaagtgttccctgattgcttcgggcagcgtgactcactcctgctctgggctcccacaggtctgggttcatgcctccatgaaagcatcttacacatggaaagtatctgctttataattgcccctccctgcaaccacgcttggcaaagtcatggcagatgtgctgctgctgctttataatcctttgcctgtagcagacattgctaagggacgagaggatgatgcctgatgtgtggtctcaaatccttctcagtacagcctcccaccaagcaatcacatatggcacaagagccaaccctactgaacatcgctgtgccagacgggagtctttgagttcttttgtgggtccctagtacctggcacatagtaggtgcttattccatgctgcttgactgaataaagaccactggaactaagacctgtatgttctgaatccggcttcagtgctttctcctggttttaaggcaaaatatgtggcctctccagcaggtcttgttggctcgctccttcaaaatacaatttttgtggcgttactatatgcctagtcctgtgttaggccctggagatagggtgatgaacaagactttatgctcccctcacccgtctctagaagcccacagtctaatgaaggatctagagaataaatagattatctcaatgcagaggccagtgctgtgccaggggtgagtatggggttggatgagagcacccagaggacataccaagcccaggagcagtcagggaggtttcctggaggaagtgacacctttcagctgagatttgaaagataaacaggagtttgcctgggagtgggaggtggagtacagaggtgctacaggaaaagcggaatcactgttggtatttcgttgggtttaaaatgtaattattgttattcctatcttcaaagaatgtgcagtatttcactctttctcaccaccacctcctccatcacactggcccatgttctcctcttgactcccagtttctgctctgccctctcttctcccctgtgagctctcaaataattacttgagaatcatttcactttccctactggaaatatgcaaagtgcaatatacattatttctttcacaaaaggcagccttccatccttcaatcccacacccctggcggaggaggggacttcccaggagccctctacctgggccacccagggccctgtgagtccttctgtctctctcttttagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctggtaagagtttgggtgtggggccttctcctgtagcaagataattacagtcatcagccacaataattgtcatgttctttctttctgggcgtctgttatctcactaggggaaagatactccatcaaaacaatgtattcaggaggattgtccccatggggatttatctaagagcttgcggggggcttaaggtcccctggttcatccttctcattttacaggtgtgagccaggactcccccccgccccctgccaccacccctgcacccacacaactggctgcatgccacccaaaggagagcattgctcccttgtcttaggcacggggtgccatggcggccaccttgtcatcagctgggagtgggtgtggaggcgagctgagtctgtccctgaacttgacttcaccttgcgccctacaatgatgtaacatcccgtctattttgtcccacagtgtgacccttacataaaaataacactgggcaaaaaagtcattgaagaccgagatcactacattcccaacactctcaacccagtctttggcaggtaatatacattcttaaatgtttttctggccttcatttctccacggaacatgcatgaagactctaatatgtgtccaaccctgtcctaggctctgaaactgtgtttgtgaactagataaacattctagacaggggagcaggtaataaatagataaacccaaaataaaagaacttcacagaagtgaagaagcttggttctgatagcttgcagggtagacagacagcattagtactagtgttataggagcacaggccagttggagtttttccggggacccccctcccacctggctgtctgcggagctgtttatataaaacatctcaaaaaaatctcgcaactctgaggtgctattattattcctattttatttttttttaagacagagtcttgctgtcacccatgctggagtgcagtggcgtgatctcggctcactgcaagctccgcctcctgggttcacgccattctcctgcctcagcctcccgagtagctgggactacaggcaactgccaccacgcccggctaattttttttgtatttttagtagagacggggtttcaccgtgttagccagggtggtctcaatctcctgaccttgtgatctgcccgcctcgccctcccaaagtgctgggattacaggcgtgagccaccgcgacaggctgagactcagtgtttaatgtacttagcttttaagagaagagtgagggccaggcacgatggctcacacctgtaatcccagcacttagggaggccgaggttggtggatcacaaagtcaggagttcgagaccagcctggccaacctggtgaaaccccatctctacaaaataacaaaaattagctaggcatggtggtgtgtacctgtaatcccagctactcaggaggctgaggctggagaattgcttgaacctgggaggtggaggttgcagtgagctgagatcgcgccattgcactccagcctgggcgacagagcaagactccgtctcccaaaaaaaaaaaataaaagaatgaggatttgaactcagaccatctgaccccagtgtctgtgtggcacgccacggtctgatttccatctccatgtcaaacttattagctgctcagggcagggattaccaacccgactgtacaggtgcagaaaacagggctcccagagctctattaatagaggtggggtaagtgatagagccgagatttagctagaaattctgctgactccaagccccatgcttttccaaccgccttggtgatgtttcacatttgtggcaaagccatcacctgtagaaaaatgttctctgtctgagacatttgtgaaaatgatgttttgttctcagaaccttgctgagtgagagaatactgtgttcttatttgctgcgtggcatatatttttatttctggctttattatcttgcccatatgcttctttccttctcgggtttgttggtttgtagccttacgtattctttctctgtcatgtgtcacacacacatacatgcacacacctgcccaccccccaccccccctacgccccccgcatgctgcacacccaaggccatgcacccgggccagggaatggaagtaatcctctggcaccgcaatatgatcgttttccttttcttccactgatccagccccgaggtctagacaggaaaaggcacgcagggcaggaaggagggctcccgtgagggagacagggaagcagggaaagccagctttgaagggagaaaggcaaccctgtctgaattgctcgtctcagaggagccaggcacaagcttaattaagtggcaggaaaagtcttgctcggaggcaccctggaaggaaggggtgctgtaggctctgctcggccaatcgctgtctggcggatgggcagacttcccctcatccagcagggtggagccaaggagatgccggctctgcagcccccagatggctccagtccatggcctcagtcttagggggtagctttcttctccgcagagactcttggggactctggaacaggaattcaggaaggaacaacctttcctatgtgcgtggccgttactcagagtcctatccatcatggcagatcaccttcaaaagaatatcggtgtcttccacaggatattaattgatgttccaagaaaaaaaaatattccttagtaaaaccaagacacttgggtttaaaagttataattgcaggacttctcagaacctttagtttgtccagaagaactgcaaaagaagtggttctcaaccttatttgactgaagaattctttccagagaccacatatgatttgcttcttggaagttgggattggaaatgtgatgtttgggggcacatgtgggtaaggtgcttcatgtgtcatgactcaagcaccttttctcacatctgttttctgctcaaatggatcaacattcctggctctttgggcagggaccagtccacacaccagagtgcaaggagaaggggaggaggcagagaggaggcctctcacagcttctccttcaatagaacatattgagcaccttctccgggactgtccctctgtggatagtgcagatacagagcccaaagcccaccctctagcatacatcgcccacccaccacagaagcactgtctgactctttctcttcatctcaggagtgtttgcattttcatatgggttctatagaaaagccttaaagaactggagccaagggcatacccagtgggtctgggagaagaggggagcctttggggcaccctacatatcacaccctatggtgaatcacactcactcccctcccctgtgcttctgtggggtgagtcaaagatgttccatggggcagtggtctctattgaggcagaggagggaacctaggaggggcacaggtagggggctataagtcagggtacttgtgccttactcatctctgagctgggtggaggtgctctggtgaacagctaatgggcatgtgatgataaagttaataatataatacatcattattattatactggcattggagcgatgcactcatgtcagatgctctctaaatatttcttcacttgacacttatagcgacactgatgggagggattattatcaccactttacagatgagaaaacttagcacagagaagtaactggtctagagtcccacagctggtaagcagcagaggtaggatttgaagctaggcatttaaagcccacaggtttccctgagcaagcatatgttctcttcttgttcttatttctagtatgtactatttatcaagccacccaccaccacccaccctggttatcctgctcagatgtcctccagcagccatactacacacagcctgggaattctgtgcacagagccccagtttttgtgaggtactcagatggatcatgaagattctgaccttgcatttgtttatttaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtgtaagttgctttgactgtacaagaggcactttgctgcctctgacattggcacctggggaggcctaggccctctaccttagtgccttccttcactgagccactgctcctatcactcaggtatggatttcaatcgcaggattattctagggaatctccgggccacctcatggcccctattcacatcacagtgtgtgtaaaatggtggcagctggagcagtgctgtgcgctggggaatggcacagttagcagcccagagaccagttcccttgctccccgtcattgagcccctcctggatgtcaaggactgaggactggcaacgtttgatagcagggatttcctgtccttgggaaatagggattctttgtgccctctacttaattttgtgactccctcttcccctgcctggtatacagtgtctttccacagtatctgattaagacatagcttgcaatttctagtttatgagtttgcctattatgactagagtgatctcaactcctcacttttatggaggaggaaactgagggctaaataatattaaataaataaatacatttgtttctctgaggccaaaatagcatatgggtttttaggactctgaaatagatttctaggccaaagtcagagtgtagcgcagattttctgcacccactatatgggagcacctaagagtacatgagcatgtatgtgtgaatctgagaagaacctgcaggctcctccgtaactccgagccacgtgatgctattcacagttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttggtgagcacctagctgtggattgtaaactggtacaaagtatagtaacccatatatattgctgggtttgggggagtgaatagacagagccagtaccctaattataccacatgagactgtgcacgtgacactaacaacagccacgtcagagttctgctgtcttgtcaagtgtcaaagtggacacattttcttgtctgctgtttcacttgccctttttagattatagccattagagctttatacaaagtactagtaatgaactaatttccatgtaatgcataattagctaaaaaaatgcccatacagtagtgcaggaatttcccttccaggtttatcccatcatttgttctgtcccttctcccagaagcttcagggatgttatggttggcttgaagagcctgctatgttcccatttggctcatgttcaagcttggggtcttgctctttcccaaccagcaatttataatccgacctgtcctgacgcatcaacagctagctacactatgacaaagactgcagtaagcatcatagagcatgcgaactgtgcttccatattttgcacgggggagggttacccagagggggcggtggcaagggcatgggatatccagggggagctgaacaaacgtgcacaggaagaaaagtgctttctgctcctcagcttgattcgtgacattgtaaaaaacgatgttttgaggccgggcacagtggctcacacctgtaatctcagcactttgggaggtcgagtcgggtggatcatttgaggtcaggagttcaagaccagcctgaccaacatggtgaaagcccaactctactaaaaatacaaaaacaaacaaacagaagagccgggtgtggtggcatgcacctgtaatcccagctactcaggaggctgaagcatgagaatcgcttgaacccaggaggcagaggttgcagtgagctgagatcgtgcctctgtaccccagcctgggcgacagagtgagatcctgtctcaaaaaacaaacaaacaaaaaaacttatgttttgtctttccattttaaagaggacttggtatcagggatgattagatgtttaagaaatgttgatgctgcttctaacgtgaacttgcaaacaggattggaaataaattgggaagcatcatggtctaatggttaagggtacccccaaacaatcaaacaactcccccgtcatggggattgttccagttactattgatatataacagatcaccccaaacttagtaactgaaaacaaccattttgttttcctcacagttttgcggggtcaggaattcaggacgggctcaggtgaacagttctggccgaggctggccatgagcttgtgccacaagagtatatacagaatgctcccacttaccggatctggagttctggtccctttgctattggcagtccacaagttaggtttgagcctgggtggctcatctcctgtggttgcagtcagatgttggctgaggctgcagtcatctgaaagccctgctcgggggagcagtcaggtggtccacacacacagctggcagttgtgttggctctcggctggggctgatgaccagagcacctacacaggcctttccagcaggggagactgcagacccaggctccttacatgtggatggtgtcccccagagtgagggtccccagaaaaccaggcaggagctgtgtggccttttgtgtctaagccttggagtcacacagcatcttttctccatactccagtgtttgactacgtctccagattcaaagggaaatgacacagaccccacctcttcatgggagaagtgtcaagagaatctggggcctatgtttttagaatatcacagtggtggccagatacagtggctcacacctgtaatcccagcactttgggaggccgaggagggcagatcgcctgagcccaggagttcgacaccagcctggccaacatagtgaaaccctctctctactaaaaatacaaaaattagctgcgtgtggtggcacatgcctgtaatcccagctactcgggaggctgaggcacgagaatcgcttgaacccaggaggcaggggttgcagtgagccgagatcacgccattgcactccagcctggatgacagagcgagactgtctcaaaaaacatacaaaaaacccagaataccagtgatgccagctgctgtaaaaactgaacctccaaatttccgtgttctaacacaaaaaaagtttatttctcattgattctaagtaggtattcctccaggtgggtagctgtcttccaagcagtgctccatgaacccaggtccctgccgtcttctagctctgcagttcttaagtgcaggagtctgaggctgctgttcctttttgcagccagaagaaaaaggcacatagagactcctacccaggagggatttatgggccaggtccggaggagatacacatgtcacttctacccatgttaccctctggctgaacttggtcacatggcctcctctaactgcaagggaggctgagaaacaggcaggccatgagctcgtgccacagaagtaaatatataacgctcccacttacccgttctggtgtcctggcccctttactattggcagtccacaagttaggcttgagcctggttgggacagggctcctggtcagaagctctttctgtcaactcttccttcacaagtcaaagtttgcatgttggcactgcctgtccattttggcaaagtctgggatgaagtgctggaagcagctctaggcaatctggctgaactattcccaaatactcattcctgcttcaatgctgctttccattgcagaagccaacaaaatcctgcaccagcacctcggggcccctgaagagcggcttgctcttcacatcctcaggactcaggggctggtccctgagcacgtggaaacaaggactttgcacagcaccttccagcccaacatttcccaggtaaagggccttccctcccttgaagaccattatccctgccccaaatgcaatggcagtagttgacatttttgcgccttttatcttctttgaatactttgagatgcacagaaatagaaatgagactcaaattagcgtcatatcaaaagggaatttttttgtaagaattttcaggtaactctctaaatctagataggagattggccatgactcagaacaaaccagaaccagggtctctctgtgtctcatctgtttctctgagtctatttcatctgccctcttgctgtgatcaccttcctatgagtccagatattacagagagtccttgagtgcttgtgtgttgtaatgcagccccatctacttctaaatgcatagggatttgttgcccaaacttggctcctttgcccaccatgggaccactgagctccagcgaggtgggcagggtctgggaaagtgattgagctcggcccggttcaggaggtgccatctgagactacagtatcagggaggcgaggaccatgtggatagcaatgggggacattccactccagaagatggagagcagtttccacagaagcaaagcaagacatggccactgacaaaataatctatgtggaagcttgttataatgaagatgtccaggccatgtctgcagagatttggatccagtaggtctagggtgggtccaggaatctgaattttaacaagtacctgaagaggttctgatcacactttaagaaatattaatctaggccgggtgcggtggcttatgcctataatcccaacactttgggaggtcgaggcaggtggatcacgaagtcaggagttcgagaccagcctggccaagatggtgaaaccctgtctctactaaaaatacaaaaattagctgggcgcggtggtgggtgcctgtaaccccagctactcgggaggctgaggcaggagaatcacttgaaccagggaggtggaggttgcagtgagtcgtgatcccaccactgcactctagcctgggtgacagagccagactctgtctcacaaaaaaaaagaaaaaaagaaatattaatctaatggatgcaaatattgttgaccctgacagcaaaactatggacacgctgattgcaaaagggttggcctgggctttctaggttgttttgtcacttccttcttgcttttattttgttctacatttccatttcttccttttcttactcttcctttcaccaaagaacttattcctccttctttctctcctctcaccccttagccatatgaggagtttcaagaaatgacagagtgaggaagatttctccccgggaatccacaaacccccatcacttctgcctccagcattagccacagactgtggctgggtttggggagacactggacgcctaatattctgtagagtgcttgatgaattgtagagccctgagccctagagattagttgcaggagagtcaggatcatagtaaaatacatccttttcaagagctccacttaatgtattttgatcacaatgcattaggaagccaatctagtggtttccttggcaactttcttgaagatcagtttgtttttgtctgaagacagagtctacagaacactcaaaaacagtttgaagaatataaattggtttgtacggttgatatagttttttcgtggcattcctgacctgtctggaagaacattcgagtcagatggatgggccaagtctgtgtcagtcaaagagctgagcaggacctcaccaagatggagcacaaatgtcagtctaggctttcacctccccttcctgctagccacttacctggtggtgggcactaatgaaccaatggccaggaatccttaccttttgggaactgtaatattatcattgtttgagctcctcttttgaaaatgccatgttgtttttcttttacaaaattaaataccattttcactaattgcattcattactttgattttatattttgaggtaagtagagaaacccttgggtatggcaaaatggggattggtgtcaggtgggcaatgtgatggatagaatgacagcctgagaactgctaaaggcgaaggacccaattttaagtcattgtaagaggggggatgtgcgcgcacgcgcgtgtgtgtgtgtgtgcacgtgcgtgtgcctgcctgtgggatgtgtatgttggggttgggttagtgatgggaagtctgcagttttattaaccaggcgagacccagactatgatacaggtgggcatgtgcagccgtcagagacccctgagtgagaatggaaagtgggtggcctaaatgacattgtacataaaagattaaccttggtttgctctcttccacttcttgccttccatgtggactaataaattagagagaccaaagaaagaaatagtttcatctaagaaatatgaaagaaaattgtgacttctgctacccatcatataacttcagtcctcttttcattttcaaatggtttagggaaaacttcagatgtgggtggatgttttccccaagagtttggggccaccaggccctcctttcaacatcacaccccggaaagccaagaagtaagtcagtcatcctgagaccctgatacatacactgggctggggacttggtccaggaccagaaaaaaaagtaccttccaactgtgcttcttgcagatactacctgcgtgtgatcatctggaacaccaaggacgttatcttggacgagaaaagcatcacaggagaggaaatgagtgacatctacgtcaaagggtaaggttagcatgtgagagactttgccaagctcagggaaacagactctctccttcgtgagttttcattactgaatatgcccaagataggattcttggttttttgaggttattttatctcattaatgtgatctacttaggtagctcctggaaagcaaaggagagagagcaagacctgtacagactttgtttatgaggaaagctatataaggattataagaactgataaatatttctttgtttcctttttgacaaaatggattttcttcagtttcttaagcagatgtattatttctgggacgttttagccatgtagtttctttttattcctctttgataccctgaataactagccttagaaacacaagtaaagctcccaaaatttcattttctacatattttattaccagcagcccatgtctatggaaaagaggaaatgttcgcagatttcaaaggaagtaatttattctcccaacctgcactgagtgccagcatccaacatgtcaagtgtcattgttgttcaatattctcttacttgcctaattcaattaaatcgtctctgtggatggctatgccttgatcatatgcctcgatcatagatgttgcgtgcagtacagcatagcgactacattctggtgctttccctactgtctgggcaaggtagttagctcgctgttcctcatctgtaaaatggtgataatgattattcttccttcccagggatattcaggtgatccagttatccaaagcatttaggacagtgcctggcacatagtattgttgctattccacgtggactgagtttgattccttgatacatgaaagataagacttgcgacatttaatatattcataaagtgagaacaaagtttcacctataatcccatgtggccttcaatcaaaactttgttaaagatataattagtatcatttaggttcactataaacagggaatgtttcatcaagttcttcattattatttttggatctcattaccattctctagggaaactaatctcagctaattatatatatgcaaatttatttgactatcataagcattatttttttttttttcaaatcagggaaacaaactcaagtaattctgaacggagagaaaactcctctaatcagagaataaagctcaacttaaagtaccttgcaaaatttggaataaaaatctaaatacgacatgtgaaaagatgaatcgtgcataaataccatgcctagtgctagacacagctgggtattatattacataccaagctatacatatacatacatgcacacaaatacgtatacctataggagctgtttgacttgtcttaaagtatgaaaagatttatgtttaaaattaaatgtgaaaattcaccaaaaaaagagaggaagagctgtaagggtgagcagtctagggtaggatgatggtgacccttaggggtgggtcaggaggtgaggccaccaaggtcatggccaagagaatgtgaactctcctcagtgagttaccttaaaagttaatagtcaaaactgggcatggtggcttacgcctgcagtctcagctactcagaagtctgaggcaggaggatcacttgagccccgtagtttgaagtccaggctgggcagcatagtgagaacctggctcttgtaaaaaaaaaaaaaaaaaaaaaaaggttaatagtcaaaaggaatctttcaactcatttatctagtcagttaattgactagcaaaaaggaaaactactgcagttgattggtattaataccactactaatagtaggacttaatattttcaagtgactttgcaatctctgtggttctttgaggcagagtaacagatgtggacttcgcaatcagactgacctgggaatcctacttagttctgtcagttctgggctatgtgaccttgtgcaagttaatatattctctctgaacctcagtttcctcttccacaaaatggagatagttacgcagttgttgggaagaataaaataatgcatgtaaagtacctggttcatagaagatgataactgtgtgttaaaggtacctccattcccactctgcccctgctaaaccataatcttttctgtctgcgtgtcgaccatgtgaagggcgcacatatcattaatcttattttacagatgcgagatgaggctcagagagtttttccagccaggcctgcctcctaccatgaatctctatctatctgtggggtccaggcatcaatatttttaaaacgtccccagtcgattctaatgtgattctaatgtgcagtttcgagaaaaccatgcgctctctattgctttgacagtgtaaaatcgaatgttaccccctggtttcaaactagaagtcttcccagtagcaacaacttctttctgggcacactcattcattcattcattccttcagtaggtatttatctagtgtctactatgtgccaggcacaagcagaagaaaacttctcaaacgttaaaagttaagatgttactgaaatgaatgctcatagatatgcatgtggaaataagagctgacatcttccttgccggtatcattaatattatcatagtgaatttaagaataatttataaaaaggaagctgtaagattacttgatttgtgcttctttggtttgcttaagtaaaatatgggaaaggaaatgctaaaattttgagctaactcatattcatttaacctatcagcagtgctgaaagacactgatgagttatagttgtgaggactaaagtcatagccagcaggcttcattgtacccaaaatagaagctacattgttgatattttccagaaaatttcaccttagccctgttaactgaagtctaaagggtttcctgctttggttttaggggaatgatattttatttggccacaacctgtgttggatgcaatagagcacctcccctccataaatcacccccagctccgaagataactggaatctgcccaagaaaagtgcattaattctcctgctctttgctcccctaattactgcacaattttgcggctacatgacttgtcaatcacgtgaagctaagtctgtttgcctctgcctttcagctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagtgagctctgaaatatgccgctgggaagtgggtatcatggatcttccttaactcagaagctcatagaatgctggagctgctcaggatctcggaggtcactgagtccggctccttctcagcagagatggggaatctgccaccttgacacttgtccaaggtcacactgctaggacaggtatttgtgtcattaggaagcatgaggagcacaactttctttcccctcacatactcacatactggtggcgaaggataaagggtagaagtaacggttttgtattagtataaacaacaacccaagtgtgttctttatgtgatggggagactgatgtcttcccatgctaggcagagtcaagcagaggcccagtattaaagtgggtatccttccttatcaaacttccacatctgctttacctccctcagaggcactgccatgagggctcagggccctcctggtcttaactagttagactttcagttacagaactcaactcaaactggctgacaccagaaaaacgatgtattggttcacattaccaaaaagtccaggcttctgctggctttaagcccgtctggatcccacagtgaagtgataatgactttagaaattggtttcaccctccacactcttccccaggagacagtggcagcctcagctcacatcctgtcctccccgcaaacctcagcagaaagagaagagcgaagccctcatggggccaaccagagttctgtaattgggcctcaatgtctctgcttttgggggtcatgtgcctatccctgaaccaaccattgttgcccagggatgctctgattgtccaggctctagagttagtgacagaggcagcttctctaaaatttggggaaaaggggagtccgctaaggaaaatctgggtgctttcattccaaaaaagggggcctagaacctgcatagtcaataacaacagatgtcttctataggtgccctgttccattcctgcctccacattctgtcagcttcctcctctccccacacctgatcagaatgtaccagccaccagccctgtgtcgcattaggcctaccctctgctggccctactcagtgctaatgctgtagtaagcactattttttgtttttttgagacagagtttcactgttgttgcccaggctggagtgcaatggtgcaatctcagctcaccacaacctctgcctcctggattcaagctattctcctgcctcagcctcccaagtagctgggattacaggcatgtaccatcacgcccagctaattttgtacttttagtagagacggggtttctccgtgttggtcaggctggtcttgaactcctgacctcaggtgatccacccacctcggccccgcaaagtgctgggattataggtatgagccaccgtgcccagccagcactgttttaataccagtgggatgaacgccttcaaaggggacttttttctttttgagatagggtctcactctgccacccaggctggagtgtagtggtgcactcacagctcactgcagccttgaccttctgggctcaagcaatcctcccacctcagcctccctagtagctggaactataggcatgcatcaccatgcctggctaatttttgtattttttgtagagataaggtttcactttgttgcccaggctggtctcgaactccaaggatcaagccattctcccaccttggcctcccaaagtgacaaaggggacttttaagaggcacagaagctcaatgtgatatcaaaaatgcacactttcagatggtgtggcatcagggctgatggtggggatcagggctttaggtatggttacctttcctgtttacccacatctagggccagacctccccacaccctgtggtgcttggagcatgatcctacccaggacagtcaggcagcaacagataacagcagagtgggctgccgagcccctcagagccaggctttctgagccctgcaaaggaaaacattcctggaatatgaaaaacaacccagtaatcttccttcaaattcatgaaacactgggaaattcccttttcactggggccagaggaacttaggtgtacctgagctgtaaagatgtttagtcttagttaacattgtctgaggcaatggaggcaagaacttgaaggacacttacctagtcttccttcaacctacctctagcatgaggatctgagggtcttaagtgaccacaagcaaacaaaagccagtggtttgttttgttttgttttgtttctgagacggaatctctgtcgcccaggctggagtgcagtggtatgatctcagctcactgcaacctccacctcccaggtttgagtgattctcgtgcctcagcctcccaggtagctggtattacaggcatgcaccatcatacccagctatgttttgtatttttagtagagacggggtttcaccatgttggccaggctggtctcaaactcctggccttaagtaatctaccccctcggcctcccaaagtattgggattacaggaatgagccactgcacccagcccaatggtatttttcaaaggccaaaaatcccagacattctaaatctgcactgataaaagagcagaagtagaatctgggccccagtctccttacccccatgtaaaatgagagcatactcagacatctgtgtgggtgggagggtgggtagaaagttgctgagcagaagtgacaccccggtgggtgatactgtgggctgatctagaatgcctggccttaggaggataatctaaataggacatagtggtctttggtggggagatgagtcactctccaacccccaggtggcagcgggaagtcacactgatagggacatggcaggaaatcttctttgggaaaaacctgggacattccttcagttgcccagcttgtgatttcctggggagcctgactgctctctgtacagatagagtggaaggatttaggcccaagggagtgtcagggtgggggtgcaaaggagagaaaggccccaggctttgatgctgtcttaaggagccaaaggtgagtgtttcagagtcatcatgatcatgtttctttttgttttaggagcatttctggagtattgaccaaacggaatttcgaatcccacccaggctgatcattcagatatgggacaatgacaagttttctctggatgactacttgggtagggcttacatttggatcattgtttctaagaaactgtacttggaattagtggggtcaatgaaaacttggaagcaattctttaaatcttcaatactttttggtaatgggggcctggtggggggacaggggatacacccagtgcttgtgtgagctcttggcagtgcagcctgacagtgagtgccatcccttttcaagggctctggtgagggtcttgcaccagctcctgtctgtctgtgaagactcaagtcctgtttctgcagggggatgccacactcctacatccactttcaaaccagccactctctcctcagcacctgggaatcagctcctaccctcctcaacctgttcccaagttaccaaggtccccaacccccccgccatttctcctgtccctaggcccattctcctctgtggtaagggcactagttcaatgcacccttagcccgggcccttccctctcctggcacactcctccctcgccccccatggcactgtgctctccagattttcactctcccaggctctggtcttgtcacattagccagctctgtttctgcatcccactctatttttttatttttttatttttggagacaggtctctctgttacccaggctggagtgcagtggcacgatcatagctcactgcaacctcaacctcctgggttcgagaaatccttccacctcagcctcccgagtagctgggactacaggcatacgaaacctggctaattttttttttttttcactttttagtacagacgaggtctcactatgttgcccaggctggccttgaacccctgagctcaagcaatccttgcacctcagcctctcaaagtgccaggattacaagcataagccacagcgcccagcctcccactttttgaatacaggccttccctgaggttcttctgctctcctccaacccgccaaccaccccctccaaggatttacccactctcacctcagtggaaggtcatgcttcaactctcacctttccacaaagtatggctcctaaaccaggacgtgtagcctgcgctctcatagtgcctgcagtacagtcaaaggaaatcgttgtgagggtcattcctgattcctggccagaacctcccacctttatatctggctggcagtgagcctgtactgtgactgaaatctcactcagcatttcttccctgacctcacccctgctctcctcaggaacttatttagcagctcacaacccctccatttccccagccacccaggcgaaagcacccggagtcctctgtggttttcctcctctcttttctccccacgccccgccagccactccattctagcaatgtcatctgttttatcacgcacacttattttcttagtcctgtgatctctgccacttgccagttgaaactcactttctgctagccacatgttacagtagcccctgactggtctccctgtttccacgctgcttccaggggtccctcctggcagaggaaacacccaccaaaggctgtgtcttatttatcccttttccccgcacagtacctaatgcaatggttttgactaagtgcttagttaagaggtcagcaaataaatgagtatgcaagtaggcttacataaagtatatggatagtaaattctaggataataaagggtttgcccttggctttgtttgttgagacagagtctcactctctcacccaggctggagtgcagtggcatgatctaggatcactgcaacctccacctcctgggctcaggcgatcctcccaacctcagcctcccaagtagctgggaccacagacacgtgccaccaagcctggataattttgtgtatgttttgtagagacagggttttgccatgttgcccaagctggtctcaaattcctgagctcaagtaatctgcccacctcggcctcccaatattgctgggattacaggcatgagccaccatgcctggccttcccttggaatttaaacaaaactatcagacaacaaataaagagaatgactgtgtctcaaaatgccaagtgagcacataaccaaaaggagaggggagacaaaagcagtcataggtcaagaaaggctaaggtcacgtgtcttatgggtccactatatgctgaagggtagtccctgagcctgacagtttaaagagaaaatgccacaacctccttgttgctctttgctgccactgctgaaggccagactcttgccccagtcatccatagacttgaccccacatcacagataccattttcttaaggaaagggctcacaggagttcccaagcccaaaacacacttttcccttaccgtggaagtggtactaaagagttaatgtggccgggcacagtgggtcatgcctgtaatcccagaactttgggaggccaaggtgggtggatcacatgaggtcaggagttcaagaccagcctggccaacatggcaaaaccctgtctccactaaaaatacaaaaattagccgggcattgtggtgcacacctgtagtcccagctactagggaggctgaggcatgagaatcgcttgaacccagtaggcggaggttgcagtgagctgagatcacatcactgtactccagcctgggttatagagagagactcagtctcaaaaagagtgaatgccttacatcatagaagggacaatgtgcttctccagacactctgattgaggctaggagtctcagttcctggtgagcgttttctgttgagtcatgttccttctcaagcttctgtttctgaggttttactaggagagtcttggacatgcacatttcatgcagcatcctgtgttggttttctgttttgttttttttgagacagaatctcgctctgctgcccaggctggagaacaatggtgcgatctctgctcactgcaacctctgcctcctgggctcacgcgattcttgtgcctcagcctcttgagtagctgggattacggatgtgtgccatcgtgcccggctaatttttatatttttagtagagacggggtttcaccatgttggccaggctggtcttgaactcctgacctcaagtgatctgcccacctcagcctcccaaagtgctaggattacagccgtgagccactttgcccagccagcatcctgtgttctaagcacctattgtctttacccaaagccaaatgacctctctgctcagggcagctcagaactaaaaggaaaacatttcacatccaagggccttgagttgagtgaaaattgtgtctgtagatatttcattactttgagtttaaagaactctgtttatgctcatatctttgagaaagaaaacaggagatgctgtgcagtggacggctatttcttcggccattttccttcctaactggaaagactttaaatgtccaccaggctccctttctctaactcaccatttacctgttcaaaatcactgtgtgcctctctcctgataagaacgttctgttcacttgtgaacaacagctgatccacttgaagctcatttggacttactgttgtttccttggctaggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgtatgaacatttcctggttctggttgaaaatcgtttatgccttttatcatttaggttttgccctttatccatagacttactccagataaaatgaggaagttttaaattggtgggagtttaagttatgggaacagtttgtctttgggatatgtttgcctttgtcttacaatataaggtgggagatgctgtgagcatgtgtttggagttggaggaaggtgaagaagttggaatggtcaaaaagtagaagcccaggtggtttcactatattttcctttcttcttcatcagggaagttaattaatgctaggcttctagtacaatttcgtatggaaaagggaacttcacatttgaatttttctcattaaaaaaaaaaggtagggctgggtgtggtggctcatgcctgtaatccaaggcaggtggattacctgaggtcaggagttcgagaccagcctggccaacgtggcaaaacaccgtctctactaaaaatacaaaaacaacaacaacaaaaatagccagtagtggtggtgcacacctgtagtcccagacacttaggaggctgaggcacgagaatcacttggacccaggaggcataggttgcagtgagccaagatcgtgccactgtactccagcctgggtgacagagtgagactctgcctcaaaaaaaataaaaaagaaaaaaaagagaggtggaagaagcaaggtgtgctggcattagttgaataagaaggccataaattacaagcaagttgaggaactcaagatgtattttgatctagaagcaatagtgtgggttaccatgccatatcacgaaagactacctagttcattatgcattattaaaaatagctaacatttttgatcattaattttgaaccaggcagcatgccaagtaccttacattcataatctttttaaaaacaaccttggtgtataatttacataaactgtattcatttaaagtacacaatttgatgacttttgacagatgtagacactcactgaaccataatcaagatccagaaccttcccatcacccccaaaatttccttgtgctctctctctgcagtccattgctccctccctccctggtcccaggaaaccactgacctgctttccgttacaatacagcagtttgcacataacctcacttagttctgctgacaacgccatgaagtagacattgtccccactttagcgattccaaaaacagtcttggagagatggagcaacttgccaaagtcagaaacccagctttgtctgacttgtaagggtagaggtcatcagggctctactcagggccagggcttcccaaattgttggtgaccttgctgcctttcctggctcttagaaagtctgttacaaagtctgttacaatcttaggtatggctcactataaaagtgggcaggtttgttgcttttttttttttttttagagatgaagtctcactctgtcacccaggctggagtgcagtggtgcgatctctgcttactgcaacctctgcctcccaagtagctgggactacaggcgcacgccaccatgctggctaatttttttttttttttttgtatttttagtagagatggggtttcgccatgttggccaggctggtcttgaactcctgacctcaggtgatcctcccgcctcagcctcccaaagcactgggattacaggcataagccactgcgcccagccaaaagtgggcaagtttctagaccactttcactttggcctcactgttctcatttgcacatgaggacaataatagtacctttgtagggttgccatgagcattacatgagataacccatgtagaacatttaaacggtgctgggaacatcactcaggaacccgtgagcagggagaaaacattcattcactcactcattcattcatttattgagctagtgtacatggagtacctactgaatgccagccactgtgcacagtaggtgacaatgattgataggcatgaagagatatggctctgttctcttactgggagcctacaataatgctcaataaatgttagatattgttattagtggtattcaggttagtctgggtccaagtgaagttacataggaaggtgtgtggggagacaaggagaccaatgtgagaatgttagagtgagggggatacagaaaatgaaaagtagggagtgggggaagcaatttgtcctcaaagtttcccacacagagtcagttcagaaacacatggaagaggaaatgggatgaaatctcttgaggaaaactgaaggcaatctaaggattgttttacaagaataaaaatcattgctcggggaatactccttgggttgaagtaaaaatatttgtgaaacatgatgtcatatgtttaacctgctctgctttactgaaggggaaagtggagatgacattggaaatcctcaacgagaaggaggccgacgagaggccagccgggaaggggcgggacgaacccaacatgaaccccaagctggacttaccaaagtgagaggccttctttgttctcccactccccaaacacctgcaggctgagagccccccttcccattggcttaatgggatggattagcttttgtggtcctcctaatctggtatttaatagtggtgggtgggggtggagaggttggtgatctggcttcattttaagaattctcctttccaggaaaccaaagttcagcatcttaggaagctgtcgtaggttaaagagcctttctcagtcaacgaaggggaacagtattttttcttgaccttattaatgtgattctttattcctgaaactgtgttatgctctggaataaaatatgcatccctcctgagttgggtaggtgatactgtttctttgcaatgcagtcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccggtaggagcccttccttggccccttgtcttggctttcttgtgagttgcagttggtcctctcccttggcatctgccctgaccactgtgcagaagaatgacccgctcagcagcatggggttgtaacccttctgctttggggaaatttaaagtaatgtgtcttgtaattagaatcacattctcagggtttcacaaattacgggcagaacttttctttatgatctgaaaataactttggtttcaggaattctaggagaaatcactcaggtctcggtcagtgtgtgtctggactatggccagcgtttccagctgatcttcctgccttcagactttcttgttccaaaccatcctgcatcctaattccttgtcctagcttcaagaatccccaaatctgggttcattgtgggtctacatataccttgtgttccacccaaactagatcattgatcccaacctccccaaatattattgcccttacctatctggatgcctttgccaattttgtttctctgtccacatttatctatcaaaacctcactcattttttaaggctcatgtcacgtataacctcccccttaaatgttcccctaatcaccccagtcataaacgggagtccaagtgggagatttggcagcttgcctagaagtagtacctcccttcctccatccagaggatgtattgcgcatctacgacaggctaggaattaagttatagtgatgattaaattattggcatgatttgtgcccaagagcagttcatattctgggaacaggcagccacgggaacaaggacacatgactaagggaggtgagctgttatggagacagaaacaaacaaccgtgggcaccccctgctaagacagttcctccaaggaggggacattcaagtttgccaagtggagaagggatagtccaggcagaggaagccatgctcagaagttgggccagtggcactgaatgtcacaggagacattcaaaagctcttactccaaaaacacattaataataatatcagctgggcgaggtggctcatgcctgtaatcctggcactttgggaggccgaggcgggtgaatcacttgaggtcaggagttcaagactagcctggccaacatagcgaaaccccgtctctactaaaaatacaaaaattagttgggtgtggtggcacatgcctgtaatcccagctactagggatgctaagataggataattgcttgaacctgggaggcggaggttgcagtgagctgagaccacaccactgcactccaacctggatgaagaagtgagactctgtctcaaaaaaatagtatcgtagccatacaagcagcaggggttttgtgtcttcatttttccccagtatagtacttctagtttgtcatctatgagtatatgtacactattatacagtcgtagctggtcaaactgcttttttttttttttttgagacagagtctcactctatcacccaggctggagtacagtggcacgatctcggctcactgcaacctccgcctcccaggttcaagcatttctcatgcctcagcctcccgagtagctgggattacaggtgcctgccaccacaccctgccaatttttgtatttttagtagagactgggtttcaccatgttggccaggctggtctcgaactcctgacctcaagtgatccacccacctcagcctcccaacgtgctaggattataggtgtgaaccaccacattcggtcccagtccaactgtcttgaccatttaaaaaacttctattttttttattttttattttttttgagatggggttttgctctgtcacccaggctggagtacagtggcgcaatcttggctcactgcaacctctgcctcacaggttcaagcgattctccagcctcagcctcccaagtagctgggattacaggcacccaccaccatgcccggctaatttttttatttttagtagagacggggtttcaccatgttggccaggctggtctccaactcctgacctcatgtgatctgcctgccttagcctcccaaagtgctgggattacaggtgtgagccactgcacccggtctagttaattctttttcctgatttagattctgttggcagccgggtacagtggctcacacctataatcccagcactttgggaggctgaggcgggcggatcacctgaggtcaggagtttgagaccagcctgaccaacatggtgaaaccctgtctctactaaaaatttaaaaattagcagagcgtgttggtgggcgcctgtaatcccagctacttgggaggctgaggctggagaatcacttgaacctgcgaggcaaaggttgcagtgactggagatcacgccactgcactccaccctgggtgacaagtgcaaaactccgtctcaaaaaaaaaaaaaaaattctattggtttaaaccagtggttactgcagggcgtggtggctcacgcctgtaatcccaccatgtttggaggccgaggcaggcggatcacgaggtcaggagacagagtccatcctggctaacacagtgaaaccccatctctactaagaatataaaaaattagctgggcatggtggcaggcgcctgtagtcccagctgctctggaggctgaggcaggagaatggcatggcgtgaacctgggaggcggaggttgcagtgagccgagatcgcgccactgcactccagcctaggcgacagagcaagactccatctcaaaaaaaaaataaaaataaaaataaaccagtggttcccaattaggggagatttttgctccccacccccaagaggacatttgccaacgtctggagacattttggttgcaacaacttggcgggggggtgctactggcactcggtgggtagaggccagtgaaagctgctgaacatcctacaatgcacaggacactccccaacaagaaagaatcatctggttcaaaatgtcaattttttctcaagattgagaaaccctaactgaaaaacatatatacatacatgtttttttaccactgtttttgtttcctttccagaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 37564 - DNA, 70429 bp, Homo sapiens; identical to SEQ ID NO: 36515

SEQ ID NO: 37565 - DNA, 205998 bp, Homo sapiens
gacaacaacagggggacacaaaatggcggcggcttagctcctacccctggcggcggcggcagcggtggcggaggcgacggcacctcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggctctagggcaagggggcggggctcgagggcggaggggggcggggcgggatcgggtgggggcggggttcggggagtcggaaggcgggggctgagagggaatttctgagtgggagtgaactggtaggagcggtggggggccggcgagggtgtgaggaagactagtgagggttgggtgggaggagaagctgaaggtgtagaagcaggtgcagagggagagttagggagggatgcaatttgagagaagtggaaggcggaccgaggggtgtgtgagggcaggtgagatgataccgaaggcgagattgcagttgtctgggcgcagagtaggtgggtttgggtgtggtggatgtggagtagagttgaagcggtgcagagtgttgggtttggggaggcgttgaggggtttggggaggcattgaggcgcatgtgaggagcaggtacgattgcagtgatgggaaagaggtatctgggtggatcgcatgttggaataagaaggaggtttgctagctttggggtatgaagtattttttaaaaacgtggaaggatgggatggttgtgcttgggagagtttctgaaagatgatgctaagacagcagagcaaacttaaatatgaaggaaggggagagaggctgcttagaacttgcaaaatctgtggcagaaaatctcctggggacaagggattggtaggggtgggacaaggcggcaggtgtgaagaaagtgggtggagctgtacagtaattttcggtgaatgtgatttggtggactgtgccaggggtgaggatggggcagagaaaggtgttagtttgggagacaagttgtttgataggctgtatttattattttttataaaaatgagaaaagggtctcactatgttgcccaggctggtctcgaactcctggcctcaagtgatctgcccacctctgcctgactgatgggattacagacgtgagctatggcgacccgtgatacgctggattcattatgttaaacttgatctggagtcttcaagggagtgtccggcagcagggtatcccaggaagagacatgcaccataccttgggataggacattttgcatagctttgaatttgctagtactttgctgtgggcagagtgcagggagtggtaggagatgaccaggcaaaggcagaggaggggttagattacaaatggtgtcctatgccccatgaaggagtttaagccctgtaattggtagaaggtgttgggacgtgttaaagagagtgttagacagaagttgtgaaggggtagtgataaagaattacagatgtgggaaataggaaatgaagaccaacgaaccaagtatgtttggggttggaggtaccaaggaaattcagggtagagcatatgagggcccctcctatatggacagaaggtggaaatagcaaatggaaattagttgtgttcgaacagtcttagttctatggggccccaagaaggttttttgtgtttttttttttttaaagtgcattcttcctgtcttacttgtataccctagattttttggcatagccttgaaataaaacactccatttttttcttactcataagttctttttttttttttttttttttttgagacggagtctcagtctgtcgcccaggctggagtgcagtggcgccatctcggctcactgcaagctccgcctcccgggttcacgccattgtcctgcctcagcctccggagtagctgggactacaggcgcctgccaccacgccccgctaattttttgtatatttagtagagacggggtttcaccgtgttagccaggatggtctcgaactcttgaccttgtgatctgcccgcctcggcctcccaaagtgctgggattacaggcgtgagccaccgcgcccggccattcataagttctttacacatttatcagaatgaatttggacagtattttatgtttttaagaaggaaaggataatgcacatgttttttcttttccgagaacttctactgagagttaaaggttggagtggtgaagtgatggtttaaaaaaaaaaaaaaagaaaagaaaagagagagacagaggaagattttaacattaaaagaggaatttagggaatggctgatggtcatgacacggtcggcagaggaagttttgcttactagccacacttaggcttctgagtagagtggatattatgtcattgctattatagcatgtgtttatttcacacactgcttttgaagattgggtggaaactgtcagatgtgaggcatagcatgaatgaaaggtaaatagcatgagtattagaaagtagatgaggaagtttaataattttaatgtgcttcataagctctcatggactttcacgtatcaattagtaaaagacgtaactaagtgatctggctttcagtctcctagttctctacagtgtaccctcagttttccacgtgcttacacatgcctacatttgtactgagagaaaaggaaatagttttttttttttttttgagacagtcttgctctgttgcccaggctggagtgcagtggcacgatctcggctcactgcaacctccacctcctggattcaggtgattctcctgcctcagcttcccgggtagctaggattacagacatgtgcccagctaatttttgtatttttagtagaggtggggtttcgccatgttggccaggctggtctcaaactcctgacctcaggtgatccactcacctcggcctcccagagtgctgggattaaataaatagttttatgtggctgggtgtggtggctcacgcctgtaatcccagcactttgggaggccgaggtggatggatcacgaggtcaagaaatcaagaccatcctggccaacatggtgaaaccccatctctactaaaaatacaaaaaattagctgggcatggtggcgggcgcctgtagtcccagctgctcaggaggttgaggcaggcgaatcacttgaacctgggaggcggaggttgcagtgagctgagattgcaccactgcactccagcctggcgacagagcgagactctgtctcaaaaaaaaaaaaacaaaaaaaaaagaaaaatattttatgtaagtagggatgtgtaagctgtagtgatcagtctttgttgcagaatggtaaatgatgcgtggatgagagaagtggggtgatgggatatttcttccctttaatgccttaatttgcatttccaaagcacctttaagcatctttttatagaactcccatgatcttctgatacctgtcttctcgcagaccccagaaagagaatacaccaattttcgtatcatctattccattgttgccgaatatttgagttgtttcaagtttggggcaattgtgaacaaagctgctatgagcattcctatacctgtcatctggtgcccatgtgcacaagtttctctaaggtatacacctaggaatgaaattgccggtttatagctagggtgaccatttgtcctggtttttgcttattttcccagcgtaactgtaacacttttagttttcaaaagtatctagggttagatgatgaattgtatggtcacctagtcataaggtatgcttgtcttcatctttactaagtaccaaactcttctaaagtattgtaccaggttacactccctccagcaatatatgaattcccttgcttctcgccctctccaatctcagcctttttagcttttatgattttagccaatatggtaaattttgcgtttacctgattagtaatcagattgcacagctcttcatatatatatatatatatatatatatatatatatatattttttttttttttttttttttttttttttttttttgagacggagttttgcttttgtcacccaggctggagtgcagtggcgtgatcttggctcactgcaacctctgcttcctgggttcaagcgattctcctgcctcagcctcctgagtagctgggattacaggtgcccactaccacaaccagctaattttttgtatttttagtagagatggggttttgccatgttgggcaggcttgtttcaaactcctgatctcagttgacccgcccgtcttggcctcccaaagtgctgggattacaggcgtgagcctctgcacccggccagctcttcatatacttttttagccatttagatagcctcatttataaagttctgttcaagtctttcccaccctgcttttaaaagttgggccttgtatcttttattgctatttagaagttctttatttactgtgaatacaagtcctttgtcatgtgtgtgtgttgcaaatactgtggcttgccttttcactctctttatggtgtcttttaatgaacagaagttcttaattttaatggagtcaaatttattggtctttactttatggttagtgccttttgtgtcttgttttaagacttttcctaccctgaggtcaataagatattctcctatgcagtactatctttttaaagctttgttgaccttaaacaatgtataactatgagtaaaatacactcttcttgaccccagcctcaccattacaatctatttttgctttccttcacttttttctgttctctgtcttgaatttttacttctctgcagctataactaagagccaggtgctgacttctcctgtctcttaggagaaaatggtcatatagacagaagttcagccagattagattttacaggtctccagctgactgtattgccctttttccttttatgagctagcattttattgtgttcctgctatgtgtctgccatcatccttgctgctttcatatttgttatctcagtgattcctcttaacggttctgtaaaacagagaagtattctcatttttacagaagagaaaacagagacttagattgatttagtagcatgtccaatatcccctagcctaggtagctagcagaatggggactggatccctgactctgatacttcccatcacagcacacctacttgttgattaaaatgtcagaaacctgttttttgataacatccaaaaccaaaaagaataactttcttactcttgatgtaacatgccttaagtaaagcacacaaagctaactattgtgaaactggataaaatacctctctgtatatagccagtggaccttaagtggtccatggctggatgacagaaggtctgttaacccttaaaaatgtataccagtgtatatgggtacatgtgcttattttttagagtagagctataatatttatgaaactctcaaaagggaacctgaatttttcagggtatctggatatctggtctgaagacatctgtaatacagttaacaaagaatcctgtaataatctctctttcaaaagaatcataaaaaagttaagatgtcagatttttctcagccaggtgcagtggctcatgcctgtaatcccactactttgggaggctacagtgaaaggatcccttgagccctggagttcaagacatgcctgggcaacatagggagacccccgcctctatttttatttatttatttagattttttggtatcttcattttatcttatttattttgttgagatagagttttgctcttgttgcccaggctggagtgcaatggcgtaatcttggctcactgcaacctccacctcctgggttcaagcaattttcctgcctcagcctcccaaagagctgggattacaggcatgcgccaccacgcctgctaattttttgtatttagtagagatggggtttcaccatgttggccgggctggtctcaaactcctgacctcaggtgatccacctgccttggcctgtcgaagtgctgggattataggcataagccaccaagcctggccttgtatctctattttaaaaagttttttaaaaatcacattttttggccgggcatgatggctcatgcctgtaatcccagcactttgggaggctcaggcagctggatcacaaggtcaggagctcgagaccagcctggccaacatggtaaaaccccgtctctactaaaaataaaaacaacaacaacaaacaaacaatggcatggtggcatgtgcctgtaatcccagctactcagaaggctggggcaggagagtcgtttgaacccgggaggcggaggttgcagtgagccgagatcacgccattgcactccagcctgggcaacagggcaagactctgtctcaaaaaaaaaaaaaaaaaaaaaaaaatcacattttttcccttaatacattattctcggtctttgtcatcaaaaaccaactaaagctaatttgtaattagggagaaatctaggattgaataggaatttttaaatgccaaaaaaagacactctaaatttagttgattatttcttaagtgaaagtgcttagttataatacatcattactaatcagtgtaccctggctccaaagacctgatgacttcaaatgacttttcatcttgtctctaaattcctctgttttacaagggatcaaatttcctgtgaggttcctaacagtgtgattaaattttagagactgaaactattgagcacttaaatgcagggataactatgcaaacctaattcatgggtttcaccaggagatttgggacctgtctctactaatttatgatgatgatgttgaaactaatctttgctagggattatggaaaccataatagtttattgatggttcagttattgtttgttgaagcacatttacacaattatagtttaatgacataacaaggatattgtcaactaggagagcatgacatgaaaaattaaacttgcaattaatataatatgtattagttgaaatgataatttttatggtgatttagcctcttagaaatccttggaaaacattattagcttatgaattgaaaactctctttgttaatgagtagtgggaaagaacttagtgttactctaaaaagatggggaattaaatattcagttcaaccagcgttttattgagtgcctgctctgggcttgctgctgagttaggctcataaatataagttgaacaagattgatgtttgcagagatgaaatactggttgcttttgttttttctttcaatcacccttccctccagagtagatggctactattgccagagtgattcaaacattcaacaggtttgtgtgtgtatgtgcatgcccttccctgtgcattatggtgtcacctgctcctgcagtggcttcctattcatctgtcacgttcacacaccacagcttggcttttttcacagccaactttatttctgttttttttttttttgagatggattctggctctgttgccaggctggagtgcagtggcgcgatctcggctcactgcatccaccacctccggggttcaagcaattcccctgcctcagccttccgagtagctgggaccacaggcatgcaccaccacgcctggctaattttttgtattttagtagagatggagtttcaccatgttggccaggatggtctcaatctcctgacctcgtgatctgcccgccttggcctcccaaagtgctaggattacaggtgtgagccactgtgcctggcctatttctgtttttcatttttaaattatatttgtcttttttagagacagagtcttgctctattgcctaggctggagagcagtggcacaatcatagcccactgtggcctcaacctcctgggcggctcaagagatcctcttgcctcggtctcccgagtagctgggtctacaggtgtacaccaccacagccacctaattttttatttttgtagaggtagggtcttgttgtgttgcctaggcttgtctcgagctcctggcctcaagtaatcctccttccttgacctcccaaagtgctgggattagaggcatgagccattgtgcctggcccaacttaatttctttatcccttttgagcatatacctgttctagtcaggcacatggacttggtgtcccttttgtttgacagctcattcttagcttctgttatttcactttgatttccttcattcattccccgatacatttatttagcaaataggcattgaaaccctcttatgatcaagttgtggtcttgggaaatcttagggtatacaaagatgaatcaagcatgaatcctgtttttaagaattttatagtctagtaggggtgacaaggttaatacacaagtaagcataatactaagtgggaaatgaatgtcaaaacagtaaaaaagctaaaagcttcctgttagacaaagatgtttggggcttttgagaagttgtttgcactgggccatgaaggatttgaatttgggcagagggacggtggggcacttatccaggctcagcattatctttcaaggttcagtttcagtcccatccatccaagagatgttcatccatcctccacgtggtttcagcaaggtagtatagtcacagttgtttccagacttcttccttctgtaatcagaggaacacttcctttaaagcgaatcttatggggaagacaaatatatgtaaaacagttaaagtggagctgcactgttgggttcaaggtgctgcaatggcccaaagtttaacccacaaggggtacctgaaggtaatacccgaagtaactccttgtcacagagatctaaagagcctagtttgaaaacctctggagagacagaaagagtttgggctttggcatctgaattaaaatccttcatgacttaatggctctgagatcttggctaagtcaagcctgttttccttttgtaaaaacaacaatgctaccttacagagttgttttaaagtttactgataatctatgtaaagtacctggaccacagtaggtgtcaggaaatggttggtattattattattattatagtttagtgctttgttatttctttttttttaaacaatttattgaggtgaaactcacataacataaaatgaaaaaaccattaaaaagtgaacaaatcagtggcatttagtacattcagtgttgtgtcaccactgccactatcaagttccaaaacatttttattgatcccaaataaaaccccttacccattaagcagtttctctagatatgtccctgagactccaccaatctgtgttttgtctatggatttatctattctggatgtctcatatgaatgaaattatatgatgtgtggccttttgtgtctggcttctttcacagcataacgtgtttgaggtccatctacattgtagtagcatgtatcgaaacttcattgctttttatagttgtatagtattctagtgtatggatataccacagtttatctgttcatctgttgatggacatttgggctgtttacaccttttggctactgtgaatagttttgttatgaacatgggtgtacgtgtacttatttgagtatctgttctcaattcttttgagtctatacctagaaatggaattacagaaccatatggtaattctgtgtttaactttttgaggaaccgccaaacagtgctttgctatttcttaattgcttcttatatgttctgtctctagctttgctttgtattccccatagtacctaccacagggctgcatgcagggagcatcagctcgctaaatatttgttggtttttctttgattagtatttataacctcacctcccagttcacatgttttgggcctgaagcattgatttcagaggaaatagatgcatccaggatttgaaagataagaaatatcaccatatggatggcgtttcatgttgtcagacaacagatatttgttaaccaaggacactattttgagcaactctgccaataacctgagctgggtgctgatagaagaaaaataagtcaaggtcccttcccctaaacagttctgttctgtttcggaagatactgcttagatttgtggatgctcactcagttacacaatgggctttgaaaaaatccaggttttccaacagtgatccctttggggaaaaaaaagaaagaaaaagccaggacttatgaaagtaaaatagttaaaaataactgttagcaagtaaaactcaggatgacaaaagtgtaaactctattattaatctttgtttttttctaccactgttttttgcctcatccataatctcatgacttgagtgttatgacattgattttgaaacaacacacacagctttagtaaaagcttagaggaggcctcgcataatacttatgatccaggatattttgactcttcttatgctgacatgaatatttctgaatagtgttgatgtttatgtaataccagtgaagctaaaagctcagtgctggactaagcatttctctagatatgtttagaatatttgtaatgaatgatgtaaatagtgttatattataagaccgtatgatacaaccatataatttactgatattttgtagttaaaaataaaatgattcacaaccttagaaaatagaataatttaatttgatgtagcacaaatccccagaattaatttaggatgatttgctacctttttgatagccttttagtccaaccttcaagtttttatagaaaaaaaatgaaaagagaataatgattttagggttttcgcttgtgatagaatgtcctatctacatgtgaagcaaatccccatgctctgaaaaagagaaatagtgtggataattccaaatcaggaaaaaaaaaatcatttctatttggcttttgaatgaattatgcatttttttttcctgtggatttgtctttccagttagatactgcttaggctaaaatgaaattggttttcaatctattctcttgcttatatgaatttacagtggggccagtgggatgttggaaacaaatcagcctaagattaaaaaatttgcggtggataatatacaaagtggataatatacatgtgtttagttgagaattggctacagataagagacttctgattttgttcctctcctagctgtgtattttttttttttttttgaacactgtgattctgcttgtagcaaagagctgctgagttacatctgcttctgcctaattaactctgttggttggtgtcagatgagagctaattttgagattaaatcgaggagtggggtgtgtgtcgtggctgggggaggggagaaggaggatccaaggttgcttgattgttttacgtaagatcaaaatgcagttattcacaattgttcttttaaatttattttttgcttttcaagtaaaaataatcactgctgtcctaaaatgtgacttgtgtcaatacatatttactattatgtaaactggtacgtttttcttgtaggtgagcttattggtcatatctgggtagtccattcagtacctaggtgcctggtggcctttgggacaaacagcgaatgctgcccaggaatgtgaatgctgaccttaaaacaacttttgactgtctttttttctgataaatgttatatctgtttggctatttgagtagtagtgggtttttgtttttgttttgtttttccatgatgagattttttcttaggaatctatcacaaacctgatttttaaaatttgaacaggtctgggcttagggatgaaatttacttctataggcacttggctgggtccttggggcttcattttctgtctcaagtttcatatttataagaatccttcagtggtctaaaagaattattatatcaccaaatgtagtataataactcattggagctgtttgtcttgaatggttgtggagatacacggatggttgctgaatttaaggatgtccttatgtccaaatgaacatttccttttttcttttggcagatttgcctgaagacctggataatctccatttttgtcatggactgttaaaacgtttgaagttccaattctggtactttcccttattttattacatttttaaggtataaaatgacaatcttattgaaatgtgttggtaatggatataaacaattgttttatggatataaatgattgtgggtaaagatttgtgggctgggtgcagtggctcacgcctgtaatcccagcactttgggaggccgaagtgggcggatcacgagatcaggagtttgagtccagcctggccaacatggcaaaaccctgtctctactaaaaattcaaaaattagctgggcgtggtggtgggcacctgtaatcccagctacttgggaggctgaggcaggagaattgcttgaatctgggcggtggagattgcagtgagccgagatcatgccattgcactccagcctgggcgacaagagcaagactctgtgccccccaaaaaaaaaaaaatgattgtggtaaaagcttgtcatgaaggtatattttaggtatctattagttatgaaacacattttttttttttttttgagatggagtttcgctcttgttgccgaggctggagtacaatggcgcaatctcgactcactgcaacctctgcctcctgggttcaagcgattctcctgccttagcctcctgagtagctgggattacaggcgcatgccaccatgcttggctaattttttgtatttttagtagagacggggtttcaccatgttggccaggctggtcttgaactcctgaccttgggtgatccacccgccttggcctcccaaagtgctgggattacgggtgtgagccaccacgcccggctatgcattttgttttaatgtacgttcgtttgcttgtgtaacaaaacacctaaaagcaacttggcaatattgggcacttttcctgtgacctcttctactttctgcagttgtattttgtgcaatcaaattaaattagttgtgattcatcctgaataaatgatgaaagattaaataattacttggatacagtgaaatatcttctaatgaaattttgcccgaaaccattttacttgggaaagatcaatttcctgttctaaactaactgacagagaatgattctgtgttctatcctgaaagtggttgcactgtgaaagccagtgatttcattcctaaacacactgtgttccaagtctaacatttttgtcaagggtttatataatgaaacaaaagtgagtacttattagatttgtagatgacatagatgacagaatcaagattcaaaacaatctttagcaggttggaagataggcttaaatcaacgagatgaaattgaacggtaataaacgttaaattgcagcatttcaatttgcagaaggaaaggggtggaaagactcaacttgacagcactttttgaaaaaagatctgggatttttagttggactgcatgctcaccatgaccacttgtgtggcaggggtattgaggaagttcctgtaatttgggttgcatttataattggataatgcctgaactgtcatattttaagatggccaatagccaaactagtgagcaaccaagagaaagtggtgctttgaaacaatgtgatatgtggaagggttaagaaactgggatatgagtggtctaagttatggctggaggtagcatggggttttgtcgttagtggttttcaaaaggtacttgtttttggacatttgaaggcctctcatactgaagaaatactaagaattgtcttgggatccttccagggaataggactagttaggaataggaatagggtcgaagttatggggtggcagatttttgcttctctgagcaagaaatttagctagagctgtgcaacagtggggtgagctgcctcaaaaagtgacaaattatcaatcactggaagtattttaaaaatgtaaagactcattgcccatctatttgggatattgggcagggatcttttattggataactagaggttggactggatgaccttcagccccaagtttctgaatctgaggggagaatgagtagagtgaatttacagcttactgatcacagggacaatcttgtttaaattgcctcctttaaggtggcattttgggttggcatttaaaactgtactgtttgaacaagtatagttcaatgacccagctgtttttcagcaacattccaggatctctgagagcaaatactatattcttcagtatgtctggctaaagtttttaaggaaagatattattttcttctcttaggtatagtctgtctaaataaataaccagagataactttaattttgtattttgttataaaaatttcaaagtatatagatgttgcatttgatgaaagtgataactatatattgaatattagataatgtgtttatttaatcctctcagtagtcctgtaagggatataccagtattgcctacaagtaaagtgatggaagcttaagttatccagggttcctccactggacattgtggtagggctggggttcagacccaggttggtctctttgcagaggcagaactagctagagcaggcagttgtggctcaggtgagaacagtgatggacttagttggattttagaattggctgggcacagtggcttacacctataatcctagcacttttgagaggccgaggtgggctgaggtcaggagtttgagaccagcctggccaaaatggcaaaactccatctctactaaaaatacaaacattagctgggtgtggtggcacattcctgtaatcccagccacttgggaggctgtgcaggagaatcgcttgaacccagaaggcagagattacagtgagctgagattgcgctattgcactccagcctgggtgacagagcgagactctatctcaaaaaaaaaaaattaataaaaaaaattaatgatgttcgaccctttaatctgttattgactcttcccttgggtgaattccatcttctcccgagcctcagtttacccacaaagttctgcagtttaagtgacaagttatatgtgagcacactctgtacagtttaaactataaaaagaattaagaagtggatgttatcattggacaccaagattagagctcaggtttggcccaattcccaggccaaggctctttctccttgtagcctctttgtagatgtactcaataccagattggagatctagggtggtttttgtatataccaagcatctctcagaacaaatgccactgtccacctggaatcagatttgtatatatcttctttgtactgagctgtttaatgagctaactgggtattaagataactagaatgctctactacttaaaggtgaagggttatgttactgtattattttcagttttccaatttgtgggttagagggtatcatagacctctgttaaagggatggggatgtgattccatagaagtagctagatgggaagtttttttacgtatgagacttgggaaatacaatacctagctgaaagctggattatttactcttttttttaagtttaagattttttgaaataagtttaatgtactttcatcagattttttatatcatagacttattctttgatgtgtattttatgtttatggcagacatatacctcaaaccactttcatataattttgttaatttcaataaatataattaaatgtataatttagatgtgattatgcctcataaatgacttcatatagagaagtgaaacattctaaaaacaatttcttctcagactgtgacccaatttcttgttgaaaaatatagtcactgtggctgtgttatgtaatacctgcctgtcattacttcttgtggtcattctgtgtctgaaaaagtcatgctaaagaatcttttagtttatttgtgtaagcttcattattaagagactttcccctctttttatcctttaaggtcttgatttcccagttaaagatgttcttcacccgaatgcagtctttcctgttggtaaaataagacaaccatcaacattgcctgtttgtctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctgctaccacacctggctaatttttgtatttttaatagagacaggacttcaccatcttggccaggctggtctcaagctcctgacctcaagtgatgcgcccgcctcggcctcccaaagcgctgggattagaggcgtgagccaccatgcccagctagacttcttattttaatggtgataatctatgcttttttttttgagatggagttttgctcttgttgcccaggctggagtgcagtggcacaatctcggctcactgcaacctctgcctcccgggttcaagtgattcttctgcctcagcctacctagtagctgggattacaggcacatgccaccatgcccagctaatttttgtatttttagtagagaccaggtttcaccatgttggccgggctagtctcgaactcctgacttcaggtgatccacccgctttggtctcccaaagtgttgggattacaggcgtgagacaccatgcctggctgataatctatgcatgtaagaagttattttaatacgtcacctaaatccctcatttcaataaaaagtcattttttattgtccacttctctgtgttgtaggtgaatgtttattttgtctcatacagtatctttttaaaatactctgatttcttgggccttatgttatttctatagtatttataaatatatggcagaattctccttacattactgctaccactttaagtttttggttgagtaagatttgtctttgtttcaaagctacagtatttacttcccaaactaaacacaaagtagagcagcagaaagttatttatagttcatgtctagttttggggtttattctctgtcttttgggtgagcagatatattgatatcagttaattttattaatacatgttataaaacattaatcattgttgatagaaaggtggttttggctgggcagggtggctcctgcctgtagtcccagcaccttgggaggccagggtgggaggatcacttgagcccaggagttcaagactagcctgggcaacatagtaagacccctgtctctacaaaaaaatcaaagaattagccaggcttggtgaagcacatgtgtagtcccagctacttgggaggctgaggtgggaggatcacttgagcatgggaggtagaggctgcagtgagccttgattgtactccagcctgggtgatagagtgagatcctgtcccaaagataaagaaaggaagaaagaaaaggtggttttggccaggcacagtggctcatgcctgtaatcccagcactttgggaggctgaggtgggccaattgcctgagtttgagaccagcctggccaacatggtgaaaccccatctctactaaatatacaaaaaaattaggcaggcgtggtggggggcacctgtagtcccagctatttgggaggctgaggcaggagaatcccttaaacccgggaggcagacgttgcagtgagctgagattgtgccactgcactccagcctgggtgacagagcgagactctgtctcaaaaaaaaaaaaaaaaacaaaaaaaaaaagaaggaaagaaatggtggttttattcatggtttactgcagccttgaccttttgggatcaagtgttcctcccaagtaactgggaatacaggtgtatgccaccatgcccagctaagtttttaaattttttgtagagatggggttttgccatgttgcctgggctaagtacagtttagaaacaattgaaacatgcatgttaggaaaagttatgctcctcttgtttggataccatgaacccttgaaatggaacctgttttcctcaatgctttagatcagatcagcccatggaaaggcaaaccacctggtcctacaaattggataggaccaggtggtttgcctttccatgggctgatctaaaaggctggagtgcagtggtgtcacctcggctcactgcaacctccacctcccgggttcaagtgatgctctcacctcagccacccgagcagctgggactacaggtgcacaccaccacgcccggctaatttttgtactttttgtaaagatgaggtttctcgatgttgcccaggctggtctcgatctcctgggctcaagacatccttccgcctcggcctcccaaggtgctgggattataggcatgagccactgtgcctggccaacatttatttgttaactatatttttattttgttagtcttctgccacatttatttgatccttaggtggttgttgtgtttgtgtaaccaacctctagttctctgtggcagaatgtgggcataaagaaagaagtaaagttatgaaattttcttcttaataacatttgtttaaaagaaaatacaaaaagccacttaaatcctaattcatatgtctgacacagccaaatcagggacctctgtttttaattaaatacatatgtatatatatatttttgttttgtttttttgttttttttgagatggagtcttgctctgtcaccaggctggagtacagtggcatgatcttggctcactgcagcctctgcctcccaggttcaagtgatttccttgccttaacttcccgagtagctgggactacaggagcgtgccaccatgcctggccaattttttgtattttagtagagacggggtttcaccatgttggccaggatggcctcaatctcctgacctcatggtccacctgccttagcctcccaaaatgctgggattacaggcgtgagccactgtgcccagccttaattaaatattttttataaaagcttatactgtgaagaaattccttaagggactatagagccatttcttgatggatttggatatctttgtttttaaaaatatgtacactaccctaaggtatgttaaggttttataatgaacaggtacgtggactaattcaggtagctttaggcaatttaatagtatgtttcaataattttgtgatccaggggatactttttacttgtgatggaagagtcagtacaaattttccacagtatcttctgatccttcgctttaaccttgcccgtcatttcttgccaaccttatcatatttttttcaggcagcatctgtacagaagtatttttagtctaaaggaaaattcatgtctgaaagtgtctaggattgagagcagagtaatttattgcttagcaggcaattgttactgctctttttatgatgctgatctttaaattgtttagttagcatcatgctataatgaggaaagctgagaaatgttttctagaatttttacttgatgaaatttggagactaattctattaagtaatcatttgattcttaaaaaacaaaaataaataaaaatcagtttaaacaaagttggcaacatgtttgtattctttaatgaaatagcatttttttccagctgggtgcagtggctcatgcctgtaatcccagcactttgggaggccgaggtgggtggatcacctgaggtcagcagttcaagaccagcctgaccaacatggagaaacctcgtctctattaaaaaaatacaaaagtagccgggcatggtggtgcatgcctgtaatcccagctgctggggaggctgaggcaggagaattgcttgaacttgggaggcagagattgcagtgagccgagattgcgccattgcattccagcctgggcaacaaaagcgaaactccatctcaaaaaaaaaaataaataaataaaatagcatttttccttaaaaaatgtgagaaaattacaacataatatattaccctttgaaattaaaagtgatttaatagtttaaaaccatgtaaactcgctaagtaaatttaatagaaattcttagcccgggatccacaaatgaacttgggtgggtatcccacaaatcctctgaaatagagtgtgaagtcatgtgtgtgtatccatgtttttctttttttttctttttctttttctttttttttttttttgagacatagtttcactcttgtcacccaggctggagtacaatggcacaatcatggcccactgcaacctctgtctcccaggttcaagtgactcttctgcctcagcctccctagtagctgggattacaggcgtgcgccaccatgcctggctaatttttgcattttcagtagagacggggtttcaccatgttggccaggctggtcttgaactcctgacctcaggtgatccacccacctcagcctcccaaagtgctgggattataggcatgagcctctgtgcctggcctccacatgtttttctatggctagggtctatagcaagcttgtccaacccatggcccatgggctagatgcggccctgaatggctttgaatgcagcccaacacaaattcgtaaactttcttaaaacataaagagatttttggcttgcggcgtggtggcacacgcctataatcccagctactcaggaggctgaggcacaagaattgtttgaacctgggaggcggaggttgcagttagctgagattgaggcactgcactccagcctgggcgacagagcaacacttcgtttcaacaacaacaacaagaacaacaacaacaacaacaacatttttttgtggtttttaatttttttttttttaagctcactagctattgttagtgtattttatatgtggccctagacaattcttcttccagtgtggcccagggaagccaaaagattggacactcctggtctacatcttttgtcaaaggcacccaaaatgcctagtagccattttaaaatagtttgagtttcttatactaaatcatagtatgctaattgtcgacctatgatgattcttcctttggctgctgaacttggattcatatgtagattgattgtactataatttcctatatataagactttttctaatatatttgaaaagattatcattgttcttgatgtgcttgaagtcataggatttgccttgcattgtgggaggaaatttatgatataagtgaaaacagttcagaaatggagtgatctcaattacaatctagtcaactaatgccttttttttgagacagagtgtcactgtgtcacccagtctggagtgcagtggcatgatcttggctccctgcaacctcagcatcccaggttcaaacaattcttgtgcctcagcctcccgagtagctgggattacaggtgtgtgccaccacactgggctaatttttgtattttagtagagatggggtttcattaatgttggccaggctggccttgaactcctggcctcaagtgatccgcctgccttggcctcccaaaatgctgggattatagacgtgagctactatgccccatgcctggcctaactaatgacttttttttttttgagatggaatctcactctgtcatccagactggagtacgctggtgccatctcagctcactgcaacctccgcctcccagttcaagtgattctcctgcatcagcctcccaagtagctgggattacaggcacgcaccaccaagcccggctaattttagtatttttagtagagacagggtttcaccatgttgaccaggctggtctcgaactcgtgatctcaagtgatccgcctgccttggcatctcaaagtgctaggtaggattacaggcttgtgagccaccgtgcctggccatgactttcaagaagctgtttattctggttacttttttgagcagttacattaaatgtaaaacaaaataaaaatagtaagaataataactaacgttttgtaagtgttaaatgctggcactattccaagtgctttacatttattatctccttgacttgtcacaataactgcaagggaggtagattattacccttattttacagatgaaaaaatgaggctgaaagcttaagtgatttgcccaaggtcactgatagagctagtgagtggtgaagccaagattctgacgagacagtctgacctcagagctctttaccactgggcagtacactggtcaacagtggtggctttttttttttttttgagacagagtctcgctctgtcgcccaggctggagtgcagtggcatgatctcgcctcactgcaagctccgccttccgggttcacgccattctcctgcctcagcctcctgagtagctgggactacaggcgcccaccaccacgcccggctaattttttgtatttttagtagagacggggtttcaccgtgttagccaggatggtctcaatctcctgacctcgtgatccacctgcctcggcctgtggtggctttttattaacagtaaaagtatctcttccagttcttcaaatgattagaagcagttttgccccaacaaatagatttccagcattttaaatttggtagatgcaatgagcttattatagtttttaaagtagatactatttataatattagcaatatggaaaggcagtagagaaagtagtaagtctgtgtctaattagattgaacatcatcatcattccgatgcatgactgctaggaggaatacaatgcaagttaaaatagaagggctccttcctttctgaaatgtaattgcacatcttctgatagtctggaattcaaattgggtattaccacactggcttcttagcataaattctttgtatttatttaagaaagctctcttcggtgaggtgatatggaaatgaattaaaccactgaagataaaactttatctttgacttggtgagggaactcctaaaggatagtattaatgtttctcattaaaagtagtaaagctcaattaggtcagattatgaggactttggaaagtcacatattctaagagagacttccattatcactgcgcactttgtagcattaagattccatttgaacatttgagctttagcatttttataaaatcagtttagttccatttaaaataaattccatagtatttcactttagtgagaatgtcttcataaaatttattaagtgtcaagtcttggtctgtttccagtgtagtacataatgtgggaattctcattctaggttggcatcgtaattggaaggtgggacactttcagtatcaagtagggcttctgatgttttttctgttgaagaaatatttgtattagaatcttacaaaaagccttcaaacataaacaaaattacaaaaacagtgatactgtcaataagaaaaaaatcaaaatgatttttttttttttggatacagagtcttgctctgttgcccaggccggagtgcagtggcgcaatctcggctcactgcagctgccgcctctcgggttcaagcgattctcctgcctcagcctcctgagtagttggggattacaggcatgtgccaccatgcccggctaatttttgtatttttagtagagacagggtttcaccatgttggtcaggctgataagaatgattttttttttttttttttggagatggagtcttgctatgttgccaggctggagtgcagtggcgcgatctcggctcactacaacctccgcctccctggttcaagcaattctcctgcctcagcctctggagtagctagactacagacgtgcaccaccacgcccagctaatttttgtatttttagtagaaacggggtttcaccatattggccaggatggtctcaatctcttgacctagtgatccacctgcctcggcctcccaaagtgctgggattacaggcatgagccactgtgtctggccacaaaatgatttttaaaaggagttcagatgatcagaaatggggttgaaagacaaacgtaggacccttgttatgtgtggtcttggcttattcagttgtttattctatttctcctgccccttttagagagatacgttgttagggtttttggcactgttattaatatgaaatatttctacaaatagaagataaatgtacatcctacagcagttgcttgagttgtttacacacatgaattagataagtttatttttagattttcttttcttctgttttctccattctgttttctcctcttcagtccccttaaccctgccctagagcagaccctcctcatctgttctgggacttttccaatagcctgtactttatgaaggactattcattagtccatattgttctttgatgtggcaggcttccagaagtctctcagccctaggggaattgttcatagtctcaggcaactctggatcttttttggcagaaatgtgtatattttttatctgctaattatagagcctgaatgtcctcctctctgttgaccttcttagttttcctttgaattggtatcctttgtgttgcagatgtcatctttcttgaagagtgcttgattatgtgtatttaactgaaaatcgaataaatctctaaatattgtaaaatatgctcttcaaaataacctgcattttggaattggtatggataaagtcagttttagaatcactaaagtcagacagaaacctattgtaatgtgaaagacgaggtggatcaaatacttgctgttccagggtcatggaaggaaaaaaattgcagttcatgttcttcttataattaagcttcagaagttcttcacaatagcagtgtctgaggactgcttttgtgagcaggtagtaccagttgttgagacattgttgagagagcacatgaattgtctcaaactagttagttgggtcaagggaaagataaaatgaagggtgaatgagtctttctattgtactctgaggcatgacagcgtgttccacttttgagcttttatcaagatgggacttgtctagacttctaatgaaatgggcttcaggtaaagtagaaacattatgtcaagaggatttttggttgttcaaatgaatgttaaacattcttttaactctttggatcttagatagatttgatagttgtgatacctttactgtatgtaacacatgatcctgtcctgaatgatcagcagctttcaggagttactcttgtattcccagctacatttgtgatactttcagtgctaagaaaatctatattctgtagctttgaagttatttaacagttaagtactatttgctggtttattctgattttgtcttaaatgacaaatattttattcatcctttctcttcaaacattatttaacaaatgtacgttttaatgtttctcaaaaatgaaggtctatattctttttatatgttttatctttgtatgttatttctttcatctttttttttttttttttttttctgagacagggtctcactctgttacccaggctggagtgcagtggtttgatcatggctcactgcagcctcgacctcccgggctcaagtgatccttgatcctcccacctcagcctcctgagtaactgggactacaggtgtgcaccaccttgtctggctaatttttttttttcttttttttgagacagtcttactctgttgcccaggctggagtgcagccgtgtaatcatggttcactgcagccttgaccttcccaggctcaaatgatccatcctcccacctcagccccccaagtagcttggactacaggcacacaccactacacccagctaatttttgtattttttgtagagatagggtttcgccacgttgcccaggctggtcttgaacgcctgagctcaagcagttcacacacctcggcctcccaaagtactggggttataggcgtgagccaccgtgctcagccttttatttttaatatataagaaatgccttttttttttttttttttttaatttgagatggagtcttgctgtcttgcccaggctggagtgtagtggcatggtctcggctcactgcaacctccgcctcccaggttaaagcaattctcctgtcttggcctcccgagtagctgggattacaggcatgtgccaccactcctggctaatttttttgtatttttagtagagacgggggtttcaccatattggccaggctggtctcgaactcctgaccttgtgatctgcccacctcggcctcccaaagtgctgggattagaggcatgccccaccacgcccagcccattgttttatcatgacagtagcaatgtgttttaattgtaaaattcttgactttttgttttgtttataaacttccttttcttggccctgtgccttaaactacagtagattaggtgaaactgttctctgatcacactagcatttaaaatatgaacctgaatcttctcaggtactttgatctctccaatctattaatgtttctgagtacataaacatcaattagctcaccaaattaaagttagcaaatgcgtcagccatgtaatttgcatgtgacattttgagttagcagggccaagagggaagtatgtttttgtgagtgggtgtgcttatctctctgtcttcaggtggtgatggaaagttgtacatgtaagagaaggagttgtggcagtggatatgtgaaatgctaactgtacatatgcctctgcttggggcagaagcactttaccagagaagtctccaacagttgcaaactacatattctttttccttatataagtgaatcttttaattagtgtaatattatgtagagtgtatgttttttctgtttttttttaatgaaaggtgatattttgataaatctgcaaaatgagcaatatagacaacattttagagtgaatgatactagatttaaactatgaggctggtctctgcaaagatacaaagtaaatactaatcactggtctaagcaaaatccaggaaggatttttgttaatttgacaagtgggtttagaattctttagccactattttttagaaaccagctttgttcatacatcctttctctaatttgcctcacttttgatctgtgataaaccagctgcaatttggtttcattaacaaacttaactggtcaacagatgttttggctctattttgtcctttctattagaaacagcataggcgtacacagaaaccatgctgggccttttcctgtctgtagctcgacaggcgttacagaagagcaacctaactttacttacaagttcaatttttcttcctcagtatttttattataggtatacaaacattgtagttttgtctcccccatcaagtcggtcttttgttgttaatcttccatctgttagtccagtatacacttctcaccctgctttttagcattgcaaaatcttagcatgcagggaaaaaggtactattgcaggagaggtaattgagatatcagcgactcttccacaattcaagggaaggagtggaactagcctggtgaatttagataatttcttccgtcttctttgatgtcagtgagctgccatatggagagcagtgaggcctgcaggaaggaggtgagccttggtctgggctgcctagggtgttcagagtgacatgggctgagagccagaggcagagcttgactgtttctgttagtagtttctgatgtgaccagccctgctttttgtccaaggtttccctgtcatgcttgccaccctatgggtatgatgaagtttaagaaacagatcataaacattatcttgggaaagagaaacataagaacatattaaaatctagtaataaggccattaaaagatgactcccatttgatatttgaccaacttgttttcaaaattagtattgtaaacacttctgtcttataacaaaacccagctttagctgttgagccttgagttgtgagtaaagcagcagaaaacaggatctgctagtggaagagtattggctgtttgaagaacatcagctgttccaggtagactcctggcagtgtgtgagcagacctgggaaaggcaggcatggagggagctaggaaaatacttctctcctaacctttataatttataaaattagagtatttcataaatattaaaagagtagtacagtaaacactctatttctttcacatagattcaccaattttaacattttgccacattctttctcttcctatatgtgtgtatatgtatatgtttttatacatgggtgtgcgtatatatacagcacatttatatattcacaattttgactaaactgttggaaactaaattacaaatattatatttcacccctaaatacttaataatatatcaaaaatgttctcttatatactatactattacgcaaaaaattcggcagtggaatgagtgttaactgacagtccatatttccccaaatggccccaaaatctcatttataacttttgactttttttgagatggagtctcgctctgttgcccaggctggggtgcagtggtatgatcttagctcactgcaacctccacctcccaggttcaagcaattctcttgcctcagcctcccgagcagctgggactacaggtgcgtgccaccatgcccggctaactttttttatttttagtagtgatggggtttcgccaggttggccaggctggtcttgaactcctgacatcaggtgatctacccgcctaggcctcccaaagtgctgggattaaaggtgtgagccactgcgcctggccaacttttgacttttcatccaggatccaaccaaagatcatatattgcatttggctgtcatgtcacctttaatagagaacagttttccctcctttttgcttctgaagacattgacatttttgaagagtctagggtagttgtcttgtaggatgtcccacaattagtatttgtctgactgtatcctcatgattagattcagagtaaacatttttgacaagaatagcgtgtgggggtctgggagtggtggctcacacctataatcccagcactttgggaggctaagatgggtggactgattgagctcagaagtttgagaccagcctgggaaacatggtgaaaccccgtttctacagaaaatacaaaaaaatcagctgggcgtggtggcatgtgcctgtagtcccagctacttgggagactgaggtagaaggattgcttgaatccaggagatggaggttgcagtaagccaaggtcacaccactgcgctccagcctgggtgacagagtgagactctgtctcaaaaagaaaaaagaaaagaaaaaatactgtatgggggatgttgtatatttcttcttgtgagataccaggagataaataatttcagcttgtctcattactggtggtgcttagtttatcagttggttaaggtggcatctgctagatcttcgtttataaaggcgccttttcccttttgtaattaacaagtaatctgtgcaatgatactttgaaagcatgtgagtaacctttcacccagtgtgtattagttttctattgctgctgtaacaaattacagcaacttaatggtttaacacaacacaaatgtattgtcttacagttcggtaggtcagaagtccaacatgggtttcttaggttaaaatgaaggtgagggcaaggtaatgttcttttctggaggctctaggagagaatcttttcccttgcttttttgagcttctagaggctgcgcatattccttgactcatgatcccttcctccatcttcaaagccagcaatgttgcatctctctgactgttctttcacagtcacatctgcctcttaccacagcctggacagtttttcagcttttaaaggatgcatattattagattgagcccatttggataatccagataatgcccttatctcacagtccttaactttatcatatctgcaaggttattttgccaggtaaggttctgggcattaggaagtagacatttttgggggagcccattattttgcctgccacacagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaatttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgagttttgagtctcatggtacatcctgagtcatttccaggagagcaggaacgggggcgtgcactcttgcctccacttcatgtccctttactcactagttgaagaactgaagaatggatttggcactaatagcttcagagtttttaacaatagaagtttggatgggcaatttttttttttttttttttgagacagggtctcactttgttgcccaggctggaatgcagcggtgtgatcatggctcactgcagccttgacctcctaggctcaagcactcctcccacctcagggtcctggaactacaggggcgtgtgccaccatgcccagctaatttttgtatatttgataggcatgggttttgccattttgcccgggctggtctcgaactccttggctcaagcaatctacccaccttggcctcccaaagttctgggattacaagtgagagccgctatgcctggcccaaaatgatttttgagaagtacatttaaagttgtagagaagggtctttcatttaaatgcccacagggtgcatgaaaaatacaaggtgatttatcaagataggctctttggctcatgcctgtaatcccagcattttgggaggccgaggtgcatggatcacttgaggtccagagttcgagaccagcctgggcaacatggcgaaaccccatctctactaaaaatgtaaaaattagctgggcatggtggctcacgcctgtagtcccagctactcaggaggctgaggcaggagaatcgcttgaaccttggaggtggagattgcggtgagccaatattgtgccactatactccagcctgggcaacagagcaagactccatctctggaactcctgatctcaagtgatctacccaccttggcctcccagagtgctgggattataggcataagccagtgtgccctgcctttgatgatatttcaaagactaagtaacatctgaagaattttatgtcttttatttatttatttagacaacgtcttgctctgttgctcaggctggagtgcagtggcacgatcttggctcactacagcctccacctcccaggttcaagcaattctcatgcctcagcctcctgagtagctggaattacaggtgcctgctaccatgcccagctaattttgtattttttttttagtagagatggggtttcactgtgttgatcaggctggttttgaacccctggcctcaagagatccagccacctcagcctcccaaagtgctgggattataggcgtgagccactgtgcccagcatatatctataatttaaattagaaccctcaatcagagaagtctaaataggctgaaaaagaaactcatttatttaaaaaagaaaaatgacatgcagatggatgtatattatattcttttagtttttagtaaaaattcagaaaaataaacatgaacttgaggtaacgagcctctagaattcttcattttatttcatttcacaatgtttcagcagtcttctgcagttagttggaaggttttggaaattctgactaatccagttgttgaagaataactagttagcttaataaatatgttttctagagctgataaaaaagatgattttttcatctgatgagctctgaccctctataaaccttctaacttaactcattttccaccagctacagaaatgtaacaagatgccaacaattacatcctcatggagcatgtatactagcttataaaatcacccctttgttggaaaattgtgtaatatcttgatttcaatttagcatggcatgttggttagcagtaaatcttgctagtgtatgaacacaagcctgcaggcagtttggagaacattgatcaggtgtaaattgtatgtatttttctcgcttctaaaaattttatagcagaatgaaataaagagctagcattgagaacactttttcagttgttttttattttttatttttatttatttttattatactttaagttctagggaacatgtgcacaagtgcaagtttgttacatatatatacatgtgccatgctggtttgtaggttgttttttattttgacatgtatcttgtggaaagtgccttctctctcctgaaatccatgatttgtgtctctgaccacttaggttccccatttagtatgtgacacatagcaaaagcaaacaagcatagttaaaacgtgtatttgtgccttgtgaaatgtgcattataagcagttaatactagatttgaaggctgtacaaaaaacatgcaaaaagatattaatattaaatacttagtgcttattgtgtatattaagcatttaatatatacaatataattttgcatgaactctgaaagataagtactgttattaactgaattttacagatgaagaaacaggccaaataaggtgacttgcccaagagtacacaggaagtattggagctggtgtttcaatcctggtgcacaggcagagtgtagtgtagtcactttatcaccttctgcctctcatttcttcgggcgaaatcaacacatacctagtgaattcttgcaatatataaaacactgtattaggcacataatatggaagttaccacatatctaaatggtaataaaagtgatcagttgaggctaggcatggtggctcacgcctgtaaccccagcactttgggaggccaaggcaggaggatcacttgaggccaggagttcgagaccagcctgggaaacatgacaaaaccccatctgtaccaaaaatacaaaaattagctgggccaggcgcagtggctcacacctgtaatcctagcactttgggaggctgaggcgagtggatcacctgaggtcaggagttcgagaccagcctgaccaacatggagaaaccccgtctctactaaaaatgcaaaattagccgggcgtggtggcacatgcctgtaatcccagctactcgggaggctgaggcgggagaatcacttgaacccgggaggtggaggttgcgggagctgagatcgtgccattgcactccatcctgggcaacaagagtgaacctccgtctcaaaaaaaaaaaaaacattagccgggtgtggtgacacacacctgtaatcccaactcctcaggaggctgaggcaggagaatcacttgaatgccggaggccgaaggtgcagtgagcagagatcacaccactgcattccagcttgggtgacagagcgagactctgtctcaaaggtaaaaaaaaagaaacatgctaatacatacagctgttattccttttcaaacgatcattggagtgatcatcacttttagagcaattgaaattttaagaatgaataataacaaccaacatttataaaatgctttactatgaggcaggcactacttcaagtgctttgtgtataacctgtttgtaaggtaggactattcattcttcgtttacaaaggaagaagctgaggcatgtcaggtgaaaggacttgcccaagattacctagctattaatgtggtagagctggagccaggatttagacccaggcatccaagctccttgatctgtacatgtaaccattatactacattacctctcattttcctgatgaagaaaacttcttttaatgagaaggtattgaaaatagtttcatattaggttcttataaacatgagcctttaagtgcctttttactgtttataatagacgtcactgagaagattgttaaaatttataatatgatatcattaaagtagcttttcccaaatgatgttctgaggaagaaggaagtactctacaagaaattaatgatgctaataatagtctgagatttacagtacctgagtagttctaaaatttaccttgcctaacccaagatgatttgacgatgggcctctctcctctttgtcttcatagcagccattcacttgtctagaaatctttgcatttggttaagcagtttggatagtgctgatgtaaggttatagtgctaattcctttgcttatttcttctaaatacacatcccaagggaaaccattgattaattaaacttggagtttgtccttcagaatagaaaaccaaaaatcatcaaattcaccccttgtctctattaatgtattgatttagtaatatttatgtaattctttaaatgtagtataaaactttagagttgcaggagatctttgagatcaccaagtccagggttttaaggctaaggttcaaggagcccttttttctggggtttgtagacctctgaaattatatgcaaaaagagtatttttctggagcttcttgcccctcctctccttcagcaggtcatttgacctaggccagtggttcccaaactttgctgcacattagaattactggaggagcttttaaacgttagatgcccagatcacacctccatgctgcttaaataaaaatgttggagtgggagtcaggcattagaactttttgaagtttccttgtgatgccagcatgcatcacatgctttcttctttaatagatgaacaagtaggatctacttatgtggctgaggaagcaatctagagatgttaattggtcagggctctgcttcctgctaaaagagattttagagatcgttctgaaggagtcttgtggggaagtggctctggagctagaatgcttaggttcaaatcccaagttttcctcagctgactaatagggatgataatatagcactgaccacactgggatagtcgctgcctgagctacagaggtggtgagcttgtcctcagcctcaacagaaaggtcagctgaacagactccaaggcagtggagggacggcagcccccagcactccactctgccatactgtttgggaaggaaaagctgtaaaccgatgtcctcattaccttctaacgaagacctcctctcctcttgctctcttacgccaagaatggctagaatccgtttctctttgtggctccttccaccccacctcatgttatttaagtaatcagaaaaggagtctattattttcagagtaacacatgctccttgtacagactttgaaaaacagaaagatttggagatgatacattatcactgcaaatttgactataaagataactactgttgaaagtgtgtattttcttccagtcttttttccttttttcctacatgtaaatatgtatgctatatttaaataaaaagaagactgtgtgagctatataattttgtatcttcctttctaaatttaaaatctgttgtgagccttttcccatattcttgattattctttgaagctgactaaatagctgcatagtatttatgtctttatccttcaaaatttaaggtgctcctaaatcttctgctattacaaataataccgctactaaaaatttgtgcatgtgtggataattatttcccatagaatagattactaaaggaggtaatactgaggcatgactatgaattctttttctaaagctttggaagcatattatcaaaaactgttccaaaaagatagtaccaatttatacttatgggcagagtataagggagtgtgggcatctaattgattcttaatgcttaccttttgtcatgttaatgtagtagagggaagaatggatccttaggagttactttgcatttctttgattactaatgacttggacattttaaaatgattaatggccattgctaaataacagtgttgtggttatttccccatccttattcctatgccctgcagataagcatcttcaactctttcaaccacatttagtctggcttcttagggaagttggaggtctgtaatattcttacgctgttgtttcttatttttaaattgtagacattatctgttgacttcttgcgagtgtagataaggataaaggtccctcatacacatacacttttctctttccctttgcccctcttatctcaatatacactacttttatgtaggtaagtatatgtattcagtgcttatatttttatgagtttgtaaatattattcacacttgagccatcaaaattttttgttgttgtttttttgagacagggtctctctctttcagccaggctggagtgcagtggcgcgatctcagcccactgcaacctccacctcctgggttcaagtgattctcttgcctcagcctccaaagtagctaggactacaggtgcacaccaccatgcccagctaatttttgtattttttgtatttttttgagatggagtctcactgtcgcctaggttggagtgcagtggcgcgatctcggctcactgcaacgctccatctcccaggttcaggcgattctcctgcctcagcctcctgaatagctgggattacaggcgtgctccactacgcccggctaattttgtgttttttagtagagacggggtttcaccatgttggccaggctggtctcgaactcctgacctcaagtctgtataaaaaagcctgtatatgttctgtaaagacgcaaccatccacttttttcccctcaggtattttatttatatatttggagacagggtctttctctgttgcccaggctggtgtgcagtagtgtgatttcagctcactgcaacttccgcctcctgggttcaagtgattcttccccctcagcctcctgagtagctgggattataggcatgggcaccaccccaaccctcgactaccccaggtgttttgaattgaggttagttgactccacacatacagaggtccaactgtatataaagtaaagagtaaaagttttacctcattggccctgtgtgttcttctctgaaaacagctttccaaaggcagccacacttggtggtttgtatgtattcttacagggctttttaaagcacttgtaagctaatattatacctacgtttatgtatttcttgtaacagaaattgggatcggactttggtattttttcttttgaaaagtttttagatatataagacatatatgagtacattcttcttgaaaaagttctaatagcagaaagaaagtgtcacacaaactccctgagtctcacttaccttatctgtaaaatgggaaggattatatattcttcatagggttgttaattagaatttaatgaaattatgcatttaggtggcctaacacagtgcctattcaataacaaaaatgagctagttattttgaacatgtatcagctttggaatttttaatgaagagcattttggcatattactgtatagtttgacagtggtcttttgatttgctcagtcctttttcagggtcttacagaagaaaaggagagtcttacatgttttccttcatagctttgtatgctgtaaatatgagtttagtttaatagcagagtttttctttcttttttgaattaattatttggattgcttcctctctactgccttcaagccaaaagctcagagtttcccaaaccaaagtgtgcctcaatcacaatttttaccagttttatacaatctgtattaattattttatcttttttttttttttgagatggagtcttactctgtcacccaggctggagtgcagtggcacaatctcagcttactgtaatctccacctcccaggctcaagcgattctcctggctcagtctcccaagtagctgagattacaggcgtgcaccaccacgcctggctaatttttatatttttagtagagagggagtttcactgtgttgcccaggctggtcttgaactgctgaccttaagtgatcctcgtgccttggcctcccacaagtgctgggtttacaggcatgagccactgcacccagcccctgtattattttcttaatacttgctttcacattaccgcactaaagaggcataataaccaaatgccgtgcatggaaaacagtacagttgacccttgaacaacacaggtttgtgctgcgctggtcaacttacgtgctgatttttttcaaccaaatctaatacagtattcatggatgcaaaatgcacacatacagagggctgattttttgtctctgtgggttcttcagggccagctgcaggacttgagtatgtgtggattttgttatagtctgaggtcttggaactgatccctcatgtataacaagggatgacaatattaaaaaattacttatttgggggataattggatacatttgaatttggattacatattaagggaacttaatggcattaatgttattgttcttcaatatgataatggcattttgattatctaggatgtctttatgagttgggagatgccttcggaagtatttaatggtgaagtgtcttgatgtttgcagcttactttcaaatggttcagcaaaaatcatactaaaatatgtatgtataaatatatgtgtgaatatagacagatatagataaagatatgaggcaaaagataggacccctaattgttgaatctaggtgaagggcataccagtgttcattatgctacttcaacttttctgtagggctgaaagtttttcaaagtgtaaacttggaaaaataaatgtaattagaatatttacttaaaattaaattgcctcattttctttatcttagtagatttactaaaaaaaaggagtctatatcattattgtaagtggaaaacaagcattccttgccataaatagaagataactgtaaaagttattattttaaaaagtttcagctggatattgttgtctgccaaggctctgagcctgaggcctgctctctcaaaagaagattaacaagcattagaggcgttaaacacaatattagcaccaaaatgagactttcttcttgacttaatgggaaggtatgaaagaaaattgaaaagggaacaagtttctcattctgtgtgattcagctcacctcataacatctcaagtctcacctcaaggcatcttgagtaccactagtgatagaatcccacacttggggaaatactgtatcaggtgatttcagtgtaatgtgttagaatgaaagtaaatttttatattaaatactgtttatagtgcccattatgtcttttttaaaccttgtatgttggtttatcatcatcattattattatttggtagtctcgataactagagctagctgcatggttagctgcgtgatgtcctggcttagggcagatgtcagatattgcagtctaaattattattggggtatacttattctattttatgatatgcagtgttgcctgactctcgaagcataataaagccaattgagatctttaaaaaattaattattattgatttcttactctgaagttgctcttgtagtgggtttttgctatatatattttttctttccttctttttttcttgctacattgttcctgctgttatttggaaggcactaggacattttgcctcttgaacaatgaaaggatccagatcgtgtctgtctcacattttgttatcccagtacaagactcaattgaataaaacatattacccatctggcctggaaatctcagtggcactcaaaataacttactaacaagttgttggatcatgatatcttgagattttctgaaagttcagcttctttttagctgttgctaagagagaaatttcattgacatgagggacacgaggacatgtctgcacactgccagttgttttagaggcatttggctctgccgccttgcagatggttagactctgggtggtgggtgaatgtatgctgattatcttattgaattaaggtaaccttttgtcattcattgaattctgcagaccagttggtcagtgagcagctgctccatgtggcttggtttgggttttgaagtacacaaaaactatcttaaagggtggtcagtctaatccaggtattcaacaaagcaatattgaaagccttcttccccttttgacactgttttctgttctgatggaagtgaatgagcaaaaatatttttactttttgctcaattaactaaatgattgaagcaaaggtttatggaatggccgaataagaattttttaacctagtgctttaagttgaagaaaatacactttcataatatttggtgtcagaaacattctacttttatggcatggtcttatgtttgaagatacgtggtagagtttttaaagtttatttttacaaatatctagaaactaaaaagcattcttttttatcatgcatgcttaataacatcatcttgacaaatactagctgcataacttttggtttgtagggttgttttaagatcagttttttgtttgtttattatattttaagagacggtgtccctgtcttgcccaggctcgtcttgaactcctgagctcaagcaatcctcctgcttcagcttcccaaataactggaataaatctgccatattttttctatatggcttccatttcagtttctagaaactctttcaggaggcttcattttaaataaagaggttcttaattgtttttagtaaattgctgaaattgtatggctcatttctcttctcagagatttttatcttgagctgatccttttggttttactgaaggtgcaatataggtaacctcagagaaagtgactttagccactagttgatttgcttattgtcagagagaaatcatttaacagtgattgatgaggaactgtttaatttctccagtttagtcacctgttgggccctagagcctttcgattcagagctcactgtttcatttgcatttatatcctagtaactatcataatgtctaccagtatttattaagcacatattctgtgctgggtgtcgccgtttatatatgctctttcattttgtcctcaccacaactttatgaggcaggtcttgttagctccatgttagagatgatacagcagcctcccagggatgttcattcacttgtctggtatcatgcagatagttaatggctgggccatattggagtccagggccttcagactctcaggctcatgctcccttctgccctgctgctgttttaatgaaaatcagccttgttctgaaccacagttttacaatgaagcttaagattaaactgaaaatgctcaagttctctgttagggcttcagattctatgtctatacttgtcttattaatggtaaaaataatgtaacaacattaaagaaaaattttgaagggtgaaacactgtttagactcttgccaccttaatacaaccgttttgtttttgcttatttccttccagatttgtttatgcgcgtgtcctttcacacaactataatcaaagcatatatacagctatgcagttttttttttaaacatagtgttattttatacatattttctttttaaatgttcttttttgtttttgagatggagtctcactctgttgcccacccagactggagtgcagcggtgcgatctcccctcagtgcaacctctgtctcctgagttcaggtgattctcctgcttcagcctcccttgtagctgggattggccatgcctggctaatttttgtatttttagtagatacagggtttcgccatgttggccaggctggtctcgaactcctggcctcaagcaatctgcctgcctgggcctcccaaagtgctgagattacaggcgtgagccaccacgcctggctttaaatgttgttctttaaaaagacttttcccacctctttgaatttcccaatctcaacgaggtcccttttataattcgaacaaaggaccatatgctttttcttattagcctttattatagtctaattatgtatttatttgtctggctattttgtaacttaagttgtcccctctaaatggaaaagcttcatgaagacagggaccttatttctgctgtatggatgcaagcagttatttattaactaagattaagcttctgtttatctgttacctcatctgtcagaaacagttggacagattttcaccaaacttagaaggtttttgaagggcatctgtggtgatcaggagacacatgacatatattttctgatcctgtgtctgagataacatacagagatttcaaacatgagacctggctgggtgcagtggctcatgcctataatcacagcaatttgggaggctgaggcaggaggatcagttgagtccgggagtttgagaacagcttgggcaacttagcgagaccccacctctacaaaaatacaaaaattagacaggtgtgatggcatgcccctgtagtcccagcgacttgggggtgctgaggcaggaggatcaatcacttgagcctgggaggttgagtctgttgagtctgcagtgagccatgatcacaccactgcattccagcctgggagacagaacaagactctgtctcaaaagacaaaaaaccccacgaaaaaccaaatatgagaccatgagacctatattgaagggcccaagggcagattgtcaagatggcagaccttggtttgcactttagagttgggtagcttcttaacttgggctgttccacatcttaatctaggatgagcagcaacaaggatgtctttatttaataatgaccaacaagtctcccagtcacatactgactaatttcaaataaatgcatttgatcttttcattttcattttgcttgtttaaatataaattgtctattgaaagagtttttttttctttttgagacagagttttgctcttgctgtccaggctggagtgcaatggtggatcttggctcattgcagcctccgcctcctgggttcaggcgattctcctgcctcagcctcctgagtagctgggattacaggcatgcgccaccacgcccagctaattttgtatttttagtagagacggggttttccatgttggtcaggctggcctcaaactcctcacctcaggtgatctgcctgcctcggcctcccaaattgctgggatgacagatgtgagccaccatgcctggcgtttttttgtttttttttttgatatggagtcttactctgtcacccaggctggagtgctatggcacgatctcggctcactgcaacctctgcctcccgggttcaagtaattctcctgcctcagcctcccaagtagctgggattacaggtgcccagcaccacgcccaactaatttttttgtgtgtttttagtagagacggggttccaccatgttggccgggctggtctcaaactcctgacctcacgtgatccacctgcctgcctcagcctcccaaagtgctgggatgacaggtgtgagccaccaagcctggcctttttttttttttttttttttttttgatatggagtcttactctgtcacccaggctggagtgctatggtgccatctcagctcactgcaagccctgccttctgggtccaagtgattctcctgcctcaacctcccaagtaactgggattacaggcacacaccgtcatacccggctgatttttgtatttttagtagagatggggtttcaccatgttggccagactggtctcgaactcctgacctcaagtgatccacctgccttggcttcccaaagtgttgggattacaggcgtgagccaccatgcctagccctcatatggtttatgagtacttaagacatgtttgattcaatttaaaaaataattacaagctgggcatggtggctaatgcctataatcccagcacttagggaggctaagacaggaggattgcttgagcccaggagtttgaaagcagcctgagcaatatagagatactctgtctctacaagaaatttaagaataggctgcaacactcactctaaggggagcattgtgaggtataccaagatgagtaagaacaatatggtttagcatgccagaacaaggaagtttcaggtgctagaaacacagacatcctcagctcaaacaggaacgcccagaacagtatacaagaaagcctggagctggagtcagaagactggctcccatgtgtggtgtcctaactctctctagacctcaatttcctcatatgtttaataaggataacaacctactcttcagcccacctgagaggacaggatgcttcaagaaagacagtgagcagcaggtcctttaaaaatcaaaggaaaacaggctcctggataggtgtgagatagaagtgaattatggcacatacgagagcaacaataaattatcctttactaacagtaacctaagggaaatgcccggcattgtgtctggcacagactagatactcagtagttcccttctcacacttgctcagccctgtttgaacccagacagagagcagctcaaaatatgcaagtattacatactcacagaacctggagacaagagaagcggcttctaggcacatgggctcccatccttgcagcagctggtatagaggttgcatgacaacttgtgaggattctgcagtagcgtgggctcagctacatgacctaaataaaggtctctttcaaccctgagattctgtaagtttctttttctttagacagagtctcactctgtcacccaggctggagtgcagtgacacgatctcggctcagcgcaacctctgcctccaaggctcaagtgatccttccacctcagcctcccgagtaggtgggactacagttgtgtaccaccatggctggcaaagttttaaagtttttttgtagtgacagggtctcactatgttacccaggctgattttgaactcctaagctcaagcgatcctcccacctcaggctcctgagtagctgggactacagtcttgtgccaccactcctggctaattaattttttttttttttgtagagagggggttctgctatgttgcccaggctgggtgaactcctgggttcaagtgatcctcccactttggtcttccaaagtgttggggttacaggcatgagccactgtacctgtcttagtttatgttttaaagtcatcgagagacatgaaaactaaatggtcctaggttggaggaagaaaacttactgtaaaggacagtattggggaaaactggcaaatttggaatatgtactgactgttagatgatactcttatatcaatgttaagtgtcctaagtctgataatacattatggaaatgaagagaatgaccttgttcttaagcggggtgaatgatcatggtctttacaacttattctcaaatgattcacaaaagagagataaagcaaaagtggccagttttaaagggcatatgggtgtttattgaattattcctgcaacttttctataggtttgaaattttttcaaaataaaacttttttgcccaggcatggtggctcacggctataatttcagtgctttgggaggctgaggtggaagtatcgcttgaggccaggaattggagaccagcctgggcaacatagagagatcccatctctacaaaaaatgaaaaaaaaaaaaagccagatgtgatggcatgtgcctgtggttccagctgctcaggaggctgaggcaggaggatcgcttgagcccaggaatacaaggctgcagtgagctatgatcatgccactgcactttagtctgagcagcagcaaaataaataaataaataaataaataaataaaataaaactttttaaaggtcaccgaggctgctgtgtggccaggggagctatagaggagcaagggtagaggagggcaagcctgggaggaggcctttgtgaggatggaggcatagactggggttttgacagtggggatggagagatgaggacagatctgaaatatgttttgaagaacatatttaacagaacttgctcatggattggaagagattttaggggagagagagggaggtagatgttccccacttggtgcaccctgatggttgcagactgaattccaatagaatcttctccccaaggtctttttattccctctctcttttcctcaattcagccactctatgagtagttaatacaggtatttatttcacagatgaggtgagactcagggagatgaaatgactcatttagagttatcaggtgcagacagaaattttactctacccagaaaaccaaaatataggcatgaaatcagtgttcttcaaactgaattgtctctcattaattgattgtgaaatcaacataatgagttcctatcagcattaaagaaaaaaaaaagagaaacagaataaaaatatagcatgccttgtgtaaaagggtaagtaatgtttcatgaaacttctattttagtttaatattcacatatgtgtatagtaggtcatgatgtgaacgtatttcttacttgaagttatgaaaaattggaaaggcacatacaggatcattgtagaaggaacttatgttatcacagaggtcctgtagtccccatgggaataagaaagcaaaagacaaattcacttgggtggttactgtaggttgtcatatgttgtttatttcttcagtgactgataggctgtaagtctgtcagtttcttagttgttttcttagttgatttttcttttcttttcttttctttttccgagacagagtcttgctctgtcgctcaggctggagtgcagtggcgcaatctcggcacactgcaacctctgcctcctagttcaagggattctcctgcctcagtctcccgagtagccaggattacagccatgcgccaccacacccagctaattttttgtagttttagtagagacagggtttctaccatgttggccaggctggtctcaaactcctgacctcaagtgatccacctgcctcggcctcccaaagtgctgggattataagcgtgagccaccatgcccagcctttcttagttgatttcatagtcatcctgtacttccagtcttgccattagcaaatattgagtacttgctgtgtgcagggttagaagttacttctttgtgtgagatctatgttttgtgtgtgggtggtgtgtgtggggtgtgtgtgtgtgtgtatgtgtgtgtgtgtttgtgtgtttaaaagtagacttttttttgaagagcaattttagatttacagcaaaattgagtggaaggggcagagatttctcatgtactccctacccctacacatgcacaattttccccattatcaacctcccccaccagaatggttgttacatctgatgacacattgtaattgcacagccttatcacccaaagcccatagtttacattagggtttactcctggtgttgtatattctatgggtgtgagatacatgtttaaaaatattttgtattagataaattggggataatagtcatttcaagaacaaaatgttggataaattaaattagctaataaacacagagtgctttaaacattcctagtgcaaaataagatcttgttgtttgtggtggtggtggctattcaggcttaaggtctagattccacttagtatgtaagtaaataatagcaatcctggctgtcatctgtatgtgtaatgtagtaatcagttttgtttagctagttcttatgtgtagcacattaaagcaatcttgaatagtgaggggacctcattactagattaccattaaatggtaatgttaagtgaccctgaaaccaaagtaatggaaaattgtcttcctttttttctttttttttttttttcccttgagatggagtcttgcactgtcacccaggctggagtgcagtggctcatggcaacctccacttcttgggttcacgagattctcctgcctcagccacccaagtagctgggattacagatgtacgccaccacacccggctaatttttgtatttttagtagagatgaggtttcaccatgccggccaggctgatctcgaactcctgagctcaagtgacctgcccacctcagcctcccagagtgctgggattacaggcatgagccactgtgcccagcctgtcttcctttttctcaaacatttaatttgctgtttcttgatcacatatcatccttctttcctttcaaggtcaggggagataattttttactgtatgtactgctgcatcttcacacaaattatcatctgaaaagccttctcagatttgacaaatgaagtctcttttcattcccaggaggaacttgttaaaccaatgaagttcaaaattctaattcctgttcctttctagtgtgcaccactttattcatcttgaataaacatacaacctcaagcatcctacaaggcaaatagattcctttttaattagtggctctatacacagagttttatcatcatgaaatttataaaccaggaagggaacaaatatttacacttgcaacttcatgtcaacattgcctactatttgaagagctctgaaattgtaaatgtatcaccccctccttcttcccccactccccacccctgccggcttttaaactatggcagtagaaaaataggtttcaactttctaggagcacatctctcctatgtggggaatgtggcagattctttatataagtgctctttctttgtgactggcattacttttttttctcacaaagatttgtttcagaagctaatcttcatttttttggttgttgctttttgtagtactatttctaaggcatctccaagtagaaaggcaaaattttattttgagaagttactgctttcatagttacacagaattatttctcaatttaagtaggccttttattccaggacaaaattaagccagtcagaaggtttctgggagaaaaataatgaagagctgaggttttgtatgttaatgtgggcagtctaatgcttgataaaagaaaacttttggctgggtgtggtggctcatgcctgtaatcccagcactttgggaggccgaggtggtcggatcacctgaggtcaggagtttgacaccagcctggccaacatggtgaaactccatctctactaaaaatacaaaattagctgggcatggtggcgcatgcgtgtagtctcagctactcgggaggctgaggcaggagaatcgcttgaacctgggagactgaggctgcagtgagctcagatcgcaccattgcactccagcctgagtgacagagtgagactccatctcaaaaataaaataaataaaataaagaaaactttttttttgtttgtttggcccttgtcagggacagattccgtctcagaaaagtctcgctctgttgctcaggctggagcgcaatggtgcaatctcggctcactgcaacctctacctgccggttcaagcgattctcctgcctcagccttcccagtagctgggattacaggcatgcgccaccacgcctggctaatttttgtatttttagtggagacagggtttcaccatgttggccaggctggtgtcaaactcctgacctcagataatctgcccacctccgtctcccaaagtgctgggattacaggcatgagccaccacacccagccaagaaaacttttaaagatgtgtaaatatgcagtgatttaaaaatctcagttgaagcttgttaaaatgtatcaaaataatttaggaaaaggggggctgattttgccaaaatttgggagatgcatactttttttcaaggctttactgcagttttaaaaaatattttattgttttgtaggcagcttctgaaccagagtaggctcagagactccctttattgcagttttgatgctgcagaaagtgactgcttaatttcagctgttgaggatgttggttatactatgcctggatcaaaaaaatgattttacattgcttagtttgttaaaatatgtttaataggttaatctttttttcaaagcatcaaaaataattaagatgaaatatcagataaaccctatgtctagaatgaataatttagttctaaacatcctggatgctaaggagaaaagaacaagatgttggtttataaaattcttattgtcaaataaagaagcatagaagtttgaagaaagataatttttttgtttttattttttctctctgaatttaggagtaatttatgtttgggttctaatcctatgttatcatcaaagagtaataacattggcaatcttccctcccattctgcttcatcctccccactaaagggaaataccagattgtaaaagaaaaaaaaaaagcatgctggttgtataaaaagaaacattttaaacaaataagaaatatatatattgaaatgcagtctccctgaatgatgctaaacccctgtccaagtaggcatttctcagcccacagaaagggatggcattaaatcacagctcaatggagacatttttatgaggagctgtgatggtttgtgtttagcaaacatgtattgggcatctcagatttgcctgttagggatgcaacagtgagtgagatactatttgttcccttaagaaactcaaagaggaaaggggttgacttgttcagtcagtgacttatgaaatatttcatactcattcatttacagagtactttttgtaggtatagtacagcgtggtcagccagggagactatagtgggtgcattagtaactaaccatacaactaatgctaatgttgcgggctgactgggtttggggtgaacaaatgacccctaaagctcaggagttctagaccagcctgggcaacacagtgaaaccctgtctctactaaaatacaaaaaattagccgggtatggtagcatgtgcctgtaatcccagctactcgggaggctgaggcaggagaatcacttgaacccgggaggtggaggttgcagtgagccaagatggtgccgctgcactccagtctgggtgacagagcaagactccatctcaaaaaaaaaaaaaaaaaaaagacatttgttttggctggggaaggctttgcagagggaggtaacttctagattgagatttgaagtcagagtccatccagaaagtagggaagacattttatgtagagaagtaacaagctacagggatcagaggtatgaaccagggtgcatgtttgggttatggtgagtggtgtctggccaaactgtgtggctcagggtctttctgcttcaccatctttagcatagaagccttccttgtgctcacttgctcatctcattctcacaaaatagctgcttcatatctaggcaccatctctctattcccacaggggaaagagggaaagtgccaagggtaacagcggaaacgtcttcctttttattcaggaaatgagggactccccaaggcttctgcttatatttcattggcttgagctgagccgtacaaccatcactagtggcaggtagtctgggatgtcaagaaagtagcttcccagtctctttggttagaaggcaaaggagaagatggtgggaatcggtttgcatcagtcactctacacattatctgctttgttagggcagcattatcttagtattgttaccaagttcagggtcttttctggggtgatcaagcatcctgggtcgcctgggaccaagtggttttctgggttgtaggactttgagtgctatagcctggaaagccctaggaaaaccaggatggttggccatcctagtctttccccatatcctctgttgtccaaaaatatggaagcaggtcatttcttgacataggagctgccttgactgggcttaaaaaggcctgaaaggcagcttaataatttacaatgagaaataaatgatattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagcttctggtgctgactagtctccccttctaatggacagtgtttagatacgttattgtctaaaggtagatctggccaggcatggtggctcacacctgtaatcccagcactttgggaggccaaagctggcagatcacctgaggtcaggagtttgagaccagcctggccaacacggtgaaaccccgtctctactaaaaatacaaaaattagctggacatggtgacaggcacctatagctgagatccattgtgagtgccattgcactctagcctgggcgacagagtgagactccatctcaaaaaataataataaaaataaaggtagattaaaaaaaaagagacataatttgcgttatcgtaaaatttacttttttaaagtgtgtaattcagtggtttttagtatgttcacaaagtcattcaccactgtctaattccagaacatttttcttaccccaaaatgaaatcctatacccattagcatcactgcccatttcctgcttcctttagactgtggcaaccactcatctattttctgtctctataactttgcgtattttagacatgtcatataaatggaatcctatggtatgtggccttttttaaaaatcactggcttctttcactgagcataatttttcaagttcttttaagctgtagtatgtatcagtacttcattctttataactgccaaataatagttctttgtatggatataccacattttatttcattcattcattagacattgatggttctactttctggctattatgagtagtagtactatgaacatttgtgtacatatttttgtgtggacacgtttttacttctcttggctgtatacctagcagtggaattgctggtcttcaggtgtgtcttactgatgtttttttttgagatggagttttggtctgtcgcctgggctgaagtgcagtggcgcaatctcggctcactgcaacctccacctcccaggctcaagcaattctcctgcctcagcctcccaagtaactgggattacaggcgcacgccaccatgcccagctaattgttgtatttttagtagagacggggtttcaccatgttggccaggctggtctcgaactcctgggctcaagcaatcctcctgccttggcctcccaaagtgttgggattacaggcgtgagccactgttcctggccttatcttactctctctttttttttttgagacggactctcactctgtcttccatgctggagtgcagtggtgcagtcttggctcactgcaacctccacctcccaggttcaagccattatcctacctcagcctctggagtagctgggactacaggtgcagctaatttttgtcattttagtagagatggggtttcaccatattggtcaggctggtctccatctcctgacctcaggggatccgcctgcctcggcctcccaaagtgctgggattataggtgtgagccactgtgcccaaccatctttaagcctccttaaggaggctgtgtctctaacatgccctgttggttttatagttggactctcactggacagcctcgtttttctaagatttgggggttataaggatcagagttgtccccagttggctcctttcacctcgtccataaggttgttgtgaggcttcactgaggtaatctgtataaagtaaggtgctggcctgtaccctgtacatcactcagtagtggtgatttcactgccctttgcctcctgcctttggcttctggctatctccaaacaccccatgccttctgtgctccaccctctgttgaaacacaggaatctaaaaccattcattgatactttttgagtgattatactgaaaacaattgcatgttgtctcatgcagaattttcgtgttaaaccctgtgttgcaaggatgccattaaccagcacacagatggcggtggagattgattgattgagatggggtttcgctgtgttgcccaggctggagtgcagtggtgtaatcgtagttcactgtaactttgaactcctggactccagtgatcctcctgtgtcagttttccaagtaactgggactacagtctcatgtcactgtgcctggctaatttttaaaattattttatagagctggggtctcgctatgttgcctaggctcttctcaaactcctggcctcaaagcgatcctcctgcctcagcctcccaaagtgttgggattaccagcgtgaaccaccacacttggctggggatggagttttagacaccagaggcttccttccgaggttgacctagaaagcacccttggtgggtgccatgggatgggggaatacagtcaaaaggaacctgctcttcccgctgcgcctccacctgaggtggatgtgtctgctggggctgctggagtctccatcttccactttaacttcacttaagagctgaaagctctgccccttcttcaagattttccctgctgtctccccttccctgctcaaccagagattcctcttattcttcctcttgctattagtattaatctggctcactgactcttttccttaacctcatcctaaaactgtctgatgcatattttatattttcttgcatgtttgacttttagttagtattttacagtaatttcgttctgcagccatcctcttatctgataccctggaactcattcctgtgcctatcagttctcacctctggtaattaaactttgtaaaaaagaaatgtgacatttggacatattctcttattagtaaaggtattattgtgtatgagactaatgctgtgcatctataataagttgtttcaccttgtgaatactaatgtaatttggaaataaacctttctttgttaaagactttttctacatgggccacgtttttccagacctatttcctaataatttgtggtttttaaaggtatgtcaatagagatgctgtagccagcatggctggattctgttagataaacattttgtgagattgcttaccttaaacaattgtctttaaaagttaatttcttccctaatgtgtcagtaaggaaattctatagtatttaagaagcctgataaagtccagttaaaacattttgcattgctctttaaacatcttttctgagggttgatgtgttcgtgtttgtttggttcacatagtttcttctgaattttaagaaagctttgtcagaatcagtaacttgcctatagtgtatttttcatgaccatatggctttcttcatcaaaaacagctaagtaaaaatttcagtgaataatagtatatatatatgggaatgtattcctcatcatttgtatgctcttgagagagtgactcatgtactgttttctattgagttcccgaaagtttataaagagatgacaaacaattggctatgggattgaaataatgcacatgtaaaatggaagggaaaacatggaaacagtttcttcctttgttcttcccttaccttgatgaaatttttaccacttaacgtttttcagtaaagtcaaggtcagtatcagagcctagtacggttctgcttgccgctgtctgaggattacctgtcttattacagaatgtacatgctcccagaggagaagatacagtttgatttcaggatgacaaacagctcttctgggacaatagtgtcaagtataaaaggattataaaggttttaggaccatgggatggtttgaaggggaaagggtgaaatgacagttaaggttggcatcaccgaggtcccagttgttggctgccccctacttctcctgttcccctctggcagtattttacagatgtatttcctttgacctttcctttagtaggaagttgtaggctttaagatccagcagaaaaaaattatgagccatttgtgaccctcttgagcagtccttcaggtagaacacatttcataagagctagtgaatggtcttgggtaattaaagctcactttatgattatacagtgtggtggccagcccagagggaacatcacaaatacacattatgaatgtatagaattgagactttatacctggagactgttggatgacctggtcctctgcccccaggcctacccttctgcccatcctcatccaattctgttttgatttttaaaaagtatgtgcttcttagccctctcattgcttcactgtgaggggaaaaacttttctattgaggtgctgaagctgtgctttccaggactcatacttatgtgctgttgaatgagtctcagtgctcctaggagtctataaaaggaatagaagacttcttttctctaactcccttatggtttgtattttatctgctaagagacactggcatttcatggagatgggagagaaaaagacacagcctacttagacagttcctttattccaacatatatactcacttcacatattcatagacaccttccacctagcatcaaattctgaactcatagaagacttaggtgtttttggttttgtatgcatagcttttgaaatccctgggttgaaaattttctaggtgttgtttgtatgctctagtcaagcccaggacataaagggttatgttaaaattactttccttagtgactattaaccagaaattttatctgtcaggagaaaggattcatgcaactctaagaatgcattgccctctgcataggctattagctttggcaaccgaagatagatgagacttaggctgtgtttaaatttttcattgtgatgagacaaatctattattataaaagccctactttatcagtgagagtgtttccttatgttgttttaattaaaggagcagtgtgtttttaaatttaattatggtaccttgaagatctgatactagctgtaagctaaggattctttgggttttcaagattttttttttggagacggagtttcactctgttgcccaggctggagtgcagtggcgtgatctgggctcactgcaacacctgcttcctggtttcaagtgattcttctgcctcagcctcccaggtagctgggattacaggtgcgggccaccatgcccggctgattttttgtatttttagtagagacaggtttcaccatgttggtcaggctggtctcgaattcctgacctcaaatgatctgccatcttcagcctcccaaaatgctgggattacaggcgtgagctacagtgcccagccagttttcaagatttttaatgcatttggagcagcgctatcctaaagaaccttctttgatgatggaaattttctctatctgcaccatccaatatggtctggtaaccaccagccacatgtggctattgagcacttaaaatgtggctgagactgagaaactaaaattttaattttcttgaaaatgtaaattaattaattaattaatttatttatttatttagagacaaggtcttgctctgttacccaggccggagtgcagtggtgcaatcatagttcactgcagcctcgacctcctgggctcaagtgattctcctgccttagccttctgagtagctgggattacaggcatgtaccaccatacctggctaattaaaaaaaaaaaattttgtagatatggggtctctctatgttgcccaagctggtctggactccaggcctcagcctcccaaaggagaaaatgtaaatttatatagtcgcatgtgattagtggttattgtgttggacagcacagatttagaatctgaggaaactctccatttagtataatgccatctgaagctcttaaccagttgaggctggttaaatctgaagttgatattggataatattgctattaggccaatgagagatttctttaataaagatgcaagtttatcaaacttaaatatgctagatatgaactttgggaaggcaaaaattaattccagaaataattccaatataattaattgaacaaatatttagaaaatgttatctaggataaagaagtgtagtaaatattgtggaggactcagaggtgagtgggacttaggtgaggctgcctattttgagtcctgctggggaggccttgaaaggtcaaggagaagttcttttttttttttttttgagatggagtcttgctctgtcaccaggctggagtgcagtggcacgatctcagctcactgcaacctctgcctcccaggttcaagcgattctactgcctcagcctcccgagtagctgggactacaggtgcacgccaccacatccagctaattttttgtatttttagtggagacagggtttcaccatgttggccaggatggtcttgatctcttgaccttgtgatcctcccaccttggcctcccaatgtcctgggattacaggtgtgagccactgcgcccggccaggggaagctctttctaagggagtagcttagagcacagaatgccaactgggttatcatcaggctgtaaacagtaggatttcagtttgtgcaagcacgatggttggggctgtaacaggagaagggggagctgtttacatcaggggaacattaggttacatttggctctgacaggcaagattaattttgtctgagagaaggttgaggtgggattggaattttcccaggtatgccctgcgatgttctgctgagtttcatgtgtgttggagcaggcctctcaggccatcacagttctgggagatggactttccaaagattgggaagctggaggcagggacacctggacacagagccttcttcacccccacctgcatcccaggtgaggaggaattcttgaaaatgccgagtttgactcaccaaccaggagtatctaatgtatataaatattcctttaaacgtaagtatagtgatgagtagataagccagagtatttaaaagccacagcaaagattcagcttcctctccgctcccccgtgccccacatctgggaggaccccacctgagcttggtgttatagttggctgatgctcttaggtggaaacccaggggcaaaggacaagccacagaaacataggctgcatctgctcctactctgtacttccaccttacctgcccattaagtgctatgttcttgactaaataattcatgtatcgcagagagggaaggtatgtgttcccaccaacctctgacccatccataacccagtgtattacactgacccaggaaccagagctcacttcaccctgcttggagtcagggaactcggaacctaactgtcctgggccctctttctggtagttgggtgagtcctgagggcctgatacgtgaggtttggacaggctgggcagtaggttatggcatatcttgtaagggagaccatgtcagcagtggggagcagaatgcagaggaatcaaagacctgatctcatagtgcaggtgtgaagggagaagagccagcctttctccaccgtctctctggggacaggggactgtctcgcagggactacaccttggcatttgggcatgtcagaccaggatctagtcatcagagttacccaatgccctggggttggtttctaccaggtcagggatgcagttctgcaggcagtatgttacatctgagactacaggagagaggggtggggtgacagtctttccatagggtgtccagacactcctggcccagggactgagccatggatagtgggatgcttgcctctctgtgtggcagggctttcgtctctgttttttgtttttgagatggagtcttgctctgttgctcaggctggagtgtagtggcgcaatcttggctcactgcaacctctgcctcctgggttcaagcaattctgcctcagcctcctgagtagctgagattacaggcacatgccaccatgcccagctaatttttgtatttttagtagagatggggttttaccatgttggccaggctggtcctgaactcctgacctcaggtgatccacctgcctcagcctcccaaagtgctgagattacaagtgtgagccaccatgcccagcctggtctctggttttgagccatgatgtcaggctgaccaggctggcacatttagcctggaatgggttaggcttctggctttgatgttaagaaaggaaactagtgccaagtgcagtggctcctgcccataatctcaagactttgggaggctaagccaggaggattgcttgagcctaggagtttgagaccagcctgggcaacatagcaagaccccacctcaaaaaaaaaaaaggtagtttggtgtggggcatgcgcctataattccagtgctttgggctgaggcactttggggagattgagactgcagtaagctatgattgtgccactgcagcccagcctggttgacagagtgagatcctgtctggaaaaaaaaagagaactggctggtccttcctgaaatagtgcccacaggctggcagagcactgactgacacctgcctctttcagaggtggggtcaggatagctgtatggaaattctccaatgtgtgggttgtaggagtgtatctcatatcccttcaagcactgccaggccagaacccagtggagtttgcaaagaatgggtttcttgttagaagaaagtattacgtacatgtaagtaatcttgggtatagctgggaagtgatgaataaatttgaccattaaaagattgtaatgtctgtatcaccaaagacaaaatcacaaatataattaaaaaacaaataacagactaggagaaaatagaccatgtgcaatacacaaaggataaatacagagtatataaagaagcttctgcatattaataagaaaacactagaataaatgggcaaaagatataaaaaggcattgacagaaagggaacaaatggccaataaatacaaagagatgcttaacttcattaataattagtgaattacacattaaagcaactagatatgattttatcccatcagattggcagaaattaaagagaataatattctttggcggcaatgagaaaaaatgggtgtactttcatattctgagcatataaattgttcagacctttttggagaaggtagtttggctgtatctttgaaaataaaatcacatacttttaatttggtaattttgtgtctagtgaaatacacctgaacacatgctcattccagcactggaatggtgaaatattggaatgattaaatgtacagtggtacagccagcatatagaatgcgatacctaaaaagtgtgtaagagtgtggtatagatctttatgcagctgatgtgggaggctctctcagatacgtttttagtgagaaaaaatataaaattattacatttatatttgtaaacctcaaaatttatatgtatttgtaaattctaaaacatgcttttcagattttttaacatttctgaaatcagcgtatctaacaattggtgacatagtttactaatttaaactcttggtgaagcatagtgcacattacaagtgataagatcttagatttgatgaaggatgatatgtaaatacgtggataaaggactctaagacagacatgggacgagattgaggaagtgtcagtggagactttgtctgtgtcatctatgttgtcaaattttttttacagtgaaattatattccattattgtgtaacgaaaaattttaaaaatacatatttatattttttagacaagatataattttagacaagataaggttgcctggatgtctctgatgtctgatccatttctctacttgggtgattatgcttgatattcagctttgagaactttaaggcctggatggttgatagagcgttcagcttcattaagaagttaagtagctgtgaagattcagtgggagagaattgagaactgaggtccaagagaagggaggagccgaactccagaattcagggccagttgcctcatggggacctttgcatctgtgtaaagaggttgaaattctctccccacaaggtggtgccaggctttttatactggactgggcataccctggagcaaggctcagtggatgggaggcagaaaatagatcaaatcaaggagccttatccaatgtcattgaaaggaaaattcattgttttgggagagagctaagccctagtgggaaagagccaaaggaataaatgggcttttaaatctgaggaatttacacaaggcaggcaggagatgacctgccataggttggaggcaggctctgcttggatcctgtgtaaacagggcatagtgtgagtgtctccccataagtaaaagctgtgttgtgaagatgaactcacagtttagtagtgactttttgaccaaagatgactcttcaagaagggataaggtgtatggagtatagctcattgccaggactgtgggaggcagaggaaggagaggacacttggccaagatgccatttgagctggtcactgtaggaaagggagaatttggacatgtaattttttttttttttttaagacagagtctcactctgtcacccaggctggagtgcagtggtgtagtcttggctcaccacaacctctgcctcctgagttcaagtgattctcctgcctcagcctccccagtagctgggactacaggcacatgccagctgcctggctcattttgtatttttagtagagatggggtttcgccatgttgcccaggctagtcttgaactcctgacctcaagtgatctggcctggacatgtaatttttaaggagatattcagaagaaaagggaggtgagcccaccatttacaaatgcacacaggaggccgggtgtggtggctcacacttgtaatcccattactttgggaggctgaggcaggcagattgcttgaggctaggagtttgagaccagcctggccaacaatgcaaaatcccgtccgtactaataatataaaaaattagccgggccactgcactccagcctgagtgacagagcaagactccgtctcaaaacaaacaaacaaacaaacaaaaatacacacaggagaatgtgaggagctgagtagtacagttttctcggagtacacgtctattaaagggaagcagtaggaagtaaaatagaaaaaggtaggctagggccggaccatgaagagctgagaatgccaagtttagaaatttgaccttgagtcagtgaactcatgttttacatttaatcttttggttaccaatttttttttgtaccatcattggtttgatttttaaaatacagtcactttgttttctaaggattttatgatatatgttcaaatcttgagttaaaggtaaatagaacacagtttgggtttttttttggcatataaatggttgaatttcaaaattatatttgtgttacaaactttgtttttactctctgccttccagcatttgcaaataaccatttctctttcaaaggaaattctagtatgtattcccattcaataaaagcaaagagctgagctctatatgaataagaggtaaaattgaacatgaaaattactgagcaagattagtgggggatgaaatggatgaacattggggaaagctgtgatccttgttacctttgctatagtgcaatttggaatggcttctttattcctggcaattcctgacagcatttcttttaaacctggccacctttccattgccagctcgaccttgatgttagctggtgctgctactgcaagggctgcctttggcaggaagccttcagtcaactttctgggctctggttttggctctgcacatgccttgctgagaagaccttaagaatctgaaatgtggagggtcattttggggtagggaaatgtggtggcaactcttgagttttctgccacgatgtaacttaacagatcctcttgtttttccttaaatggtacaagggtttgcaccgaaatggtaattcatctgtgtctgtgatgctttaaaaaataacagtttcactaatgtgtcacaacatgtattatttatcattttagtaaatggatattttaacaagcaacaatttgcaaatttaagcatggcagttaacatgatctgacattaaaaaattaaataatctcctgccatctttgttatcagccttgcattaaggattttagcccttctgggagcttttatttttttgttgactctgactgatgatggcagattgtggtagtgatcagagctatgcttttataaattattttttagttggaacaatattggcatgtaacgtggactggcagaattaacattgtttatcattaccagtgttgttttgacagatattctcagttctttaaggaagcagatagggaatgtctgtaatggacatctgctgtccactataggttgcccaataatgagtcctggtaggttctaccttctgctgtggaagccagcagagttcaaatgggcattttctgttcttgcctcctaggaactgcaggggtggacatgcttcttaggcttagcctgttgactgcttccacctggagtttgaatctgaacagtgttagaaaatgcagggacaggctgagtgtggtggctcacgcctgtaatcccagcactttgggaggacaaggaaggaggatcacttgagcccaggagttcgagaccagcctgggcaaaaaagcaagacccagtctctacacaaagtaaacaaattagccaggcatggtggtgtgcacctgtagtcccagctacttgggaggctgtggtgggaagatcctttgagcctagaagtttggggttgcaatgagctatatttgccccactgcactgcagcctgggggacaaagagagaccctgtctcctataaaggcagcgacagttagtagtggcactagagttactaaaattatcaagattttcttcctggatagtcctggttgcacacatcagtgttactataggtggacttagcctttacttttgtacatttcgcactgatacctctaaccaccttttgtgcacatagcagctattataccccccatagcataaccaacctgtgtaagagaagagtataagtcagttgcttgcaaggaactcttaggggtagggagctcttgcctgggggaggtgggggtttctcctctttctgtcctcccctagtcattagagaaaggcctcaagagaataactcagagattacggttgaattcaagagggtagattgacatctcattgagctgcacagaggtaccagccaggtgctgctgtgggattagaatggactcctgagaaagcgttcttgagtgagtgtggtgtggctttcctggagtttggggatgtctgtgaatacagaggcaagtatcttcctctcatctgaaagccccccatgtggctggagctgcccctggggacagtgtatggagagaggacagcaaaaacgcttgacatttcctgtgggcctggtggtctacatggaggacagctggcctgagtctttttgaaagacttgtcctgcctgcgaaggctgcctgccagggctaggcccgcagcagaaagaggttgtgggtgaaccacagaggcaggagctgagaggagactgagagctgagtcaaagggcacccgttgcctgcatcaggcagcatggaggtcccagcaaaggggtctcactagagagagctggcatgtggactcctgcaaatggtggaagatattttacaggctgcaggactggaccacagaaaagtgggcagacctttccctttcctcacacttgccgcctttcattccttggacccctctctttttcctcactgctgttcttaggggaaaagcttgacattggataaaatgaatttggatttagactaaatagactttttaataactgaaagtttggctttatttaagataatattttctttttaaaacactgtctagaaatcagtgggtttttttttttgttttttgtttttttttaaagacagagtttcgttcttgttgcctaggctggagtgtgatgacgcaatctcagctcactgcaacctccatctctggggttcaagcgattctcctggctcagcctcccgagtagctgggattacaggcatgcaccaccacgcccagctaatttttgtatttttaatagagatggggtttcaccatattggccaggctagtcttgaactcccgatctcaggtgatctgcccacctcagcctcccaaagtgctgggattataggcatgagccaccacgcccagccaaaattagtggttttaatgttactaaatcctgaaatagctttccatgatgacaaaatcaatcaacaatctcaaccccagtagactggagtggattttagaatttagcacactttcccttatttatactctgcaggtttcaagcatacaacttgccagcaattactgtgttggctgagaaatttgaaattttactagcttgaacactaaatttgttgatgtaacatacagctaataataaaggtcacgtccccatattggcatgagggaccccttatgaattagcctgaaactttgcagcctttaatcatatttttctctcttttttcccttgagacggagtctccctctgtcgcccaggctggagtgcaatggcacgatctcggctcgctgcaacttcgcttgccgggttcaagccattctcctgcctcagcctcccaagtagctggaactataggcatgagccaccacgcccagctaattttcgtacttttagtagagacggggtttcaccatgttcaccaggctggtctcgaactcctgacctcaagtgatccacccacctcggcctccccaagtgctaggattataggcatgagccaccgtgctcggccatgttgttatttttggtttgtttgttgattatggtttaaaaaaaccacataacattaaatttaccatctttgccatttttaagtgtgtagtatggtagtgttaactgtatgcaacagttagtgcaacagatctttagagtttttttatcttgtaaaaccgaaactctgtacccaggaagcaattcctgattccctgcttctgccagcctctaccaaccaccattctactttttgttgctaagagtttgattactttcgataactcacatcagtggaataatgcagtatttgtttttttcttactggtttatttcacttagcttaatgtcctcaaggttcatccatgttgtagcatgtgacaagatttccttctttttaaggatgaataatattccattgtatggatagaccacatttgctttatctagttgtctgttggtgaacatttagggtacttctacctttcggctcctgtgaacactactgcagtgaacatgggtaagcaaaaatctctttgagatccttttggctatatacccagaaggggattgctggatcatcattctgtttttaattctttgaggagccgccaaactgttctttatagcagctacgccattttacattcccaccagcagtgcacagagattaccattgcttcatatccttatcaacacttggtttttttttttttgccattttaatgggtctgaggtgatatttcattatggttttgatttgcatttctctaatgattagtgatgttgaacatctttttatatgcttcttgcccatttgtatatcttctttggagaaatgtcttttgaagtgctttgcccattttttaattgcattagtttgttgtttttttgatttgtaggagttatttatatattccgggtattaatgccttatcagatatttggttgaaaatattttctcccattcataagttgccttttcactttgccctttaatcatattattattattattattattatggttaaaacattaattgtgtaatactgaaaagtttaggaaataatatgacagattttgatcaggtcttaaatatcttcccaataggccctatgagtaaggcataaaaagcttgaattaattccatagtttcaccaaaacgctcttcttcttaatcttattccttatttttttgaggcagagtctttctggcccaggcagcctggagtgcagtggtgcaatctcagctcactacaaccttcacttcccgggttcaagcgattctcgtgccccagccacctgcgtagctgggactacaggtgtgagctaccatgcctagctaatttttgtatttttaataaagatgaagtttcaccgtgttggccaggctggtctcgaactcttgggattcgagtgctgggattataggcatgagccaccatgcctggcccttaatcttgttcctatcaatctttccagctttaccttccccagcatgacttcctcttatccccttcctatgtccaaagattccctaaaaatattctagctctgtaccattccacacactgcttttttgttgttgttgttgttgttgtttttttttgcctgaaatatgggatatgtacctttccctcttgtttaaccttgtttttcagactccttctttttcttttcctttaaagactcagcccagatgtgaaaatgttccagtcagccagtcagctgcttttctctcctatagcctcttaggtacagcccaggttagcacacttgtctgaaagtattgtgaggacttttataaaccccctctctccaggaccatatgctgctagatcacctagcttagctttgcctttttattcctctttgtcatgggcctaccataatatctagtccataatatttgtgtactttagttttttatttatttatttatttttgagatggtggtcttactccatcacccaggctggagtacagtggcacgggatctcggctcactgcaacccccgcctcctgggttcaagctattctcctgccttagcctctgagtagccgggactacaggacacgccaccacgcccagctaatttttgtatttttagtagagatggggtttcactattttggccaggctggtctcaaactcctgacctcaagtgatccacctgccttggcctcccaaagtgctgggattacaggcatgagccacaacacccggcctatttgtgtactttaaacgattatgggtagaaagaaagagcaaatgcctttttagaaataagataacagaactttttaccaattgtgcttccaaatatgctttctcttctaattttatctgctaagattttggcagctaattgtagattttatgaacttacattgggttgcctttgtcttctgttataaaagcaataattagaggaaatgatccttttgagaggttgtttaatgaattctgcttgttttaaatgtgctgctttaaatcttatttcacgtaaactgtactaatgcccaaattatctcaccctagatcagcattgaaccaaagtattatgatgattaatttccttctgttaaatcccttatagtcttttctttggtgtgtgtgtggggtcaacaatcaaagaaagaatttattgactttacatttaatatggtttactctacttgattatattgttcaagtgtgaatttgtgtatggtataagattatgccatactgggattctattttctgttaaacaaatagctttgtgttttattaactgccagtgtttaaatttaatggtttaagatttcagagagccctttttgtaagtatttgaaagtttttattataatcctgagcctaaccttcttctggtttcactgcatccttctccagccttgaaacaagccctggcacagacgcaaatcctggcgtgcaccacctcttcctctcccccgctccccactctaacatgacaagaagtgtctgtcccagaagtaatctgattgtgcacctagagtacctgttttctgcctggggaagaatgcacactgctggacctagagcggtggcaaaagtgccctctccactgtgggggccacagtggtaggcacaacccttatccctcagccccattagttaattaagtcattttacctgcattaaactttacgggcagagaaaattcagtaagtcaccactaccaggtgactttcttttttatgttaccccctagcaaggcatgtagtttgcatcctacagaatataaaagatggggccagcatctattctgtgtcttagcagtgaacttcatccaatagatacttgatttttaaatactttcaccttgtgtcatgattaaatcactaaacaggaagtttcagcttttctttaaagaagtacatcctattaaaaatttaaatgtcttcataactgcttacgctcagtaaatgaacactaggaatctataaacaggaatctatggctctaaaaattgaaattttgggggctgtttcattctttagaacttgaaaacgccataggcaattagctataattcatttgcagattatttttgccatgttaaattaggaattttagccatagcaagcataacagacaagcacacttttaaattattttgttcagcaaaacaccataggcccttatatgtgtttgctggaatttttctttgtcaacaataaatctatatgtttctttagttaaaaaaaaaacagcaacaaagtgtttattgtagaatgtttactttttaaacaaacgtgaaaggcattggtacaaaaagggaaaagcacctaggatttggatcctcagtgggtccaggagtacagcttccttgttctgcagttactggaggcagtgtggtgaggggaaggatgtgggctttggactgagctgctgcttctacctgtgctatgactttgcacaagttaggagtagcctttttgagctttgttttctccttagaagatgactaagatcatgtttgcacatagcacatgacacaaactcatgatactggttttgttttttctaacattgtctcagtgggtcttcactgccttctttctacaattttttttttttaagggaatagggtcttactctgttgctcaaggctggagcgcagtggctgatcattgctcaccatagcctcaaattcctattcactgccctcttatatagtggataatgtgggcgttagtctcatgcagttaagagaacaggttcaaaagaagttttgaactgtctgttttattttcacaaggccagtcagtgacagagaaagaacttccacttgggtgtcctggctctgtgtcccatggttttcctactgaaatactattactgtgctatagcagaagaaagaaggctaagacagttctgtgcttacagtcaccttcagtttcaaatgtaatcatatcctgggggaggggaaatgaaactttgagtttcatctcccaaatcattcctttatttagaatcaaccggctgggcacggtggctcattcctgtaatcctagcactctgggaggctgaggtgggtggatcacttgaggtcaggagttcaaaaccagcctggccaacatggtgaaacccccgtctgtactaaaaatacaaaaaaaaaaaaaaatagccgagcatggtggcaggcacctgtaatctcagctacttgggaggctgaggcaagaaagttgcttgaacccaagaggcggaggttgcagtgagctgagattgcgccactgcactccagcctgggtgacagagcagtactccatctcaaaaaaaaaaaatagtatcaatgaattcaaagaaataaaatgtttttcatgtactcatggaaacaactatttctaaaattctaaatgaattattattattattattattattattattattattattatttgagacggagtttctttcttgtcagtcaggctagaatgcaatggcgcgatctcggctcatgcaacttctgcctcttgggttcaagggattctcctgcctcaccctccccagtagctgggattacaggcgcctgccaccatgcctggctaattttgtatatttttagtagagatggggtttcaccacgttggccaggctggtctcgaactcctgacctctggtgatccacccaccttagcctgtcaaagtgctgggattacaggcatgagccaccgcgcccgacctctaaatgaatttttaaaactccagcatctcacaaatggttcttgaataatttttccttagcctgcagtgtttaagttgggttttgaaggttttgttactcaatagtcacccttttttgggtgtaagtttgtcctctactcctgagtaagtaagtgaccttagggcagtattaccatgaaacagatctcacaaataacattgataccaacatcattatttttggtcaaatgttaaatagttaaaatttgtcatcctagtctatattgaactaatttgaaataccttatatttaagcaaactttattgtttttaacatagcaaaacaattaataaaactttaaatcaattacacatgaaacagtaagaaagcagtgcaagattaaaatctctaggtaagtgttctatagtgtataagtaagttctgtagaacttcagaaaaaagagaggtcagtaggattcttagagcaaagtgtgattttatctgtactttgggtcagaataacttttctgattttttttattactaacatacctaaacacagataatgttaacattaattaagtgaccttagggcagtatcacaatgaaacatctcacaagtaacattgatactaacacaattatttttagtcaaatgttaaatatttaaaatttgtcatccttgtctatattgaactaatttaaaatatcttattgaaatatattattaattaattcatatcagacttagctagagacacctaatgttcaaaacagaaagtagaggtggattgggcccagttggctccagttgctcagaggatgtggtcagtgctgtttttgtacatcttgagctctgctcactctgtctgcgagtaggttttgcgttttgcttgttggctgtcttgttgggggtgggaaaatggctgcccataccttctgccaggtgggcaaccccaaagacttttcttttccagcgcacgtgtaggagcagcctgttggaggcatgtgcccatgctttagactgtcacccaggtcatgaggactgtggtttgaagagtgtgctcactcaactggctagggggtgagggcactgtgtttgacaactgtcaaggactagcgaggttcccagatgaaagggggtgatataccagaagaagaggcatgggtgggaaatgtgcatagcagtcccagccaatagctatcactgcctaccacatagtgctacaaaacagcgtaagaattattcattgagtgcaaatgttgggggagtgggggttaaacagagacctattctaagtgattcttgactgtttgtccaggtgtcattccttgttataggagttttaaaagcagaaaattctcaactgctcattcacctaatactccatgaaagtatatattcttgagtgtcctaagtgtgtgtcctttgaaatgtttatatatataaaagatattttaagtataaaatcttaaatatcttttacacttaaaatatcttttatattttatatttgtgcttttataagttaaaaaatgtgatcaccatgaccctctacttggatgtgacaaccctccattttataaaataattaccgttgaatcaaaatttttgctcaacgtatgctatccagttacctgtcaaagccaactgaatgaatgatgaaaaggttcagatcaaaagcaactggcttaacttcacggaggttttcatgctttaatttaaaatgtgtctatgtctaactgattatctctcacattttataaagaaatattgacgttctgtaaagtatgtagtgacctcacttctggctgtgtgggcaggtttcactgcaggcctctgaagcattgatattcctgtaacctttgaggcaagatgtgtgtgtagtgtattaatgagctgattgaagtgatgtacagtaatttcatccttgggtaaaaacagatgtgaaagattctgttttaatatttaatcagcctccaagcctctgttggcttgtttaagttgacctgacagcattatacctggaaacactttgaattaaactctgagtgcttgaccttgttcaaacagttgtaatttaataaggctgctgtcttggtggagatagtgtcgctaataggcaaatcctcttctgactgggattgttctgtttgtgagtgctggggttggagagattcagagattctcatcagtttgtggggaggaactgggatttgaagaagtaaaaacaaatctaaattaagaaagtgtcttttagaagatctttaaaaacttttattttaatttttagacatatagaagtaatgtttttaatgtcattttgattaggctcattttggttgaaaggaatggaaaatcatttgttaaaaagagagctggaaacttgtcagaaatcaaagaagtgctaggaggactgcatactcactctggctctccttgtcctcctgtccacccatccctccacccacccatccgtccctgcttttctctgtctctgtcttgggcgtcctctgcacgatagcctgtctgctctctcctttcttctgttggctccctcaatctctgtttcgtgtacttctctctagcccatagctcctctttactaatcatttctgttctctcatgccatcagtttgcaggggctcttggtagtttcagctctcttgtatcctttcagctctaagtcttgctgtcaacaagtttgtttccttgttcacgttccagttagctgggtctgaatggctctcctgatcttttttgtgccatatccaaattgcccatgctttccaaagcagggggagctgtggacaagacagtttttggcttgaaggaaagattagttggggcaaataccatgatttgcccaatataaatgcgtgtagatatatattttctggttctaagagtaccatatgcttactggggaaaaatgagaaaatttaaaaaactaataaaaatacagttaaaatctcctgtaaaccgactattcaaatagctaaactactttggtgtatttcctctgattttttttgcttgtttatacataaacataatatacacagtaaacatcccaaaattttagaatcatagtggtaacattttaaagatcttcatatctacttgttaccagtggcatctgtaggaatactctggctgtcaggcctacgttaaaaactgtggtaatttggtgtgaatcttttattaattctttccttttgactaatattaagtgtggcatcattaatcatgttatattatcttcactttggcttgcattacttatcaactcctttgagaagagttaatattattttcatatttcacagtacttgacatattgtctcatacttagtagatgttcagtatttggtctatagtttctgcttaatttttatgaaacttgatttctgtgagtgggcaaaatacattcataaggttccagctcagaagaaggaaaaagtaacaatgtatagcactaagaatattggaaaacaacggggaaatatgctaattgcttttaaacgaacagggattttggcagtattgtggtatatgaagggtctcctgtaggaagctgactggctcttctcttttaggagccctcccagggtggcattcattaccttgtcggattgccatggtccagtgtgggtagcagaatcctgagagacccccagtgaccctgccctttgtattatatcttcccctttgagtataggtggaacctatgcatgtttgagatatcacccatgattctactaccttgcttggcagagggagactatccaggtgggctgatctaatcacacaagccccttagaaaccatattctccagcaggtgggaagaaagagtgatctgaagcatgaataggatttgatgttgactgcgaagatgaaagggaccatgtgccaagcaatgtgggtagcttctagaaactgagcatggtccccagctggcagccagcaaagaaacagggacctcagtcctacaaccgctaggaaccgaattattctaacaacctaaacgagcttggaggtgaatttttcctaagagctcatggataagagcagagtctggctgacaccttgattttggctctgtgagaccctaagcagagaacccagctgagcctgactggatttctgacccactcagctgtgagctcatgaatgggtgttgttttaagccactgtttgtggcagtaagactaatatagtccagggtctggctaattcttagctttgtcagattttaacttgattttctgtggatatcaagggtggagctgtctctcaggggtagacttacaggagcctagctgaagaaactggtgtatggaatcaggaggccagcatatttatttgtttatttacctgaaaagtaaatgttccagggactgagatactccatgtggatggtcagtacattatctcccttaaggcagacctgtgtaggaggccaggtgtgtattagtgagcatggcatccaaaccatgagttagatgagcacagtttccatggcatcaaacacctgtctcacaacaaggatggccttctctatgtctggacaatgtttagatgggtactgccagcttctctggagactcactgtattagttttcaattacagtgtaacacataaccacaagttagcagcttaaaacaatgaaagtatattatctcacagtttctatgagtccaggcacaggtaactgggtcccctgctcaaggactcaccaggctgaaatcaaaatgtcagcagggatgtggtctcataagctcactggttgttggtggaattcagtgccttatggttgtaagactgaggtcctcttctcccagaggctgccctgccacatggccctctctacaatgtagcattttgcttcttcaaggtcagctggaaaatctcccacacacttttggtctttacaatctctgaccccctttaaaagcctagccctgtgtatgctcatagggagagattgtacaggggcccaaatcttgagggcattgtaaaattctgctcccacacttgctttcccctcagcatcccttgatgactggccagctttctgtttgacacctcctttctttagctgtgttaatatatccagtctttgggagtccaggcttggttggatatttcacatctctgaagtgactacatagttcttctcacattcagtatgtattgatttttaaaatttaaatttgtgaacttaatcacacctttatttctgtgatcctcccccctttagtaactggggaatgggatgaggaggaatttcttcatcttagtttcagaagtcttcacagcagtggcctctatttgtagtttgatggtctaaggagtttagattgttagagaacttctaccttcactagaattttgaagacgtaacttaaaattacacttactagatgtagaaactggggagacaaaatgagttatttgcacagttaaattattagctagtgaagaagggtttttatttcttatttatatcctgccttctctcaatatgatgatgtccagtaaaaggcatagatagtctaaaagtgaagcaattaaaaatttttctattatgggaatttgacagtacaaaaaaacacagatgtccttgcccattaaagtgaacaccaaggagtccaaaatattttcatgaggtagttttttgccattgcctgtcagttgtgagagatcattgcctcaggccacagcgactaggtgtgtggcagagttaacctgcctgctctctagggaaaccgtcaagaaatgggcaataaattaataagtagaaagtgttctctgagctccaggcagttgttgattgactgatggaaaaggtaggcggtaggctaatagacgatgacatccaaattcagctgttgcctctcagctgaacccaaccctgggcttctgctgccttttgctccttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctgaaaaataggaaaaaatatagcaataactgattaatagaaaaccataggattggctgggcacagtatctcacacctgaaatcccagcactttgggaggccgaggcaggtggatcacctgaggtcaggagttcgagaccagcctgaccaacatggtaaaaccccgtctccactaaaaatacaaaaactagctggacgtggtggtgcactcctgtaatcccagctactcaggaggctgaggcaggataattgcttgaactcaggaggcaaaggttgtggtgagccaagatcgtgccactgcactccagcctgggtgatagggactccacctcaaaaaaaaaatcttttttttccctttttatatttttgtctggatcctaaatattgggacatttgaaagatgtgcatatttagtttaagcaaattctggtggatttggttggttctctctgtagtaagagtagagaagaatggtagatgtgaaaagaatatattctgaaaagaatatgggataagagaaaatcaagaaggcaagaaaataatcatttccacccttttatctactttgaaatcaccacttttcttactttggtcttctgtttcctctataaactatgcttaagagaccagagtgagcagacttcttcgtgaaaacctgagcttgggagttgggatggtttacagtcttggcttcagtccacttttctgacttaacacccagacccctttccggctaaatttattgtctcctgttcctgctgggcctttctggagcgtccgcctctggagtgccctctgctcttgaggtcccaaactgcccatcccacacctacctggtcacagctttgcagtttaagtccccacatgccagtgactgcttcctttctggacccctttactgcatttcagcagtgctgtcaatccttcctttaaatttatgtcactggtttgtagggctcattcttccagcctgcagacgtcagttgagattccactgtgatcaaagcaggatatttaagttctgcagcgggtgggctgcaagtggtagaaatagttattttcttgccttcctgaatttctcttgttccattctcttttcaggatacattcctttcactacagagagttgtctgctctcactacaaacagaaccagccaaacccaccacgatttgcttagacataatgggcaagaactttcagaacatttggaacttttcagaacattgggtggtcttagagactagccagtacagaaatctcttgagagggtgttactgtgttccttctggacacctccagtttctgatttggctgtcctgtttgtcagcagtacatccttcatattgagcccaaaacctccattcattctggtgttcttcagtgcagtcacactgcttcgtgatggcttttcttcagtgcagtcatttgcttcatgtgacttttcttttttctttttctttttctttttctttttttctgaggcagagtttcactgttgttgcccaggctggagtgcaatggcatggtctcggctcactgcaacctcctctgcctcctgggttcaagcaattctcctacctcagcttcccaagtagctgggattacaagtgcccaccactatgcccgcctaatttttgtatttttagtagagacagggtttcacaatgttggccaggctggtctcaaactcttgacctcaggtgatgcatctgtcttggcctcccaaagtgctgggattacaggcgtgagccactgcacccagccatgatggcttttccaatgcaaaacattgcaatagttattcctttgaaccttataaaattactgattgttatgttttgaatatttgtcccctccaaaacttacattgaaatgtaatccccaatgtggcagtattgagaggtggagtctttaagaggtgattggatcaccagggctttgccttcatgaatggactaatccattcatggattactagattaatgagttaattcatgaattaatggactgatgggttatcatgggagtggacctggtggctttataagaagagtatgagagacctgaaccagcacattcagcttcttgccatgtgatgccctgcactaccatgagattctgcagattcttccccaccagtgggaaggtcccaccagatgtgaggcccctcgaacttggacttctcagtcttcataactataagaaataagttcctggccaggcacagtggctcatgcctgtaatcgcggcactttgggaggccgaggcgggcagatcacgaggtcaagagattgaaaccatcctggccaaagtggtgaaactccatctctactgaaaatgcaaaaattagctgggcatggtgctgcgtgcctgtagtcccagctactcgggaggctgatgcagaatcgcttgaacctgggaggcggaggttgcagtgagccgaaattgcactccagcctgggcaacagagccagaccccgtctcaaaaaaaaaaaaaaaaaagaaagagaaataaactccttttctttataagttgcctagtttcaggcattctgttataagcaatagaaaatgaactaagacactgatattcaattgttttagcctataaaaatgggaattttatgtgggtcaacctagtatattccccctgattctctgcttttccagctcatatacttttgtagtttagataacctcctgtcagttaaatcatgatataagttcttcgttccttttttttcctttatagtttaaaaattattttatgtgtatctttcctctggtagccccctgagacttgcttactgcaagcccacatgctgccttgactccttttccctgaatcaactgtgaattgttccgcagcttctctcctttttggtctctgaaccaaggtttcttaattagagtatccacaagtctatatgtgaagaggttgagggaaaagtaaccactggggacatgagaaatctgaaaagtaatagttagaaatggccatcttagccttattaaaatgtaagtaaggccgtgtatggtggctcacacctgtaatcccagcacgagaggccaaggtgggcagatcaccttaggtcaggagttcgagactagccttgccacaatggcgaaaccccatctctactaaaaatacaaaaattagctgggcgtggtggcatttgcctgtaatcccagctacttgggaggctgaggcaggagactcgcttgaacctgggaggtgaaggttgcagtgagctgagatcgcatcattgtactccagcctgggagacagagcaagacaacatctctaaataaataaataaatataatgtaaggcaaggccttttcccttatatctattttagggtttacccttgtgtatacagaaaaattgttccctgtccagcttattatgggctggatagcaggcagaactcctcagtttgggttagcattgcattaacagaactgccacatctttctggataatcttcctttgtgcataagctccaggctcaccttctctgcctcacagctgtgcgctggtttcccttagctttcttgggttctggatggatactggccttctgggtgagaagggggttctttggcaaaaggtgtttttgacataatttaggaccttcttaagttctacagcagacctaaatttcttcccccaagttctttgtctatatagagtactcagcactcattacccattctcagttctgaaggaaatcttatggagcagttgtagtatttatagggtaagcagagtgcccagtttccatgccccaccccaaaccatttagatttcagtcatgtatgtcaagggaggagtgagtacatttttgtggtcagctgcctcttcttttccctaacattctcactttttcatctttcctgctttcttgaggtcatttatctattgaataggatgtctattgaaaggaaaaacctcccctaatcgcctttaaactaatatttcttactgggcatggtggatcacctgaggttgacagtttgagaccagcctggccaacatggagaagccccatctctactaaaaaaaaaaaaaaaaaaatattagccaggcgtggtggcgcatgcctgtaatcccagctatttgggaggctaaggcaggagagtcgcttgaacccaggaggcggaggttgcggtgagccaagatcgtgccattgccctccagcctgggcaacaagagcgaaactccatctcaaaaaataactaaactaatatttctcttttctcaataataatggcatgaaaagaattttttctgtgccttttcaaaatcccaataccccctcgtggcatttcctatgttgaagttttcaacagccttatcaggaggagaaatgagcttaatttttgagttttagtgcttagggactctgtcttggcttctagagataacttcactgtgggcacccacaaataatatgtttaattttttttctaaaccttttgctgatggtcattgcaatattttcttgattttaatttcctgagttttcttctttcacattttttcttttttttttggtgatatttttccatattccattatctgcatccttctcactctccctgatttttcaaacatcatggactacagatctgcaacctccctggtaattcctcttgggtttgagaggaagtttgtcaagtactggaaacttgaacttgtataaaacagatgtcaccactcattttaatggaagaaggcatggagtaaatacagatagcacataacagctatatgcattctcttaaatttctttcccgatcttgggcttgaggtatttttatctaatctagtctacccttgccattttcaagatctttttctttgatacttgatagagaagtgtcttctgtatttttcttccttcttggaagaatatattttaaaaaatgtattttgagattgagtattttgtgaaacatctttcctctaaaatcctcaaagtaactttgcctctctttgatttctatgggtagtccagcggagagtgatacacataaggatatttcataaacactgcttgcattcctctgggatttgtgctcctagatgacagcatatatatgcatgtgattctgtgtgtgtaaacatgctttaaaaaatttattgaacatagttttcagctgtcttcactcactttaaaccttagtctactttctttttcttttttttttttttttgagactaagtattgctctgtagcccaggctggagtgcagtggcgcagtctcaactcactgcaacctcctccaggttcaaacgattctcctgcctcagcttcctgagtagctgggattatagttgcccaccaccatgcctggctaattttttgtatttttagtagagacagggtttcaccatgttggccaggctggtctcaaactcctgacctcaagtgatccgcctgcttcagcctcccaaagtgctgggattacaggtgtgagccactgtgcccagcctttagtctactttctgtttttacaattccatgccatgtttattgaaagcatgttgttggtttcttttgatgcctcccctgtctttcttctcatcatgattttaaaaattaatactttgtaatatttgagatttttatatctatgtcaagttaacttttcctgaaaaatattttgatacattttctagaatgttagtgtattgtgtttataacatgggggaaaatgtactgtttcatttttaaatttatttttatttatttttgttattattattttttaagaaacagggtcttgctctgttgctcaggctggagagcagtggcatgatcctggactcaaacaatcttcccacctcagctttctgagtagctaggactacatgcgtatgccaccatgcccacctaatttttaatttttttgtagagacagagttttactatattgtccagactggttttgacctcctgggctcaagggatcttcccaccttggcctcctaaagtgttaggattataggtgtgagttatcacagccaggtgcaataagtgtttatgattaatttaaaagcagatgctgtgcttttcaaaaattatgctcaattttttttttaatattacaaaggacttttagactggcttcctcctaaacatttcttcaactcctatcaagttcagtctgcaaatatcctaatttctaggttgtttgggaatgttaattgattgtctcatgtatgtatgtatgtatgtatgtatggatagacagatagatgaaggttgaaggatggatggatagattaaatggatggatggatagatagatagatagatagatagatagatagatagaaagatagatgaaggttgaagggtagggctggaggaggaattccagctttccagtagattttctatcaagcagtcattcatatatataacttcctatattgttagccaaagttcatccatgtctcttgtatttagctctctgtctgtattgtagaaagcttatttattatgtgagcattttgctttctcctatccctccctctttctttaacatcagttataacagctgtgaatacagtttataatatgagcagccatattcagtttttaggctttcaaaatcacaaatacaaaggaggatataatacatagtcctatattttatacaaattgggacacttttcttcatttcttatttcgtggcattgcctaactatagtcaagctaatgacccatgtagatgtagtgttgtacctggtgtccgtgtccctgtgaatgtgtcatgttgtgctggcctgattccccaacatcagccccagggagccagcagctggagcagctgtcatcttgtgaaagcagagtgtccttgttgctattgattgggttgttcagtcaattgcaaaaaagtggatctaactgtcaatggtagttatatgataatcctggagataaataagtgtcaagtgaagtattacttgaatttaggacttgaagagagagaaaggggtatgagtagttggaggggaagatttgctatgacaagctattattcagtgtggttattttgtatgacaggtaagtctacaggtatcttttgttagataaatcagaaattaagcattccctttgtaaactccaaacaagattttgaaacaccatggtccccccttatccacctccaagatctccagtggatgtctgaaaccactgatagtactgaagtctctatatattatgtttttcccctgtatgtaatacatacctgtgataaagtttaatttataaattaggcacaggaagaaattaacaaaaataagtaagaatagaacagttataactatatgttctattaaaagttatgtgaatttgttttctctctctctcaaaatatcctgttgtgctgtgtgttcacccatttttgagctgccgttgactgtggataacaaaccacagaaagtgaaacttcacataaagggggactactgtattctcataatgttaattgcttctagaattcacaaggattgaattcaacttgaatcttgctaaagaagtactttattattcgatgttagtccagcaacaacttatagtgtagaaatttgcccttttgagggtgaatacacaaaggggaaagaaaacttgtgtgcccacggtccactaacagataagcttctggaggccaggagtaaaccgccctgcaggggagccatctcccagggtttccccagcagagagctgtgcccagtgccggggtctcatgcttacctatttctctgtgccagtatagtagacctgttttcaagcctagcatgagccttaagtattactggctgggagtggtggctcatgcctgtaatcctagcactttgggagggtgaggcaggcggattgcctgagctcaggagtttgagaccagcctgggcaacatggtgaaaccctgtctctactaaaatacaaaaaattagccgggcgtggtggcgggcacctgtagtcccagctacttgggaggctgaggtaggagaattgcttgaacccaggaggcagacattgcagtgggctgagatcacgccagtgcactccagcctgggtgacagagcgagactctgtctcccacaaaaaaaagaaaaaaaaaaaaagtattacttatttagtaagtccatagcattttgttcacacagtgtatcattgtgcttttctgtttcaaagtgtaattatttaatctagaaattttaagtcctgtgacagaaaacaaatgctgttctcacaaaatatgagaaatcaaattccatcttattatttaaattaattcttttttaactgaagaattgttatgtgggtagctttcaacataattttttcaatattagatgcttataactaatgtggatttagttaattcgatgtttatcacatttaattcttatttactacaaaggttaaagcaattttatttcttctggaaacttttaggatcttgtgagtgagggacgtcagccaaaattggcaactttttcaagcaactggctcaagaaattaggaatttctctaataatgagccatcgttttttgaattcaacaatttaaaagggctgcatagttaggatatgattccagtttcccctcagtgcaaattgatatttttttctgttgacacattctactttgttttcgaagactagtttatagtgttcttttaaaagcaaagaaaatatctttaaaaatcccagctttttggctgggtgcggtggcttcatgcctgtgatcctagcactttgggaggctggggtgggaggatcactggaggccaggagtttgagaccagtctgggcaacacaggcactccatctctttaaaataaaaaataaaaaaataaaaatagccaggcttggtggcccacacttgtagtcccagctactcgggatgctgaggcaggaggattgctggagctcagggattcaaggttgtagtgagctatgattgagccactgcactttagcttgggcaatggagcaaaaccttgtttcctttaaaaaaaaaatttattaaaacatgctcttactttggcaaaaatatatgtttcttcatagtgatgataatcataatgatacattattactatatgcagcttataagaatcagttgtctaatgtatccgtgtaagtttctctgtggttttaagaatcattccataggctgataaatgcatactctcttcaccccattgcacatccagcattctgaatttttctcacttccttgaatatgccatgttccatgcacttgtagatcttccatcacagaaggtgcctcatctgtccagaacccctgccatacctctgctccctttgtctagctaacgctcactcatcctttagatcccagtgaaatgtcacttgcatctgggaggactttctgactaggttctgagcttcctttgcattctgtttttcattgacataatgacatcacatttattagtattgtctcattgtaaaccccagtaaggcaggaactgtatctctctgtatccccaacactaccacagtgcctggtgcatgttaaattgcagttaatatttctagaatgaaagagtgcttccatccttcatcatccgtctttcagataaagaagtatctagttacctttgtcttaaattaaaacaatttcaaaaggttgcatgtgctggtggaccagttgaaatccacagctcccatattgctgctcattgccactgttattgatgccctggagatgatttaaaattcagttatgttgcttgtgatggtggtatttaaaaatctataattttggctgggcgtggtggctcatacctataatcccagctctttgggaggccaaggcaggtggatcacaaggtcaggagtttgagaatagcctggccaacagagaaaccccgcctctactaataatacaaaaattagccggtcgtggtggtgtgcacctgcaatcccagctactcaggaggctgaggcaggagaattgcttgaacccggaggcggaggttgcagtgagctgagattgtgacactgcactccagcctgggcgatagagcaagactctatcttgaagaaaataaaaaataaataaataaaatctataatttttatactcatgtgctattatagtgaccctgtgagacatcataatgccttaatgatagcttgtcttgtttttactttcacttacatctatagttccaaatgttttattgaattgtgctttatttgataattcatagttgtaaactgacctcatcccatatttgtatttttacaatctcaacagttttatcagggacatatttttatattctgtagcataatacagtgccttctgtagagcttagtttcatgtgcagtgatgtgtcagaatgaaatatctgcccagtggtattgaatttcatgtattatgatttacatattcttctgtgtatcaactggttttatattacccagagaatgcttatggtggtggttgagagttgtgtattgctattgactgtacgggccatagacatatttgtaggtatattaaatttgctttgtacttctcacacaattgatttggtgggcattcttcttaattatacttgatgggtgcatacataaattcattcttggttaaaaaaattcagatagtgtagatatggcagtggttcctttaatccctccaattatttatttaccttatatatctgggaactttgtataaaaactaaacactggcctggcacggtggctcatgcctgtcatcccagctctttgggaggcccaggcgggtggatgtcttgagctcaggagtttgagaacagcctgggcaaaatgtggcaaaaccctgtctctacaaaaaaatacaaaagtgacccaagtgtggtggtgcacacctgcagtcccaggtactcgggaggctgaggtgggaggattgcttgagcctgggaagtggaggctgcagtgaactgagatcacaccactgccctttggcctgggtgacaggccgagaccctgtctcaaaaaacctgaacacttctttgttatgtttctacaatttgacacaataattcaagtcagccaagcactttaaaaattattttgaaataattttagatttataggaaagttgtcaaaatagggtagagttaattatatataaccttatgcagtttccctgataaccacttatataaccatagcacagttataaaaaaattatcaggaaattcactggtataataccattaactaaactgtggccctttttgactttcaccggtttttcacctcctgtatttttctctgttccaggatcccatccaggatcccacattaccttcagttgttgtttctcctttatttcctgcaatctattaaagattctaatcctttctttgtctttcatgacttcagcaaacagttttagttggatgcttagtatataccagtcactgagattggtgcttgagggaagggagataaatgaatggatgagacatggcccttacctaatgaggtgagccaacacatagacaagtaatgctaaaacaatgtagtgcctttaaaaggcctttgtactatctccctagagaagagagagttgctgactcactgaataacagtgttgaggcagcattttcagaagaaatgacattgatctgggtcttaaagaatggggaaacttttccttgtggagaaatggagtggaagaggagttcatcatggacaggcaggggcatttggcatgaaagtgtgaaagactggcttgtttgcagactggcaaatcacttgataggaatggagcatagggtatgtgaagaacacagtgaggcatgaaactagaagagtagttacaaagctaccttttttcattactttttattaataaatatatcctcatatttgtagggtaagttttggcttaaattttttttaaatctcattattcatacttaatgagcatttaattgtaatcagtgtttctagttttaaactgcacaacattaagattgttactgtacttttggaaagaaaaagagaacaaataattatgcttagctgttgcaatagcatctaatagcatttaaattctgttaataaagaatatgaatttattctgtaatgcctattgggcacctattatatggcaggcactgtttgaggtgagagagatatagcagcaaagaaaagagaaaaactcctgctcttgttctaatatattctagtggtcctagttgcaatatgtttgaactaacatggtagttcagtcaacaagtcaaatgttaactgcctagcatgttatctagatgctcagcagatttttaaaaaatgaatagatatatgactgggtcttgaaggagtaaaagaatttcaggctgggcacggtggctcatgcctgtaatcacagcactttgggagaccaaggcaggcggataacctaaggtcaggagttcaggaccagcctggcccaacatggtgaaaccttgtcttttcaaaaaatacaaaaattagccaggtgtggtggtgggcccttgtaatcccagctacttgggaggctgaggcaggaaaattgcttgaacccgggaggcagaggttgcagtgagctgagattgtgctgttgcactccaacctgggtgacaagagtgaaactccatctcaaaaaagaaaagaatttcattgagtagaggtttgctggcatgagtaatttttgtttatttcatatgcattcttggagattattcttaggtagttagaacacattgaagatattatttcattgtcttttgacttcaattgtcaatctcaggtaattgtcttttccctggctgtctttaaaaatattttctctgggccgtgcatggtggctcacgcttgtaatcctagcactttgggaggctgaggcaggtggatcaccagaggtcaggagttcaagaccagcctggacaacatagcaaaaccccatctctactaaaaatatattaaaaaaatgggccaggcgtggtggcaggtgcctgtaatcccagctacttgggaggctaaagcaggagaattacctgaacctggggcatggaggttgcagtgagccaagatcgcaccacttcactccagcctgggcaaaagagcaaaactccatatctatctatctatatatatatatttttttcctctggttcttatttttgaagtttttgtacaatatatcaagatacagatttatttttatttattctgctaggtatctgaggattggtattttagttcaggaaaattcgcagccattatttcttcacatactgtttgtgcttcatcctctttttttgtttgtttttttgagatgaagtcttgctctgtcatccaggctggagtgcagtggcgtgatcatggctccactgcaacctctgcctcctgggttcaagctatcctcccacctcagcctcccgagcagctgggattacaggtgtgctccaccacgccctgctaatttttaaatttttttagtagagatgggatttcatcatgttggccaggctggtcttgaactcctgatctcaggcgatccgcccacctaggcctcccaaagtgctgggattaacaggcatgagccaccatacccagcctgcttcatcctcttttaatctcattttcagtctccaattaaacatatgttaaaatttctcactgtatgctctatgcctttaccctcttttgtgtttttcttctttttctgagctgtactcagtttactgattctctcttcaactatatctaatctgtcattagttatagaatttttatttagttatcaaatttgtcatcttttatagtttatagttccctgttaaaaccatttagtttggtttttatctctttgaatatagttaatgtcattgtttttaaatctttacctgtattttcaatatctgaagttcctgtgggtcttcttctgtagtttcttgtttctgctggttctgactcatggtgtttgttttttcctgtgcctgattacatcctggatgttgtttttgaaaaagtatttatagaaataatttgaggttgagaattttcatatgcttctgccttctgcctaggttgtacagtttaaggcctcctcaagccaagttcatgattcaggtattgtgagttgggctgcaaacctgtgtgcaggctggttacttacagttcactttccctctttgaagccccatttacaataggggttggtatccttgagaccccacctgcttaggctccagatgtcaccagaatttcacatcagctttatttcctggattggtaaatataaccccatgataaaagtggctctgagtgttgggtttacctcttggacttcctgtcctcaccaatttttgaccgaaaattcaaccctatgttgttagctctttgaattacctattctgtcctcattagaagagtgcctccagcatttattgcctaaacatgacagctgagtatttttagtttgattttttttttaacatttgctaataatacgttttcaaccagatcataaactttgtggataaggtccctgtctgctatttctttacccttctcatatagcatttaatacaatgataggtggataattggttctcttggccagttgactgatcaaggggcaattctccaaactctggtgatttctccttttcgttcgtaagactgcttttataccccaacaaagaaacttgttataatttaatagtggctgtgtccatttttcttttcttctctgctgttccatcccaaggtgggatggccccaattagactaaccactgaaaccctgggcataaaatggtgcccagggagcttttcttcatattaatttgtgtgtactctaaaaggaaagattatttggcttgctcataaatccaaaattttggtgatgaaaatatgtttataattatttcttttgagcttgatttgttgtggattttttcctttattttggtttaagatcaaatggtttcctaatgtgtatgggtcactgtagtctaaatttttttttttttttttttttttgagatggagttttgcccttgttgcccaggctggagttaaatggcgagatcttgcctcactgcaacctccacctcctggcttcaagtgattctcctgcctcatcctcctgagtagctgggattacagatgcctgccaccacgcccagctaattttgtatttttagtagagacaagattttatcatgttggccaggccggtctggaactcctgacctcaggtgatccgcctgccttgaactcccaaagtgctgggattataggcatgagccaccgtgcctggcctctaaatatttttaaagtatagatgtttttaaacttgtagctcctgagtgtgaactgtcccttgctgttttttgggcatctatcaaggcatttgttctaaccactgagtaagaaggacatcactaagggggttgtagctatacctttcttctttttatctttaattaacatgcattgactgcctggtatgttagaaacagacctgcctattacagtctcattcccttccatactcatccttgcttgtgtggctacctcccaagctaggactgcaagacccttatcactcctgcttactattggtttttgtgtccttttggcaattttctagtggctgcttgaactattggttgtcagattgacctgatttgtttcacttgtaaacaaaatgcttaagccactgttgatttttgtgacagctcagttgcttagagcaaggtgttaatgagacatcggtcataggtccaggctctgggttgactggtaagctttgctctggcccatggccacagaccctgactcccccttgccagctgtcttgcacatgtagctatggctcattatggggacacagcagggggtggagataagacaaggcaaatctgtcatctctgccagaaaagacaactcctactgataggtcagtaaccttttcattggaagaacagcacgttagtattagcttctgtagatgtgtctaactgagtctttttcttaaaataactcatgtgattgtatgggttgtctgcagcaagtttagaatactgctcacattttaaagcatgtttgaatataaggatggctttttagtttgtgaagattattgtccttaatcagggattcttaatatcattctctaaagtagaaaagtgagctttagaagtcaaatttgataaagctctagaaaacaactgcaaaattgctgttataaagaaacctgtcaaatttaggaagtgccctccaggagcccttcatcccaaccaatcctctcctaaaagaaaggaaaaaaagaagaaagatggctaggtagatggaatagtgatcagaaaaaaagaacttttctagaaaagcataccagtgtgctctttaccagagcattttagcaggtaatattttacaaaggacccagcagataattgggcaggttttttctttaggaacttagtgttgatggcctgaattaatctgactaggaatttagacatttcttcatgatatattttgagtccatagatgatctgattctaatgtgacttcagtttttaacttacatagcgttaagcaaaaggatgtgtgtgtatgtatgtgtgtttgttttacatcctaaaggtattacaggccccatggtaaactttttggctcaagtgaatccagagtttggtatatgtaacctccagtggtggttcatgaacaaacacttcatttctgtagtcatatttttttttaaagaataaaagtgagccaggtttaaaacttgttaagaaaataatagcacaggtgatacacagatgaagcaaaattgccgtggatggtctgggaatgcctgaggattgagaaacactggctgaattatacactgtggcagaagaaattataggcccttagaaacaggtagaggttattggaaagattcaagcacctaatgtttagttagaaggtaagtaagctggtttcttaagttcttgtttatttattgggtgtgggctcaggataagttagtttgaaatagatcttagagaagtaaatgcaagacaactttatcaatgagtcatgggcaaacaattctattattagaagtagtatagaaaaggagtaggagaagtagaagggaggaagtctagtattcattcatttatttattcattaattcagccactatttcttgagcacctggtgtatgtcaggcactgttgtaggcactggggacacagcagggagcaaaacagacaagtctctgccctcatgaaattcatttacatcctaatgggaagagacaaataatgtaagtgagtatatagcatgtcagctgtgagaaatgctatggagaaaaataaagcagagtaagggaattaaggagtgatgggatggggaggcattgcttttttaaatagtttgatgaggaaagacctctctaagaaagtgacatttaacttgacttctgagggaagtgagggagcattccaggcatggagaaggagtgttctagatggagggaacagcaagtgcaaagagcccttgacatgtctgagaaacagataagaggccagtgtggctggcgtggagagagaggggagagtcgtcaagtagtaagaggtgagagcagatgggaggaaggtctcagcacaggtcaggcctctggctttgctgagagtgatggatgcctttgcagggttttgaacagaggaggcacatgatttgacttaacgttttaacaagctgtttcctgctgctgtgttgagaataagctgtaggcggcaccaaggtggcagctgggagggtattgccacaaaacaagcaagagatatgatggtttaggccagtggtaatggtggagagtgtgagaagaggacagattctggatgtattttgaagtagagcccgcagaatttgttgatgaacttgatgcagagtgttagaaaaagagaagacttcaaggttattggcctgaataactggaaggatggagttatctatcactgagataaacagaggtaacagaagtaaaggggagagatggccatggtagaaggtggattacacctttaaatttttaaaacatatttttatttaaaatagccctcactccctggcccagtgcacacaaaggacctgatttgcttttaccctgagtttgtcactgtagatatcctggaatacttcgttaaaaactataaataaagtggccataatacggctcattttgttcagattctaaaaaaaaattccttcataagcagttggcttccaaatagcaatgcatgctgtcagtttggtgactaattgggttagaggttaatagcaaggcagtcctataaacatcaacgggagtggtgtatccaaatgaaagcttgcattaggcaacaattcaaagaatgagaatgactaaataccatgttacaagccaagtgaattatattaagagttttaactttgagagaaagggacgttacccctgaaataactatcttagttggatcttccctacttaatactcatagttgggttgtaaaaatgtaaaggttaccatcaaaacagcacttcttaaccatgaaattgactaactttgtaaaattagaaattctgttacttacttcctactatgctgattggacattccttcttttgccaaaagaacagaaagttggattttgtgccttctagccaagagaaccacacacctctctctctgtagaccagctaaatgcttcctactgctcggtgatgaaatcagatcatggaatcagtcagtttgctatactgaattttttttttttcagctgtgttctaattgaacctttggggaataaactaattcttaacatctgaaagtttaaaggtctgatactagaatttatggggtggtagaggagaccttttagtctctgtatccaaaccaaaatgtaaatttacttttatttattttttattttttgagaaggagtctcgcttaggctggagtgcagtgacatgatctcggctcactgcaacctctgcctcccgggttcaagcaattctccctacctcagcctcccaattagctgggattacaggtgctcttcaccacgtctggctaatttttgtattatttagtagagacagggttttgccatgttggccaggctggtcttgaactcctgacctcacgtgatccgcccacctcagcctccaaaagtgctgggattacaggcgtgagccactgagcctggccaatttctttttttattgtgggataatcattccatacttctccctcctctctagtccccacccccacccccctttttccccccacaagtgaagatgatttcctgtgctggtctaggattagttttgttacagtctgtctttataagaacatttcttttccataatccagaagcattttgtaaaacctatgcctggaaattgagtcactttttattgcttagattttcttcacagaaaaacataggttctgttggatgagtatttgttgtgaaagcaaattattaaggggtgaaaattgtctatacaagttgatgtataggaggatatctgaactggattagttgctcttttatctgtgttttcaaagctctttaatagtaactcttataacacttataacagtgttatcactattgtttgggcatcattccattctgctagactgggaattcttttataatacagtgcctgataggcatccattcattccttgaaataatgtattgagtgctcattatgtgcttgaaatagagtgtgtgcaggagccagagcagtcggcagaacagatgcagcttgtgtcgcatgtgcgtacagcccatggcagggtggggggcaggggacccagcaaacaagatacagataactgcgcagtacagtgccaatatgcacaggaacagtgactgtcccctacctacataaatgcatagacctcatatgtgtattgtgaatcctctataattgttgaatttgactttgaaattaaacacttgatattttagactagtcaaaaatgggatatgttattattttaataaaaacaccattgtatccagccgggcacagtggctcacgcctataatcctagcactttgggaagccgaggcgggcagatcacctgaggtcaggagttcaagaccagcttggccaacatggcaaaaccccgtctctactaaaaatacaaaaattagctgggtgtggtggcacacgcctgtaatcccagctacttgggaggctgaggcaggataatcacttgaaccctggaggcctaggttgcagtgagtcgagattgcaccactgcactccagcctgggcaacagactgagactctgtctcaaaaaacaacaacgacaacaaaaataacaccactgtatccatattgcctacaggagaaaatgcagatcacttattttatgtatgtgttgaatcattttaaataacctgacggaggtcctttcttgggcccatgcctctgcacatgttgggcatgttgtagttgtcgttactagcaagacacacctaccctttaagaccagtctaaatgccaccttgttccctccatgtaatctcagaacttctttaagggcaaggaccaaattacgtctgtgaaaccctagagtttgatctaccacttcacgtggaggcatgggacagaggttttgttaatgagtgaatgtatccatttaataagttccttcttcagtacactcttgagacctattctggctttcccaggaaacagctgaaggagtgacctccaatcaagtcagctctgtgtcaatccttcattttcggatgttttttcttccttttctcacagggtcataaggatcaaatgtaataatgatgtaagagttaagcgtattcaataaagggaggcagtggaatcatcacaatgttgatcatcacaatcaacattattattactgcaccactatagttccttgtaatacacagtccagaaatattatcacaaaatctcactgaggatgtcattgttctgggtttgacctagatgttgatgtaatgaacagttctctatcagttagtgtgttggcctagcacaggtgcttgacaaaggccctattcagacttctgtgcattacttcaaacccctccctttgctcccatagtatagtaatgaattaggagtcatatcttttgactggcaagggactgcctaaagcagatccctgcagattggggcctcactgtttctgtgggtataaagaacctctcgggagagcctgaatgatcaggagatctgaactggggagccatcggcccagcaggaggtgcctctgcttggccaaccagagcctgctgcaagaaaccttttttttttttttttttttggttctgacaggcttgttggggaaattgaaaatctcctgtttgaaagccagataatttaaaatcctttctgattcagaatctcagcaagtagtgaagggctaggttattgattgtgggaaatggggcagcctcaaagggctctgggctatctcagtaccccatctccctcacccctcacgcttcctcaggtttctctctcatgctagcttggaatggatggtgtatttcctacccagttgcctttgtttataagcatccaccaccgctgcagtagggtcaggaaactggcaatttcctcagtgatccttgcccttgaaccctatctcctccagcctaggaagtattcagaccaagtactcatgtgtgactctccagtgcttctggatagagaagaccctctgagctgccctaaactcgcaagagaatactccacaggcttatgtaagccaaaccagatcatgagtcagacatctgaactcatcaacaaaaagtgctccaggaaaaagaaatggtctacctggcatattattgtttgaaaatttattttaagtcaatcctctatttcattaagggtaataataatcagtctacaatgcaaaactcagggaaaagtaaatttcattttgtatagctgtaatataacattttttactctgctcaaaattcttgaaattgttaatccaactctataaattaggatatttgagtaaagtaagtatccattgtttgactgtgccagaagcaggagttaactttttctttctctggttaaaattatcacttacttgatagctaagtaattttttgaaagtctcttatatcctgatggtacactaaggccctgaagagagtataaaggtgcaagattcagtcccctctctcaagaaactagcagtatgattggatggataagatttatgcatgtgaaacagagaatgctagatattttgggtggtaatcaagtgtaatagtatgtgattttagttataagcgtgatgagtgcaggaagggagatgaaaaataaataatatttagtgaactccactactacagaataaatatttataatattttctatttcatcaggaagaacaatttgaatcactggcttaatcactggtggggggcctggtttttagtctgtgtcttaaaattcttagctcacttatgtcatttgtcatatgaactttttggagaaagaaatatttagtttttatacgtagtttttaagactttaaaggttttataacccttttcttgaaaaattaagacatcaaatcagcaagtatttattgagcactgaccttggtctgaggcatgtacattttttagtttttagacaacagtaaagtaaccctgaaataatgcctacaatgactttgataagtacaagatggtgagttgaggttttagccaagaacctttgttttctcttgctgaatatttttctctttggttatgtggtagaatttagagctcaaaatgttcagactgtttctgtccaagtagcattctcaccatggtcaagatttgtttagtgatttataattaattagataaaagtacgcaaagctttttgggctttgtactgggaagtgctacataagactgcgtggtagtggtttgggcctcattgcttatatctgacatagcttccaggatttatgcctgtctccaccaagattcttttcctctttaatgaatttgaaagtaactatttatcttgaatgaaattagttttttctacctagagctgggagtttcattttctaatcagaatgtctgatttatttatgtgcctgccaaaaaaatcccaaaatactggccgcctgagttctggctaatgtttccaggtgctctgttttgaaaacattccgtttctaccctgtattacagatgctcttgcgtacagtgaaatcttgtgataaatatttttcagtgaacataaagtatttaaaaaataaacgaatggcagtattagtcatacattgaccgaatgccaccagtgtattatttatcatcatatacaggacatagtccaagacacaatccttatttagtggttctgtagtctaattatctgtaaaatggtcatgtcaaaaaaaaccaaggaaccatcagttgggcaaattgtttgcaattatgattaataacttgctgtggttaattaatgggaaaatatatatggcttctaacgggctgctagtttcacatatataagcagtgtgtattcaaaagaatttataccaagtaattatttattactacattctaggtttaattcttacttgtgttttcaagccattcaaggaaagtgagcacaagtaggtgatagccaccattctttatggtaatattatttaggtcttaaaatcagtcagaggcaaattatattatttgaaaaatgattgcttttcacagactaaattatccttatattatttttccttttttttttttttttgaggcttagtctcaagctgttgcccaggctggagtacagtggcataatctcggctcacctcaacctctacctcctgggttcaagcgattctcctgcctcagcctccagagtagctgggattacaggcacctgccgccatacctggctaattttttttgtatttttagtagagatggggtttcaccatgttggtcaggctggtcccgaactcctggcctcaggtaatccacccacttcggcctcccagagtgttgggattatagctgtgagccactgtgcccagcctctttttttattattttaacatactttgaaaatacttaatacctatctagaccagacctcttttgtaccagatatatttattttggtctagagaaaatgaagacaacgtattaaagttgggtgtacccaatgcaaatatctgtttaaattcagtgttcagattggagttttgtgggcaaaatatttaacaagaattgtatttaacttacctgtgattttgactcacatagacttagctgaaatgaaacatagtaagtacagatttaaatatgtatgtatttgagtagaaatctttccacctgtatgcaggtagttttttgtaataatgaaagaaaatgatttcattttagttcttttatttgatgtgacaggaattgattggttagtcaagaaagttggttaaaagcagggaataaaaatgtgcatccactctctgtatgtgttaaatatttattaatattttaacttttgaaatatatcatgtatgtgtatttgccacttgtttgatggaggttccaggcttttctttgagcatgggttggagtttccatcttttttctcaataattttcagtctcagtttctttaaaggcatttgtgaagaatctgaatgtagagttcttctagattgtaatttccccctcgaccttttacagtttttttcactgttaatcaaatccatctaaaagcattcagctacgtgtccatagagactgcaagtctttttttgtgcacatagcttattggatgttggataacaatatttaattaaggttcttgattatagtaacaggcataactgacacaaacaggtttgagaacaagcgcaattaagcacagaactcaacagatggaagcagaagtgcctgggtgccctagacaatagcttatttgccactagtgttgaggattttgtggggaagtaaagagctctgggctggtgaggctggtaggggcggtcagtgaagagggctttgttttccttgtctgaggcttgtctccaactgaaaggcctcctttcctctcctgtccctgggtgaatctttgctcaagtcccctgtattttcatcacagccatcacccctcccctttccacccgtgtctactgccttttcctctgcagtttgtttctgaactgactgaaatctctgtcagtctccgtgttaaaattcccttcaagactcacctccttagagaagccctgtggatggactatacccagcttttacccttctattgatgatttttgatccatctatatagctttaatgaaataaaacttcaaaaacctgaattttagtattaaatatgctgccactcatataataagtgttcaagtatttctttagccatgtgaacttacattagaaaataatgaaattcttgagatggttaatttttaaagctgtttaccatacctttcttttaaaagggatggaagatctggccttttagaatatgatttgccagccttccatagagtatactattgaagaaagcaagaaatgtgtgtttgcgggattctgttgctcaggctggagtgcagtggctcaagcttggctcactgcaacctccgcctcctgggttcaagcgattcttctacctcagcctccccgagtagctgggattacaggcgcatgccaccacgcctggctaatttttgtatttttagtagagacagagttttgccatgttggccaggctggtctcaaactcccgatctcaagtaatcctcctgtgttggcctcccaaagtgctgggattacaggcgtgagccaccacgcccggctgaaagcatgttcttgaatgtatatgtgtgttctctccccatgtgatttgtaaaccctccaaggcttgggtctcacattctcattctttgaatcttttatggcataatggatagagagtctgtgctcttgtccagttgaagtaagtagtgggcgctcaaaaaatgttgattggccaaaatatctacatcaagtacagtaacgactcatagctgctaacatcttttgagcaattaacatgcaccgtacactgtcttaagcactttatatatgtcacctcatgtaattcccacaacaactatagttatccccatttcacagatgtagaaactaaaacttagaggagtcagatacttggccaagatcacacgaccagaaaatgatagagctaggaaagtagagacaggaatcaaactcagtgagtctgattccagattctgcagccttgactcctttaccccatgcctggtggatcagtaacctttcagaaaatttttgtaacaagttctgaaaacatagatgaaataggaattttcccttaaactaaatggaaaactaaaaaagtaatcattagatggagcagatttctgctaaatgggaagtcttgggagggcctcattagaaaatgagggaatggggggccaagcatggtatcatctgctacccagtgagaaaaatatcgacttacgctgtgaacccttttattttatacatgtaccacctgaatgaggatggtatatttatgagctctcacatctcattgctgggtgacatcagggagctcttttttgggatagctgtccatctgttctcctccaggaactcctggatccgtgccactgccacttggctgctggcttcaaaagagcctgaatcagtgagttgcttacaccagggagaacaaacaggctcttctccttaaagtgtctgtaattatatgaccataattagaaataaaaccttctttatacaatttgagctcacaaggaaagactttctgcatacacaccattttttcctgtgttgtttcacatgctgatcaggaaacaggtcacttggcctaatcatccaccattgaatagagtggagagagccagattccccacaaccccctaggttgctgcatgtccttgaggtagtctcctgccctctctaaacttttgtagcattatgtatgatgaggttagtatagccatgtaggaaatgttatgagaaccttagtgcctgctattagttccttggaaaaaagagatagcctagacataagtaactcatgagtagagactaccagttttggtgcagttagggttttgagtttgttatcattttaaacagtaacattgtttgggtggttctgtggtgttcgaagagatgtaggtcaccgttgatttttgcctgatgggttttgagtttgagtagatgttgattaattcatgagccccaactgcaagatagatgttcagtattgattagacacatgcccctggttgtatgctgttaaaaaggagtcagctgtgaaatactcctaaagctaaatcaataaactactaaagttgttttcccccaataagtgtttgtattttatccctttaagtgagaaaggctgttaggaatttctgtgatctggccgttaagaaaactagctgtatctttggaacaatatgctcatatgttagccattccaggtgagtataaattattcatatatacatcttcgctgaggataacaatggcttaatggaggagaaaacacaacaattttctttgaaaaattgtctttattctggtgacataggtagacaactttgctgagagcacacctaagtactaataaaaatttcaagggattgagacatacatcctcacagagtaagagtttaaaaatgcctacaattggccgggtgcggtggcttatgcctgtaatcctagcactttgggaggccgaggcgggcagatcgcctgagttgaagagtttgagaccagcctggccagcatgatgaaaccctgtctctacaaaaaatagaaaaattagctgggcgtggtggcaggtacctataatcccagctacttggcaggctgaggcaggagaatcgcttgaacctgggaggcggaggttgcagtgagccgagatcgcaccattgcactccagcctgggcaacagggcaagactccgtctccaaaaaaaaaaaaaaaaaaagcctacaatccctgttataatcatggccagtaattgctaagcaattagctgtactattagaatgagtcactaccaagttttctgccttggcaatttttttctgaaaactttattgaatttagaacaatttctggatgactttttttctctcaacatacagacattgaccagtcttcataaaatccactaaactcagcaccttctaggcttgtctttctcctttccttgccttctcttccaaattcctagaatgggccgtgtgaacttcctgactgaccatgccggctgcatcctttaaatctttacagtggcttctcatttccttttgcatctactctggctgttcacgccacacatcagaatcgatcaccagcaggctctggagtctcatttccctcatctgctgcgtgggtctccagtcttctccctccattcattcattttcagttcctctaggcagcaccttcttccttgagccttttctcaagagctatcgttttcttagactctgttctctttttttccttctgttccaagtaactcttgaaatcccgtcttccctaaaagtctttttgaattaactagagagttgctgatgggctcttcttcattcaggtctgacaataatagacctcccatagcttcttcctctaacatccaccccaattatactcacctctgcttcccacttccaaaatgacccttgctcttgacttatatctactgacagaatcccttccctgtcctggttactgtttctaatttagagatccacacaggggtgaagaaagcaggttctgagatgaactgcctgagttggattctgagctctgtcacttgcagctattctctttgggcccattattgaacaatttctgtgctgcacaatttctgtgcctcagcaagactcgagcgtaacactgacctcacaggattgttgaaataatttaagcacttaacacagtacatggcatgtagtaaacatgcaataaacatttactgttatttattaattggagagaatgaagagcacacccgatattatacatatgtacatacatttacatacacacacatatatatatatacacacatctgtgtactcatatatagctacataatttggaaaagtatttagaattatatcttttttagaaaatgaaaacaatatatctttttttttcattttttttttgagacagagtctcgctatgatgcccagaccagagtgcaatggcatgcgccaccatgcctgactaatttgtaaaactttttgttgagacgagatcttgctatgttgttgctcaggctggtcttgaactcctggcttcaagcagtcctcctgcctcagcctcccaaactgctgggattacaggcatgagccacagagcctggccaaaaatacatctttttaaatgcaaaacataccaagtaaaattgaacaaaatcctggctggtgaggcaagagtttaaacaagggaggagaagcactgtaccagttgtttctacacacctatgaaagatctggcatgaatggcttggtctttgtttaaaagcatagagcgccatgtgtatgtatggacacttgcatgcttttgagtgatgatgattagggtgagagattttccttaggaaagtttcaaaagtagtcacttatctactcagttttaagtaaatagaaaataattttttttaaaaggatagtgtgaggaagtaattttgtttttaaaaggatagtgtgaagaacaccctaaaaatgtttgtagaagaggattattcagataaatctgtagtgagtttatgcatacctcctttaaaatctatctttagtacagccattatttagcatgaagatgatttgttgcttttgttttccaagttttgttgcttgtaaataatctgttaagaaattttgggccgggtgcggtggctcttccctgtaatcccagcactttgggaggccaaggcaggcgaatcatgaggtcaggagtttgagaccagcctggccaacatggtgaaaccctgtctctaccaaaaatacaaaaaaattagccgggcatggtggcaggcgcctgtaatcccagctactcgggaggctgaggcaggagaatcacttgaacccaggaggcagaggttgcagtgagccaagactgcgccactgcactccagcctggcagacagagtaagactccatctcaaaaaaaaaaaaaaagaaattttgtaaaacatgctgaagggaatcctgggccaacaggtatttttaaaaaataatatactattcccaggtttatgttgattatttatatttgaaaatgttgattgtagatactggtagattactttcaaattaatcatttattcctaattgaccagggatgagtgagatgtttatttagaaaacaaataattttagataggaaaattgaatctttaaaaaataatggtgatttaatatatcaatgtgtggtttttgtgtgtatgtgtgtaatattggagcatccaggagtgtgcggtgtgtatatgaccttatttttctactgtatcttagaggttgccacttccatgggtataaaacttaattggatttctcgatttttattttgtttatgcacttttacaacttatgtcattttaggttgtttattaatgccagttttgtataataaaattattagagaagttatgaaggaggatggcatgagaagggtggccagagtttcactgtttcatgtttgtaactttcattccttttgaagtgtacatttattcctagtgatagaaattgatgttttctttggcaagcattagaagcaagtctatgtgaaattatgtaatgtctgaaaagttatattcatgattaattggcctatccaagaatggtatttgtgtgtgtggaataaggcgatcatgctttttatttggcagtgagttaaagtgcccctgctcagatcgggttactccacagggctttttgactgagaattgtatgtttagcttaatctctaaaaagcgtaaaatgtagcttcggagccaaatatgctggaattcatattgtaaccaaagttaatcttaggataactttaaaagcaagctgttccactctcacaccttagttaacaaataaagccaagaggtttaaaacaacatcatcatcataatagtctctgaaagcacagccagccttcattacccaaagctagactgtctgcactgtattgtcaaatattaatttaaaatcttcttgaccttgacctaaactgataagttataatgatctatttatttatccaagctggactttacaggaatgagaaaaagaaggtctttaaataattgcctcctcctgtgtgtcagcttgagaaattatgacctccattactaatattacagtgatggtgaacttgatagataactagagacagggtaatgcaatggttctaaagcctgactaccctgggaaagttaacttcagtttctcatgtgtaaatggagataatgttacctctcttcttgcattttaatcattaactaaatgcttaccagaatatctgttcatagtaagtgctcttaaatgtttgcttttgctcttaaattattgctgtcgctgcttctgctattactgctatgataactactactaactactgcaattgctgtcaccagcaaccactacaattactattattccagttcctcctccagggctttcactatagggtttaactctttggtgaatcctcatatcgaaatggtaaaacataccccaaacataccccagagttgaatatgagttgttttggcaagatcatagctcactgtaacttcaaactcctgggctcaagccatcctccctcctcagcctcccagagtgctggaattatagacatgagccgcctcacctggctgtttcgttgttgttgttgtcgttgttgtttttaaatgacctgtattcttaccattcaaaaatgtggaccgcaggtcagcaacatcaatctaacctgggagcttgtttgaaatgcaggattttggccccatcctagaaccactgtatcagaatctgcattttaacaggacgttaaaagatgttctgtttgcatattaaagtttaagaagcactgatctacaccatcctccccaccccccagctatcccccaaatcatcttaatgatttagggatggctccctacatagactaccagcagtatcatgtgaaccaggccctcaaagtagatagggcaggtaattggaaagaagagaagatgaagtggaaaaagagaagaaagaagggagagaggaagaaaaaccatgcctgacaatactgatattttacctgtatagatgggtctatgcttactgattattctttgagtctttagattattctttgttgtgacactgaatatggaaaggaatactgaaattttatgggctggtaaaaaatttccatgcccttgtaatttccaatgatctgtcaaacatacatggagagtttcctgttaactcatggtctcagataaattatgcaccctttattttctctttttttgtgagacagagtctcactctgtcacacaggctggagtgcaatggcacaatctcggctcactgcaacctctgcctcctgggttcaagcaattctcgtgcctcagcctcctgagtagctgagattacaggtgcccgcctctatacctggctaatttttgtaattttagtagagacagggtttcaccatgttggccaggctggtctcgaactcctgacctcaggtgatctgctcacctcgacctcccagagtgttgggattacaggtgtgagctgccgtgcccagcccctttattttcttaacacacacacacacacacacacacacaccagtccccttgtattcatgctttagttatctttttagtgtgaagatggtgtgcttcctatgctgatcctgcaagatcactggataggagagcagagtttggtttactactctctgcctgtttggtagtgcttctactgctgtttgagttgattcttccaatgtaaaggctgtgaggatgtatgggaacactaatctttgatattaactatgaattatgggtgcttgtggaggtacagctttatttgtattatcacatactaggggctaaggaaaattacccctttttgacttaaaatatgaccttggagtctgtttttttgttgttgttgtttatttgttttttgagatggagtctctgttgcccaggctggagtgcagtggcacaatcttggctcactgcaacctctgcctcctgggttccaatgattcttctgcctctgcctcccaagtagctgggactataggtgtgcgccaccacgaccggctaatttttgtatttttagtagagacggggtctcaccatattggccaggctggtctcaaacttctgaccttgtgattcgcccgcctcggcctcccaaagtgctgggattacaggcgtgagccactgtgcccagctggagtctattttttaaagttgatttgagaaacaagtttatggtatgattttaaacaactaaattggcaaagggaagaaatttgataaaatatgttggaagtgtgcagtgatacaacctgtcgcaatttaaaatgcctgtttccgttacccagcaatttcacttgtaagagtttatcctatagatgtatttgcacatggaagtgtacatgtgtacatttttatgtagaaacaaatgagtagtaataacatcaatattaattaggatgagactgggactgggttgagaagttgagactgctgcaacttctttttttaaggtgttatttgtgtgtgtgtgtcggggctattaatgaaagtgtcttaatgaatctggttacaataactacctttggagacaggatttgaaggtgttagaccttcaaatgtgagggacacttactttctattaaaatgtctttgtactgtgtggaattttttaagaaaaccatgtgtatgtatacattaaaatcaacaaaatagtgctcacattgaggagtttaaagctatatgtactcgtaattacacttacatatttttcccctttttttttttttttgagacagagtctcgctctgttgcccaggctggagtacagtggtgccatctcagctcactgcaacctccacctcctgggttcaagtgattcgcctgcctcagcctcctgagtagctgggactacaggcacgtgccaccatgctgggctaatttttgtatttttagtagagatggggtttcaccatgttggtccgcctggtcttgaactcttgacctcgtgattcgcccgcctcagcctcccagagtgttgggattacaggcgtgagtcaccgtgcccggcctttgttttttttttttttctttctttaaagagaagttcttgctctgtcgcccaggctggagtgcagttatgcagtcagctcattgtaacttcaaaattctgggcttcaagcaatcctcccacctcagtctatccatagctaggactacaggtgtgcaccactgcacccagcctttcccccatttttaaaacatgtttatgtacctaagctcatttatgcctttgagtccctaaattaggtggtaggcaacaaattcttggtcgcctcactgctctgtattttctctccaactccttagactcttcttagcataaactgtccagtgttctgatgattcagagctgtgattccaaagttggggtaccatcagaattcttgaagattggttacaaattaagattcctaagttaatcccagacctattgagtcaaagtctgtgggtgagacttaggcatgtgcattttttttagaagatccatgggtaattcatcagaatcaggttaagattcttcgcacctggttaaaaagcactgtctggagagcaattcttggtaggaatcttcttctactaaaatgccagctgttatctgtgcacccgcacccccagatcccaggagtgatgtgcatgtggcatatcaccaggctgaatgagcagatcctctacatccaaggaaaagggaatgttattctgaatagtcacatggttctctctattgaattagaataataatggtaatgacagagatgataccaaataagatgtctatgttagaaccaacattttctgccaataacattacaagtaaataggagaaatcaagagttggtcctttgaaacatcaataaaatttagaaatctgtagctagactaatgaaaaagaaaaagacaaattatcagtaacaggaatgggagaggagatagcattgaagacataataaggataataaaggaatattatgagcaagtttatgctaaaaaattgggtaactgagatgaaatcagaatttgtggaaagcccaaattaccaccaacacacaaacacacacacatgcatgcacacatgcacaatctgaataggtctatagcgagcaaagaaattcggttcataatttaaaacttagctacaaagaaaactccagactcagacaactgacaacataatagtgatgaaatctatcaaatctttaacaatacaaatgttaaattctttcagaaaatagaagaggagggaacacatcccatttcactttatgagattggctttgctttcatactaaaactagccaaaaactggccgggtgccacggctgtaatcccagcactttgggaggccgaggcgggcagatcacttgaggtcaggagttcaagagttcaagaccagcctggccaacatggcgaaaccccatctctactaaaaatacaaaaattagccaggcatggtgtcaggtgcctgtaatcccagctactcaggaggctgaggcaagagaatcacttgaacctgggaggcggaggttgcagtgagctgagaccatgccagtgcactctggcctcggcgacagagtgagattttgtctcaagaaataaaataaaaacgaaacaaagactttgcaagaaaaggaaactatggaacattcctcatgaacataaacacagatttttttaattagcaaattaatccagaaatatataaaaaggataatacattttgagttttacctagaaaagggtttatccagaaatacagttgatttaatattgtgacatgaagcaaatatatgatcatcttattaagataaggaaaaacaatcaacaaagctaaaaatccattaatgatataaactcttagcaaactaggaatagaagaaacttttgtcaacctgataaaagacatttataaaaagccatatctggctgggcatggtggctcatacttgtaatcccagcactttgggaggcggaggcaagcagatcacctgaggtcaggagttcgagaccagcctgaccaaaatggagaaaccctatcgctactaaaagtacaaaattagctgggcatggtggcacaagcctgtaatcccagctactcgggaggccgattcaggagaatcgcttgaacccgggaggtggaggttgcagtgagccgagatcgtgccattgcactccagcctaggcaacaagagcgaaactccatcgcaaaaaaaaaaaaaaaaaaaaaaaaaaagccatagctaatgtcattattaacagtgaaagactaaatactttcttcctaaggtcagaaataagacaagaatatccccctttcatcatttctattcagcattgtactggagtttctagccagtgtaacaaggtatgaaaaagaaatgaaagtttgggaggaagaataataatgtctcttacagtattaagtattaatgataatactaatactatgtcttacagcatgcagattgagaggaagaactaatagtgtctctagttttagaccatatggtcatctatatcaaaaatcctaaggaatctttaagacagctgctaaaactagagaggatttagcagggtcctaggatacaaaatgattatttttaaagttgcatttctatatggtagcaatgaagattcagaacctgaaataacatttacaatagcatcaaatactatgaaaatatatacagataaagttagacaaaatataggcaaagcctgtaccccaaaaactgtaaagcattattgaaagaaattaaggcagccctaagtaaatggagaagtgtcccatgttcatagaagactgataatgttacaatgttagtacttcccaaactgatttatagagtcaaaacaagcccagtaaagatcccaaaaagctttttcctaaaaattgggacgttgatgaacaaatttgtgacaaaggatttgaaatagtttaaaaattttttgaaaaagaacaacaaagttgaaggactagttcagtgggaagaagaaaatctcaacaaatgatcctggaataactggttatacatatgggaaaaaaaatgaaccttgacccttatctcacctcatacacaaaaatatactaaaaatggtgtatagacatataaaaaactaaaactataaaactagaagaaaatgtaggataaaaccattgcaactttgggatagataaaaatttcttagattgaacacaaaaagtagaaaaatcgataaatggcactttatcaaaattagaaactgaagtttttccaaaagaaattggtaggaaaatggaaaggcaagccacaaactgggagaaaatattcacaacacttatatcttatgtgttatatacatacatacaaaggacctgtatccagtatatgtaaggaactcttacaactgaataagacaaacaacccaattaaacaatgggtgttacaggttgtgttcctcaggaagcagctacggataaagctcaggtatgggatatttagtaagggatgcccttggtattaaggcttttgagaaggagggcaacaaagcagcactggatggagggagatgttgagcagtgatgcggcccaggaacagccttggatgacttcacagattgctctgaagctggactggaccttcggaatttccctgagttgggccctgatggtgcctttttatttctgcatcactcagtaatgtgggcctgtatcactggatatggcccatgctaggaaggatatatcttggccagtgtgattctctgcagcttgaggcaatccctggagggagtgatagctgaatactgatttcccatagcattcttagctgagacaataggtttttcactgaaagaggatctgacaatatattgcagtgaccattgtaatgggcaaaagattctaacagaaactgtacaaaagaagatatatgaatggccattaagcacatgaacaacgtcattagtcatcaaggatatgcaaattaggccgggcgcggtggctcacgcctgtaatccagcactttgggaggtcaaggcgggtggatcacgaggtcaagagatcgagaccatcctggctaaaacggtgaaaccccgtctctactaaatatacaaaaaattagccgggcgtagtggcaggcgcctgtgttcccagctactcgggaagctgaggcaggagaatggcgtgagcccagggggcggagcttgcagtgagccgagatcgcgccactgcactccagcccgggcgacagagcgagactccgtctcaaaaaaaaaaaaaaaaaaaaaaaaaggatatgcatattaaaatcacaatgagacacttccatacactcgaatggccaaaattaaaaacactgataataccataccaagtgcaactggaagtgtaaaatggcacaagcaccttggaaaacactttgcctgtttcttataaaataaacctacacttaaccgtatgcctagcagttccactcctaggtatttacccaagataaatgaaaacatgtacacaaaaaagacttgcatgaatgttcatatgaagtttattcatagagccccaaactgtaaagaactcagatgtctgtcaacaggtaaatggataaacaaatttagatatattcataaaatgaggcactgagtaacattaaacggaataatctactcacacatgcaacaacatggatgaatctcaaaaatatgtcaagtgtaaggttaagtcataaaagagtacggattgtatgatttcatatatgaaattttataacaggcgaaactaatctgtcgtgacagaaagcagatgagtgattgcctgggtctgaaaagggaagagaatgcaggaaggaacattttggggtgatgagagggatttatgtcttaattgttaggattattacatggatgtatcatttgcccaaacttttgtttttttcttttttttgagacggagtctcactctgtcatccaggctggagtgcagtggtgcatcttggctcactgcaacctccgcctcctgggttcgggagattcttctgcctcacctgagtgagggattacagccaccacacccagctaatttttgtatttttaatagagacggggtctcaccatgtttatcaggctggtctccaactcctgagctcaagtgatccgcccgcctcagcctcccaaagtgctgggattacaggcatgagccactgtgcccgccggcctgcccaaactttaaaaggttgcgtgtttttgcaaataaattacacctcaatgtaattatacttaagtaaaggtgagttgttttttaaagtaaaacttttcataatggagattattttcatgaaggatattgactgcacttttaattttcttttcttataatgtcttcatctgattttggtatcagaattatgctggcttcataaaaccaattgagaaatatttcctcctcctctattttctgaaatagatcgtgtaaaattggcattgtgttcttaaatctttgaaataattcaccgctaaagtcatctgggcctggtagttcttctagggaggttttaaataatgaatcattttctgtagtagatttagggttattcagattttctgtttcttcttgggttagttttgataattttgtctatcagtgaagtccatttcttatctctgttgtctaatttattggcataaagttgttaataatatttcccattattttaccgtcttaatggtctgtagttatatctctactttacttcctgatattggtgatttgcattttctttttcttaatcagtctagttaggggtttctaatgaagttaaacatatacccatctaatgacccaggtgttccactcctaggtatttaatcaagagaaatgaaagcacatattctaaaaaataatgttcatagtgatttttaaaattttagccctgaacttaaaacaaatgctaatcaattatagagagaacaaataaaattttgtatatttacagtaaaatactactcagtgataaaaattaatgaaatactgacagatacaacaatgtatgtgaatctcaaaaatattgtggagagtggaagaagccctacataaaaaaatcatagtgtctgagtccacttaaatgaagttccagaacagacttaatcaaatcgtggtggtagaaatcagatttgtgattgcttaggaagggaagtggaaaggtatgagcagggaactagcaggagagaactttctgggttatggagtggtctgtattttgataggggtgtgggttaccagtgtatgcatttatttaaagctcatcaaactgtacatttcattgtatgtaaaatatggctcaacttagttgtacaacaacgggaatgtagtcagtgccacttaactgtatgcttaaagatggttaaaatggtaaattttatgttatttatattttgccacaattgaaaaaaaaactgtttgtttgttatatttggttttttttgagacgagtcttactgtgtcgcccaggctggagttcagtggcacgatcttggctcactacaacctccaccccctgagttcaagcagttctgcctcagcctccctagtagctgggattacagccgtgtgctaccacgcccagctaatttttgtatttttaatagagatggggttttgccatgttggccaggctggtctcgaactcaagtgatctgcccgccttggcctcccaaaaaagtactggaattatagggatgagccaccgctcccggctgaaaaaacaaaaacaaacaaactaaaaacaacaactgtaaatgggaagatgtgaaggttctaaatgtgcaaacatttaaaatgtgtatttccccccataaccgtgtgctgttctattattatttatttaccatttatatgctaaagtaagaatgtaatttagaaactgataagaaagtaccaagtatgagaaatgttacattcgtatattcaacagatattaatcaaacatctactgtgtgtataattctttattatgtatagtaattaagataaaccaaacaaggatcttccaagagctcaccatgtactaagctatttaagatatgcaaaattttaccaatgtcaccaaaataatgggctttttcttccttcttcctacagtttacccttagtaggctttctactgtttacccttagtaggctttctactgtttaccctagtaaagatctaggaaattaagtttaaaatcttcaccctcaggggaaggccttgtcatgcctggtatttcttctcctggctttgctgcagcttgtattagtatgcagggaggggctttggttttgtgcagttccaacacaccttacagtgaagctgtggtgccagggagcagagtctgtccaagataatgctcatgtaagtgcccagggtggtgcctggcctaaagcataaggagatttagaaactctgccacaaagggggtctaagaatgagtcttctgctacacagaattaactccaaaaaacaaggtcagagctcttgaccttcaggtagtaattatccacataatcctcttttcctactgcttatgaatactgcaattgaaagggtcagaggtagtctgaaagcagggaaaacaaaagaagtcaggagcatggaaattctgcacaccagatggtttgtgtgcccagagggcaattgagaattaagtgtagtaatggaattacactacttttattggttctatgaggacaagcacttggagtaccaattatattctgcgtggcatactttgggtgctgagtaaatattagtaacttattgaatagcacataacatctcaactgccatgtaaatctctgtgagtgcagggcattgtcagaggtggtggtgataatattattgagaaagtgactagtgtctgacttttctagcttgttaataaccacttacctatgtcccatctcctcattctactttcctgtttggatctaattacattcagttgagttgcctgtgtctcctgagcagttagagcaggtttctcttggcaggattaatagtaagaatgtctacattcagttcacagtgtgcctaggcagtgttttgtagcaccatatctaaattaaaatgaatgccttggggcaactgcagaagctcctagctgcctctagctgatacacagctctactaagtatcagctcttgcttgtgtttcttgtaaattgttgttatgcctatcctttaatctatgcattactattttgcttctagcctcacttggaaaacattcccaagtcatagagatgaattacaatacagaatttctaccaatggcagtacttgcattgttttcagaatctagtgcccaggttttcctactgtttttcttgccgtctttaagacagaatttctatttacatccttgtcgatttttgtatccctaaataaattatagtcttgaagtctggacctgctccagtgaaggttcctacagcactgaagttgggaatcactagagaggcactttgttaattttctttttaaaaaggaatgactaaaggtttgtgacacttgaatgtaagttgattttaaaattccatttttctaaatccagagtagggtttatattgctaatatcatgatatgcttgccaaagagaatagtttgtaaatcctaaacagacttcctgtaaccatgtgttgaatttccagctgtgttgaatcagactttggtccctcttcagaagataaatccaatacctgcagtttctaatggcagaagtggaggagagaagtccctgtccagataagaaactgaaggccctggggcaagcaattgtttcatgaatgtcctttccccagccccgcgccccacccctaagaaatttgtaggcttcatctaccaggaaaacaaaacaaaacaaaacaaaaaaaacaagaaaacacacaccacacaaatgagatgctattgttaaatgcagtatgtaggattagatttgtttccttccaatagaatcactttccttaatcagcacttttataaatggcacacctgcctgattagaacaagttctagactacaggatacagtgtgagcatttcaattaagtccacacaattaaaaactgttgtggttgatgttcttagaaagactttccttctctcgtcttactccgttatggctaagctttattattttatacttctgagtcagcctttgatcatgggactttcccactgtgtggtcatttatatctttttttgtttctaaatgatttctttaaatgaaaaaagaagcgatgtattttagggatatatgtagggatgcttttgaatatttttattttattagattttcctgcttccttactgtcacttaaaatatggagaaccctcatcctgtgacaaggaggtaaaaatacagcagtcacattcaagatctccatacattaacaataataaatccttttgccctgagtaatacagatacttaatccacagagctcggggggatgatatagtgctccctcacagaaccaattacccacagagaagtataatgagcaggggaggtgatacaataaaaatctatatagggagagtagaattatgatgacagtgttgcctgtgtaaagtcttatagtaagtatatctccaattatcttttagaaaaaaattgtttggtgtctacttatgtccaattcatgatgaaattgcaagaatagccatggaataaaacaaaagggtacaggagtatagagaaaatggcgatagacttgtcgtaaacagagttctgttctaccccgaaggatgtgaagtagacccagggctgctctgagggagtgctgggcatgaacctccctgcagaggaatggctgtcctgaccacagttactgttactgcagatgcagacgggaacaaaataacgctctggaaaaaaaataagatgatttagatcatcacaggaaatccctacttttagagttagtgtgtttccgaagaccatatctgaagcagattgctgtgagggaaaatcctgagtgtgcatgatctctatcctaattaggagcaaacttgatctgttccgacagacatcagttgcataagtgggttaagtggcaagaaataaagtctagttctttattaggtaagtgtcaaatagagttctgaagtagcaaacaaaaaaaccttagtaacaacaggaagcagttttcagcctttgttgcagtgccatcagttgtgaagtttgtggacaataattcattaccagtaataaggcaccaaaatttgtaaaatatttttcttttaaaaatagaccataacaggccagacatggtagctcattcctgtaattccagcaccagccgaggcaggtggatcacttgagcccaggcgttcgagatcagcctgggcaacatggtgaaacctcatctctaccaaaaataaaaaaaaaattagccagtctcaaaagcttgtctcaaaataaattgaatagattgaaatgaaaattaaatttaaaaagactaaaccgatacatagtcttgttataattttgttaccattgcagtgtattcattttacttggcttccttctttttctttttttttttttaatttttaatttttgtttcttttgagacagaatcttgctctgttgcccaggctggagtgcagtggcatgatcttggcttgctgcaacctccctctcccgggttcaagtgattctactgcctcagcctccagagtagctgggactacaggtgcgcaccaccatgcccagctcatttttgtattttttaagtagagacggggtttcaccatgttggccaggctggtctagaactcttggcctcaaatgatctgcctgccttgtcctcccaaagtgctgggattataggtgtgagccaccacgcccagcgaccctttttttttttcttttaataaccttgtattctttgtagagatggaaagaaatagcgggactggggagggggagtgccaccacaactaggtgctggcaactggtcatgctccaaatctgtcttatatagtgactattacaacctatagtgactattactaagcaagccctaatagtgaatactgggcagataattttcctcccaactgattttaaaattttggtcccgtcttgtcagtttatgcccagggaagtatatagcaaacataaatgtcgtttattatgtgtgtcagagtaaaaaaggtttcagattagacaatggtggaacccaccttgccattgatggtttctttacatgtcgtgtttgtggtcattgaggatatacatgaaaataaaagacagttgacaatattttgggacctgtgaattggagaaaccagttcccaacttcagagcagtttattcatttgtttattcatttattcaatagatacacttttgaagctggggctacagcaatgaacagtctctgccatcatgatggaacttatggtttagtaagggaaacagacaaataaatgatatgcaatatttcagataatggtcagtgcaatgaagaaaaataaagccaaggtatggagccgagcacagtggctcacatctgtaatcccagcactttgggaggccgaggtgggtggattgcttgagcttaggagttcgagatggcctgggaaatgttgcgagacccccatctctatgaaaagttaaaaaattagctgggcgtggtagtgcgccagtatagtcccagctacttgggaggctgaggcgggaggatcacttgagcccctggagatcgagctggagtgagctttgatcacgcccccgctctccatcctgggtgacaaagtgagtggtgtctcctaaaaaaaaaaggtatggagattctggagtggtgccagtggagtacagtttcagagagggatggtcagggacagcctttctgctgaggtatatcaagctccaagtgaaaggagggacaaaccatggggaaagccagagagtgaagggcttggcatcagcaggctggaagttcctccatctcactagttaggtgaccttagagaggtggccttgtagcatggcattcgtatttgggacttgggaaaagcattgtggtaaacagcaaagcattacctaaacttcacatttcagtacagtgtaacaagggagagcaaactaaagagacacagaagagtctttttttttttttaagatggagtttcattcttgttgcccaggctggagtataatggcgcggtcttggctcactgcaacctccgcctcccgggttcaagtgattcttctgcctcagcctcctgagtagctgggattacaggcaccatgcctggctaatttttttttttttttttttttttttgtatttttagtagagccgaggtttcaccatgttggccaggctggtctcgaactcctgacctcaggtgatctgcccacctcggcctcccaaagtgtggggattacaagcgtaagccaccgtgcccagccagtattcatctttgcttgcttttgtagtattattcatttaagattttgtatttgtttatgcttttctttctccaacatctttttcttttcatttagtttgagttttccttttattaaatagttgcaggccttttggctctcagtggaggcattttctactctgttcctgtactccctgattaattcattctttaaaaaaatcctctaagattaatattcatcatgggggctcagaaaatgaaagtcttttatagagtaattctaaactccagaataattcatttgttctgatgcttattaaggacttgaagttgtttgtttgctctttctgtttttatagccaaataaaattttgcaatactcataataatatttgagtagaactttgtagtttacaaaatactttccacactcactcacatttgaactttaacaacccgagagctagacaacacagacactattgtgcacttttacagatgaggaaacctgaggcttagagagcagcgtttaaatctgggtctttctgtggtgcaaatatgaacatatgaatgaaaaatgctgaactgttttgtttttaacacttgggattactaaaatggtatgtttttttaagcagtctcatgaaagatgtagatgacttaagaagtatggatctataggggattatggagagagagggttatatgtccctgatcattgtgaacagataccatggaaatggcttacaaaacccctttttgtgtcattgtcaggaggaggatatgaatctaaatactcctggctctgattttgtgcaggaattttcatttatttttgtccagttacttagactaaggctaacaaatatatagtttccttctgggcagaaacagaagtaatcacaaagtaaaataaagcttcttaaaaatgcattgtcctagatttaaagaatgtttccttagaaaatgctatcttattttgagatcaaaggtcttgaagactcttaaaatttctaaagtattatagaatcaataaaaattagaactgggaaagtccttagagattaactctagaaccgttaaaatatttgatctggaaggaacctttgaagagtcccagatccccaaattgtgtgaggtgaaattgtatactgttgtgtcctcagcatcctgatggggcccatccagtctctccatggcctcttgattataggggcctcttattgcctcaagaataatccattccacaaatactgtatgatttcacttatatgcgatagctagaataatcaaatgcatagagacagaaagtagaatggtgttttcctgggctgggggaagagaatatgggaaattattgtttaatggatacagagtttcagttttgcaagttgaaaagagttctggagataaatggtggtaatggttgcacagtattgtgaacttacttaatgccatttgaaccacaattaaaaaaataaaaactaagcaaatgaagcggaaaaaaaaaagaatccattccattgctggacagctgttggaaaggctctctatgatgactcctattggtgtaagttttgtactctgtaaccacaagaacgaatctaaccctttcacctggatgaagacacccagcgagtccaccccagtcttttaaagctaagtagcctttgttccttcactaggtcataatattttgttttgttttgcttatactttgtttgaatcatgatcaagatatggttcacacattgtgattggctgatacgccctttaaatgtctattaatctagcgattcttctgtatctattttttgctcgcctattcacttggtctcctgtttaatttgttgaagaaactgggccattttttccgtagtgttttggtactagcatctccccgctctatagattaacatattcctctgtcctctgtatttcctctgagtcggtaatgggcttgagagaccttgatttataaatgtttgtagtccaactactgtcatcctttggcatctgtgggggattgggtacaggacccctccctcacccctctaccaccactgataccaaattccatggatgctcaagtcccttatgtaaaatggtgcagtatttgtgtataacctatgtacattctcccatatactttaaatcatttctagattacttacaataactaatacaatataaatgctatgtgaatcattctattgtctaggggataatgagaagaaaaaaacatatatgttcagtacagacaaaaccatcctttttcttttcaaatattttgcattcatggttggttgaatccacggatattaatcccgcagatatagagggcctactgaaaataatgattcagtttagatcttttttgagagtaaagggacacaattttatccccccccccccaactttttgtttggaaaagttgtaaagatgaggaaaaattatagaatgaacacccatatgccttttacatagaataatgtaatgaacacctatatgccttttacatagactccccaactgttaacattgtgtcatgtttactctctctctctgtgcacattaacatacgaacacccttaggtttgtttttttctgaatcattggagagtaagttactctccaatcataacactttactcctaaatttcaacataaagacatcataacactttactcctatatttcaacatatatctgctaaaaacgaagatattctcctacataatcagaattatgttcactcaagaaatttatattatatctagtttatatattgcctaattctgagtatacattaccctaattatcccaataatatccttcatagctgtggatattttgtaaaagtccagaatccaaccacggatcacagattatatttatatttagttttcatgcctgtttagtcaccttaattggtcctgccccctgcctcccttcttttgagaaacagggtcttgctctgccacccaggctggagtgcagtggtgcaatcacgactcattgcagcctcaacttcctcagctcaagccgtcctcccacctcaactccccaagtagctgggaccacaggcatgcgccaccatgcctgcctaatttttttattttgtagagctggggtctccccgtgttgcccaggttggtcctgcccttttttgggtattatatgacattttttcaagagtacagaaaagttgttacagagaatatcccccaatttggatttgcctgattgtttctttatgattggactcaggataaatgtttctggcaagaatactatataggtggtgctcagtcctttaggataggcacttggaaggcacatgatgtcactttgtcccatacttgtttataaagtgtccaccagatttctccattgtaaaggtaccttttccccatggtaattaatacataatccatggtgtttagtggttacctttttaatagttttaaaaaccatatgccattggtcatgggagaaattgtatggaatagattatgaacacattagtaaagagttattgccactgatggaaagataattttagacatttgttattctgaggaatggaggggaggtagcaaagtaagaaatgggctctcatgaagacagacttgtgtttgagtacagctctacacctgaacctatgcaaccttaaaaatgttacttaacttcttagatgctcaatttcttttctaaaatagagataatactcataccgggcaagattgttaagatgattaaatgagatagtgcaggagcagcctgtagcctagcagctgccccagggccattgcatgggagacaaggagatccttccagagcacagtttgctggatgtattcatctttagacttattcatgagccttccttcttgggattagtttaaaatattcaggcatgttgttgggaaaatgtgatcaacaggttaggtgcctttgtgaaatttcaaagaaaggaattaagaatttggagatttttggtatcattttcagacatcttaaatataacttacctgtagtagatttgtatagaatcaaattgccatttactcagacctttttctgactggaatccattttactttattataagggatttttttaaacacagtttatatgtagtctgattgagaacagtgaatcataataatcctgtgacccatttacatgcgttactgtaaaagtttcatttcgtacaagtgacaatttttaaaagttaattagacttggctacacggaggttagcaaaaagtgctttgaattatcaataattcagcagggcagacatttctgtataatgcagtggttttatagagtattgtgagatagttatccttaaaataaatggttgtgagcatacatcagcatggcggggttcgcttgaatgtagcgtgaagtgataacatctatgctttctattattggacagagcgcgggacatcagtctttctggccatgaactactagcaacctttgtcctttgtgttacctttagttaaaaacgaaaaatgagcatgaatgctggctgatggccatgtctctctcacagctaaaaattcatctgggaaagaaaaatgggtttggagatttggatttgtttcattgcatgaatgatatgtgacattctgtaaattatttatcagtgcaaggatgacagcagtagcttgaacattgttatatcaaatgaaagcaggaatcccgttagtaagaggaccgggttttagctcaaatctatcaggggaatgttgtcactttaaagccagattgttcttttaattgctatttaaaggaacaaaagtgttcccaaggtactgcagttgagcagttgcaagtaataactatggatccataattatgcagtgctgattatctggcatttaaaaaactgtggctacagtcagtgaccaatttgttatagcttgtctcttttcgtttttctagtacagaatgttttataatctactttttaactggggctacagaaatacatttgcatagctacctcagaacgtaaagcctgtgcatattataagaacaaattaagctgaaagtaaagggaagataatgaatgcccttgtaagatgagatttgcagtcatattaaacaatttgtgaatgtttggtcatgagatggttttttgtttttgatgacatgttgtcccaaggaactaaggcatttgttggaatcattataaccattgattttttttgttcttaactagcatatatttccttcatgtattcagttagcagatatattttgagtgcctactatgcaccaggaaatgcattaggcatttgggctagagtggctgaacaaatgaagtttattctatgctgatgtatatttagagagttagacctagcaaaatcttgtttttaatttacatttaaaaacatttgtgattatgttgggtgttcttgctctgaatttttgattcatgagattcaaatatagagacatcatagtaacattcagatggctagcagacaacatgtgtgaaggcttggaatatgcggtaaaattacagttttcgtagttttggctgttgaaaataatgtgaccagatctgtaggcactgtcagctattcctatggatgggaatactagcattgctgatagtagtaaataacaatggaaatactaaaatgtatgtagatttatacattgttaaaagcaattttcatacgagagttaaagggtgctaggggactagacaaatgttttgttgtttcttatataaagtgggaatgtcaggccgggctcggtggctcacgcctgtaatcccagcactttgggaggctgaggcgggcggatcatgaggtcagaagatcgagaccatcctgaccaacatggtgaaaccccatctctactaaaaatataaaaattagccgggtttggtggcacgcgcctgtagtcccagctactcaggaggccgaggcaagagaatcacttgaacctgggaggcagaggttgcagtgagccaagatcacaccattgcactccaggctggcgacagagtgagactctgtctataaataaataaataaataaataaataaataaataaggtgagaatgtcagagattcaaggtttatcttttttgtttggtatggtgtggtttacttttgaagaccttcgtggcacaaaagccttgttaataatgaccttttcaagtgtcccacagaatcctgctcattctattattctgtcacctaaaaacatatagatattttatgtcaaatatttagtaggtgaataatagcaatctgcgctgcaatatttaataaagtcttaacagtctatacatgatattcatagactataatgctgaacgaataatttattttaagcatatagataatagaaacaattgagatgtccaatgaatccttaattatgttcatttcaggcaagctatataatatataaaggtattagatttcactggtttaataaaaatgacttctgagtcatacattatactgaaatgtattcaggtagtactttagtgtcaaataatttaagagatttatcccagcactttgggaggctgaggcaggtggattatgaggtcaggagatcgagaccatcctggccaacatggtgaaaccccatctctactaaaatacaaaaaattagccaggcatagtggcgcgcatctgtaatcccagatactcgggaggctgaggcaggggaatcgcttgaacccgggaggtggaggttgcaatgagccgagattgtgccactgcactacaacctggcgacagagcgagacttcgtctcaaaaataatataagagtttttttactagcagaaagtgtttatttaaatacgttatttagcagtttttctttgttaaagaaagaagaagctttaagtgaaaaatgtaaaaagcttttgattttaatgtttttacttttgaaatggaaaagtgacagtattttttattttaattttgtcatagccccgtgctgatcccattccaatatgtagcttctgtttggggactaaagaatcaaatcgtgaaaagaaaccagaagaactcctctcttgtgcagattgtggcagtagtggtaagttgtgtttttcctatgtgttgtacaatgacttcccattatcatagcttcatgctatttgtctctctattaaaactgtattgttatttaaggcagttatatggtaatagcataggctttaaattttaaaagaaaaagtaaggaatagagaaaaaagcgtgagtatgttagtactgacatatggatattatatatgcttatataatactatacatatttatgattaagcttttattttataccagcattggtaattcagtgtggagatgtctgcattataggtaaattccatgtagagaattctaagctttcaagctgagtacaaccccatctttaaaaattaatagcaaaaaataagtaaaaattaagctttttctgttaatcttcaaattttttccccagactacccaaacttttttctccaaagtcttgttttaaaattcatgactatttctctagttatagtaatctctaaaaaaaaaaaacaaaaacaaaaatcgacagaacaccatagctaattcttgtttgggaagtcttgagatatactggctaggagcaaactcaagagccagccatagcccagttcctctgccttgagttagttacttgatcattctgagcccctgtttcctcattagaaaattagagataatggcagcaccatcctcttgggttttatgggaatgaaatgtgagggcacaagtaaacaccctggcacaaggtctgcagaactatggtaagtgtactacaaatgtcagcagtgttatggtttagcatgtttgatattgttatccttgattgctgcacgtaatttaaaatcttatcatcacttatgacagctgcttgatggttgggtagaagaaatgtttcatgctgaggaatgacagtgttgtgtaatgattcttattccttatatgaaggtttaacgtgataggccctttgtggttcagcagctttcaggtgctgactagaagggagagccttggaaataagacatttcaaaccctgcttgaaaaatgcattctgacagtctttttgatgggctttacagattcattaaaattcttttacctggccatggcatcatggatagtgacaaaagggcatggaaacattatctgtacgttcagtttaatacatttcagccccacgatatccctgttttatgctggtgaggtagtgcctcactcatcagttctgactctgtcgttatcttttgggttttctcacgaggctcattctgaatgaattattcttttgtgtaactgcctgatcaatttagtggtgttcacttgtctagggtttaccctttgtggcttttaaggtggtactttaaaaacacccttccctgtttttatttctttaggatctatttgtctgggtgcctagacagattaaagatgtacttaaatgtgggaagaaaagttcccttcatatatttccttacctctggtgatacacttacttgagttgataagaagttcgagatcattatcttctagatcataacttcaaggcctccttcacagggtataaaggtgtaattctaaacaggtagatcttagattttctgatgtaatcaatctccctttgtctttcccggattgaagacctgccagaggggaggttgatctcctttatgtttgaggtcactgaaaatttctttcccctggtgtttcttacttttcgctcagactttttcagggtaaagccaggggtgtttaggtacagtgttatgttttctctgttcaaaaatatcctcttgttttctcttttaacaaatggagaataatgacttgaggatactgtccagagggtttatgtggctggtgtggttttgtgagccagtcttcaagtggagagagccagaggctttggggccaaggtatgggtcatggcagaaattcaagccctggggtcaccatgtctctttgttggggataaaggatgcctcagagtgcttctctggactctgcgatgggatccggctctagtgttgaagttcacttaatcttcccttgagtgtgctgtgccagcctggatttggctgctttagtcaaaaaaactattgttcctaacgcagggaaatgctttgtacatatttattcatctgataaatcagaagaatagactttgttgttttttcctctttaaattgaagggtcaaaataaaatatagttcattttagggagtttgggggttcttgtggttctaaggctctgttttgacaccttggtaattctaaggaaaaaagaaaacaataggccagcatacctcaacagtgtcctcaaataatggcgggagccctgttgtcacagttcagcatttcaagtgggaattacagattagttgggactcctagttgaccttatggaaatggctgccttctcactctcagaagagtctattggttctgggattgaattgagaccgttcataatgttcaaagggatcccaaaatgtaagttgtttatgtgaaaaaatacccatagcagcataaaaccagaaaaaggaaatatagatggcagcctgtggggaggatcattcttaaatgtgtttcccatatgtgcctgatgcttttcagtcgtccctatctgaagtaccattcatatgatgtcacatttagactccgcttagatttcatagatgagagtaataaatgtatccttctgcttacatcataaagtaaagccaattagaaatttatctgtttttaaaggggctcgatgctttaaatgggcagtattttctttaacagtttttttttctactaaaaattctttaaaaaaaaaaatcattcaagtttatatgtagtaaaaacgtgaggtgaggtatgtagtgcccggagctctgaatgtggtgtccctagcctgggttccagttctcttccgccacttgctgggtgtgtaactttggttttcctcatctgtggggtgtaaaggagaatgtctgcaccctccatccacagagctattgtgggatccagtgagaaaatgataggaagatgatcagtaactgtaaaacatgagacaaatgtgaaggattattccagccactaatatgaatgtgggaatcatcagatagtctaggtctgtggaagtgttagaaatgattttacttgactttcatggatcagcctactttgaaattaacactgttatattctctttgcctcattaagaccaaattatctttaattagcttcacataagtattagatattataccaaatgaaattttgtgtctgctgctcagattgctgggtggttaaatcttacttacagatgagttgtgtgcatgtgtgttttcaaattagcaaatctaagataagtgtacagttcaaaattacagcatcattctaagtggaagctcattgaaacgggagacagaagaaaggctgctgtgatgcagctgggtgagtgagagaaatcccttttgtacaataaagggagcaagagccgtggagtagaatatcagtgcaccctcgggagacctgaagtcttccctgggtttgtctttatttgtgtgttaaccctgaacaaaatttgcatgctcatggagggaactggtaggggcagtgtgtggatatatggacatataaaaatattttaaaagaccactagtttcttaaggtcaccccaggagttggttgcttagtcatccagtttcacattgactagatgcagattgaatcattaggttggaaagaagactcttgactagaaagaaacctaaagatatgatccaaagaagaaaagaggccaggcgctgtggctcacgcctgtagtcccagcactttgggaggccaaggcaggtggatcacctgaggtcaggagttcaagactagcctggccaacatggtgaaaccccatccctactaaaaaaaggaaaaaaaaaaaattagccgggcatggtagcgcatcctgtaatcccagctactcggaaggctgaggcaggagaatggcttgaagccgggaggcggaggttgaggtgagccgagattgcaccactgcactccagcctaggtgacaagagtgaaactctgtctcaaaaaataaaaataaaaaaacaaagcagaaaagattgggggttgggggaaagaaggtgagccccatccctgcaaaagcccaaagcatgattgaccatccaaagagatgtaacttcactaaaactgtgcttgtctgggtaatagtgacctctttgtagcaaaatctaatgatcatttttaagtgtttatcaaaatctaattggtatcttttaatccacaccaaataatttctcttagtcatatttgatcttgtagagaatcttttttcttgaagtgttcttttcctttggcccctgtgacaccatattatctgtgttttttctctaccacttctttccacatatttttgttagccccttggtcctctctccattccctaaatgtttcttcagatgtctgtcgtggccctgtgtttgttactttgccttgtagcttctactgagcttctgaccctagatacaaataactatagagcttttccaacgagtctacccccgaggcacctcaaagttaatatccagaacagctcatcaaccttgcactgcttcctccacccaaaacaacagccacaacaataacaacagaaatcccagcaaacaaacagtatcccacctctcctggaggatttcctatattcagcaagtggcacaccgttcgctactcactcagttacacaaactagacatttggagccatcctctgtcctattctttcacaccaaggaatcaccaaaaacacattgattctaaatcataatatgtatcttgaatgctaaatttatcgatgcatccccaccagccagccccactcagatctgctgttataatgacctcaatctaggcttcaccctttttcctccaatccattttccatactatagcctaagttacctttttaagttataaatctgatcacataatttcataagtggctatcagttgctcttaggagaaatccatattctttaatatagcccccaaaaacttctggattgggctctggtttaaccccatcttacatcactattctgttcacattctgcacattggttacattgaacaacttctctctccttggatatacctcgttcatctctccctctgttcatgccatcttccctgctcttcccctcttctggtcccatccaatcacattcatcttttgggtctcttttttagggaggcctttctctaacttcctgctagattctcccatatccctaagccaccccattgtaaggcattaatgctcattcttgtttaatgtttgtctttcctgctgggctatgtgatctggaagggtgggaaccatgcctctccttttcctcactgtatccagtgctcattaaatattagttgaagggaggagagatggacagatggatggtcaggtagccagtctgaggggcttagtgtctgagtcgttattagttttccattgctactggaataaattactacagacttagtggcttaaaaacaacacatttttaatcttatagttgtaggttggaagtccatcatgggtctcaccagattaaaatcggggtatcagcagggctggctcctctctggagactttaagtgaggatccatgttcttttttttttttttgagatggagtctcactctgatgcccaggctggagtgcagtggcgtgatctcggttcactgcaagctccgcctcccgggttcacgccattcttccacctcagcctcccgagtagctgggactacaggcgcccgccaccacgcccggccaattttctgtatttttttttttttttagtagagacggggtttcaccatgttagccaggatggtcctgatctcctgacctcgtgatccacccgccttggcctcccaaagttctgggaaggagaggatccatgttcttatccatctgggttattggcagaattcaattccttgtgttgacaggaccgagatcctggttttcttgctgtcaggtgaaggtcatggccaggttctacaggccacccacattccccggcttgcagccccctccccatcttgaaagcctgtgatagcaggtggagtctctctcatgctttgaacccttcctcctccttttgccatttcatttctaaccaagtccgtaaaaggttctctgcttttaaggattaatgtgattagatcaatcatgcccactcagataatccaggataaactccccatctctaggtcggtacccctagtcacttctgcagagttctttttgctacaacaggtatagtatgtttacaggttatgggaattagagcacagatggctggggcgctgctgttgttgtgcttactacagagcctgtgttttttcttcctcagtactttctccaaaaagcttttccactggtttgtagttccattggtacttgtttaattttaaatagtattcctttggttttgctagataaaactattgtaagctactagtacttgacaatgtatttgtgtaaaattgaatgagtgaatgaatatgtattatggctctcaaatctgataaattgcaaaatacaatagtaaaacaaactccagaaagacaaagcaccatgaaacgtgtcaacagagagaacaagaattttagaggaaattagctggacgtggtggggtgtgtcagtagtcccagcactttgggaggccaaggctggtggattcttgaggccaggaattcaagaccagcctggccaacatggcaaaaccccatctctaccaaaaaaatacaaaacaattagccgggcttggtgatgcgtgcctgtagtcccagctactcgagaggctgaggtgacagcactgcttgagtctgggaggctaaggttgcagtgagccgtgatcatgccaccgcactccagcctgggcaacagagtaagaccctgtctcaaaaataaaaaaataggctgggcgctgtggctcacacctgtaatcccagcactttgggaggctgaggcaggtggatcacaaggtcaggagatcaagaccatcctggctaacacagtgaaaccctgtctgtactaaaaatacaaaaacaaaattagccaggcatagtggcgggcgcctctagtcccagctactaaggaggctgaggcgggagaatgtcgtgaacctgggaggtggagcttgcagtgagccaagatgacgccactgcactccagcctgggcaacagagcgagactccgtctcaaaaaaaaaaaaaaaattaaagtgttagaggaaattgttgagtttatgaaatcgctaaaccagaggtaaggaattacttgatcagtagcattgctttcctttatctaattactatagattgtgcagtagtatatcaagacacgttacggtcttttgtgttattttaaagttggccatgagaaaataaaatggaaatatttcttcatccctcagcatcctttacagaatcatagaaatttagaactgtaagggatctatggccaattctcttgagctaaataaaggtaagattgctgcctaaaggaaagataggctgaagattttagaatttgatagggtagcttaaatagtagtagttgagatacagtattgcttaaagtgagagaaaccattaagagaaagaatattccttgcccctgattgaaaatggctgaaatccactaattttcaaactgcataattattaaaaagtctgtctttcataagatacctgtgagaataaatagtaagctgtaatatgatgtgaattaccttagttactgaatattaagtcacaaagtacaaaagcagatttgaatgtagagaaaaattcagtgcgtgaaattgaggtcatatgtgcccatgatatatgccttacaggaagtaataaaaaagaggggggaagtaagtggtatacttttaagctgatgggatccattttaagggtggaatttaaattgctgttctttaaaagttaagtttttaccctcctcactatataaggggacagaggggagggctctgatcaaagtagacctctcccctccccgcttcagtgtgcttcttagaagtcgacaagcaagctgtctttgtttgccgttcctgagcagaaagaggagattgataccatttttatctattcagactttttccttgcattcatttgaatgagagaagcctcataaaagaacagtgtcacaggttaaatgcatctgcctgggtgtctctcctgcctgaggtcataatcctgtgacaatattttattttctcaacatcttaaatacagatgtttagagttttttttttttaactcaggaatagtgtgcttttattaacggtattggtgattgattttgaatgtttttacttcaaaaagccaaatctcctggtgggtggaattttatgaagcacctgttaagctttagggaggaggacctttttggcagcaatccaaaatacatatttaaacaatgagcctgccaaagtcaggaaattataaaacagttttgaaattgcagaatctgcttttttttattacccctcaggtttcctttgcagcttggttgtaagttctttcacatgggatttactaatgttcttactatttaaagaccaggtttaaaaaaataaaatcaagtttggagatctcttcgggtttatgtgataaaagaccattagattttaaactgtacagccttccaaagaatctaggctcacgctccgcacacctcttggaggaatctattacacactggctcatggctggctcctttgaatggcattgcccctcagggtctccagttttcctctgtgaagtgagcagtaagacctggtgtgtggagcgctgctaggtgaaaagtgtgccccaaacaggaaaatgggggaacctgctgaggccacacttcttggtgggtcctgtttaacctggatctctcagcttcttaactctgtctctcaaattcactgttttctgctcctgcttccagagtttaaactcagtgacccaggggcaagatggcaatggaatatcctctgtctagcccagcaatgggatgttctttgtgtgctattggatttgggtgggggagggcatctgtagttatgttaagcagcctcaattttttatttagttatctgttgagttttatgatttcatcacacacagagagcaggaattgtttgaactttggcaactcccctcagtgtgtggcaaaccaggaccccctgggtagatggtggttgatgaagacggcaagtacaggtgcaggagtaagaatgcctgagcctgtgttatcttcaagttctcaaaggcttcagattggaattggtataaattaagttctcttagggaaaacattcgtacagtcattttgttacatacagggaaagaaggcaaggggaaaaggcagaaaggaaaatctgtaattcggattctctgatctgttggcattttcaagttcctaaggttcattggctagcctcatcagctatctattaaatattagggaatgggagtttaaaaaagtcaaaggcaccattcccatcaagcaatttgctttttattctcataggacacccatcctgtttgaaattttgtcctgaattaacaacaaatgtaaaggccttaaggtggcagtgcatcgaatgcaagacatgcagtgcctgtagagtccaaggcagaaatgctgtaagtatggctcccgtaatccgcctccaggtaactcgctaatttccagtgttaaggtgttttcatttttatagagtatggctactttctttctaaagctttaaatacacatgatgtcaaactgcaaccaggatcttggtgcactttccttatattgtattaatgttaatccagtaacaaaagaatttttggccttttacagttggtttcagtctcaattagtctctaatatgttatattacaggataatatgcttttttgtgattcctgtgatagaggatttcatatggaatgctgtgacccaccactttccagaatgccaaaaggtgaacttctaaactgtactaaaaatgtattttattacatattggttagctttgtcctgaggtctgacagctcagaggtatacaggttctttaagcatttttttcatccctcccaccttccctatacttctgagtttagcacaggttgtgaatagaggagtataaaagcatagaaaaaaatacatatatatatgtgtatatatatacatatatataaaataaaggctctaattcagacccagggatgaaaagaccatctctctctccaaaccattcccctattagaataagattagattattaaggtcaaaagtttagaacactttccatattattcagcacagtgttaagagcttaacaaattttatatttttgaggatgatagtgactccaaagtcctacaacaggaagccatcaccattttcttggccattagttgatattttgaacacgagcatctgaatgatcttatagctgattgtgtctgatggaatgtggattttcttctgtttattgtgtaaatcagctaagctcagccttttcccctcattttgcaatatattaaacatttaaaaataactttgcctttttattataaaatccataatttacattgtggaagatttaaaaagtacagatagacaaaaaaggaataaaaataaaaatgaattggaaatttccttctctgccttcacataccctttgaagggaaatggaacattctgtacatgtttttgtaatgtactttttcctccctcttaatagattataagcatcccctacatcattaaatattctcctaaacatagtttttaataagtatgtagaactccatagtatagagcagggattacaaacctggcaactatgggtcacagatatgctttgttggtacaatatttttacaagtttgaatctgagtcctctgggtggtgcgtgtgtgctccagtttgccacaatctcactactccctgctgtcttacgttccaatttgcttcagtcacatacattatacaatctaggtccttcctggaggtatttgattttccaaccctctatataaatgaactctaatttatttaaccagtcccttagggtggatattacaaatgtttccaattttttccatccacaattatttccttgaaataaattcctagaggaggaactgttggatcaaaggctagatacatgaaaggctgtatcagttttcaggctgtccagcagtatagaaggatacctattttcctgtattgtgaccagtactcaccgttactatatctccttgagtctaagacacatttttttaatgttttaatatttttgaagtcagatgcatcatacagtatcttagatttgattagagtattattatttttaaaattttaccagtttgataatagaaatatgtctgattatttctttttaagtagtcagattgaacatttcttgtgttttattcttggctgtttgtatatcatcttttctaaagtacctctttttatccattaatcatttttctcttgggatttttacctttttcttcctgatttgcagaagctctttttttgtgtgtagtcatattcatgaatctttttatttatggcttcagttttaaatgtcagtcatgcttagattatataaatatccacatatctttcctggtacttataacattttattttttcatattacaatattcatctgtctagaatttattcttgtaaaggataggaaataattcctcttccagatagatagctatttgttctatcatgcttattgaatcatttcatcctttctccactgatttaaaatatgaccttttgatatgctaaacttttctgtaggctttggttgttctggtctttccattcttatccattgacctatttctctatgctagatgtatagtttgaatcattgtagttctgcagtactcaaaacttttatttaaattttaaaattatattttatactgataatttttttttagtgttggaactttccagaaagagatgataagacaatttttttttcttctagaaattccaaaaatggactgatttgaaaatgtctccctcaaatcaaaagatataatatctgacaggggcgagttttcatgtgtgtttatgtgttggtgagaggcttaatgacatgttgggaacagcttcatggaaggattctgagagaggggccacctctgccctcaccaccttcactccagggaaattgaccttagtgatggcttcctaaggaaaatgacaaagggaatgacgcattttttggagtaaagttcagcatacaggcatccttgagcagcttattacagctacaacttatatttaatatcttctcttaaaatgaaacattaaaatatttttctcatatatatattaattcagggatgtggatttgccaagtctgcagaccaaagaaaaagggaagaaaactacttcatgagaaagctgcacaaataaaacgacgatatgcaaaacccattggacgaccgaaaaataaattaaagcaacgattgttgtaggttgagatcttatcaaaagaaatcatttatgttttgctttaaaatataggtgattgttattctctcagattcctttaggggttttttggcatcattttttcaaactcaagggttgaaaaatacttttccttttgcataagctgtggaaattttttgaaaataacatttttaattaccattggcattttggggtcttctgttggcagtagctgtgatactaagtgacatttttcaagcagcaggatggaagcagaatgtaagaattggaaacagtcattcagcctactttattactggctgagcattagagcttaattatgtaaatattttcataggaattttaaaacgagagggatttgtccatgtctatagcaaatctcttttgtcactccagataacattttagaaaaatacctctctcttctgatagtaatgtagcattaccactttttaagatctcttttatgaaataggagcttctgaaaaacctgcagatgaccacttacctctgaagagttagacagaactatttgacaactgcactagtgcagacatatatataaaataatatattcgcagtggcctggaaatctactatgataaccccattttcactatcttgttgctgtataattgccattaaagcccagtagagcatttagcaggagttagttggaaaagcagagaaaagataagaggtgaaatgaatttattttaacctgtgtagagtatagatttgactatcagcattaaggtgtttacgaatgggatcagtagacttgcacatctatagcagttctaccaacagactaccaccatcttttcaggcttagtgaaagggtcattgtgatggagaaagaatacatgctctgcacacaccttgaacagactccaagaatctcactcccttgcttactccttttcccctaattttatctgaagctgctctcactatcttatttgctctcagaaaaatagtattctcccgcacctttatctcctaagaagaagtaagaaatgcaggctcctttctagagttttctatgaaactttgcaaaaaccctttaaccagtagacattttcaatagattttgaaaaaatttctagaggcaaacatgaaacatttatgaataaaatctttcatggtagtatcatttgaagtagaaattatatgtttttgcattcatcctgtgtaagcattgttcccaacatgggtccatatcctcagggcccaattaaaaaaaccaaattaggatataaactttctaaacagaggacacagctgaaaattgcatctggcaccaatcctaactttttgtttgtccaaaattgtcctttgagcttaggaatttttaagacagtctagggagttttcctttttacatgctttataagcatattatcctttctgggcaatcgattccagatacaatccaaatgcagctttctgatgtgaaacatttttgcctggatgagttccttgttggtaactctcactgtgtctctagtgacactagagatctctagcgttcacctgacttggctgaattggtggtgccaggcagagtccctggcagtagagccacctcagatgagcctggtagctgcacctacctccccttcaactaacagctgaaatctggtcattaaatctttgtatacaagatgatcactaaaatatactcttgtatttgtaattacttaagatatttttataattcagtattgtatctttttaaggctttcattttgtcattattcacctttagctaaattgatcattttgaaagtacattcttgggccccagcattgtcataattcatctgcaaatgtttctctattgtataaaactctgctacaaaatgggtagcttcgcaaaccctagcctgaggtgaagacagtcggccgctgttcatgtaagcagctgtgttagcgagtgacctctagtttctagaactactcaacagtatgggcagaaccagggtacaaagattctgacgccaagtgtctgataatgaccatggtaaatgtgccgcttcttcaccagactctccatgtcatgtctgacccgctgtagcttttctttaatcatttcttcagttttttgctattgttgtccttttttcagcaatattttatgctgtagttaattgtcttctctcctaagagagtattattggttatcttaccatcctaagcacaaactgctgagaggaagaggatgtctttttatgttttcttaaaaaaaagtacaaatttatagccatatccaaactctatttatataagtttgcaaattgaattaaaaattacttttaactagagattagataagcttcttcttttgcttctggataacacatatgacttatttcctcctaatactttaaaaaagacatttcaggaaatcataactacttgtgacaacaccaaaggatagcttgtttttatttaattataattaaagcattgggtgttcttttagtctcttcagcatttttcttgcttatattgcccttgggtccacatggattcttccagtacctggtggatgggccctggaagaaccatgacatgtaaatgcagttgctgctgcctttccaacagagaaacatctaggtggtggcacacacaaaaaatacagttcttaagtttaagcccattgaatgcatctagttgcaataaatttgtttttagatacctttataattctatttattaaatgctgatactattctctaaatttctgcctaggtctgtaaccagtgatgaaggatccatgaatgcattcacaggaagggggtcacctggtaggggtcaaaagactaaagtctgtaccacaccttcatctggtcatgctgcatctgggaaggactcaagcagcagattggctgttacagaccccactcggcctggtgccaccaccaaaatcaccaccacctccacctacatttctgcctctacacttaaagttaacaagaaaaccaaagggctcattgatggccttactaagttttttacaccatcacctgatggtcgcagatcacgaggtgaaattatagacttttcaaagcactatcgtccaaggaaaaaggtctctcagaaacagtcatgcacttctcatgtgttggctacaggtaccacacaaaagctaaaacctccaccttcttcacttccacccccaacccccatctccggtcagagccccagttcacaaaagtccagcacggccacttcttctccctctccccagagttcttccagccagtgcagtgtgccctccctgagcagccttaccactaacagccagctgaaggcactctttgatgggctttctcatatctataccactcagggacagtctcgcaaaaagggacacccgagttatgcaccacccaaacgtatgcgtcgtaaaactgaattatcttccacggcaaaatctaaagcccacttctttggcaaaagagatattagaagtcggtttatttctcactcctcctcctctagctgggggatggctagaggaagtatttttaaagcaattgctcacttcaagcgaacaactttccttaaaaagcacaggatgctaggcagattaaaatataaagtgacccctcagatggggaccccctcaccagggaaggggagcttgacagacggaaggattaaacctgatcaggatgatggtaagcaaaaggtcaaagctccaaccaaacctgcgtcccgtccctttctccccaaccctgaaaaaaatcaaccaatcaattcctatttgtcacataggtcttagctatttctcttgttctcacttcactttcatacagaagcagtgaaactttgacctttttctaatgctgactaaacctccaaaatgttgtttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactgctggatctatgagcagtgcttagatgtaaaagcttatttataaagctttaaaaaaaatccctatttgcccagtatgctaatttggtgccattttggtaatatatggtggttactcatgattcaagtcagtgaatacactttctgctggttttaaatgacagatactgaaataaaaataaacatcaaacaagaaagtgcagatgtaaatgtgattggaaacaaggatgtcgttactgaagaggatttggatgtttttaagcaggcccaggaactttcttgggaggtaaggcgaggatcccacattgtagtagcaagtataagatgtggcttctaactattaatatggaattactgtgttgattttatagagaatccctttcaacatcctttgtgattctttagccgttatcatgcccatttctactgactgtacattcaaaagcaatgacttagtagaattgtcgccactcttaaaagtaggtatggactcagctggtctcacaaaataaaacagagtagcattagttgaggcagattttggaaaacatttctaggtgtgaaggaatagatttctgatgagttttgcctaaatttagaaaataacaatttaaaatcattaacaaaaagaagaacatcactgttaaattcaccgatgtttcttccaacacagatggccagccatatgaaaaatgtctcatatttttagctcttctgcattgatgaaaacaatattttgtttcacaatcagttgtagtcagttttatttttattgtccagtaatttctttaagtgattccactttaattctgcttaagttattaccacccagatattgacaggtgaggctgtcagacttctcaaagacgaatctaatatgaattgtgaatttgttgtgtcagtgactacattcggtttctatgaccagtgtggtcaggtagactccctacccaaccccacttcctgttttgtggggaaggggttttctgtaggctcttaacgctttatttttagtagcagccagttgggctaaatactcctgacagtttctaccttcagagctattgggtatttccaaccctcattctgccccgatctatcaggatgccttgtatcagctttcctttggctaagataaatgtcagatttcccccagttattaaggttggaagtccttgaaccagcccaggttggaaatggagcaggtcaaaactcctacgttgatcagtagtgggattgtgcccttgaatggccactttactccagcctggacaacacagcaggatgccacctcttttaaaaaaagattcgaagtccttaaatattatctttttttggcctacttctgacattcatatgtaaacatgaacagtaggccattatctgaaagatactgctaattctaaagttttttcattccaacatggtaaaactggctttttttattcaagaaatattcttgttctgtgtcaggcactgtaccagacaccagggataccacagtgaatctggcaggcagagttcttaacctcgtgtggcttactacatggaaataagggaaataagaggagacaaatgctaagctgcagatttcacaattgattatttaattacagttgtgataaatactacttcgtggaggaataggaaactgtaagcttctgtaataaataagcctgtgtaatagccacatcatttataatcacctaatttctaatctgttacaacagattgttaaatccagttctatcgacatttgtatgtatttataccatacttatttcctttgctatattgtttcttagggtattcgtttgctgtgaatcttacacaaaggtaatgttaggttggtgcaaaagtaattgtggtttttgccattgaaaaaattataaaaacagtaattacttttgcaccaacctatttcataagggtctatagtgttttaaggccatgcaaattcacaattaagattagtgttctgatcttgataagttttgatagtcactggtgaaagaaccaaaatgtaagtgaagtatatatattattattttccttttctttctatttgacagaaaatagagtgtgagagtggggtggaagactgtggccggtacccttctgtgattgaatttggtaaatatgaaatccaaacctggtactcctcgccttacccacaggaatatgcaaggtaatggaataagtctggcaggtgtataacttgaatgtcacatatgtgagaaaggaaaattcttgattctaaagcaggaattagggatgattttaggaaataaattttggtagtcaatgccaagtgcttcccaaactattgcttttgccagcacctttttatggtattccttgttctcggtaaattccttatgctccttagttacatgggcattataaattttgccatttagcttctagattgtgctttctttccttggttaattggggaaatgttggttttgtatgaaaccaaattaaaaaaaaaaaaagaaatttgccatggtgaattattgggtagactttcttctccagttgtcttttatattttttaattaggcctgttacttttatctctgatttctggcattttattttcaagtttttaatagaaatttagcaaaagaaggaaaaatgggagaaagtaagtgggaatgggtagtcttaagagacccttccccaaatttttactttagaacatttgtgactttgaagagaaggccaggcccggtgactcactcctgtaatcccatcactttgggaggccaaggtgggtggatcacctgaggttaggtgtgcaagaccagcctggccaacatggcaaaaccccatctctactaaaaatacaaaaattagccagacgtgataggacatgcctgtaatcccagctactcgggaggctgaggcaggagaatcactggaacccaggaggtggaggttgcagtaagccgagattgcactactgcactccagctcaggtgacagaccaagatcccatctcaaaaaataaaaaataaaaaggagaaaataatggtatccaagtttttgtttgtcttgaactcaagattagcctgtgaacgaatatatcccaaaatgggtacattgagaatagatgtcttccataaagtatgtcagggtacactttactagtatcttcaaaaattttttagtctgcaaagttttcagtatttataaacttgattttcttatagaatagatcttattttttttcgttagcatgtgagtgtctggccaatcacgtaactggagaaaatgctaagtgttttctaaaagttaagtgacaaaataagagtcaagaattttggtttctccttccttataccatttggttgtgtgttcttgaacaattttaaaagactatgagctttaatttgcataggtaatgataagccatgtgctctgaaagatttgaataaaatttgtacataagtgcaagatttgaaagtagtctcacctgtgtctgcctctctcttgaaaacctttttccccattcttatactccaaagaccttgcaagtgcttctaaacattttcttataaataccagccatgttcattaagatatggaaataaaaaatgttctgatttttaaggtggagaaaaagtcagcagggaagagaggtgtttgtcttttactcaaagtaacagtggaattggtagaaaacaaattaggtcttttgattttcagccgtgctatttactgcatttagaccatatataaatctctgataataactttaaagttacctcttccagaggtggaaatggtaacaactaagtttgaggacttttcagcctcatatgtatgcagattgtttaaaataataaattcacttctgagtaagatattatatctataccactaaccatatataattggaaataagatagtaaatgtgaattttgaaaaatatgcttggtcccttgacaggatgatatccttattaagttgattttttagggtggtggttccacatctgtaaagctttctttatataggatatttttaaggaaacaaattatttgttcacaaagtaaagggagcacatattatggattatattaaaaaataatgtatggttgtttttacattctgtctttactattggctggctttctttctttctttcttccttccttccttccttccttccttccttcctttcttcctttctttcctttctttcctttctttcctttctttctttatttttttgacggtgtctcactctgttgcccaggctggagcgcagtggtgcaatctcgattcactgcaacctccgcctcatgggcttaagcgatcttcctgcctcagcctcccaaatagctgggaccacaggcatgtgccaccacgcccagctaatttttgcatttttagtagtgatgaggtttcaccatgttggccaggctggtctcaaactcctgatctcaggtgatctgcctgccttagcctcccaaagtgctggaattacaggtgtgagccactgcacccagcctccaatgttattatacagcctttttatgatgtagagaaaattgaacaatatttaatcttccccccaacagtataatctatctgatagattctatgatttttaaactttaacagattaccaaagctttacctgtgtgaattctgtcttaaatatatgaaaagtaaaaatattttgctaagacactccaagaagtgtggatggtttcatcctccagcaaatgaaatttaccgaaggaaagacctttcagtatttgaggtaagcgcgtgtaaataaaaaaattcagctttttgaaatctagtactcctaattgttgactatgtgctgatttgtgtttagaaggtacaaagtatacttaattttggcactgaaattcagactgccctttaaaacatctccatgttttggaatgtttatctaaccatattaagcaaccatttagactgatgaagaatccctacttcatcacattaacatttttgtcttccccaaaatccctgtctacactagatatattcaccatgaatttatgatctcctcagctctttgtaaattctactttctttggcaggagaaatgagctttgttcagcagctccagccaatgtctggcaggtgctcactcttccagggaattgagcagctgtacatatctcctcaatacacaaccacctgtgtttccatccacttcttggcagtgtggataatccttttggtgagaccctagcagatgttgggactccctcccatctgggtagatggccacccctgaagaactctgctgttcacaggaaccccttgtggccatatgtctgtcattgtgggtttcttgaagacattttgtatttccagaattgatttcgtagcaggcctttgcctctatatagttgcattgtttaattatgtatctgttgtcagtttcagggattccgttaagctgagtcagtttcaccttgaggagaccatgcctttctcacaggttactgtctgtctgcagggcttttcacgtttctcctttatgctcttccctccacttgcacacttctgttgtctgctgcattttctcctctgtgacccattgtggtgtgcattggtgctcattcctaggtgcttgaaacaagcctaccttgtacagcaaacgtgatgtcctctttctctggaatatagtttcacttctggattttctttttctgaattgttcaggctgaaacttattattctgccttacagttctctttatttctggcctgcagtgtcttgccatcctattaaataaagggaaggttgtaggtttctcacatggaccaggctccttctcagacaggtctgggcccactagtttttccccaagactgatcagagaacatgggaaactccagttgtgtcttatgatttttttaaagctttctctttttctatcagctctttcggtaagcttggaggaagaagggtattgttgctgggaagattaggtgatatattagttcttactaaaagctaggcacttttgacatttcaagctggttagttctttgttgtaggggctatgctatacagcgtaggatgtttagcagcatctctggcctctgctaattggatgccagtagcaccaccaccccttccagttgtgccaaccaaaaatgtctccagacgtagccaaacatcccctgggggcgcagaatcacccccagtaagaaccagtgggctagaaggaaggctgaatgcacgttgcctgaccttcctgttggtatgctatcctgccagccccagccagctgaggtgacagagctgctcacagttgaagcttagctaatgtcacaagttcagctttcctattggctccttccttgatgccttagatcttttcttccaaccaaaacattgtttctcaaagctcaaaacacattgttggccttaagtaattatttcataaatcagcatgagtcagcactgggattgaagctctcataaatccatggaacgtcttctcatgggcaagggaatcagtcttgttaggatggtaagaatgggctgttctttcagggcaggtgcttttggaccatccagagatgagaggggagacatcagaagcatgtatgtaaaattcacttatacgaataaggagttggatttgataagtaccgaggtccctattctagaatctgagttaatagagtataacatttgggcaacttttctcctagcagtttcttacaaaacttataaaataaaggaggaataatcacacattacgattttctggccttccctttctttattcctcttacacttttcacaaccaatcagaattttcttcagcactgtcatctctgtatttttctggttcacagttatgtatatctccatctttcctttttgtaatatactaccatttccaaaagggccatactctcaaatacatgtaaacttcctttaattaaagggagaattgtatcctctgtgcccattgcccatatttgattgtgttgctatgtatgggacctaggttccatccgagggaaatagttatatgaaatctaaaaataatttgtgcaagatgagaacccgtatggtccacaggagacctgagaatggtcaagttcattgtttcagagctctggttagcaaatatccatttcccttaagaaaagtgctagggaaattcttcttgaatctgctgtgttttctattttcaaagagtaactacatttgatcaaagaaattggcatctgtgcctagcctcctgtctatagccatcagtatcacagcttgattcttttattttgaagagaagtagactgtaatcatagtgcttattgtaggttgaaattcatatcactttctctgtaagtattcccaacatagatattttatcttttccaattatatttaagatgatgcttgggataaaaccaaaatggaaacctctttgctaatccacacttctgaggaatcagaataatacagttcatttattttagttttatgtgaaacccttttgaaacaacataaagtttaacttacttgagaagtattttgatctgtttatatttccttaatacagatttattcggttcagatagagaggacatgcctgatcatttttagctcagaataaattacaagtaaaaattactcctttactagtggtttggcccttctttggtagcttaaagagaaattttaactaccttaaatgtaccctaatttaagagaaaatgtggaattctgatttgccagtgacagctgttttctggttaaagctgtacttgcttaatagagtgttttaatctctcagtttaggatttggaaataaaatgatgtactttctgaaataccatatagaagaaacaattttatatggtgcagtatttttatgttaaataatgttgtctgtttctttttgctaggttgatgggaatatgagcaaaatttattgccaaaacctttgcttgttagccaagctcttcctggaccacaaaacgttgtattatgatgtcgagccattccttttttatgtccttacaaaaaatgatgaaaagggctgtcatctggttggatacttctctaaggtaaaacaagagccagcatgaccttcattttctttttcaaaatgtttttggtagagcccaattctttgaacagggctttttcattactataatttgaataagtgacatgtgtttttgaaaagctcaggttcttgttcagagctcattttaaaagatgaaaacaaaaaacatggtgcctagtaagtgtgtaaaggacctcagcactgtgtgccgccttgatgacactctaattgctgccttgtggaccacttagcgtctttgattttctcagtgtttagcttatttccgttttccctttaagtggtgtcaacatgaaggtttcagtttagtgtagcatttaagagagaattctcctttctccttgttgccttccctctgtggtcaacagtatctcagtgagttaggacgctggcatttggacagtcaagctgataaaatgactggttttacacttttgtctcttattctctgtgctatggttttaagttctaaagcaatctcacctttagaaagcctaagtatcagccgggctcagtggcttacgcgtgtaatcccaggactttgggaggccggggtgggcggatcatgaggtcgagagatagagaccatcctggccaacatggtgaaaccccatctctactaaaaatgcaagaaattagctgggcctggtggtgcacgcctgtagtcccagctacttgggaggctgaggcaggagaattgcttgaacctgggaggtggaggttgcagtgagccgagatcgcgccactgcactccagcctggcaacagagggagactccatctcaaaaacaaaacaaaacaaaacaaaacaagaacaaagaaagcctaagtatctctggctgttagagtggggaaaacaatcgacatattgaggggacggatatagcttgtcctttttactggttcagagcagttcactcacattcttctgctcaaaggcttctaagaaacaataactcctttgcaataaaggaaaactgagtttggagatgtttaccaggtaatgaccttaacttttctgaggtacctaggaaatagttaaatgtaccaggatggtacataaatagagacaataattatgagacttttagatagaaggtccaaactctcttatttatgatatttttttatattaggtgatacatgaattttaatgaatctgctcttgcacaatgtaaatgggatgctttatagaagtgccattttaatgaagtttcaaaagatagaatatatgtgaaggtacttgcaaactatagctatcctaaatttaagaatcaacccaaagatcataaacaaaaataagtaacagcattcatggaaaactgtctcagtgttttaatccacatatttggtaaagctttaaaatgaaaaagaagaaagttaatttgcacattacaaattcaaaagatgatagagaattaacactgaataaaacaataaataggaaatctatatgattaataaataaaacaccttaccttttatgtaggtttgtcaagatcattcttctccagaaacttaaaaagaatagtggttgcgtccttgctgttagaaaatggtgtttctttcattgtctgtggatttaaacataggcttaacggtgcccaccttcctcgtgctgcactgaccatcccactcctgggtcttgtgttggctgctgagtagcagccatgtgtagagttggtggtgattcttgaagtttgaatttctgcctctcttcctgccagggtacccaaaattttactcagaactagctcaacttttctcatagtttcttctatagcatggcagcagctgctgttatttcctactattctggaatactaatatgccttggcagtatagtgaaacaaaaattaatctaaaaaataagcatgttaaaagactagatgaggccgggtgcggtggctcacgcctgtaatcccagcactttgggaggccgaggtgggcagatcatgaggtcaagagatcgagagaccatcctggccaacatggtgaaaccccgtctgtactaagaatacaaaaattagctgggcattgtggcaccctgtaatcccagctactctggaggccgagacaggagaatcccttgaacccaggaggcggaggttgcagtgagctgagattgcaccactgcactccagcctggcaacagcaagactccatctcaaaaaaaaaaagactagatgaaactaaaccatattctcatgtgtcagctggaatctagaggactctggccctttggggctattcttgaaccacattctagaggttattagaactacagttcaaggatagccagagaagggctggaatgacctggaaaggttcagtgcaaattgttacatgcatatgactttccaagcacataatagatggctgtaaacagaaaggaaagaaggattagttattttattcatagcttagaatttagctgtagtaacatgttaagctgcacggaggggaagaaggatcactactatgttggatctcaaaaaactccgaaaggtggaaatggttctggacaaagcaaggaatggtatcaaggatgaattctcttaacccagagtacatttctttttagagagagtgacccatttgtctaactttgcaaaacagacgaattacttgaacctttgccattgatgtgcacatccagtgagggacaattcatcttcttagaaaaactgacacacattgcttcatcctcattttttagaggctccatagacaactacaaatgtgcaaaagttgggagtacatctttttcacaaagaaatcttcaattctgccctgtagggttttttccacaaccatctcctgtgatctttcaaattggttcattaaagatctgggtgttctgaagtaattctttggtgtggtctgtaccatttgtggtcagtcttatttgtggtttatatttggccagagcatccacgacctcaaaagccttttccagatctctgtgtaggttttggcaacttctttgtactctgaataaaaaaatactgccctgatgccacatcccatgaaagttgcaaattcttctttaactgtaagagctgtttcttaccatgttctacccagtcttcctcctggtttcaaactgttcgtaatattttggtctaacctttgtttggaggctttagggtttcttgttgttgtctttttgtttcattttattttgttttcctggtttgaaatgcagattatttctctagctttttacattgactttttattcataggagaaatatatgtgtgcacatctacccacacagatactgttttagtttcactgggacatttgcccaaaggcagaagacagattgctgttgcagagttgtagattattattatatttagcaagatagccagctaaatcctaacttactccactgggtgactccctgggatgttattttctctatctctgaagttatttgagcaaggaaagcatttcttttatgctgtctatattctgttttatttggttcatatatttccttggattctttatgcatattttatggcactgactttcaagaataaagatgtagttgagaggcatgtcagagtcgatggtttgttgttaattgatagtttgattgattaatatagtaggatttttctgcttgatcctgacctaacccattggctttctttagtggacagttttacaaggacagtggcaggtgcagggaattgcccacttcagcagggctctgacatacttgatctgtttctccttccctcaggaaaagctttgccagcagaagtataatgtctcctgcataatgatcatgccccagcaccaaaggcaaggatttggacggtttctcattgatttcagtaagtgaagtactttatttactttcatgatccaggaagctgatggccgttacaggaaacagtaaaatataaaactttatttaacctgcattgttgtttttatcaatagataatgggctttctatttatatttacataggttagaacatcttcctcaagtgaaaaatgtactgctgctcagtgattgtactctaggaaattgagactagatctctcggcagcaggcctcatgcacaaagccattaccctgaatgaaccgacagaattacattccattttgtggtgctcatgctcattagcaccaaaagaggcaattatttgtgattaaagctaaaggaagtattatttgaaaggattttcagctctctgaaattttgcctataatcttgtacagtacaaagcagaaaaggtatatttccatttagaaaaataattttctaggcagcttatcctgggccttgctagtagaaataactcttaccttattttgttaatttcccttttctattatggaaattaatacagtgtttgtatctagaggtttcccaagaaatatttatcttatatgcactcatatcttctgaaccttctcagttaaaaccggcataatatataaaagtatgcacatggataatgtttttaaaaatggtagttttttttttcctccttgtttatattatactggatgtgtaaatgttgtgttaggggtacatttggagaatcaattcaaaatatctagataacatgatgaccagataacccatgataatagtcatttctcgtcatgtaaaaatctgtcactggccgggcgtggtggcttatgcctgtaatcccagcactttgggaggccaaggcaggtgggtcacaagatcaagagatcgagaccatcctggccaacatggtgaaccccatctctactaaaaaatacaaaaattagctggatgtggtggcacacacctgtactcccagctactagggaggctgaggcaggagaatcacttgaacccgggaggtggaggttgcagtgagccgagatggtgccactgcactccagcctgggtgacagagtgagagactctgtctcaaaaaaaaaaaaaaaaaaaaaaaaaaaaaaaaagtctgtcgctaggaaccaggtgcttcttgattaccagattgcagtttatctgattattaactgaaaggaggaaaatttaggactttgcacaatcttcatcagctacatcagatgcaaaaaccacaatgtaaatgcgcttacagaaaaccatgaagaaatatagtgaatctaaatctatattgttaggtattaaaagattaaggtctgattaaagtgtaaaataactgaatagcagttttggactgatttatatgatttattgacattgaagaatatgattcttttaaaagaagaattttgattatttttctctttttagataatatttttagttatttattaattaccctagtcttatctatactttcctgacctaattatccatgaaaccagtaatcccaaggagggccaccttaccaaatgcagtgtaccatttttatttttatagagtcctagctgtaatcatttctgagggcaaaaccatttatcttgttctctagttttgtgtggctaccattcataagtagttcataaatatagtttctggtatgcatagcagccattcaagccttaaatgtttggtcatatctatatgcctacagaataaggcaaactccttagctcaatatttaacgtcttccaacatctagttccagcctgtcctttaggctttttcatctactaatctcctttttctcaaatagtctgagcatggtcctatacctctatttttttgtctattcagtcccttccttgaaatgatcacctcgtcctttcctagactccgtctgttcaaaatcctgcccattgttaagagccagctcaagaatctctgctttttgatcccacctcctggaattttatctcatacctttattttatcttataccatattctatatggtatcacacttacactctgttcacccttttatgataattattgatggaggtttcatacttccaacttctctgtatccactaggacagtttcctttataataatatgtattagatgatataaattaaattttattgatataaactaaatttccaaattgatatatggttgctgtccacaatcattgtctacctaaaattaaaaaggaactggtacttactaggtaaaagttcaagctctaaattcagtagtatcttatttgtacagcatgatctggcactaaggccttctacataagagaacaatctgggtaacaaatacattatcttcaaatgctatgtcttttttttaaccattttagtgaaaactgttactagaaactaccttgtattattaaactacagaacacattgaaaccttttctcagtggctccaggccaccatgatgaatgctgtccaccaggatgtgagcaggcaaagtagtgctgagggtgtggtttttttcttttctctttcctgtacacctagcattgcccctactggagtgagttaagaagtgcagtgaaagatttgaataaagttgaagagactggtgttattccctcagagaaggggaaactaggggaagaattttatagcactcaaagaaaatgggaactggtgtaaacccaatagaaattcagtttaaaaccaaaagaatttcttggctataaaagttttaaggaagatagagtaggctgctgaagaaattaatagcaccttctcttggaagttacttaaagtaatagtagataaatatctttccaaaatgattgaaatccagcctttgaaggtagggatgagtcacatgacctctcatgatcatttttgatctcataatttggagcccaggatagaaagctaactagggttacaggttttctaaaatctgctctggttttttaaaggactttttaatggttaaatttattttatttctatttggtaaatgagcctggggccttttggtcagggatgtattttcagtaagtcaaatgaggttgtaaatcaggtagatctttataattgccagtttagtaagctgaaacacgatacgagcagggagaaagatatagccgcccacttgcacacttgatcacagacatgggtggaatgtgatgcactgtgtgtatatacatgctcctagacttacagtggggctgtgggctgataaacccatcataaagtgaaaatatcataaattaaaaatacatttaatacacctaatctaccaaccatcatagcttagcctggactttaaatgtgctcagaacacttacattaccctacagttgggcagaatcatccaacacaaagccaattctataataaagtgttgaatatctcatgtaagagtgttgtaccacatatcgctagcccaggaaacgatcaagtatggtttttactgatcataccatagtaaagttgaaccaagttgtaagttgtaagttgaaccagttgtaagccaaggactgtctgtataaagaactgcaaatgcagggctttgaacactgttcttcagggcagcagagtgaggtggaatggtcatccatgggaccatgtgctgcttgcagagtaagtcatttgtatatcacttcctagaccagcttctctgggatttgtcagagcaaggctccccaggaggccatttgcagagtttggccagagtgagtaaagggcaccaactcccaatctggttataaactccctagtgggttttatgactctttgcccacaattggaatgggtggaggagagagtgactatcgtggattggttgagaacgcattccttcctcttggattctaggattccctttctcagtcagaaaatttgaaagtcttccccatctctgtctgtaaagtctttctatctctctctccctccgtccccaccagacatctcagaacttcagagaactcccttgcccacaaaacatttgcagttcctacttcagagcctcacaccgtcaaggcaaggagctcttcttctcccagccactgctgagcactgggggcccagagtgctccctcccaagccctggactgcttctgctgctggggctgcccagcaatgccttatccatctcactatttttttctttaattttgaaataatttcagacttagagaaaagctctaagaataataccaaaatttcccgtacattgttgcacatgttcacattttatcacatctgttttctgctctattattctcaatctctccctttgtttctcttctctctcatattttcttttcagaatcatttgagagtaagttgaagatgtgttgcacctttacccctaaatattgcagtttttctacaaagatgctctcatatatagccacaatacaaattattaaaatcaagatattaaagtaatttatgcacatttgttcaaattttaaattttgcgagattatactgatgttctttctggaggaaaagaaaaatctcctactccaggatcacatggagtatgtaattatgtccctggggcctcctttaatctggaatagtacctgcttttttgttttgttttgctttgcttcgtgttttccatgattttgatattttttaagcatacaggccatttattttgtatggtgtgcctcaatttgggcttatctgatgtttcctcatgattagatttaggctgtacattttttggcaggaataccatagaagtgaccgtatgtccttcccagtgcatttcatcaggatcatatgataatacatttgtctcatcactgggttaaggtggtaactgccaggcttcttcactgtgaaattaccatttttcgctttgtaatcagtaagcatctggtgagaagatactttgggattatataaatatcaattctcatccaattttcacctcctagttttaccattcacttatggctcttatctaaaataattattactatgataattaccaaatggtaattttctaattccattctttctacaacttactaattggcattctagaaggaagaattatttcttcttccccatttatttaatttttttgtataattgtgggttttaattttattctataggttataacctgtcattaccatgattgattttgatgttccccaaacatcaaattgtcccagatttatttatcagcaaatgtttcaagtgggttcttgtgccttttccacatgcttccatcctgtggattcttccttcctttctgccacagcatgatgttccaggtttagcttatccttttcttaagccagccctggaatcatccatttctcccaagccttggttccttatggtggagaacagtagttaggaaccaggatctgggctgggtgaggtggctcatgcctgtaatcccagcactttgggaggccgagacaggcggatctcttgaggccaggagttcaagaccagcctggccaacacggtgaaaccctgtctctacaaaaaaaaaacacaaaaatgagccgggcttggtggcaggcgcctgtagtcccagctacttgggaggctgaggcagagaattgcttgaacccgggaggtggaggttgcagtgagctgagattgcaccgagctgagattgcaccactgcactccagtctgggtgaaaaagcaagacttcatctgttaaaaaaaaaaaaaaaaatggaggaaaccaagttctgatcacttaaatgtgcccattgctgcttgggtgtcactgcttctagccctctcagaggacagagctaggatagcatgcatatttatatccatgtatgtgcacatatacatatgggtgttataaacacatatgcgtgtacacacacactcccttcatgagttcagaccattccagatctgcgccaccatacggttgtattctgtctttccctcttcccatgtaattcctttctctgacagtgagaaccctgacttccattacccacaatatacttatgtgctacaccctagaatacacagtaagtagtttcagaattactaactcatgccattgtgaaaaacaaacctcttaagtggaggtcaatatttatatatggttccttttggctttaccccaagtgtatttagtcaaaacactgtgtttaaatgttactagagttagtttttctcccccttcagtgttactgtagtattcattggaatacaattaggcttatttgtttctgtttgttttttattttatacttgttacctttttaaattagaatgtaaaacattaacatgattttaaaaatggaaactgtattaaagggtattctcagtgaatgtgccctctctacccattcccattccctcatcctttcctgcaggtctccaatctcattagcttgtagtttatccttcctgtttctttgtgtacaaatgagcagatagatgtgcatttttctaatttctcctcctttctaacacaaaatgtagcatactataggtagtcttttgcattttgatttttccagtatatcctggaaatgacttcatagagatttcttttctttgacagctgcactctactccgttgcatgcatgtatacagtttgcttacctgctttcctatgtatgggtttataggttgtttccaatattttgcagtttaaaaagtagtgtcatgagtaatcttgggcatattttgactgatagatacttaggtagcagttattgtatattagatatcctttcagttgttaggactctgtttggctaggtaataagtgagcagataatgaattgtcttttactcgggcctgcagagccagaaccctggctgatgggcaggatacaaaacccgttctcctgggctctgacccaggagagaccgagggaacaccaactgattcagcagtaggtgagagaaccaagtgccagatggtggtgagggaggtggcaccatcactcacatgtgtgtttgtgtatatgcatttatctgatgccaaactggaggataaaggaagatgcgaagagtcatgtccttcattttttacctctttactttaaccttattgattgggataccacactctacattctgctaaacatcagcaaccaaaagggaagaagacatagctcttgctgggctgtcaagttcactgacaaatcaacaaatgttgcatagtattttggacagtatgccttgagagctcataagaagttgaaatgaaaacattctaggcagaggggagcagcatattcacaagcatgactgcgtgaggaagcatgttacatacctgggtaactacagcagaaactccaggtagattaaagacttgattaccaaaaaacagacacacagaaacacttaaaaagctagaggagaggtggggtgcggtggctcacgcctgtaatcccagcactgtgggaggccgaggcaggcagatcacgaggtcaggagatcgagaccatcctggctaacatggtgaaaccccgtctctactaaaaatgcaaaaattagctgggtgtggtggcacacacctgtagtcccagctactcgggaggctgaggcaggagaatcacttgaacctgggaggcggagcttgcagtgagctgagatcgcaccactgcactccagcctgggcgacagagcgagactcggtctcaaaaaaaaaaaaaaaaaaaaagctagaggagagattatgtataattatttatctgatctttggatggtcaaggacatcataaccatcaaagcaatgaaagaatatgcagatagacttgactatataaaaatatagaacttctatctagtaaaaagtattaatatttaaagcaaacataatgagaaagatgtttgatgtttacaacatatgtgctaggcaaagtttaatatctatagtgtttaaataaatatatatatacttttaagtttggtagcattaaaacaaaaaccctaatagagaaatgggcagaggatcagctatggtggctcatacctgtaatcccagcactctggcaggccgagacaggagactcacttgagcccaggagttcaacaccagcctgggcaacacaaggagaccatctctctctctttctctctctctctctccccctgttctccccacccccccattcccctccttctctcgtctctcaataaatacataaacaaataggcagaggacaggaacacagaatgtacagaaaaggaaaatcactggtggccacgacattgctgacatttactgagtgagtaacatgtgccaacccctttcctaagagtcctgcatttattgattgattcattcagtcctcacggcaacagttgagatatgtgcttttagccccattctatgggtgttgaaattgaggcacagttacacaaataagttgcacagctgcaaattgaacccaagcactttaactgttagccactccactccgaagtctcttaggtataatggctaattcaaatatgaaaaaaaaattgttggtggtttaaaaatgcaaatttagtaactgcaagattacaattttttgcctaccacactaacaaagagtttacaacttacccaaatctaactaagctggtggaaaatggacaccttatttacactgaagaaagtgtatattggtaggcattttctggaactttgacagtgtgtatcaaaaacatctaatggtttttttttttaataaaattttatgtatttaaaaactaggctggggacagtggctcacgcctgtaatcccagcactttgggaagccaaggcaagcagatcacctgaggtcaggagttcgagaccagcctggccaacatgacgaaaccctgtctctactaaaaatacagaaaatagccgggcgtggtgatgggtgcctgtaatcccagctactcgggaggctaaggcaggagaatcacttgaacctgagcggcggaggttgcagtgagctgagattgtgccattgcactccaaccaggtgacagagtgagactccatctcaaaaagtaatacataaaacaaaaaatagagacagggtcttgctatgttgcccaggctggtctcaaattatggagctcaagcatttctcctgccttggcctcccaagtgtgggattcaggtgtgagccaccgtgcccagcctccaatggttattttctaaaggaattcattctagggaaatcagcatattttaatcaacaaacattattttcatagttaatatagcaacattattttgtttcatattattatgttttaaatagtggacttctctttttgcctccctcccccagcccctgattatagcaatatggactcatagtagaaagttaaaaaaaaaggtgtaattaatagaagaaaatgtcacccagagagttaatgttttggtatatttgtccttcacactcattatttacaacaggtaaaaaactaaaacagacttgatatttcaaaggcaagagagaaccattcccacgagaaagttatggcacatccatataatggaatattattagctgctgagaattatgttctgaccaggtgcagtggctcatgcctgtaatctttgggagactgaggcaggaggatcacatgagcccaggagttcgaggccagcctgggcaacatagtaagaccccatctctacaaaaataaataaatgaaattagctgggcctggtagcttgtgactgtaattccagttactcaggaggctgagtcctccattaaggatggcttgatcccaggaggtcaaggcttcagtgaactatgattgcaccactgcactccaacctgggcaatagaaccagaccctgtttcttaaaaaaaattatctgggaatttgtaatgcttgtgataagcaagtggctttcaaaattatatatgtaatatgttctcaattatgtaaaaaatatgcaaagcaaaacaaatacatttctagatgacctctggaattagaattacagatactttttattttcttatttatactttttgctgtaactaaaaagaaaagaggccagagtcaatggaggcctgacagtgaggatgcatggaaaagaggcaggtcctgttcgttccgtagcaggagcatgcctggtgcagagtggtgctcagaaaatactggtatttattgaatgcataactgagcttggagagatagtgagcgcagctttatgtagctttcactgtgcgtttggatgtctacgtgcactttgcacagactccagagctcagcagggggtctgcattagagggagcagctgggagtcgtggacatgcggtggtagctgaaaccatggatgtgggtgagggcaaccagggggaagtgtatagggaaacagggctgagggtggagtgcttggagtgttaacatctaagggactaataaagaatgaggagctcgccaaggaaatttgcaaagggcccagaagtcagaagaaaattgggagataatggtgttaggaaaaccagaagaggtcagtatttcaacagtaacagtcacaataatcatcatagctgccacttctagagcccttgctatgtgtcaggcactgttaccggaattacacacatttactcacttagtcctcacggagaccctatggggtaggttactgtgaccatctctcttctgggacgagacactaagagacttgtctaagatcatcccccagagattcagtgccccagagagaaagtcataagaagtattctttggacaactgtatattaagtgcgattaaaagtagattcaaaaagcttttgactgttttattctgtttggttgggcgtagcgtctcacgcctgtaatcccagcactttgggagtctgaggtaggtggaccacttgaggtcaggagttcaagaccagcctggccaacatggtgaaaccccatttctactaaaaatacaaaaatatggatgtggtggcatgtgcctgtagtcccagctactcaagaggctgagataggagaatcacttgaacctgggaagcagaggttgcagtgagctgagatcaccccactgcactccagcctgggcgacagagcaagactctgtctttttttttttttctttttttaaaacaaagcaaaacaaaacaaaacaaaagcttgactgtcaagggctggggacacaggaacctagttgtctttatttttaagctggagagcctggagcatgtgtatgtacatcagtagggaaaagaaagagcagcgctgatggaaaaaatcgaggggaaaacaaaaagcaacatccaggcaggtggtttattacaaagtctgatctggcatttgatgaaattcaacattctctcctaactaaaatacttaaacctactaactagaactataagggttctaaatctcagattaactttttcttttttatcgggggcagacggacgtgtaactaacgctataaagggtaaaggacagctggatccaagtctacagacttacgtctatagtttttagagaccagataaacttgccattaatattaattaatggcaagttcgtcagttaagttaaatatcagttaattgtacattcaggcatttctaaaattagtatgtttgtggaataatcataaaaatgtgtcagcagtttcaatttttggctttctttattcagtattaaaatattgggcagtccttcatggaacaaggctgtaactataggaagcagaagtgattgaatgaattaggcattcacttcggggaattccctttgctggctcttcatatgttgagggtttcaccttagcttttgtgaggtccgtgtgctatttaaaaactgagtctataattaatcagcgctgctagaagatggtgcaaatggcccagttttgtgcctccaggttatgaatttggctcttgtcttcagtgtggtttgcagcgtccttctacatgtccccttttttagaaatgatactcccctccacccctgccccccacacacatatacagccaaccggatttaaggaaagcaggaactacaataaacttttgaggaaagatgctttagggtatgatttagtaccttagttcctttctcacttgagtattaatcagtgtggttttctgcaccgtcgttctttcctcctctggtttaatgacagagatttcttctttaggtgccacaaccacccacgtccgtagagatccccgggcttgtttctcctttagcctctgaatagttcttggctgatttcttgaggaagcaccgcattggaagagaaaagcatcttctctttggtttcctgctccctgcttctctgcccttttaagtccataaagcgaattaggaagaaagccacatacttcatttctacccaggggggtatcatgtcaggaggctaatcatatccactctctcagagagaaagctgcttcttcccagaatcttagatgcaagctactggtttaaatgttgtattatatgatggctaaatacagaagtacgtgtcatagtagttcaggttgccagctactactagttttcacagtctgccttcagtgggctattttgtttaaaagagcttccacttacaagcttttcaaaatacaatttaagtgaaacttaagagtgtttttaagtagagactaagtggtttcatcctacctgaaaattgccttcttgaaataaatgtttgatacccactggcctatctcctctggaaaacaggagttttcatttagaagtccagttggttggattccagtaagccgtttcacctgactgtattacgccccctggaaccagggctgtgcaggagccaccggcttctcccagagggcagggtgagcacagtatcagggcacatggcttaccctcaggagctgcatcccagcctcaaggccctggtgagaaactgtgctctccagcaagggtctctggccgtctctgcaccgtgtggtcagcttagggctgtgcctcccaagacaggacctgaggatgggtatgggtagcagagatattgctccctttgctcctgggtgtccagagctccagtgcctgtcacctcacctctagcagcctcaggagctgtgtaaattctgtcatatacatgatgagggagatcatgaagcactcacttgaatcataaagtctgtctgggggaggctgcagagtaaatattccactttccccacttacaggccccacaaacaagcctcagaaatgtgtttggagggaccatgacagcatctcttagggacttgtgttatttagttttctctctctctctctttttagtggcactaaccaaaaaaaaaaaacaacaacaaactaggctaagcaagtgcagagtcatttataaacttgcataggtcttttatatacagtcatttatcatttaaaaactgagattcattttgagaaatgcaccattaggcaacttcattgtcgtgtgaacatcatagtgtatgtacttagacagacctaagtcgaagtctataggttactacacacctaggctatgtggcatagctgattgctcctaggtgaccaacctggacagcagttactgtactggataccgtaggtgttagtggttgtaacataatggtatttttgtatctaaacatatctaaatatagaaaaggtacagtaaaaatatgctgttataatcttatgggactaccattgaatatgtggtccatcgttgacctaaacatcattatgtggtgcatgactgtatttattgttgattgcccatgtctttcaccaaaagtaagcttcatgagagtgtggactttgctctttgctgcattctgatcttctagaagagcctggcgcttagtaggttcttattaattgttgaacaaatgttaaattaattatgacgggaagaacttttaaaatgtgctttcccttctagtgtgtgattcttagggacaattttattttattagaacataaaccatcagcactggtttacttacttccaaatgatgctaggtatgccctgtcttctttcgaggtctggtacttttgctgaaatgcagcctctatcttaagatcatttcagttgcatcagaaagaagatgtcactgcctgctctaaaccttgggcggagaaagcagagctgtgacataatccacatttgtacatagcaggttgaagagacacttaaatcttttgcttactttttctcttatcagataattcatttcttgattgcatttatttttgaaaggaaaataccagctttagccataagaagctgtcaagaaagcttctctttgcttagccttcccagcagctacgctcctgggtgagtgcagtcaaggcaatcattaaagaataataagttatgcttttgaaatggtgctcaagtacttcatagccttttctaagataaggagcctcccacctttgcccccatgacacttgttggaaaatactggaccagcagctatatccttgggcttttgctgggttttggaagacacattttgacctatgtaatcaagtataatgatgacatttattttaataggattctagtctgtaatataataaggaaaatggctatttttccttattttctcattataatatgttacactaaaagcttctgccattactgttttattatattggtctgaggtacaatatattttaatatgctaaagataacatcaaggttgaaaattgagctctcagtgatttattcagaggttgactgttgctgaatgcattgaaatgagttgcatgagacagtgcggctaacgatttatttgtgtatctttttttaagctaagcttgtcataaataagagcaaataaatagctcttatagaatagtttgtattcattgcctcaatgaaaacattgtaaatatgaaacatacggtctgcagtctctctcattttttctgaaagctagtgttttgccttacatagctcagaattttttcaagttttggcatgcaggtggttggttttttttttttaccaaacaaattttttgtctgtttggatttctaacgttgactggcatttgcattgagttattttgaaatccactactggacaaattccattcaaataattggtatgagaataacctaatcttcagcagaactggaacaaaatgaaaccttagtgggaccatcaagagggcaggaacttggtcattgctaaactccaagccatgagcacagtgcctagcacatagaggatacagaataaaggattgttgggggaaatcaatgaatgcctgagtctagttaatccacttctttgtatgactgtcaacacctgccagatgcatccagctagcttttgaccagtagtgcttaaactcagatctcctctcagtctttgttttttacactttatttatcccttcatcccatccttcagcaaacatgctttaaatacactgtgccagggatggtctaggtgatgaggacataaggatgaatgatttagtccttgcccatagggaagtagagggtcagacacaaaattcttcccagtcctgcaatttcaaatttcagagaggctgtggcagtgcagaggaggaaatgcttccaactctattttccatttacccagttaagatatatagaagagacgcatttttccttgcttttctttttaaagactgggtctcactctgtcacccaggctggagtacagtggcgtgatcatagctcactgcagcattgaattcctgagctaaagtgatcctcccatgtcagcctcccaagtagctgggattacaggcacatgccaccattcctggccatttttcagggggaggggtggggggtcagctagagacaggctcttgctttgttgcccaggctggtttccaactcctggcttcaagttatgctcctgcctcggcctcccaaggcactgggattacaggtgtgagccactatgccctgagctgttgttaaaacaagatcaagaaagattttgctctgcttggttgaaattagtgctatacctcatttgggtttcaagagaactattcccccttgaacatatattccagcttgtaatagagacattatgtttgagatagaatattctaagataaaagtttgcttccacttacccctctcatgatggcatttcgtttttttgttctttttttttttttcttttgagaccgagtcttgctctgttgcccaggctgaagtgcagtggcacgatctcagctcactgcagcctctgcctcccgggttcaagcagttctcctgcctcagtctcctgagtagctgggatcacaggcacgtgccaccatgcccgggtaatttttgtatttttagtagagacagggttttgccatgttgcccaggctggtctcaaactcctgaatacaagcgatccacccacctcagcctcccaaagtgctgggattacaggcatgagccaccacgcctggccctaaacaacacaactataacttcagctggttgtaaggtagttttttggttggttggttggttggttgttggttttttgtttgtttgtttttaaatataatttcatattgggtaaaacaaaaggttttccttaacttgtttagaattgtttaggaaaatactagttaggaatctgattttttttctcccccatggatttgtggttagcatgtttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcggacgtcagtctccacaataaatttgcatatgtccttttttgggggcaaatacagtcatcattttaaatgaagtcgaagagttatttctgtaaacaaaacaaaagtcctccttgtcatactagacagcaaggaagcaaaaattgttagggtcatgtcaaaaagactcaggagtcaatttgaagaggttctgaccagacaataaatataataataaagataaaaaattgcaatttattgcaacttgtcaaatgtttaaattcacaagttcataatgatactaaaaaacaaactgatttagaggataataggaaccagtttattttcttgaaagctgcaaaaattgcaattaaaacatttatcctgcctttcttacataaactgtacagtgaagtaatcaagtagtaaaggaggggaaacatcattttattttttaaatttttaaaaattttttgagacagggtcttgctctatcacccaggctgtagtgcagtggtgcgatctcagcttactgcagcctcacctcctagactcaagagatcctcccacctcagcctcctgagtaactgggacttcaggtaaacaccaccatgcccagctgattttttcattttctgtagtctctttatgttgtccaggctggtcttgaactcctgcgctcaagcgatccatctgccttggcttcccaacgtgataggattacaggcatgagccactgcacctggccagaaacatctttttataaacatattccagctaaccaatgaaaataaaatgtacggtggctcacacctgtaatcccagcactttgggaggccgaggcaggcggattgcctgagctcagggagttcacgaccagcctggacaacatggtgaaactccatctctactaaaatacaaaaaattatccgggtgttgcggcatgcacctgtagtcccagctacttgggaggctgaggcaggagcatcccttgaacccgggaggcggaggttgcagtgagctgagatcgtgccactgtactccagcctgggcaacagagtgagactccatctcaaaaaaaaaaaaaaaagaaaagaaaatgacagaattaaaatataaccattttgtaatccccaccaccaccatgaattaatggatctagacaatgaacaacatcaacagttgcaaaaaggacaaccagaaattatctatcttctgatcaaggatatttgtagtcttgccagtggatggaacccaagtctaatcaatcaagcactggatctagttaccattttgcaagagatacagagtaaagaggagcatactgagctgcagtgcaagtaggagatcagcaaaatccagagtgaggacagtataggtcaagtggccccagttcaaccacagatagattacaaggaaaagaaaggggtgaaggtggaacccctagattaaaatgacattaagatttttttttttaataggcaagactgttctagtgcctggactgttttggtgatgaaagtataaaaaaatgcaagagattattgtgaaagtcaggatagtggttacttatgagagagaaaggagaggtgattggctggagcggatagaaagttttctggagtagccggcaaacttctatttcttgatcctgggtgatagttacaaggacagttgccttataataatccattaagctgtgtatttgttttttgtcattttatgtatctctgttttatttttgttttttagaaagcaatcatcttaaaatgggaggtgacatcctatggtatcttagtgcttgggtttttgtaactcttgaaactgaaaacttactcgatttattggtggcatcctactagtcatgttttaaagagagacacagttttcaccttgactgcttgaaaatgaaaacttgagtgcacaagtatttagtgtacgggcatcaactccatgtcagcctttgcagagccatttttatgtgaaggaaatgtactgaaatttacttgaatcaaatcctctgaagtgttgagtctagttcattagagaacagcattcctgtaaatttcactttcactcttaaacttagaaaaacataattgaagggttgtgcgttaacagaatgaggatgaaatggaggattcggacaaggaatggtgatgcagagtgaggatggagtacagagaaaatatttaactgtgagcccgaggagagaaagaagagacactgcagcatgagaactgttttcccatttttctttttttgtgggaagaacagcaccagcagacactgtaagatgtgtacaggaaaattgctctttcctcctcctaggttgctgagcagttctaaaatttgtggtagatctttaggcactagaaacagaacttagagaaaagatgttaaaagttagatttttaagaaagggaagaaaaaggctacgatgacttaaaatgtcctgaaatgaggctctgctatttatcagaaaaacaggcttccttcttcttaagaaggtgattgtctgttcatagactaggagtcctgccctggggttcacccagcgttggagcttttctccatgaagttaaggacattaataagatttttctctaccaaagcagaagatgctctgaagacagcctttcatccctgtagcttttgagttgcatccagttaaaaacttgtagaacataatgaatgtttttagagaggaaataaaatgaatgatgcccgtgaatttgttttaaacattgtttattttacctaataatttatataaatcttccttgaagaggaagagaaattaccagatttaattaataattggaagctttttagaggatttactttgaaatacctccctgccaatttttcataaattaagcataaactttctttgacctcatcacacataattaaatagctgtggaagggttaaaaccaactaaaaagcaattctgtatctcaatctccattctcctgcaaaacttatacaggaagtttgtttcagttctcaagcagggtaattacaagagacagttacataatttacacttccaatctacttgtctataatcacacacttctacctagttgtatatacccccatgagtatgtgtgttgtactttgatttgtaaatgatgattgcagtgtgattgattccttgcaatgtagcatattgaattcattttttaaaaatgaactttagctgttaacatgtctatttgagttcctgttatttacgtagtttgtggttcttgtgttcagcagttgcataccagctaacaaattaaactcccagagctttttttctcattaaatttggaaaatagagtgtctgtatacaacctaaatagaaaagtacctagtacctagtaggcactcaactgttggacatagcacaaaaccatttcaagcctttgcaggtggaatggagattctttgattaacataatataaagtctcatggggataatattagtatattgtggtgaagctctgctaatattaatgtattgttactgaagtctaaaatttagccaaacagtggacagaatagcggttcattccaggggcttagagaaatgtgtcatctacaacctaagaggtagtcattgctgtctttaatgctgctggtgacgatactgcatatgtgtttgtttttctaacagctaacatctactgtagccagtttggactttaagattccctaagattaaaggctaagtccctggccgggcgcagtggctcatgcctgtaatctcagcactttgggaggctggggcaggcagatcacctgaggtcaggagttcgagaccagcctaacatgaagcaacccgatctctactaaaaatacaaaattacccaggcgtggtggtgcatgcctgtaatcccagctactcgggaggctgaggcaggagaatcacttgaacccgggagatggtggttgcaatgagccgagatcatgccattgcactccagcctgggcaacaagagtgaaactccatctcaaattaaaaaagctaagtccctacatgacaccaagtccatgggcaaaccagccagtcacttgtctggcccccctcccaccctagctccgctacccagggtgcctttgtgctgcacagcttcagagggggctcagcaataaccctggggggacacaaccattgatctccagaggcttcttacctcaaatcacgtttcaaagcatttgggagataaataaaaaataagcgaaaagaaaagtagaccagtggagtgggattgtttgtctagataacctgaggacaactagcgacagtttctcttacatttccaacagtggttgatcagtcagattaggtgatgggctgtactttgattttagaaagttatctccaaaactgacagattcctttttgaaatgtactttgtttgaaaacaaagaaaatttctaaggagatttgtattctcattttttctttcttcaatcttgctgtgtatttttgtttgctgtgtgaaagctcatcatccagaattggaattacaacatactttgtcctatttttaaaaattacagctggtacatacacacaacactcccttccacatatacacacagcattttagggggcttgtaggagagcaaatggaaaggcaagttgctattccaaccatcctgtctcccaaacctggttctgaaatcagtggtactgccatgattatgtaaatagcacccctctcccaccctccaccatcggtctgtggggttggaccagaccagatgactagatattagaatgaagtgtctcagctgcctcagtagaacctcagacctataaaagtaggcaaaagaagtctcagtttttgcatttagtgatttagttaaggaaaatgttcaatcgcagtgttttcgcagcaggagaacaatcttaaaggtaaagcattttaagtgcatgcagtcatttgtttggcgcagatgctttatttaaagtgtatatgtgttcgattaagtttgccatcttaaagcctttcagtggtaagttcttgttaccagaattttgtaacttagacatgaaaattttatccaagtttcaacttggggagcaagcctagggggagccaggtatttaaaatgctttcttttagtgaaaactgaagaattaagttgtcttctatttcaattgtgttattttctatttcaaaaactatttctttttttaatgaatctctaatgtagacttttgcctatttataagagaggaaataattttaaaatgccaaattacttcatctttaaatttttaaaaataaatgtgtttttcctaaaatatcctagaatttaaaagtggtttgaactgtggaaaacttaaaaggtcaaagaggaagaccttcctctgcatgcctttctaatttctgtcatgctgaaggccatagcactggggctttctcattacctaactgaaagtgcctctgggtcacaaatcagagcattaacttagtttggtgataggcaatgggcttcgtgaacaatttggttacttcaacaatttggtaagctattcttacatcaacatatttttaaaaattcttgccttccccaattttagtttgggcataaatgatactgacagagtataacatctctcattccatgatcattttatctgtgtggcaggtgcctcattttcctaacaaggaaattgaaggatgaatctatatcatagtcagtcaccttattaaaaaatttttattcttctaatccactagaccaggaactcggttgtggtgacacaccatacactcacaaatactcctcagttgaatgtttaatgaaatgaaactctgtgaagtgtatcacacagttgtttacggagtggccatcctcccctgcgtcagttcagagatttgcctgctgctgggatttctcattaggcaccactgctaccactatagccctgtgaggtggcaaaaatgaagaagtggtgctgtaccccatttaatattctggcccaagtatagtcccccaaggccctttccttactgggacccataatatatctgaaaccaggcaagtcatgaggttgggtggaacacagacatctgtggctttttaaagccccaagtgagtctgatgtgcaggcagggtcgagaaccactgggctatacttgaagacagaagaaggaacaataggccaggtgcaatggctcacacctgtaatcccagcactttgggaggccgaggcaggagggttgcttgagccgaggagtttgagaccagcctgggcaacatggtgaaaccccatctctacaaaaatacaaacattagccaagcatggtggtatgcacttgttgtcccagctactcgggaggctgaggtgggaggatttcttgagcccagaaagttgaggctgcagtgaaccaagatcacaccactgcactccagcctgggtgatagagtgagaccgtgtccaaaaaataaaagaaaaaggagcaattaattctctcactgggtaagagaatcaggtataaatgccatctcacacagatgtctctggccctcaggctgcttccatgtggcacgtgctatcctggcacctccggctcaggagcacatccacagaggtctacgcttctcaacacaggggcggtgcagagggagggaagtcccctttcgtgctgcctgatgccctacttgtgagttcattttctttctgagcacctgtacctttccctgggggactgacatgcagaatgaccaaccccgcaagggagtccacacctacccacagaaccatggaaccatctggtaaatcccagcatggtcagtcagctcagagacacaggcacaccacacggcatcggggagtcacactcctgccatacatcttccactgtgggagttgaaggaagaccattccactctggaatggacttgaaaggatggggacattcagtaagaaaaatcagtggccctttggggaagagctcagcagtggaggtctgctgaggaacttgtgggatcccagagaagagagatctaagagtggggcttagagtaacaggctggtatgtgacccagggcagccagcctccttccccaaagacatgctgtgtccatgctcagggtttcactgggtcaggccattttcccagagacacacttgagtcttgttgaatatttgagtctttcatctgtcttgggactgtccctgggctctgctgaagccctaagcagtcattgtttctgtggttggatgggctagccatttcctaagggtagtccttgaagttaaggactaaggggccaaagggaatttgggggcacagaactgtgtttgctgggaactttgttgccatttcttaagaccactcctgaggcagaattttttttcatagcctctttctttaattcaattgatatctgggtggttagctggggggaggggagaggaaggaagggtgggatgagaggagagcttctgtctgagttcatggaatggtttttaggttcctcaggcaaaagtaggaaaacaaagttagcttttctcaatctgattctatagagcagtctgtctctgttgtttcccttctgtccaaattttatttctttcccctaccttaaggatgtttagttacccaaatgatcaccttgagacttgattcattcagtatgttgaataataatcatagctaacacttattaggattactgtgatgcgtcaagcactgttctgcatgtttcatattaactcaatccttaccagaactgtaacagttaggtacagttattattcacatcttatggatgagggatctgaagcacagagaggttaaataaaatccctgaggtcacacagctggtacatggtggaccccagattccattctgggtagtctggctccagagcccatgctttccacccacccatagagcctctcacgatctgtcgtattgtatgcaatatatgacatattgttttaaaatacgggtgccctgttacccagctttaaaaaactcatctttgtttagtgcacatggtctcaaagtatggttcagggagtctacaaggtcataattattttccaagtagtactaagatactctttttcctttttactttcattttctcatgagtatacagaggagttttccagaatgtcatgacctgtgatatcacagcagactcaataccaaagcaatctatgaaaatctagcaagctgggtgcagtggctcacgcctgtaatcccagcactttgggaggctgaggtgggaggatcgcttgagcctgagagtttgagaccagcctgggcaacatagggagaccctgtcttcttgaaaaagaaaaagaaagaacaaaataaagagagaaagagagaatctaactggcttctcttaagccagaagttaaagagatttgtaaaacatgtaaaataatgccactcttttcactataaattttatttatattttagaaagtataggattttttttaatttaaaaaaatgttacataatgggtttatcgttatcttttagatgaattaataaatatttgtcaaatttctcagtaaaattaatagatagagcccttaaaagcaaaagctctctgagtgctgaggccaaagcatttgaaaactaccgatttaaagtataaaccattgctattcaagtgtggtccatggcacaggaagttgttagaggtgcagaatctcaagccccacccctgacctactgaaccggagtccatgctgttaaccagaactagtttgtctgcacaatggaagttgagaagcagaggtgtagaacatctgcacgaagcgatttggcaactcagtgacctctagccaaatttcagtctggtggggctttggcgagtccattctccaattatcttgcatccaaggagctgagtgaggtcttacctatttgagattcttcagtcctactgtctcttaagtggccacaccctcatcaaagccagcagcttcagagcagggttctagtggtggttttcaaactcgggtacatcagaatcacctgggggacttctgaaagcacagatgctgggctctgcctctccccaccaaagatcctgattcagcaggtctgagataggttctgagaatttaaagttctagcaagttctcaggtgatgttgatgccacaggtctccacactgagatcttgataaacagcatttattcaagttcttatataattatgtcatgcccataggacttatgggagagaggtcttaaacttgtttcaacaccaatctcttaaaagtaaaatatatgaaaaattcaaaatttccgtctttgccaaggaggcacctgtatcttttaataagtggaaagcagtaagatatcaggcaggtcacaggtcatttagagcacggctgttctcttaaaatgatgtgagaactaaggttcagcatccttctgcactaattgcaaaatcaccacaaaatttaaacgaggagatataaatagcctgtcaagttcatttgtcattatttaaactgataacatgccattcatccagttggtcagtgctgctctgcaccagaaaccaggaacagatgagcgtacaaaccagtgaattgccatctccaagcatgagataacttggttagagtcatcagatttcctgtgctcaaaagctgccataaatccctggcctcgtgtctgttcccaggcttgcaaacccagtgccgtcgactgatacagacctttcagcaggatttgctgagctaaacaggtgtctgatgaaaagtgtgtaatcctcaaagattatcatcccctaaaagcagctggtgaccccaaactcacataatccagagagatggaagttgggagtgagtagcttgccaaagtttacactttggtgtttgaggaggttcatatggtttggtttggttccaggtagtggaagatggaggtgtgcaggggtgagggtgtctgcccctgtcgggggagatccctgtccctatccatgcccttgcctgagaacattattctactatggtccatttacactcttgaatactcctagtttaaagggaaggaattttcattttcaatgagcgttaacattacagttattatgctgggaattaaatttaatttgggaatttgggtctgcaaaaacatatcttgaccttgtctagatagttccttccttatcctaatagatctgtctacatgagataactctctaccacttttattttctcccactgggagagagttaaccatttcaaactcagggctagttaacatgagatttgattcttttactgcaagtagttaagccttaacagaggtgaggcacactcgggttccatgcagtacagcttagaaatgcttactttttatagacagaaatcacattgttcttcctttccctttaagcagacatcttgacaatcctttgaattgattatgtggcctgtatactgaaagtcagatgtcaccttccccaggataagtacttccagtaaagcaaaagaggaagccagcttttgctacgatcaagatagttgatgtggatgaggggtttatgggctaccccgttttcaattacaaggctcccactcacagagtaagtgctgttggccagcacctctggctcacagacaagttccagggaataatttcaccagcgattaattatactgcagctactgggatttgtcctccaaacatcactttgttttccatctgaaacagccaggtttctccagggagagctgaggttttctgattgaaagtatcccgagttaaggagaagtgttagagcaccatgggaatctattcaccaggggtgtactgtacttgtttcagatgcttcaggataatacaccagcttctaagataagtgctttttttttttttttttttttgagatggagtttcactcttgttgcccaggctggagtgcaatggcatgatctcggctcactgcaacctctgcctcccggattcaagtgattctcctgcctcagcctcccgagtagctgggattacaggcgcacgccaccatgcccggctagttttgtgtttttagtagagatggggtttctccatgttggtcaggctggtctcgaactcctgacctcaggtgatctgcccacctcagcctcccaaagtgctgggattacaggcatgagccaccgcgcccagccaagataagtgttttttatttccctgcatcttagatcaattatttggaatttttttggtaagttaagagctgtaacttaaaccaccacatctctatgatgtactcaataagtgaaatgttcttaccaaaaatttttcttccaatgggctatatcataattatgttgtgaagagcctagaaaaaaatagaggccgggcacagtggctcacgcctgtaatcccaacacttgagggactgaggtcaggagttcgagaccagcctgggcaaaatggtgaaaccctgtctctactaaaaatgcaaatcttagccaggcatggccactggcgcctgtaatcccagctactcaggaagctgaggaaggagaatcgcttgagcctgggaagcggaggttgcatcgagcccatatcgcaccattgcactccagcctaggcaacagagcaagtctctgtctcaaaaaaaaaaagtacaaagaaacaaaaggtggcaagaaattcgttttttaaaacatcgcatgttatgagggtcagagtagtgaagtgccaccagctgcagccttctgagaggaagtgctgctgctggttcaaatggaattctgtcctacatccaccaagcacgccagtggagtggacatgacacacacttttcttctaagctgtacagtttaacatattacaagtgagttcatttaactagtaaggaatcagaaatgtatctttgttcattttgatcgttttgatggattctgttttctcttacgtgagtagactttgtggacttccaaatggctcctggcataagtgccagttcctgctattagttccttgagggtctcatgagtcagagaggagagggaaaaacccactgcaagccatgcaggggtcccttcggatagtggccttgtgcagtctgcagtgtcggtgcacgtcatccctgcacacccgcctgctgtgctctggctggagcttgggtttgcagttgtcttctttacagcacccagggaagcatggcctcctggcaggtgttggccactccctgctttctcctggcctttgcaagcacagtgcaagggtgtttgctgaaaaagaccactgggctttcagtgtacccacacccatcagggctgatcaccctgctgccacctccccaggactcttccgtgactatcagtcatagcctgaagtctgtgtccaagggagtgtctcaggagacagccacttaacatggtaggagtagcaggtgctaaaaggtttatgcctaaatgctccccatggaccccaagttgcctgctggtttgagtggcctaacccatttaggctcaggccctgacagggtgtgtgtgcaccacttcggggtgtgaaagcatgaacagctgcggaaagcgtgggttttctgatgctggctgctgctgccttccggattagggactgtagcggggagacagaacaaaggaacacatgtgcttctgggtaagctggcccatcatagtgggggacataaggtatgggggggcacataccaccttggtatgaacactttggttgtacagaattctttcagcaaggctgagaggagtggggctttctgtccttgactgctggattcaaataagcaccagtagaggacctggggactttcacactcactgcaggggactttcaattgtgggatctcatggacaaaagggaatggttctatatccacggctctatggttctcacccccccaggagtacaaagctgggaccccccagcctcctgggtacgtttctcagcatgtgccaagcactttggaggcaggtgacggatgtgccaattatctgtattctgaggtgtgggctcccttcatactctggcaacacagagacgtagagagctcttcttcgtgttgacaggacacaatatgggctggcttcggcacagtggccatcactgtgttagcattcctgacacactgctattgaaagccccaatctgctgccaaattacatgtagacagtggtttcactgtaaaatgttgcggtgcttgtttgcattcagtcaaatactttgcacttaaacatgggttaaagagacaaataagtcaaaagaccttagcaaaacctgaagttaaatttacgcctattcttcataatggcattcagattaaagccatcaaaatgcaaaatgctgtgattatacccttcgagggttcaggctggattcttgttttgtatttctgcattactgtatttgcagtgattttgagatgcaggaaaatgcatcagaggcattgatttcttctttaacaaaaaataaccctaaaattgagaaaattcttgagaatgcagccattttggaaatgtagataaagaagaaaaatgctgaagatttgggtggtttatggagccgtatgattttgtcattgctgccacctactgtatgtggttgatgtttgtttaaacttaggaagttcatgaaggtgaggctgttgaaatagataattagagcaaggtagacatcattagcttatagcatttcttttctaccccataagtggctcttaattactgagacagccgccagctttcattcattaccttcaagtggatttaaagggctggtttctttttttttttttttttccatttttaaagttcctttgccaaggaaccttcacagtaatgctgtaaaatgcgttcaaaagcttaagatgctgggggattttctgagcatacatgcaataggttgttttaaggagtttgttttgttttgtcttaatttgtaggagcaatattctgggattggattgtaaattaatttctatgaaagaggtgaaaatggagctagtggagctgatgggagttgcagcagttgacttgaaagacattcttttattagtcctaaaacaaagcttcagatcaacctgctagttaaatgtaacaagcaatatagactctgagtcaacagaggtccttctctttttattaagacccagctgtcaaagggtcattaggtccttcctgtggaaaacaacttgcccattaatgttgggggtggtccctcgacaggatttctgagtaagtgcctgacatttcgtttttgaaagaatctaaagctgtgggagacttagatgttgagacttagcaggagtaatgtcttcaaccatagcttttagtctttgttaaatatgtcacaatatgtgtttggaatgctgctgctagctgcgtgaattgacttagagtgccactgtcaaagattcaggagcgtaaacttcacggagatcaaatcactataactgggaagaggctacattcctaaagcgaatgcacttctctgttgtgatgtttttaccttgtcactactcatattatttctagtggctcctgttctaagctctgggaatgccacagtgaggaatgcccatttattttttctgccctaggctatttgctttctagaagagaaggccaagcagggtctcctgaaaagcctctctccgatctgggccgtctctcctacctggcatattggaagagcgtcatcttggagtatctctaccaccaccatgagaggcacatcagcatcaaggcaattagcagagcgacgggcatgtgcccacatgacattgccaccactctgcagcacctccacatgatcgacaagagagatggcaggtgagtcctgggaccctgggcagctccgtggctcaggcatcccacaccagaaagggtccctggagataggtgcattcattccagttaaagactgaggttccctaacagtattatcaaaccttttctcctaaaaataacacatgaaatgacacttttttactggttggattccagtgttctgtaccctctcattgaggtgctttctgatttttcctaacgcagataacattagtgctagcatatgtccgtatgtgaagctgaagtgaaatttcagcttgtgattacatcttgttctgccttatcacattacagatttgtcatcattagacgggaaaagttgatattgagccacatggaaaagctgaaaacctgttccagagccaatgaacttgatccagacagtctgaggtggaccccaattttaatttctaatgctgcagtgtctgaagaagagcgagaagctgagaaagaggtaatgattgtctttatcatcctaagttgtgtaacttcaatcttgtagcattcttaagctaagaaagtcattaagatcgttgtcaaaagcttggttatgtagagatagcatgtgaaatgatatggcactaatttatcctaactgaggttgcatggtaagacatgataattttattgaattgagtatgaaaaatgaaacatttatcattgattacaaagcagcatttttcactactgagagcatgtaatcagatcaaattcggtgctgagctccaaggctgcagtgtcaattgattctttgtgtttatgaacttgcttaaagtgctccttgccagtgagcatgtaatgtagtgataaaggactcaaatcaattcgctgcatcattaatactgttaaatatcccatgaaacccaatcttctttgatttgttatcctaactgatgcaaaaggttcctgagatgatgcagctggaatgtgcttggctggctggctgtcctgatcagaaccgacttagagacactttgccattgatcctcagaggctctggctgtgtaactgccctctcactggccaccatttttaccctccccacttaggctgagcggctaatggaacaagctagctgctgggagaaggaggaacaagaaatcctgtcaactagagctaacagtaggcaatcacctgcaaaagtacaatcgaaaaataaatatttgcattccccggagagccggccagtcacaggggagcgagggcagctgctggagctgtctaaagagagcagtgaagaagaagaggaggaggaggacgaggaggaggaagaagaggaggaagaagaggaagaggatgaagaggaggaagaagaggaagaagaagaagaagaagaagaaaatattcaaagctctcccccaagattgacgaaaccacagtcagttgccataaagagaaaggtaggtgtctgtttagattttctgtgagtcgcgttcaatcaaatcttatttgtcattgcagacattctgtctattagtatttgtttcactctctgttctttagtcgtagtttatgtgtacccagtcccgctgatcatatatcataatcgtttatctcacagtcatgattatgtttacttttcaggtttgttagtgcggtgacaggaaaccagggacaggccagcctcctagtctagtagtcactgccacctgctggtctgcaggagtagagtaactgaggtttatgggaacaaaaaggggccccagaaagcacttaaaccaccctccaagacctagaggccaggagacttctctaaggtcatatgactcattagagatggaagcagaaccaaatgcgtgctcaagactctaagcctgggttgggcgcagtggctcacgcctgtaatcccagcactttgggaggccaaggtgggcagatcacctgaggtcaggagttcaagaccagcctggctaacgtggtgaaatcccgtctctgctaaaaatacaaaaaattagccagacacggtagtacgcgcctgtaatcccagctactcgggaggctgagacaggagaacccagggaggcagaggttgcagtaagccgagatcgcaccattgcactccagcctgggcaacaagagcgaaactctgtctcaaaacagaacaaaaagactccaagcccagtgctcttcatgctgtttctttctcttgttcttggcacagaattgttagaaagcattttaggcccttaattttgatggtgatattttgcatttgtggccaactgcgcattactgaatctcctcagatcttagtagcccagtgatgtctctagatagaccatatcatctccaatggtacagaaagtaaagaattgactttgtttttaggtaactgctcacccagatctgatatctttgtcttcagtatctatctgggacatagaggagagccaagactgatagagatatcacaatacaagctaaggctccgccccaaggccatctgatgtggcatctgttagggaacttgctgttctaactcccagctcagcgctcttctaggcctggcagtcttctggaagggtctccatggggaggtggtagaaaggagcatcccacaaagtagacttcaggcttaagaataatgtttccatttcttaggaggagtgtgtattcatgtgttgtatatataataaaagaaatttgttctaaaactatcaaaaaccagaatcatccaaggcatgatctgaactggactcaacctgaagaaaaccagttctctaccttggcttccctcatattagggaaaattctcatggattaaagagggcaggcagactggggggaataataaccgtaaatgtttaattacagaatatgattaactggctacgtgtgtgcttcagtgagcattcagagcgttaacaaaagtaagacacaagaattcttggaggccggacacagtggctcacgcctataatccccacactttgggaagctgaggcaggaggatcatttgagctcaggagttcaagaccagcctgggcaacaaagcaagactctgtctctataaaaaataaataagtatttttaaaataataataataataattgaatacagtttacctgaaggttagcttttaaccaagcatattgaacccttctttgcagtgtattttcaataatttggggggcaacaattacatcttagcagcaaatctacctgctattcctctatttgaattttgtgtcattaaaaacttttttgctgggcgaaaaacattttataattacaattatggacagtcatttgtgccaacctttagtgcaaacagaaaaaatatttttaggccaggtgcggtggctcacacctataatcccagcactctgggaggccaaggcgggtggaccacttgagctcaggggttcgagaccagcctaggcaacatggcaaagccctgtctctacaaaaaagaaaaataaaagaaaaaaatatttttatatcatacaaataagacatctggcatgtctttaacatttttagattccttctattaaaatattttgccaggttatcagttgctcacatctcagcagccaccaatacttgactttgttaacattttaaacagtaatcctttcttcaggtacctttcctttccttttcatagccctgaagtcctatggaatgagaaaaagtaggctggtcttgtatcatatttcccagtgctgtccacatagtgggtgctccttcaagagttctcaagtattaaatgggttaacccagtggctagttaattacagcaccatttataaagacattagagtctgtgatgaccttaaatgtctgtgatgtgaggaatattgaagccagcaagtaccattggaaaaatatatgctagaaaagcaaagcttagtttttaaaatctccagtcaagctgctaggatgttccctctcagagcatctgcttgagtaaacaactgttttatttggaaaacacttgcctgtgtagttggagcccgagagggatgttagacatcaaatggaaggttaagtacaaaggcattacagaagtcaccacgtgtaagattctcagacacgcgttcagtacatgtctactgcatatcgactcaaccatttaatttctcatgagctcttatgtgttatgtttggaattaatttcagaggccttttgtactaaagaagaaaaggggtcgtaaacgcaggaggatcaacagcagtgtaacaacagagaccatttcagagacgacagaagtactgaatgagccctttgacaactcagatgaagagaggccaatgccacagctggagcctacctgtgagattgaagtggaggaagatggcaggaagccagtcctgagaaaagcattccagcatcagcctgggaagaaaagacaaacagaggaagaggaaggaaaagacaatcattgcttcaagaatgctgacccttgtagaagtaagtagaggaatgataaaaaccttacccttgagaatgtctgtatctgactgggtgccaaagagcaggcctctggcgtgatgcccagaggcacctgcgaagtggtgctgatgcacctggagcaagtgcccatctgccctttcccatccttacaagcttctctcccttcttcctggaattggattttatgttaaacaacttctaaggccagaacattcctctaggtgggttcatcttacttaccagaaattggcttatccccaaaaactttgaagtctgttgacaagaaacacattacatttctttgattctaatatgtacttttttttttcacatttagttatttctgaaatcaaggtatatattattatcagtgtgagcattgaatggaatcgtttcttttttcctggaaaacaaatattagtaaatcaatagtacattttataatcagtagtgtcgtagtatatactactataaagattcatctaaactaagctgggcatgatggcttacacctgtaatcccagcactttgggaggctgaggcaggtggatcacttgagcccaggagtttgagaccaacctaggcaacatggcaaagcccctactctaaaaaaaatacaaaaattaatcagatgtagtggtgtgcacctgtagtctcagcacttttggagactgaggcagctggatcacttgagcccaggagtttgagaccagcctgagcgacatggcaaaaccccatctctacaaaagatacaaaaattagtcagcagtggtggtgtgtgcctatagtcccagctacttgggaggctgaggtgggaggatcacctgagctcagggtgagccatgatcgtgccactgcactccagcctgggtgacagaatgagaccctttctcaaaaaaaaaaaaaaaaaaaggaaccatctaaacttacccacacatcaatattagctttgataatattgcataacataaaaatcagtaaactgactttccttttaagttgacagggacacctctaccccatcctctaaaaaatacactgaacaccagtgaatcgtctttaaaagcacccatccttgcctgtcaggttgagaacgtgtgctcccagctgaatcatgagggtttatggtatactctctctattccctggccaagatgactctattcagaacttactttaatctggggaacaggccatctcatttccctgggaaccacaggatcactctagcttttgaaaagccacagttttaagaacatatgcaagcatcttcttgattttcttagttcacagaaatgctattcctgcatacagtattttgctgaaggaatgacttcttaccctgggtatagagaaaccaagccttattctttgggttttttttttttaaacaaataacaaactgcagtgagcgatcattttgtgtgtgaaaatgaggtttatttccccttcttggctgtcttctcatattatgcctgattcctttcaggatgtccttctttcttaaaaataattgtcagaaagctcatcttctgattttgggaggtgttccaacaaaagccggtaggtccagtagcacgtagaataagaatgcagaatccagccaggcatggtggctcatgcctgtaatcccagcactttgggcggccgaggtaggcagatcacctgaggtcaggagttcaagaccagcctgaccaacatggtgaaaccccatctctaccaaaagtacaaaaaaattagctgggtgtggtgatgcatgcctgtaagtcccagctacttgggaggctgaggcaggagaatcgcttgaacctgggagacagaggttgcagtgagccgagatcatgccactgcactccagcctgggcaacagagcaagactccgtctcaaaaataaaaagaatgtggaatccgggggcactggcatggctattacctgccattgtgaatagaaatgtcctgagatgactcttaactcgggcatggtactcggcacttctcaaggaaacattctacatcacatatgtgttcttttcagctggtcggtttgaatgtaatacttgcaggtaagtttatctgtaatccttttattacctaaatcagccagtgcttactctgctgtccaccagttggactagaactcactctattctggcagaagggatatctgttttatgatgattgtgagatcttatttttattctccaaaatagagtttctaataagactattgttctatataaagcttttcctttaaattgaccactgattctagaagattggtgtaatctaaagatcttaagaatacttgggtgcttcatgcatatatttattaatatatatttattaatatgtatatagctattcatctgcttgtataaatatgtacatatttacatttatattaacatgtgcatataggttcagtaaaaagctcacctgaactgaaatgaacttcacaattatggtttgtttctaagtgtctttaatatgcaaaccttacatcagcaacatattgatccagaattcagtgtggacagaattagtgttaaaaagaatacctgtattttaaatgttcaggaatttgctagtaattacattgtagtttgtatcatgcaaaaatgatgatcctaaaaatgatgattacaaatgcatttgttttgggtatttagttatttactgatttgtttcagaggtacacagcttatttttatgccagagagaacattcaaatcaaagtaaataaatcatgtcttccaagatcatttacatcctataaatgtccacaaacagaggtttactttctctaggtagatatgagagttaaggcttctagtcatttttccaggacagtaatgatttgtatataagctagcattaattcctttcccctatatttcctaatttgtaaatgttcaaattgatttttttttttacactgtggaactctgggcttttgcatcagagaatgtcttgttcattaaattcaaataagcacattagcattgcctatatccatgtgttcccaatatgttactctcccaggcctaggttatttacttggtttataacacaatattattacacattagccttgattatgtctttaccatcaacttttaacatgccaaattgaaagcagtgtttgctaattaatttagaggaatgaattcaagttgcccatggttatgctttctaagactgttttttttccttcccgtttttgtctcttcactaagacaatatgaatgatgattcaagtaacttgaaagaaggcagtaaagacaatcccgaacctctaaagtgcaaacaagtgtggccaaaaggaacaaagcgcggtctatctaagtggaggcaaaacaaagagaggaagaccggatttaaactgaatttgtacaccccgccagaaacacccatggagcctgacgagcaggtaacagtggaagaacagaaggagacttcagaaggaaaaaccagccccagtcccatcaggattgaggaggaggtcaaggaaactggggaagccctgttgcctcaagaggaaaacagaagggaagaaacatgtgcccctgtaagtccaaacacatcaccaggtgaaaaaccagaagatgatctcatcaaacctgaggaagaggaagaggaggaggaggaggaagaggaagaagaggaagaagaggaaggggaagaagaagaaggaggaggaaatgtagaaaaagatccagatggtgctaaaagccaagaaaaagaggaaccagaaatctccacggaaaaagaagactctgcacgtttggatgatcacgaagaggaggaggaagaggatgaagagccatcccacaacgaggaccatgatgccgatgacgaggatgacagccacatggagtctgccgaagtggagaaggaagagctgcccagagaaagcttcaaagaagtactggaaaaccaggagacttttttagaccttaatgtgcagcctggtcactcgaacccagaggtcttaatggactgtggcgtcgacctgacagcttcttgtaacagtgagcccaaggagcttgctggggaccctgaagctgtacccgaatctgacgaggagccacccccaggagaacaggcacagaagcaggaccaaaagaacagcaaggaagtcgatacagagttcaaagagggaaacccagcaaccatggaaatcgactctgagactgtccaggccgttcagtctttgacccaggagagcagcgaacaggacgacacctttcaggattgtgccgagactcaagaggcctgtagaagcctacagaactacacccgtgcagaccaaagtccacagattgccaccacgctcgacgattgccaacagtcggaccacagtagcccagtttcatccgtccactcccatcctggccagtccgtacgttctgtcaacagcccaagtgtccctgctctggaaaacagctacgcccaaatcagcccagatcaaagtgccatctcagtgccatctctgcagaacatggaaaccagtcccatgatggatgtcccatcagtttcagatcattcacagcaagtcgtagacagtggatttagtgacctgggcagtatcgagagcacaactgagaactacgaaaacccaagcagctacgattctactatgggaggcagcatctgtggaaacggctcttcacagaacagctgctcctatagcaacctcacctccagcagtctgacacagagcagctgtgctgtcacccagcagatgtccaacatcagcgggagctgcagcatgctgcagcaaaccagcatcagctcccctccgacctgcagcgtcaagtctcctcaaggctgtgtggtggagaggcctccgagcagcagccagcagctggctcagtgcagcatggctgctaacttcaccccacccatgcagctggctgaaatccccgagacgagcaacgccaacattggcttatacgagcgaatgggtcagagtgattttggggctgggcattacccgcagccgtcagccaccttcagccttgccaaactgcagcagttaactaatacacttattgatcattcattgccttacagccattccgctgctgtgacttcctatgcaaacagtgcctctttgtccacaccattaagtaacacagggcttgttcaactttctcagtctccacactccgtccctgggggaccccaagcacaagctaccatgaccccaccccccaacctgactcctcctccaatgaatctgccgccgcctcttttgcaacggaacatggctgcatcaaatattggcatctctcacagccaaagactgcaaacccagattgccagcaagggccacatctccatgagaaccaagtcagcgtctctgtcaccagccgctgccacccatcagtcacaaatctatgggcgctcccagactgtagccatgcagggtcctgcacggactttaacgatgcaaagaggcatgaacatgagtgtgaacctgatgccagcgccagcctacaatgtcaactctgtgaacatgaacatgaacactctcaacgccatgaatgggtacagcatgtcccagccaatgatgaacagtggctaccacagcaatcatggctatatgaatcaaacgccccaataccctatgcagatgcagatgggcatgatgggcacccagccatatgcccagcagccaatgcagaccccaccccacggtaacatgatgtacacggcccccggacatcacggctacatgaacacaggcatgtccaaacagtctctcaatggctcctacatgagaaggtagacaacgtgggcagtccacaaaacctacggggcatcactattggattgatctgcacaaatacctttgaagagtacgatttcaaaaccagcaattggtgtgaatgcaaaaacatttgttggcaccatttatttaaaaaaaaaaaaagctgtatgcagcagaaagccttatacaagttgtttttctttttttcctttttcttttttttggtaccttcatttctgttacttttatataaaattctctgcaaaggaaggcctctctttggactacaatttggaggcagccacttgttgtgcctgcttctgttaaacaatgtggatatcaagcccccccaaattatctgttttaatattgaacctagagctttttttttcccttccctgtccactccatgtaaatgcctttagcatttcagttattgtatattttgtttaaggtgacacttcagcatgccgctaatgtctttgttagtgacagtgcattttgtagtactgtacaagtgttgtgctaacagtaagccatttcttaagttttttgccttgattagggtgccctaatttgagggttttaaaaaaaactatatttttgttaattataaaactgtaaagagctataaaagctattcccatttggttagtcaaaagggttttattgctaaatgtttggtgtaaagttgagacccttttccattttggtgacagatttctttggggaaaaaaggcagctttctgttttataaatgcagacttctgtttattgaatgaagcatatctcagtgtttatctgtcaggttttgaaacatttcatatatgtccaaatacttggcaggatttaaaaaaaaatagtgaatttggtgtaaagttgctattttatggaaatgcctctaactttacattttcattccatctgtagatttttctatctttataaaatattggagttattttttaaggaaaaatagaaaagtagcttgtgaatagctcaaactaagcttacaaatcgcatgtaaaaaagcaaaaaagttatttgtgtctgtttatattgcttccttttttgtagcctttgtacctgtacagggtgacagtaagggccaagcaggagaggcgtaatccttgtataaaataggatccagcgacactcttgtatttatctgttctctttttagtcagtcacttcaaaaaaacaaaaaacaaacaaaaaaaagctgtacattttaacataaaataaattatgatgagccatttttagcctcttgtgtcctgtcatattatgattgatagagaatgaccaatggaactgtatcatgtgtcacgcctcagaacacatacacattttgggaaaataaattatttagtgtaaattggagttatgggattttctgatttgttttgactttgggggaggggttggcaataaataagagtaatatctaataaaaccatcacatataccaaatacctatttaataaattaatttataatggattttaatgcttttcatgaaagtttattttatgcgagtgcataccttctgtatgccaatcattgtctttaaaataaagtgaaattgtttttt

SEQ ID NO: 37566 - DNA, 64294 bp, Homo sapiens; identical to SEQ ID NO: 36971

SEQ ID NO: 37567 - DNA, 37771 bp, Homo sapiens; identical to SEQ ID NO: 36007

SEQ ID NO: 37568 - DNA, 6058 bp, Homo sapiens; identical to SEQ ID NO: 36273

SEQ ID NO: 37569 - DNA, 129637 bp, Homo sapiens
cacaagtgtttcacaagtgtgttggttcagaggagggaccaggcagaaggtggttgagaggcagagctgcccctgagtgagccatgcagaggatctcctccctcatccatctctctctcttctgggcaggtaaggcagaccccagaacttgggccaagcaagactcagcagcaaagaaacatcaaggctcacaggaccttgtactcatggactgtgctccttactcaatgacctcagcccccagccctcactgagcccctctcttgtgtcttttctctcaggagtcatgtcagccattgagttggtgcctgaacaccaaacagtgcctgtgtcaataggggtccctgccaccctcaggtgctccatgaaaggagaagcgatcggtaactactatatcaactggtacaggaagacccaaggtaacacaatgactttcatataccgagaaaaggacatctatggccctggtttcaaagacaatttccaaggtgacattgatattgcaaagaacctggctgtacttaagatacttgcaccatcagagagagatgaagggtcttactactgtgcctgtgacacccaccctgctgcagctctacttctgagcagctcaaaaaccactgaccaggcgcggtggctcacacctgtaatcccagcactttgggaggccgaggtgggtggatcacgaggtcaggagatcgagaccatcctggctaatacggtgaaaccccgtccctactaaaaatacaaaaaaaaaaaattagctggtcgtggtggcgggcacctgcagtccgagctactcaggaggctgaggcaggagaatagcgtgaacctgggaggcggagcttgcagtgagccgaggtcatgccactgcactccagcctgggagacagagcaagagtccatctcaaaaaaaaaaaaaaaagaacattgccatccatgtagagcagcaattccaacaagatcgtgattttctcttgaataaataatttaggaaatagggaccagagaaagctagtgtttctacctttctttcaggctcagccactcagcttgcccgtgccctcccatggtgctcagataggcagcccccagtgggacagaagagaggagagatggagccaaaggaatgaactgtagcatctactgtgacagttttcttggaggctcataaaaggtatgaccacagagccacagtgcttagagtatagcatagattaaggaggcaccttacaatttacaactatgggtgacatccagtttttccccagccacatgcctctgaatttacatgttctagaggaaaaggactggcagtggggggaggctcctctccctccttcagatcaaatatgtacactacctgtcattttgcccaacatggaaggaaaggctacatctctagcatctctagcatgctctgttgttttgatgattactgactggatattttgttttgctttgttttgttttcttcatgagacggggtcttgctgtgtcccccaggctagagtgcagtggcgtgatcatagctcactgcagcctcacactcctgggcccaagctggatatggtgttttgctctccctttcttctctatctctttacttccacatgtgctagaaacaaaacgttgaaaaattgcttccactggcacttccttatccttctttggacagctcaatttaacactgcacttttatcttgaacaatgtgtttttccagatttagatgattgacggggctctctactccaaggctgaacctgtggcagaaatcagccttccttctgtcctcatctagaaaatctaccacttaccttgttaaataacctcataagaacttgtggtgatagacatggtcagtgacttgattgcggtgatagtttcacagatgtacaggcatatcaaactcatcagattagacactctaaatgtgtacagtttatttcacatcaagtatacctcaatacacttgtaaaaatatttgtttaaacccaaaatggattttttaggcttctttggactacttcaggcaacgtctacacaaaatgttcttcaacaaacccctctagtcaaatatcctctagtcaaatatcttccacagaagtacaaagaggctgacagggcttgccacaccttatttggtttcagtcagggcttttcactgttttgccaagtgtcttcccaatcctctctcctctcatgattctgcctgacctttcatatatataatacatgttatatatatatgttataatgtgtcgttgttccatgcattttagtcatgactgcccccatgagctcttatcatttatctccccaaatagctatattctaaaccttcagaaaatctctcttctctactcttcatcccaaactcactcactttgacctgatgcatgatcccaacataggcctggaacctgccttctacctttctgccccaccccattgggcaacttctttggttgaacggtctgcaaggccctggatactggctctgcccttggacaaaatcgggttcccaaatccccatccagatacagcactctgagctccacgatcttggaaggggtttggacccagccttccccagatgtatttaaacagagggcctgtcatgattcatcaagcccactgcctgccactcagatctaattctccttctttgaacaaatgataggcaagaaggtggagtgcatctccaacatggagaggatacaattattctcctagtttgaaatcatgatttggaaaaagaatgacatctggaaaactggttatgcagatgtcaaagttgtggagccatggttttataacgcctgcaagatggattcctagtaagaccccaagtgactccctctaacagagactgggaagagtgtctctaaggagaaggaggggaaaaaatatctggacaaatccataagactgtatgtcttccgtattaataactaatatctgttgagtgcttactatgtgccaggcagcattctaagcacttaacgtgtgttatatgattaatcttcacaacaaccttagtatttactttctattcttgtcctcattttacaaatgagaaccccaaggcacagaaaacctaaaatacttgcccaaagtagcatagctagtaagggagggtgacagatttcagactcttgatgctgcaccagaggacacagcatgtaatttggggagatgggggacccatagagaaagccaccttcaggatgtgtcagaaccaagggacaacaggggctgtgccctcaccaccaaacctgttccaattgatactcccgtgaccatctgtcaaaaaactgggacaacagaacaatggtcccaaatgacctctcaagtgttttctaactgagattttgtgatcctgacacaagcttcacactgtcttctaaaatcatctgcatctcttcatctgtgaaatggggataataagagttctaccttcactgtgttataaaatatataattatagaaagtaaataaattgcatagcttatagtagctatttaataaatgttacctattataagaaaaagcaaactgcaaggaagaataattgagaagaaagtgaactaaattactgagcaccaacgaaatgcagccactttacaggtatggactcacttatcctatgacaactcagtgaggtcattatcatcctttctgttttgcaagtgaggatactgagactcagacaggctggacagcttgcttacagaagcagagccaggatccggatctgacttgaagcctgattgtcctggctgggatactgggctgggagctgcggaatgtcctaaagaaataccttacctatagcaacatctcatgtaaaggatggctgggaacaggtatgtgaagtctggtcatctttgctcatgcaaagattgctcttgactccttggccagtttccagaagaagggatagtaggaggtcttcaactccttccccctgcctcctctcccctgctttaaaacaccaattgtaatttcagcttccaggttgttctcccgagatggctcactcccctgactgaaggaagacagctactccccagcccactgccactcacactcctgagcaccacccctaggtcagcagcttttctcccagggtacaccatgagaaacatgagagactggcccacatattccctccttctgatgcttgtcaaaggtagtctcttgttggactcccttagatcctcggggtgctcatggattcactgccttttcctctccttttcaggggcttgcctggagcgaaaaccataggggtccaaggccggcataatgagagctagaaaaattccctgggtttctgtcaggtccatagagttggtgactttaccacccacatatatctttgctgtcaagcaaagtgtgcaagtttgtctcttccgttgtcatcgacttatcacttatacagaggcagcaatggggcttgagatctgacaaccacaattctctgcattcaaaagtgagcacacgggtaccagaaaacactgcggtggatgaaggtgcaggagccaccgtgtaaagaatagaaattaatttctaactaaatgtctctgctttagttagggtcttagtccactgcagtatcttaaacaatacatattcaatgataaattttccataatgacaaggtgaacaaactcagaatcaaagctcctttcctactcttcaattcaacacattaccctaaaatattaattgaaatgataggattatacagctttttttttttgtcagagcactttattcattctttcagtaaataccatctctcatatctgcttaatttttctccacagcatttatcactatttggcatgctacatattttacttgtttatattttgttgtctggctctccactggaatacaaggtccttgatggcagagatgagtttttgtctgttttgttcactgctttaactccagcacttagaataactttggcccataacagacactcaataaatgtattaaatgaatgagggaatgaaatacatatgagtgagtgctacgtaccctgcactgagctggatgccagggacacagtggtgcacaaggctggtgcggactctgccttctgagatgttctccccaagcctcatctacccactaaaaaaatgctactgaccgtaacaagattttctgaagagttgattatagagtactctggaacaccaaataacttactcttggagagcagacatcgaggctcctaagtgcattggatgttagcaggggcaaaatgaagaaaatagtagctttctcttttctccaccttttctctcttttgagtcccaagggccccagccctgagtctgaggctgtcaaagaaaaagcgaaacacttctgttttatttcacaaaggaatttcgcaacgcttctctccaaacagactggctggggcatgctatttcacaatgaaaagccacgataacacagtttcctaaacaaaggggcgattcctaactccctctcactttatcaccactgccaccaaatgattttggtattcttcaagaatacagaatccactgggtctttttgggctttttagcaatttacacatccacaaacacataggtttatgagcggtaacagcgtacattccagtgcatgaaacactgcagggattctctgaaggcgtgccctggatgctgcaaggctccaaggcaacagtcagccagtggaacagtgtgccacccagcatgctcgacttgatagaaaaaagacccagtgacagggcaaaggaagtcaagccaacatgcaattgcttgtattaatttaaataaagccaggttctcaaactccatgtttaaataagaaatctaacagtcataagttttctttttacctgcatgcatatgggagaatagggaaagtttaaattatctttctggcttaaggacaaaattgcatgagtatttataactttcagaaaaagaaatgtcagtctaaatatattactagggcaacaaattattaagaaaaaaaacccaaagtacagtcttttggaaattaaagttgctttcatagaatatagcagcattcactcagtaacaattcattaagtacctcgtatgtgccagacgcttttctagacacaatggaagcacagctctcagaatctcaggagcttatatttcagtggaaataaacacaaaataaaataagtaaaatatatgtcagatggagataattgccatggagaggagtaaaacaggcggggagagagagagtgttgtcagcaggcttgcagaaattacaattttaaatcaggttgtcaagaagggatacaataagaaggtgacatttcagcaaaggcctgcgtgtaggcagggagcccagtatttggagtgtggatgtttgctggactccctctgttagaaataacattttcatgcacattcttaagacataatcataccagcttttctgtaggttagggagataaggagtcattttttctttcttatcttgctaagagctctttcacaagtagttcacactttcatttttcaaaatcaagcgatgaaatgccattaattagcacaaagtgtgttggggagtggacgcgagggtttggcaaggaagcagtcctgaaaagatcaaaacttacaacatgaacaggaagatgacagcactgattattgacaaacggaaaatggggcatggcattttgagccctttgccttgagtctctccctagtcacgtgaccacattctgtggactggtgagtgtttcttccccaaccacagggataagaatacaaagtgagtgatgcatttctctcactggtccccagatgactccactctagcagccccggaaaagaacctgcagcctcatctatacctgcaggttgatgtgcctcccaaaaactgtctcactcagttgtggagctgaaatcaatcatgtgttcacctcagtggggttcttggtttttcttttctggcttctccaaaaagccaatcatagagaaacctgaggactgtggagccactatggagaaggctggagtgcctttaccatccctagctcagctttagggattcaccctccaggacctctgagtgtgctgggatcacacggcctaaggtaggccctagagtcagtttctgtctttacctgccacctgacaggagtgagaagttttacttagaggcagtgagaagggaagtcagcagccccagggacagtacaaaggagacacagcctgagtgtgtgttgtcagaagctctgtcacagcgaaggcctcctcgggcataaagacctcactgtgtttgcataacacctgtgttataatcgtgagtgatcaataaaggattaactgcctcagtcatctaaggaaatgaagaagggttttatgcaccaagttcataaataaggacacagaaaaaaaccacgaaggccagtgtagctgcctctgtacgttgaaattagagaactggtacaataacaataacccacctctgtagtaagaatcaatgtaaaatctttgagttcatagctagtccatttctcagcatcaaaaccatcattttgctttctgtatggaggacgtccacccccacatatgcacactcagagtgtcagagcaatgagaaaccaattaccatcaggctccacctctttggttgaagacatagaaactgatgaatgaagaaattaagtgacttttccaacatcacacatatagtgcagacaggtaaagtgatatactgtacttctgtctctttcctccaatatcctagaagtcaagggctaagaaaagacagaaagggtaaaccatgtgatcatgccaaagtgaaagaaaaatggcagcggagtgttctccacattccagacaactacctcctgccaccttctaggtggcaatgcagtccaggtaggtaaagcgatatacaaaaataaatagccttaatcattcacaaaaatattaatgtgtgtcaaatttaaaaacaatgaattgcaaattgcccctaactttggcaagatcctttcacctaccttaaaatggacaagtttacaaatttgggctataaactgcatataagtttttgttggttttttttcttccttgagacggagtatcactcttgttgcccaggctggagtgcaatggcacaatctcagctcactgcaacctctgcctcccaggttcaagtgattctcctgcctcagcctcccgagtagctgggattacaggcaggcacaaccacgctcagctattttttgtatttttagtagagacgaggtttcaccacgttggccaggctggtctcgaactcctgacctcaggtgatccacctgccttggccttccaaagtgctacgattacagatgtgagccaccatgcccggacacatatgagtttttataagtaagttcttttagtagtgaaaaaagcataggctctggaatcagagaaaaatagaatcacaacccctcacttcatagttctgtgaccttgaaaaatgttgctttaacttttctaaccctctattccctcatccacaaaataaggataataattgcatagagttatcataatgatcaaattaaataattgcaagtaagtacctgagtgactacaaagcagaggtgctcaataatactaactccattcctttcagcacccgatggtctgcagtagagcggttcaccctctactccagacagaaggagacagaaaagacagaaaagctagaatgggagagaacatggccaatgaccaccagcatttttccaaaccaagaaatctaaagtgcctatcagcacattttttataaaaatacctcctcaggaatgttcttcccacacaacctctctaaatcctttccctgcactaatgatagtgaaggtcccaaaggcaagaccatcactgggagggtctagctccccaacaagagatgatgccctcattgcccttcatttgcagagatgaaggtgacacaggtcaatgtcagcttcaccaatagtaacagggagagtaattttttttttttgagaccgggtctcgctctattgcccaggtcggagtgcagaggcatgaccatggctcattgcagcctcaacctcccgggctgaagtgatcctctcgcctcagcctcctaagtagctgggactacaggtgtgcagcaccatgcctgggtcattttttaattttttgtagagacaaggtcttcctatattactcaggctggtcttaaattcttgagctcaagtgatgcccctgcctcggccccccagagtgccaggattacaggcatgagacctcacgccctgcatgaatgaattttttacatcaaaccttctccaacaaacttggttcagatgtctgagacaagagttgcacaaaggagtctcagtcttcagaaagttcatccttacccagctttatggatgctctaggacacatttaattcttgcatccatttaggaacagagatcttctcccatccttaaaagggaaactataatattaattactgacctgtgatgagtcagctgtccatcctcatttggcccatgctgtctacatgaagttagttttcactgtagtgcttggccaagaaaaaccaagtttttctaaatgaattccaaggataaatagcctaattcctgttctttggcttcttccactaaagaattatagggacctgatctagggaaactggggggaaaagccagggaatgagagccactgtcttgccagaaatgcatgttctgatgaggaaagatagttcaggatatctgcgccaaatcacacattggaaagaagctttctgagatctgaggaaacttccacctgctaaaaagagctagcagtctgctggaaagaaaaaaattcattcaggtgtcagaactcttactcttcactttgtgtgtgactgtagacaagtcagttaacctctttgcacctcagattctcatctgtacagtaaagagttcacattagattgtctctaagtttccttcagcactaacaagccgtgggacataggagaacaaatttgaaagattcctgagatacaggagtatggattcctgcagctgattcctttatgtgacccagtaaggataaaatcgaaaaaaggaactaaacgaaatacactcttgattaatcaaaggggattgaaagtcgtggctaacctcacacctaccttgcatcacctccagctcacctcccttgagacactcctcctcttctttaatgcctcatcatgattctcaaaaactgtgatcactcaaggttgaagcttttaatctcccatgtataaaaggatatgcaaatagagttcagtttcctgttgagtctctgccaaggtcttagcctggcagttctgggaaaagagccaaagacctcatatttcttggctgttaacattctcccatctgtgctcaagtcagcagcctaggcttcaggctgtggtttgtctttagtcttacactttcccaagttttctgaaggaaccctttagaatgttcctgcaagaaagtaagatacaagtggctcccaagaaaccagacagaggattatctggttatatttggaggcagtaagaaaaagaccaggaagtctatattcctatagtatatagccacagaatccaatcttgcaagctacttgaaatgctgatattaattaagtcttaggcagggctttcaataagtcatctgtgtctccaatatgggatgtcccacatcatgcatatgcacagtgaaaaaaagcgaggtccttgggtacagtacagcattcaaaaattaaagatctgaaaaacacaagacatctcagtgtgcttccgggctggaggctctgctaaacaacagaagcagagaccggactaattgtcccccatgtctctttgactgaactcacacaaaatagaatctaccatttttactcagtgcggggtacccagactcaagtttactgcaatgttgttaccaatattctaatggaaaattatatattcagagctatgttaaatttgaccatttattaaacatgaaatttctactttttctgtaagtgccttgtcttacttgtatttcccggtatttcccttctaaagctaactccccaaagggctttcctgtatgttctcacttccattacaaagtcaatgtacaagttaatttttttaatttctttagaaacctttataaagagatttcctccttcatttctctgttatcccaggcagctgtcaggagcaaagagctcaagcctgcactgccttggaacaggacatcagcaaaagacactctcaatctactcagaaggctgaggtgggaggattgcttgagccaggggttcaagaccagcctggacaactaagtgaggctcagtctcaaaaaaaaaaaaaaaagatctcaatattattgttccatacccagtcattcacttggtgttttctgcagcatttatttataaatatctcagtctgttcttaatccttgagcctatattttttaaaatcatactttgatatctactcagagtattgattctcttcaaatttcccacctcttagttctcctcccactctctcccaccctgagccttacacctccaacaatgatcattctaagaccatttatatctcaataggaaagtgatgtaaaacgggtctccttactctgttttggagggtttttttgttgttgctgttgcttgcttctctgtcccaccccaaactcatgtgtgtctgaaatttagcaccaccttgcgacgtttgtgagcatttttctcagagcagcattttgagactgagcctgaactccactgatgttatgacccttaaaagtgtctggctccaaaagactaaggagttcctgcgtaaatccaggtccagctacttcatcactgtgacttgttattggaaaaggttgagctatcaacatattgctcctgtaaaggctcagaactgaatcttagattcttcaggatatttgagtcctctgaggctcctgggtaaagactccaatgtagcagttctgtggactataaatgggagatatccagatcatacaccttcaatggaagaaaaagcactgtcaccttagacgactccaactctgtagtctacttttgtcttcctaatatcatacctcattctccagtgggtttatggcaagcctcatctactcagaagtaaccaagtacaagccaacacactcttgtgttagtgtggaggcccaaagtggcataagtgaatgtgactccagatgaaaaccttcccctctccaacacaaagatgccaaagactatgtataaagcaagtcttaaatcactctatatttccatttgaatatatttccccagttcctgtgcattgcttctgcatacacagaattcaatgataaaaattgagactgtctcctagatacagtaattaactcagctatcaatgccaattgactgtgtagaggggagacaattttgtaccaagatttactaacctctattttaatggaaaaacaatggaaaagctttcttcctactatgactctctctggataaattgcttgccaggaagcgttaggataattctgccatgactctttgtcttccacacccaaagacatttggtctccatcacatatggaggaaggatctccttgttcagcagtatttacaccatcaccctgacacccgcagtcagatctaactatacagcttggctaataaacctggagaagctcatattctaagaaaaaagtggagagtggtgggacagatggggcctgagtgctgggaaactgcccgtgcccactgctgacttggtcttctcaccagctgcttgatctaacagatgcatcttccttatgaggcaccagagaaccagaatgtccacatcctgtggtcccctgtacccttaacaccccacatttgagttcctttccaattcagaaaacaaaacctgcaggctttgagccaatttacaacagatgtgggtcacaacaaccaactacccaggaagcctccaccagaacgcagcgtgagaatcagcttcttagatattcccatacgtgtgatcccatcaatcatttaacaactgtcaaagagaaagactaggagactttctcccgagcatctccagggatttaattcactatgttggaaattaagagattactactaagccataagaaggctaagacagagttaaaagaattattggaaggttggcattacaactttacgtgtacactaggaaaatctgcagctctacctgtagctttgacataatgccttcctataccctgtccttgcccaactgtgactcccacatcatggtcataccctggataggcccctctctgcatgtagagcaatgtgaatggggattctgcttatcaggatatcatcactagtctgtgccaggccttgcaagaatgtccttgtactgcaactatttgtaccagatggtaccctggccacccctaagtgtgcagactttttaactttttcccccaagaaagtggtccctgatgtgcactgcctactgagtaaggctaagaaagataggaaggaagaggacaaagtgcaaggagagaaacatttttgcaaggagaaaaataatgatgtggatgcagaatatttatcatgtgaattcatattaacctgacttcctcagaaaatgtcaccgttagtattagaatgtgtatttccttcggagctctgaaagaaaatatgagaattcaaggggtgctagtgcagaatacacacacacacacacacacacacacacacacacacactgtgcttcactgtggctggaatgatgcagagtcttggcaatagttcgggaagctgctagctgtccgcccattgtaaacagtgaagtaggtcatctgtggctccccatcctcatctgtctgggccattttcttgggccctcctccacatcccattcctcatatgttctcattctatttccatcaaacctcaatctcaagaaatgacctgaaatcaattcgtactaatgtttgagtcatgaaaacagaggaaggctttagcttctctgagattggcagggagggtcgctagtgagcattgtattttcataaagataatagccataagctaaacactgcagcaaccacagcagaattttccaagcctgaggaacactgcccaaaatgaaagacagaggtttgttctctctttgtttggaggttcagtgtggatcatacacagagagtctggagcctcccacagtggacacttcttttcctctgtccagggagaagtccagctggagcagacaaccagagagaacattagcctgaccatggggaaaggcattgcagcagaattaggcccaatagaggaaaaaagatgcctggaaagaaatttcatttcaatagcaggaatagctttgtaagagctgatagccattcaacagtgaaacaagcatccttgtcagtggatgagttcggtggatgactacactgggaaggttgtctacattggttgggagctaaactcagtgagctctttccctcctagaattcattatatactgtatgtatatgattatatatactctgtgtatgtaatcgtgtattacatatactccatatatgtatattacatatacatatattacatatactctgtatatgtaatcatactccatatacacatttgtatccattacatattcaattttccatgctattggatatttttcctattcaataattttaataagctatgttaatattgtatctagagctacattatagtttactcaatcagttctcttcatggttgagcatttaggcaacttctaaatttttcctactatgaaaattattatgatgaacacacctgtacttacaactttttcattatttaaagtcatcatatatgtatatgatgatttggatccacttccacatcccattccttatatgccctcattctatttccatcacaactcaatctcaagaatatttcagtatgtgacctgaaatcaatgcattctaaagtttaagtaatgaaaacggaggaagactttagcttttctgaggttggcagggagggtcacaggtgagcattgtattttaatagcaataatagccataagctaaacactgcagcaaccacagcagatatacaaatggtatatatacaaatatacaattatatttgtataaatatatataaacatataataaagtaagctcctattttcttaattagaagattcaaagttaagaattttgtccaacttgaatatatgaaactttagggttatagagaaattagccaattctactttagatgttttaatgtattaatacagttaaacacacatattttaaaattacatattatataaaataatatatcaattttgaatactgctatttccttttaataattcataaaataactttaaattcttcacaggcatttcaaatcaatgtatttgttgccactagagccacttttttatcctcaaatatttttccagagtatatgaaactcactttgctaaattgaaaattaagaggcacattagatttagaaacataattttaaattgtttcaatgatggcacattattaatacctactttgagacacaatacatactcacataatattagaatcattgttttgccatttatcctgtaagtgaatattcatgatctccacaacaaaacatttactttgatagatttgtttaaacaatatcaaacacttgcagtcttgaaggcactggaagacccaaaaaatagttactacgtttctgttaaactacttagtcatctttttaactaattctatcagctgactgccataagcatccatgagctagcattgattgagatcattccaatgtgtcctcactaaactgtacttaactgttcaaagccaaataattaagtgaaagtatggtaatactgtttttcataattattgtaaggaatcaaatataagggatttcttcttctctgaggatcatgaaccttactccatgttcaaatagatatagtattttttcacagtaaattccccaaagtggaaatagtcactcaaacgaatacttttactcttttgacattaaccaaatggcttccaataaaaatcaaacaatttatatttttaccaacatcttgcccacattgggagtgtcaacattttgagcaaaagctttaattaaatatccatccaaaaaatggtttgttaatactttacagttttattactagagggttaaaatcctttttcaagtctgataatcaatgattaactttcttcatttgtccttcacccatttgttttttaggttgatggtgttttacttattgatttgtgtaattataataattttgtgtctgagttttacagcatttaaccacaaaaacagcattggtgaaaggagtttcaggggtattgtggatggcagcgggtggtgatggcaaagtgccaaggaaagggaaaaaggaagaagagggtttttatactgatgtgtttcattgtgccttcctaccacacaggttggagtgcattaagcctttgtccaaaaacacccagccgtgacccgctatgtatgtctcagcattgggaagagtcctctgagtgtcatgggaaaataatatatgagttttattgcccctgtgtcccaattattttctgtttactccatgttggtctacagcaatagcttcagaacataaacaaatatcaccaaaaacatcagtgatgaacaattccaaccacacatttcaatgtttactaaatatacccgtggcactgtaaaaaagaatataatggaagagtaaaggaattgggactgatcgtgactgagaacctgtatagtaggctacacactagctatatgatgaaccaagaagttgaacccaaatctaactaacttacataatcccttcctttaaagaacttaatgtccagtgcaaagcaagtgttcaaaaaagtgtttgttgtgaattgaattcatttcattggaatacagcatgcttgcaaagtcccaactttttaaaataatgtgtttctaaagaccactggtctttagaaagaccaatgaccaaagaccttagaccattggtctaaggaccatctggaagcagatccccaaggtgaaattctgacgttgaattcccaaatctaacaggtcatgtgccttgttctgatgagaaaactgtcgaataagggagtagcagtggcatgaaggttgttagtaggtagcataggccaaatggcccagtgatgtgatgaaaagtgcactcctccaaataagaccctagttactagaaagtcacaagtaggtaaacagatgccgggagggacagtttttgttggataaagtcagcagagaaaggcttttggaggagatgaatcctgagctggtgtctacagatagtgacagacttagtgcgactaggaatattatggagaataaaagaatctccctctctaactaatgccaccaagcagtcccttcaccccagagcaaaggcataacctatcttcacccaagtgaactatgtattcttgaaatatatctccttggaactaaaccatttttctgttcacttcaaatcaaccagtgttaatatcatagatctgacagcttagaaggcctgtgttctccttcactcttctcttgaccctatgtgagtttgattcaagagcatggggattagtcccttctcttgaattacaatcaccaatcagcacaccacatccagttgctctttttaagtctaggagagcaaaaacaatgcacaggtgaaggaaactatgcctaggcctcatccctaggttgtacaaagtaactgaatttatggcttcaaggacagaataaatcaaataaaatcaaagaagcccattttcagggaatagaaacaattcacagaaataacaccttgaatgaaattctcatttttagtgcagaaatggaacataacattcttagattacttgctttctaaaagtgaatattctttaggtattactttttcaacattgatgagtttacaacatttctttttgcatagcagacaaaactgtgtaggcattcacagttacagaaagaaaaaatatgactagcttcctgcttcacacaaagaaatcatgcaaaaaaaaaatttcaagccaaaagaaaaaaaaagttttaaaacattttaaagtctcatattacttgctggctgtaatgggaatgtgtaactttgtgaagatgtctgtagccatcttattctaatgatcacttatctttatcaagccattatgtccatcttgacatgatgcaatacacagggcataacattacctacacagtatttctgacataaataaataaactaaaactaatcaaacttttagttctaacaggagacaggaagctagaaaagcaaattaaaggattctacaaagaaacatctagacaaatccagcaggtgagacattccactggacaacaggttcagtcccaccaataatcaatgtcatgaaaaggcaggaaaaaagtgcagtagaggggaagcagtggaaggagaactattaaagattaaagagattttaaagatttaacaacaatgaaatgcacagtctttgaatggatccttgttttaaaaaaaaaaaaaatctgtaacagaggccaggcatggtggctcactcctgtaatcccagcactttgggaggcagagactggaggaccacttgagcccaggagtttaagaccctgtgtctgaaaaaaaaaaaaaaagaaagaaagaaagaaaaaggaaaaaataatctataaaagacatttggagcatttggaggaaaactaggaaaacttgactatgggttggctattaagttattttcgggaatttctgttaactttgttaggtggaaaatggtattgtggttgagtagaaaaatatccttttttgtaatatatactgaagtgaattgtcattttatctgtattttttttaaatactcgagcaaaacaaatagaaaatgtgacaaatgttaacaactgttaaatctaagtgatcattctatagatacttattttattaatctcttctttttggattgtttcaaaaattttataataaaatccttttttaaagtcttcattttgtgggtgggcatggtggttcactcctgtaatcccagcactttggggagccagggcaggtgattgcttgagcccaagagttctaaaccagcctgggcaacatagcaaaactctgtctctacaaaagaatacgaaaatgtcaccaggcgaagtggtgcatgcctgcagtcccagctactagagaggctgaggtgggaggatcacttgaacctgggagatcaaggctcccagtgagccatgagcatgcctctgcactccagcctggataatggagtgagaacctgtctcaaaaaaataaataataaagttttcatttttaaatggccaacaagtctacagcaaatttaaacaatgaaaatatgagatacaatatcttccttaaaaattagcatattttcttaaggaatactgctctgctcgaagaattccctagttctgtaagcgttcgaacaaattaaaatcttgtgtttatataacatatttctaagacaacaatgaattctgtcactaactatatgagtaaaatgaacaagaaaaccactaataatgatggtgcacattttagattccttttattctttttcaagacacagacataactgagatatcttaaaatcactgactttcaagatttgagataatgataataactcaagatcaagtcttccccttgtgttagaagtgggggtgggacagttccagacttccacagttgtaccaatgaaccccaatcagatgattttcaagttacttctccttcaggtgggtgggcatcagagagaagctaagagaaggttttgacaaaatccaaagtgtgtccagacccctcaaataaggtaacctgaccaagtttaatacattcttagggcctaatatggatctcagttaaaaatcctggtctcttttaattcttgtccagttgctaagtgtattatttgacccattaactctgcaagtcatgttggtccattcttcttctttacggttttgcaaaatacatcaggttacagtttcaagtatctgtcacttaaacaagtaagcatttattatttttaatgggagggctaacatattgccacagaaatatagtatgggtactgaagaaaatatacacagactctcaggtcatcactgagccttcccaccatcatcatagatccagcatctgacttccagagtaccaccaagaagaaatcagaggcagatgacatacatatccatggtccttgactctagagagtccagccaaaatgtgtgggtccatttaatcatttctacagaaatgggaggctattgctccaaatgacttctaaccactcactcatccatcactcaaagcatatgatacaattgatttaccagtcattagtaggcaggtagagagtggtgaagcagtggagagagcttggtatttacagctgctattgcaactttggtagcacaaacaacatggaattaggacagggattttcaaagtattgcccacggacttctgagcacctcaagatcttttcagggagtccatgaggtcagaatttttttcataataacagcaaaacattacttgcctttttcgttgtgttgatatttacactgatggtggaaaaacaatgatggataaaactgctggtgccttagcatgaatcaaggcgggggcatcaaatctgtattaataatcatgatattcttcactgccacatattttcaggggaaaaaagttagtttcacttaaaaatgatactgactgtattaccttgctagggctgccataacaaaataccacagactaggcaacttaaacaacagaaatttattttctcatagttctacaggatagaagtccaagatcaaagggctggcagagttggtttcttctaaggacccctcctccatctccaggcagacagcaggcttgccgctgtgccctccagaaaggatggtctttcctctttgtgtggggaacactggtgtctcttctcacagtgtgtccaaatttcctcctcttataaggacatcagtcagattgaattagggccaactttaatgacctcattttaacttaataacttctcaaaaggccctttctgcaaatatagtcacattctgaggttatgggatttagggtttcaacatgaatttggtggaaaacaattcaacccataatactgacaaagcaataacaattattaattttattaaatctcaactttcgagtacatgtctttttagtattctatgtgacaaaatgataagtacacataaagcacttctgttacattccaaattatgattgttatctaagaggaaacacttgtgtggttgtttgagttgcaagctgaactagctactttttccatgaaacacacatttttgcttgaaagaacaattgacaggcaactatggttattcagacttgtagatttgccaggcattttcttaaaaacaaatgaacagagcctgtcatattaaaataaacaacttatagttgttgctaattataaaatcttttttttttttttgacagagtctcactctgtcacccaggggggagtgcagtggtgcaatctcagatcactgcaacctccacctcccgggttcaagtgattctactgcttcagcctctcaagtagctgggattacaggtgctcgccaccacgcccagctaatttttgtacttttagtagagacagggtttcaccatgttggtcaggctggtctcgaactcctgaccttgtgatctgcccaccttggcctcccaaagtactgagattacaggcatgaggcactgcgcctggcctccaccagtactctttagcctctgtcctttgagatgaaaggcgtatatccagggagtcattgccacttcaccctgacctctagaatgaagacacataaaacagacctaaatccaactcacatcttgaagccaagtccaggtggcctgcagaccagtgagcaaaagtgatacatgtttgttgctgtaagcaattgaaattttggggttgttatagatcacaattacaacaaaaatagctgattaatacagatggtgggtcttgagaggattctaccttcatatgcttttaactctatgtctctagcaattatgaaatggcatacctaaaatttttggtggtttcctattatcctcaggacaaaacagtatagcttacttgctcccttaaatgcagttgcattgaactacttacttcctgaatgctctgtgttctttcatatttctttgcttgagatgccctttccttcttctatcccccaattggtccgtagtccctctgtattttcagggtcttagctcagttgtttgcttccctgcgaattcctaaatgactaccccagtgatctgggttaagtgctcacccttttcggaattttcatagcatccagtacttatctctattttcgcactcaaaaccctttttctttcttcttcattaggttgagacccttgagagaagtgatctgtcttgttcatccctgtataccatgtaccagcacagagcctaacccagtgagtgctcagaaagtgccttctgaacccattttaaggatgaggtatctcaggttcagggaagataagctagtaagtgacagagccatggccagatcttcccaactcccaggttctggctcagtgcctggtactaggctgccttatggaatactgccttaacatttgtttagtggtattaaaacacattggtttttaatattagcctgagttaaacatggttggtaagtttaatttgttgtgatttactccataccatatactatattctaaagctgtatagaaatgagtttcacattgtctacatatttggagtattcaagtcatgttctcttccactaagatcaattgcatctctggagaggaatcctcgaatgccacagctgggagatgtttcaaagatcatgtattcactctcctaggttttcagatgagagagtctagaaagatccagagaggtttcacaacttggccaagtcacccaatttcaaaagaacttacaagaaattgggtatctctatcccagtgcagtgatctttttggtacactaggcgaatgtcttctttggtctttcattctggcatttatggtttgagactgtttcagcctgtcagtggatacccttccctggagtggccctaggatagtctgggcaacctggtcctttctttctctgtgtagattttaatcgttatgtgagatgctcttctgcaggaatggggaagagcaggcacaaggtggatgaatcctgaagttcaactattcctggaaggagactgtgtcatgttcttttttccaggcaaactcattttcagaggaaagggacagtgttggaggctgagttgactgtggtacagttcagtcctggctgggttgaggtctcatgcttgggagcaaatatatgggatattaagccaagaaatgaaacagggattaaacaggggcatcctccaggcttagaatatttgggattgtgaactttgagctagtgttatttatctctaccccctgcttctggtattaacacacacggtttgagagttgtagacagactacggcgtgttttaaaaaggataccaggttgtttaacagacttcaaaccatgtcctgggaggaatagctaaaacatatgggagactgtagaccaaaggaagggaggtatcatagtgatcacagtcttcagatatctgtcagagaagagctggcatatcagaagacagttggattctcatgtctgcttatgcactctacctattgcagtatgttggtttggttgaaatatatgaggaaaatctggcctcacatagatatgtagtatgaaaacaaaggagtattttaatagcttgttcaaaatattgtggacatgatattctttatattgcaccataattatttgacaagaggtagtttctttgaaggttagttgcaatgtgaaatctgataccatcttagtgaacttatcatattctgttacattaaaacattggtttatcctgaaatttggatagaacgttcacccatgcatgcttcttaacccatccattagtcacttgagaaaattggttcgctgttaagcagcttccacctgttagcacacattttattattcaataccaaaatattacagtagctaacatcatcactggtctctttaagtcaggaaaaatttttaaatattggtgagctatctacttcacagtgacaaacataaatttcctaaaactctaatttttcctggaagcttagattttctaattagcaggctgggcacggtggcacatacctgtaatcccagcactttgggaggccaaggtgggcagatcacttgaggtcgggcgttcgagaccagcctgaccaacatggtgaaaccccgtctctactaaaaatacaaaaattatctgggtgtggtgggagtggctataatcccagctacttgtgaggctgaagcagtagaatcacttgaacccaggaggtagaggtcgcagtgatctgagatcgcaccactgcactccagtctgagcgacagagtgagactctgtcaaaaaaaaaaaaaaaagattttataattagcaacaacttagcttaggaggctgaggcaggagaatcatttgaacctgggagacaaaggttgcagtgagatgagatcgcaccactgcattccagcctgggcaacagggaaagactccgtctcaaaaaaaaaaaaaaaaaaaaaagagagagtgctggtggaaacccattatgtgacgtgtcttgaagcctcagcttagaactggcacaccgtcacttccactcatattctatgaatcaaaacataatgaagccccaatgtcaatagagcctgtagtaggaagccctgcaaagtcccatggcaaagaacctggaggtacacttctattacagggaggaagtgaagagttgggaagctgcattctcatcaggattcccaacttctgtttcctctaactaatcctattcacaccagtttctgatggctgcttcttgggaaagtcaccagcactagaaggagctcaatgagtctcatatgggtgagtcagaagcttatttcatcaatcagctacctcttgccatttcaaagactagtacctaaggccagctacactcaagagtccaagtgacagttctttattctcacctggttctccccatgaggccttttgctgtatgccatcccattacatcgtctgttattgaagccataacatttcttatttttctcttttcctatttgcttttttttaatcagcaaaagaatgttagactttatatagagagataacgttccttggagtttatggggcaggcatgcagctgtatgtagggtggaaagtcattacaaaggtcataggtaaaatagtcataattaaatcaaaccatggatttggataagactccagggaaagtgtgaagagtaacctttttaaattcctgctccctgttgataaatagcaacaacaacaaaattcctactcttctttcatggttaaagtttaataaggtcactttcgatgagcctatcacctatcatattgctttgttttgacagcactagaacagagatcaaaggcaaacaagaccagtgtcttgtgagccctgaggagaggttttgagaaggcaatgactgggtcaaaactctgaggtcaaacaagattaaaactgaaaatcatccgttgaatttggccagagctgctgcctctgattgctcaggttgtgccttcacaagggcatctggcagagaggagaagtggggctaaaattcaatgcgtgctctgccgccagccaaggccctgatgtggcgttgcatcttccggaaagggaaggccttttataaaccacacaaaagtgcaatctgttcgccaagcttgaacccaaggggctatctctacattcacccagcagggctgccttttctaaatcgcacaaagcaccatatgggctactggcctgaatttagcaactgggaggaggtcaatggaggggacacaattttaaatttacatgaaaaccctttgtaaactgtataacactattcaagtgtaaagcaggaagaggtgattcagaagcttagcaggtgacaggagaaattacactgaccacaagccttttctgcctaacccacagcatgtagaatctccatgagacgtttaagtacccgacaaactcctcagtgggaaaccatttgagggcagactggccagaaagcacagatgggaatggatgtgattatttctaaaagtccattctagtcacaaaccccaaggcagatctagccagtggggcagaagagccccagacagaagcacctgagccagcttggcctgacctaactgtcaggaccctttgatcttgctggagcttgacttggagaaaacatctggttctggggattctcaggggccatatagtgtgaaaccgaggggaagtttttgtaaagctctgtagcactgtgactgggggatacgcacagtgctacaaaacctacagagacctgtacaaaaactgcaggggcaaaagtgccatttccctgggatatcctcaccctgggtcccatgcctcaggagacaaacacagcaagcagcttccctccctgctttggggcctggaagggatagcaggaagttgactggaccagggagatgaccacagctgctgacctctcactcactgctgttcttccttgggtgaaactggcatttctacattttcttacagcacatttggggaatacaaaaaggcctttcttaaaaactattcttgtcttgttttcatgttgattctattgcaaaagagagttatatgagccacctcatacggaatttctaaattcaaacctctagagagatttacccaagtgctttgctttgcagtttgggaggatggatttgaagagagattgatttttttgtaggcaatcaccggccacagttgctcattctaaagctgactgctctgtaaatcacccagtgcttcatgccaccctttctcctcttgctgtgccacacgttatctgcctttaaagcagcagcactggtgtctgtaaaggccttaaccctggagtagtcatggagccaagacccacccctttgacagtgccagctttccaacacagagagctgagtatgggtctaggaagtgagagcaatgtaaaacaatagaaagcaacagttcagagcactgcatcaagtgtactgtgctggaaaggtccgccataggaaatatggtcctccatactcctcagacaacagccttccgaaagcaaacctgtccctacctgcagatgattaaccatctatgaaccggctgggtaagcaacaagtgccatctttcatggagctgagccttaaagatcctccagtcctaaagctgacgggaagaaggtaggtgggagcagcgctgaggtttttggaacgtcctcaagtgctgtgacaccgataaactcatctttggaaaaggaacccgtgtgactgtggaaccaagtaagtaactcatttatttatctgaagtttaaggttaaggcatcctccatctaaggaggcagaaataatcctgaaatgggaaatgggtgaaatagctagcatttaggaggactcctgggaagaggtgaaatatggttaatcctttccataggagaggagcagaaggtgtctgtaaaaaaagagtttggggcatatgaagggacccttctggctcagaggaaacagagaactctgcccagtccatcgaatttgggtcaggctgtagaaaccacagagtcattggcccaactccctgagcagagtcagaatggacacagaatgaagctgacttgagtccaggtggttttaccaacgtgattccaaacgttctgacctcccttatgccaaacacatcctcctggaagagctcagaactgaatccgtctcctgggcatggagggtggggcgagcgcaagtagtccctggtgttgcgatatttctctttagaagaaaataacctgtttcagacatttgtttctaattgtttgagctgcaaatgaaaactaggttactagtgagaaatatgggacattctggttcccactgagaccagattccaagcaggacaaagtgaatgtgtagtgcttccaactaagaaatgctttgaagtctccaggacacagccaggagagttccctaccactcaccagtgttcatcgtttttgcaaagagtatatggtgccagtcacttattaacagttatgcaagaatcaatgctaaggttgttgaaggattgtgctcaacacagaaggcatctttggtgtcctttcaatgacatttgaattcgaccgtgtcttgctaaaaaataaaataaaataagacagtggtctccacctggcagcagattccagttagatagtacatattaatcttaagtaagaaaatgtaataaaccaatacaaaaacccatttcgaaggtcctagggaagtctagcaataggggtcagtggtcccaaatctgcccaaccagctgttggaaaagaaacagcatgccctgccctggctgggactttggcactcagctcaggtttttcaaggtaaaagaaggctctagagagatagggtggtgatggtgggctcttctcagagaccaaatggggacaaagcagttccaggcatatgcaggcaaggaggctgaggaaggggaaggacaggcatgagcaacccaagacctcacacactgcagggagaaaaggggcaggggccctgccgtcagggagaaagacacccaaagttgtgctagtggagtcagtgcagagatgttcagacttttttaaaaaatcaacatcttagtaagattttgaaattttaactaatttgggcctttgcctttagaccttattatccttaaaattttcactaaaataagtttatccacaattccaacaaagctaaagactgattatcctaatttccctttgtttgccaagtaagggatgaattaagttcctctgtttacccatttacttggtccatatttccctaactgcggagtgcacagcacatattttcagatggagagacgttctttttatttgcatggatctatcttttaatggctatcagaatagtacaactaggctatcaaacccatgtgatttcaagtttccttttaattatattttaagttaaaaagtgaataaatttttttaaattattaagcaaattatgacagatgactatgaccaaaaaagcgggggagatgtgcttaattgaagtttgggaagtgctgaacttcatattggtgcatttcatcagcctttgaagtgaaaaagtaaggggtatccagagggggcacaacctagaatatctttgaatggcagcttctatttttaagctaccaacattggattaaagagactgcactgcaaacccagggcctttatcttctcagaagccttttgatgctttttttttccttgggagcttctttcaagttcttacttacggagctcctgggtagcacaaaactaacagaacaggtctatacaaacccacagctgtagatcccacactttagtcctctggatacagtaaacctggagagaccacttagcttcgtaaaacagaacagagaaacaggacaaaacagcatggaataaagtaatggaaacgtgtacttctatggtaacaacagcggcagtggggaaaagaggcatggtcgttgggaacatctgcgtggaagtgggccatgtgatggactttgaatgcaatctattattgtatgtcacaattatgtaactaccactttttgagtgcctaccatttattaggccactgggctaagtcctttaatgattatcacttcactcagtcctcactacgatcatgtggaattgaggtaccatgacttgcgttttatggatcaggaaactgaatcttaaaggggttcctcaagatcacacagcttagtaaagtcatcatttgaatcacctgcttgatgccagcatctgtgctcttaagaagtctgctcttccatcagggctgcagctagactagggcatgtgtggaggtttttcctgcctggcccagcctctgcctcaggtctctaatgagctccttttcaagctgaatcagaaacaacagttatgccacttcccttccagtgccatccccatcacttctctcaccaaggaagaacttctgaacccccgccaaaaccagttacccaaagcagcattccccttccccaggaggagccaggtgaggcccatctctcacattacacccctggagacccagggtccctaaatacagaaaggtccagacgatgatcagagcatcactctttccctcaagaaaaggagtccacataattctggcctcatcaaaatgtttctcagattccaaaagatgaccttcccattcctccaggcccactagcccttggcctggcatctggcactccctctcactcccagtcagcatctcccagaacagagcctttgcacctgcaagtccttccacctggagccattttctcccagggactcacacagttttctccctcccctcctccaggtctccactcaaatgtcatttccagtgaatcctttccctaccacctcatgtcactctgaagacccctttccctgctttatttatagccctcatgtctacttgaatctttatatgctcgtttactgtctgtttcccttgctctgtgagagaaaggactttgagttgtttcttactgcacctataagtacactgaaagcactaaacaaacatttgttgaatgagtgaatgaataaataaaggaatgaatgaatcagagaaaaagtcagctatggtataaagcaaaagaaaagaaaaatgaagggaagctggtaacctacagagccgagcctgagtcctggctctgcaacccatcacaggtctctgccacgaagtgccaggcactgttctgggtgccagggaatcgacatgaacaaagcaggcatgaacttctgccatattggagcttattttctaatggcaaaagacagatggtaaactaaataaataaataaaaaatatatacagtgcgttagggtggtaataagccctgagaagaaaaataaagccgggaaggagaataaagaggactagtgggagggaccagcatgcagttttaaacagaagagtcacagaaggtctcactggaaaggtgacagtggagcagagacccgaggaggtggtaaagtgaggcatgcagacctctggagagagagcacttccaggcagaggggacacagggctgcctggggtgtgtggctggaggaggggagggagtgatggggagagaatgtgaaaatgaggtcagattggtgatgggttggggagagggtggcttgtaggccactgtaaggactactgcttttggattcgaaagggaagattggggagtagaatggaagtcacacgtaacctagagaaaagatctagagagacagaaacctgaataccagtcctaacccacggccctaagaagtgggcaccctcttcatatcacataacaccaaaaaatagcttctgttctttttcagcaacctgtcccaacaatccttcctgcttgggagctctgttcttagtgcaattacattccccacgcttctagtaaaatgtatcttctctgagtttagccctaataaacattctaataattacatcgagtctctctagttcacagatgctgtatctaatcttataacctataatacggaagatgttatcctcacttcgtagagaaaccagataaagctcagtgagtttaaggaacttggccaagattacacacttggaaagggacagagtcaaaactaggttttggatcttctgacatccttctactttacaacgactaggaaccacccttcatgttagtgattctccaactatcatctacagtcttttaaggattgtaaactgatccgaaaaatccatattccctccttggtttttatgagtgacatacaggcaatctcatagattctgatgttcacgtataacagaaattaatttaactgtcacttctaagtgtgagagtgtcattgaagcttgctaaaatttgatatgcatgaatgtgttattaaaatggatggaaaaacttaattctattttgtactaagcagtttggctgctgcacaatacttggcaatgatgcaaaactctcagatatgaaataaatttcccctaaaaggttggaatgcatggtatatataacctgctaggtccctgcctcacctaagtgtagcccgaaggtggagaaccactgctctatgaccaacgttccacccttctttcctcttgatcaaaccaaaaaacatctttccagtctatattcattctctcttatttgagcacaaattctgtcagattgtaatatgggcaaaagcttggatttctatttgatgctagagtcacctcttgttccatcctgaaggacaacctctaagacggaggagaagaggctaggccagatgggacagaaaatcacatgggatgaatatcatgtgacttggcaactggggctagggttgccgtaaagggaaaagcaaggtagtttttggattaggtatgtcagctgtgccagacccctgatctttggcaaaggaacctatctggaggtacaacaacgtaagtaacctacttttccttcttatgaccactatgtttggcaattacatttgttaaatatttttctaagtcaccaggttaggaagcagtgctccagtaggtaatatagcaagggatggcttgaggaacaggaactgagtttccgataaaatccaggatggcgtctgtgcttcagtgagccgtcttgatccattgtccttcctagagagtttctattccctctacctggctccagaaagctaccctcctcaacatctatgcatccaccatgtacagatctaggccaccactgtgatcagactcacatgacagcacttcggggggtggacacaaggtgaaatgaggagcacgctgaaccagtaaatcagaggccaagttccaatctgtccaatgcattaactgacaatgcattagctgacaaactctgtgacttaactgcactgaactatagtttccctatagttagatgaaggatttccaagctgtcttccagcccttgcccactatgatcctgattatccccagaccaattcttatgaacaattgggaggaaaagcaaggaagcccaatggtgtgactgtcctattacccagtaggaattctgtgatttaatggaaaaaaaaaaaaaggcactggaaagggagtgaaaactctccctatgcatcccttaattagcccttgtgtgatcacagaggtttggaaaaatgatgccttgaggctcctttcagtcctaccatctattactctggttcaggggctggaaactggaaattgagtgaagcccaactcagccactcacttaaccacctttacagtgcctttgtctgtgagatggatctaaaaatatcacctcatagagtttatttcaataactttgttgaagtagtataaacaccagctgtttaagtaggaaagtatttatacaaatcatagtcatctgtgattattatagtcctttggatagaccccaagtcttttgcatcaatggctcttgctccaaccattgtgtccttccacctctcgctgaggcacagtcctgttgtgattgatttagttgaggcttgttgttacgtttctgcctacaacggccatttggcaattctcagcaaaatatgtgaaaatgttatcctgaagcaagatctgggagtaagagatggcaggttgaggagataatagcagaaaatctaaggacttgcctaagtgtcaaaactcagaagatagcagacatcaaaaaagctgccaaaatataatgctcagatctcagaaacccttgcaaagctctgtctccagctacacccattctgctccacccacccacttccaaacagatgaattagactgacagggagcaaataggtagcaaggtttttcgtaatgatgcctgtggtagtgctttgacagcacaactcttctttggaaagggaacacaactcatcgtggaaccaggtaagttatgcattttactacagctcagtgtgtatatttctttagggttgttgtagcgtagtcctgaatgaatggggcttcttgggaagtaaagagttccaaattagaaacccattgtttgttgcaaacagtaggggtaaaatttgggagcaaatgcattagatttctcttaagaaaatattctgtatatgcttggaaactccattctgaggcttggtattcataagttttttacaactactgaaaaaaagccctaggtcaggcttttagttttgggctccctagaaccaggaaaaaggcaagctgtggttgaggagggtctctccagtatttatgagggataaaagtcatggtcacagtgtaggaagagggaaggttagaaagaaaaaagtattacgaaagaaggagttttaaaaagaggatctttctctcctctctctctctctctctctctctctctctctggataagaagccaatcttgcccttgtcacttttttctgaacttgcattaaaccaacataaatggttcagattaaatggttctcaaggtcccatcctggcctgggtctgctgagagcagttatgagctcacctctcctgttagccctgaaactgggaactttgcacaatggttcaggagcctgtatccaatgtagaaacacagccaccaactccaggacaatagagaagtcgtggtcccctactggagacattgtctactggtagcctactccaatgtttggaaatccaggggctatattctggtagtttgggtagctgccaacagtcaatcactaagaccagtccagagaatagccttcagacaccttccaaaatgccaagtccattgggagagccattacctcttacatgattaggtattgattttgtttattcagaggaaataaataagtagggaatggtacatgaatgtggctaggctatctgaccaaaagtccaaaaagtgactggtgctgtcaacatggtctctgcctctcagagaataatataaacttatagggattctccactgcctgttgcctccagggaaatggtagaatttggtgagttttcttatctttgaggggagagagactagagcactgaaaaggagggaaacagaatcatgtcgtagctgattgtagtctgattgatgtttagcaaattgcatctgagcaaaaactactgtgtttcattttcccctaaaatcatttccacttgaaatttggaattatctgcagtgttagaatcaaatctttgaggctgtgcctttgggagtcttagggaagaaggaaattgatgaaactgatgcttagcccctctgccaggatgctgaccatgctccccgatgacactccattcgcttctctggttttcttctcctgcagtggtgaaatgtaatatgatgatgtgaagctcaggtaggggatgtgaaaattttcaaatcaaaccccaagtccttaaagctttgacagtgaataatggccctacacaactgtcattctcttttgcctggctctagcccaacgatcttgatttttggtgatgaggcagagtaattcacatggtctttatgttacattgcacatgatgactatatactcctgaaacttatatctggatccagagtcaggagaaattataaaacaaaaataagcaatgcaaagcaagcactggcttctctgacctgtgtccatgacacacagcaccagtgggctccctgagcagtgaccaatttcttgttcaaccctcaggtccttagaaagcctttcgccaagctcagggaattagaaagcaggttcgttattattgtgagactcagtctgagtgatgggggaaattaggtttctaatcaaaattctgtacttgtgacccaagagaatggaaccagagtataataagaatggaaactctttctataaccctcctctcctcaacctaacatttgttgtaagaaaggtcaagttaagtgccccatccctaccctcaagctattgtgttcttcttggatgcccctctcaataaactggaagttagattttccatcatgaaggcagctatttgtcacctgccaccctcttctcttgctctgtctcagccctgccctagtatctcttggatggggatatcaccctcacatctctatcaagcagttcaactattattagcttcaaagggaactgagactctgtgtactcagccccttggtctcatcaagagcagctttgtagttctctgagctgtggggtctctaggctgagaactgaggctggggaggcagggcacagatgttacagctcaggccccagggccagctccaggctagttacctgtgaggcactgtcataatgtgctcctgggacacccgacagatgtttttcggaactggcatcaaactcttcgtggagccccgtgagttgatctttttcctatatttctgggataatttgagtcctggcactggggctgcaatccagtttgcattataaattataactagtaaatgaaattataacaaggagacagagtattacagatgtgaaataggccagagtgaacacactagactgagtcacttaagtagctctgtaactctatttattttaatatatatactctatattaaaacaatagctcccatttatttctgaaatcttcagagcagcccaaaaaacacaaagaaatctagaagaactacactaagagttggagcattcaggtgcaagggagacagtgggagggatacttcagccccaattcctcaggaagctgcttcatctctgcacatccctttggctaagctaactagtatgcgtgcctccttgcaaactgaaaacaagtgtcctacagcttggaagattctggagaaaggtagttagcatggtcagagtaattaggtagaacaaacttttatttcagggtttaagttaaatcccatattggcagaaagtcttgaaattctgagtgacatttattacagttgttgcaattcttaggggatcagtaggactagctatgagaatctaaaacataggtgacttctaagtttataaattaagaaagactgttcaggaatggtacacacttttttggtattgtttaccagcacataaacttagcaatgtattggtgttcataaaaagagaaagtctgacaataaagcaattttccaaagaaataacacttgaaacacatgttgcaatgtaattatatttgtggactaagaaaaaaagactacaagttcttcaaagataaacgattaaatctttaatctaaattctggactacaatttcatacagcttcacgtctgggtttaagtcaaatacaaaatagactaggatgcatatggcaactatattgagtgcactccagtttttaaaaaggtttaattcagtcagacacccatttctttggttaccaagatgccaaacaatggattctataagacactttctttcaaacaatcgttttgaaaatataaacattaatgtagaaagagggattcagaaaaatgttttatcaaatcaatgtattatgctctatctgaaatgctgactaacagagtcagagcacaatatcataagtgcatgaccttcttcagacatctgtcttttcagttatattgtattattcaaattactcaaacccaatctccccagcccaaagtgatgatttgacaactgcctgatgaatttagcttttaaaattctagcaagccttaattatccaactaaatcagaccaggattaagagatactcttaaataaacaaggagatagggtgtttattttatggacaagtttcttttgtaacttgtaactcccttgaaagtcagccagagtatgtctcaaaccaaagtcaagatagtgagcaagaagtgttgcacttatgaagggaggtgagtgagcaatgcatgtggtttccaaccgttaatgctagagttatcactttctgttatcaagtggcttcagctatgcaaggaaaccaaacaggggaagttttctcaagcaggttgaaagcaggttccaagaaagccctttgaaaaatgtctaatcctttcaattgtctagaactaaagccaaaaacataaggaaccagattcttaggaataagtttcctgccctgagtgactgaaacagaatcagtcttttagttgagcttctcagcagaggaaacggggagaatgatgatggtagtgatggggggtttctctgaatagttgattttctaggaaaaccatgatcaactttggtccatttacaaagccgtgatcagcagaaacttcctgactagcaatcgccccctctcaaccagatataaccagttgatctggcagtagctctgctgctgtgaacctcacagctgaagcccaaattcagattcaggataaagcattagaaaaattatttatttttatacagaaaattagccaggtgtggtggtgtgcacctgtggtcccagctactcggaagactgaggctggaggagagtctgagccaggaggcagaggttgcaatgagttgatattgggccacttcactccaacctgggtggaaaagaccctgtctcaaaaaaaaaaaaaaaaaaggaaaaggaaaattacttattttccatttacacattcattaccaactttctgttcagcaacacctaatgtcttgattatagaccatagtaggtaaaagtacactggaattcaatgtatttttcatttgatatcaagaagcaaaattcacctaagtttcaaatactaagggccaaatttacaggagcaattaatattaaaagtcagcattaaatttaggattgaaaaatgtatcttgatcatcattcacaggttggttgtgtttcttggtttcaggtattaacagggctctttctttaacagttatttgaagatagcctaagaatttaagtccccatggacacaacatttatcacaattcaaaaacttcagtgaggcactgtgtgaaagaatcatcactacctctctcaaagcttcaagacttgtggtcttaaggaaagaaaagtatgcatgtacagggtggtagtccaaagtgaggcacaaaagaagagaaggccaggagggaagccaatcctgggaccaacattccacagttcctcttagattaaaacaagaatgaacgggcttcaattggttttatttctttaaggacttcctgaaaatgatcattgttatcctctgattaaagactcaaaggaaactatacagtagtcagtcccctacagaagaatgagtattcacctaaaggcagaaacatgtaccacctaccttcagcagatccctttccaccctttccagcagatctggaagggatggcacccttccgggaccccaacactgccatcctcagaacctctgagccagttatgcagtccttctcagaccctcgattctttaagtgacagaatgcatagcatgagcacctgccctgatctaccatccaagggcccatgcatttacaaaaaaccaactggtgcagagagatattcagcctgacctagattgtccagaggattgattaataaaacacagataatcggctggatgcagtggttcacacctgtaattccagcactttgggaggccaaggtgggcggatcacctgaggtcgggagttcgagaccagcctgaccaacatggagaaaccccatctctactaaaaataaaaaaaattagctgggcatggtgatgcatgcctgtaatcccagctactcgggaggctgaggcaggagaatcacttgaacccgggaggcggaggttgcagtgagccgagattgcaccattgcactccagcctgggcaacaagagtgaaactctatctcaaaaaaaaagaaaaagaaaaaaaagaaagaaaaagaaaaaagccacagataatcgaaacccagatgatccagaaacttctttgtagttgtcattttccatctgtgcttccagccctatctcctagcagctcctaactggaagtcaaacttactgcctttcatttctgctccccttgcctgtcctttcacagaggtggtaataagcccaggtcactaacaggatgcatggaggtctggattgtagtgtttggctccagggtaatcgaggtaatcaccactgtttaacccccacaaagttgtgaataatcatctcacctaataagttgattatatttgcaggaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacaggtaggccatttctagcttcaaggagctggagattatggggaacaagaattgggtgaaagggaagttagagatgtaactgtggacaaatcattctcagtatagcatcatgctggaaataagacttaggcccaactatagcctgccattggcaggggagggaaatgcttgtcatccctaagatggaatctaaaataaagcccatcttatttcttcctcatctctcctctttacctaccactgtccccttcatactagactctgggattgaaagtcctcgtgcattctaatccagtgctaaattccaacaaagggcaatgcggcctattgtggggctaagaatcctagttcttcccgcatattggtgtgcctggatgttgacctcatggtacaatgaaaaaggctagaatgggaagcatgttgtataattagctatgtgaccttcaccaagtcacatcctctggtcctcagttcactcacccaaagtctcctccagttttaaaagcctacaatcctgtgagcctcttcattcccaatgtaaccctgaccactgctgtttgttccagatcacgtaaaaccaaaggaaactgaaaacacaaagcaaccttcaaagagctgccataaacccaaaggttagttcaaatcaaagggccaacttcagaatcaagggttaaagcaaactctgtaattgtccactggggccaaaatgtatcagatttcaaaagaaaacacaaaccatgctgagcccagttggttctgcagagcctctgactctcccagcaaggcttacctggctgtcggcatcggtttcccaagcttgcctggctgggtgtcagcagcagcctaaggtctctgacggctatctggcaccatgctggacttgcaggccagaaagaactaggcagacttggggcaggctaatatcagtgttgcaggcccaatttctggaagggaatttaatctctccctgaagccaccctcttcactctttttcagccatagttcataccgagaaggtgaacatgatgtccctcacagtgcttgggctacgaatgctgtttgcaaagactgttgccgtcaattttctcttgactgccaagttatttttcttgtaaggtaagaattagccgcttcttattcctatctctacccacaccatgctgcacatggggaaaggggatttagaaatggctaagaaaccaagaagcattggaaagggaaaatagagacatacttagaattaataaggtaggctatctcagctactcagcaaaacagcaccccatttcctgttatcctttcattttgagtcagactgaaacccattaggtagtataatgtactatttttctaatataccagagaataaccctcactttcactccagggagaaaactgaagataaataaggagaattcatcttctttactgctattttgttcatcgaccaagagaccatgggttatttgcaaggccataagtaaagctttgcctgaagactatccagaggaagcagaacctatctttgtcctgataaagggaatgccagctcacactccttaatcataggaccagcctgtctatgtgtggatcagcctgtctttgggatgaacctacacacagcattagtagtgaacagctcactattagctactcaggatgcatacacagttaggtttgagatgtcaattatttgcctgttacttgcattccgttctcaggtaatctcatacacgaaattgaaaccagggcctgggtttgcgtgtgaggcttctccccctcactccttctccaatactcacaaatgctcatcaaccccagcttctgttctaggaacaaccctagactcagagtacttgactgatctgacccagacagtaaacatacccagtcatctcaaaaagggggtccagctcacctgttattttactaacagtcccagggacacaggcagtgtggctgggtaaaaagagagctatactaagagtcagaagatctgggttttatcctgattttgacactaacttacatgttaccttagccaggtttcttcatctctctgggcctgggtttttgcatctgcaaaacaaatgagttaaaaaaaataataaccaaaggagaacaaaagagtctcatgacttgtgccaacactgatagctgaactagctgagctattgccatgtgtacatggaaagtgagccacaatagattagtgatgtctgcaatggtacagtatagcaagtaccggccaaccccagactacatgacccctacgattccttctagcactggcagtctattctataacaactttcttcactgcaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaaggatataaaaagatataggactctttttttactcctacaagtgatacactttgaaaatgatgttttgttccttttgactttctttaccttttgaagtagaaagtgggaaccaacaggttcacagcttcattcctcatgaggcaaataggccttgggagaagaagagcgggtgcccttttatctaaacatggaaggctctgctcaactgagcactagatttgctacaaaccagcatcatcttcttcctcctgtcctcacggcttgtcccaccctctatgttcacttcaggagccacactagagattctgcatggcgtggaggaggacaaagtttcagcactttctgcctctcctaatactttacaaatgagattacatttgaatttgctaatactttatgagcaggcaatgaggtttccaaaatctcatctaaatactctccaatctattagcaaaaatcagagtaaaatacagaggaaaggcactgctttctgttaattgatttaacatgcatgaattagctccctctgagttccaggcactatgctgagagtacaaagaagacacaagtctgctttcaagcaactcactgtgaaagtgtttttgaagggaggaacagaaatgagacccctatctttccctataaaaacaacatttttactgtcttttgcctgccaatctgtatttgaaaccattggacactgattctctggcctgggactttggcattgatggttttctgcctttcttctcagcctctgcctctattgcatttattaaactgcattgtgtgcacctcgcctctggctttactctttgcagatcaccacagggggaaactcagctctgtgagctcactattagtcagccaaaagccaaattgaacttatgggtcacactgcactttcctgagccccaagcctacagaggccctgccttggagacccagcctcgggtttcctgctgcctctgctgatgccgctgttacagcaagagcaacagcagcacctgcagcgtggccagtgacctctgctactgccacccaggaaggccacagccttttccaggagcactgctcaggtgcagagccctagcaacccattattgtggttctctcagcacctatgtggagcatcaagtcgggggttatgaggttacaagtgaaagagtgactgtcgccaacaactccacttgccatccccgacagcaaactcccccatcatgtctactacaccttgtatgtgtaaggaatgctgatttccaaaacattcacgagttaccttgtgtaatattagggtgtttcctctgaagttgttaggaacaaaaagatcatattctcatttttcagataaaacaaaaatgccctctcctcaaaaaagtatgtatcatgtccagagtcattcagtgaggcagggatattgctgggagcagaaccaaggtctcaagattttcagcccaaagttcctgctataagaacatactgcatccccaaatgaggacaagatgtcaaagtgagtatcagctagaatgaacttcaggattgtcccatatttagcatataaatgagccaccctctagcccactatgccagaaacaaaaaaaatcctggcatatcacaggaccatgaatttcccacaccaaaaggagcctccagggaagatttaaggcaagagccaggagggattatggctgccttctgatctggggccatgatatgtgaactgtgagatggacatgtgtcacactcagtaggcattagaacagaagccccagaaagccaagccacatgcccaaggtctttggctccctcatcccctgttctttccattgttctatacagtggctactcttgtccactgtttctgaagagcacataaactgctgcccaaaccactcactgatagagccacctagggtacagctgcagaagagagccctggaagtgtaacgctgcatctctgggcctgtcattatccaggtatacgactttgagaatgtccaccatgtctctggactgcagtgtagtttctataaaataacatgtaaggcctcttctatttctaagattatatctaataactctaatagttctattaaggcagataattcaagagaagaggaaggagggactgattcccagggactgagggtgtgtatctatttcaacatcacatagtcagtttgccccagaggaaattttctctgccggagacaccactgagcttcaaactcagggacttggcagctggaattctggaagtcacaactttccaggagtgcctcagtgctctgcagtgaaaaaaaagaaaatgttctccaaataaaataagtaaaatggaggtgtcaaagaacatcaaggagaaggtggctggatataaaaagatgcgggaaaaaaaaagtaaattggtgaaaagtcttttaagtaaataactttgtgtctaacttaattttttttttttttttgagacagaatctcgctctgtcacccaggctggaatgcagtggcaccacctcggctcactgcaacctctgcctcctgggttcaagcgattcttgtgcctcagcctcccgagtagccgggactacgggcgcgagccaccacgcccggctaattcttgtatttttagtagagacgggtcttcgccatgttggccaagctggtcttgaactcctggcctcaagtgatctgcccgcctcagcctcccaaagtgttgcaattattggcatgagccaccacatctggccctaatttaattctgcaatgaaaacagatcaattcataataatggataaatggtggtggtgactaaaataaagacacggctgacggcctcgccttagatgggccctttacctgcacctgaacctgcatcctgaaacactcacagaaaatgcagcacaggcttgtcaagcccctttctgtatcgggacgaccagggcaccaggggcacgaagacagcgctctgtaaacatgcagttctcctttgcctaccaggagtcattcaggtggcaagggccccgtgagtcagaagtggggagatactctgcttctctgaagccagggtgctcccctggatctgaccaggccatttatttctcagaagacactttaggtcacttctaaaggccaggctggaacccaaaatggctaagagaaggatgccaagtcccagacatgacctgccctaagaggcagctctgctgagctgtgccccaggagtttgtgttatgacttcctgggcacctgcatcatagtgctaaaggcacagtagtaagtggcactgtcttcagtccttactggagagatcaccaagtgaaaggctttctgggtcagaatgtgtttcacagaaaaccgtccttgagtaaaatctgcaccttctgatctgctgttatccccataaaagacaaactgaaaggaataatctggccttatccggtaccagaataaatctggatttgaatatacagtgtcgtaagtgcagagcagtaccacctcactgccactcgccaccgtctggtccggggaactctgggttactttgtcacacagcgtgcccctgtctgggaaaaagacaatgaggaaatagtgaattctgcaccccccagacagtgagtacagcacatgcctagcccagaagaactcaatgagcagaggcaagagaaggacacagaaataaagccaaaggcagcaaataaccaaaaaccaagagtgcaagagaaaaagccttcaagagtcagagaaggagaaatggggttatagagcaagtggaatgtaaacaaatgaaactacttacagaaaaacaaaaagctaaagcccacagtaagaatcatcttttcttcatatcagggcagaggatatacaacaaaacagggttcctaagatctcagagactatctgacggttctaatgaaagaagacgggaggaaaacaagaggagactggcagcgctgacggtcatgtgactgattcagctgtgacttctagaggcaaatgcgctcagccaaggaaactgctattgctattatgattttggccccaatccatcttgaactaacacatatgacaatgaaaaatggattacttttaaaaaagaaaagaaaagaaaaacaaaggaagggagagagagaggaagtgagggaggaaagaaaactgcaagactaatgatggcgttcttggatatccaactgctacaaaagtagttcactctccatttctgtatcctctggtcacagactggtgtactagtccattaatcacatgtcgtactttgagtgacactgtctcatagcatctagcacggctccacacactttgttctattcaataaatggaataagtgaaagagtaccttggacaactcccttactcctctgtgtaaagaggaaggaaagggggttggaccagattctttctaaaatctgtcctagacctgaattccagaaatctttgatttcagatgcttgagggagtgtcctgatcctaagtgcttcttgcacttcaccagcttgactttccatctctcactgggcccactgcagcacacacttggctccagctggaaaatcctgaacagagcttcccggcaggtgaactgccataagtgggttataagcttgctgagatagtgttcagagtgcccatgtacctggggtggctggagcccctgagccagcccctcccagtcaggagcactacaaatacagttttccatgtaagccatcaatatgacaacagttgggaggcactgctgtgaaaaacagaacactgactaactcactccccaaaatgcaggagtgttcctaggagtatttctagaaggtccttcatttccctttttccctacatccacttcatcagtaagacctgtcagttctaccatgaaaatatatctccaatccatctacttcttccatctccactgcaaccaccttctataaacaccatcatctcttacagggactgcttcaataacccactaactggcccccttgcttctgctcttgtccctggacaatccattctccagttcttcataaaatgtacatcagatgatgacagctggacctccttcccaggcctgtaacatctgcaaacgatctggcccttgcttcctccccagcctcacctcacatctgctccttctctttcttcccttcagctgcagtggccttccttctcgtcctttctatgtctctcttttctagctacctgaaactctgtctccaatttttcacagttctcagctccaactaaattagtcacccatgccacccataaccaacctcaattacatctctgttcttattttccctcacatcactatctgaaatcatcagattcatacatgtttattttatgtctctcccatctcacctctcccctacacacacacacacacacacacacacacacacacacacacacacacacacacgataatataaactatatgagggcagggagcttatcttttcactgatatgtctccagcccctgggcttgtgttgaccgcatcacagacaatcagtaaatatctgtgtaaaaaaaaggaatgcaatttcttcacttaaaaactcaccattcacctagatttaggaaataaaaatacaagacacccagttaaatgtgcatttcaaataaacaacaaaaatttcagtaatacgggtagctgggacatgccatatttggaacacatttatactaaaaaagtattcattgtttatctgaaattcaaattccactgggcatcctgtgttttatctggcaatgctaggcatgcagaataccaaaagtaagcaccaggcaggccagagtcccaccatgagcatcttcagggcccctggatgtggaagagggatgttgagggcccaggggctgccttgccggtgcattggctgcccaggcctgcactgccgcctgccggcaggggtccagtccacgagacccagctccctgctggcggaagtccatttcagagcttccggttctcccaagtccaaggattatgctcactccccacccacagtctcttagtgtctgtccctgctctaaagatgttgtctgggcttgatattaatatgagagctgactgttcccttcctgatctagaccataaccatcttcaagttaaattgctcctcctcttctaactgcccaacctcacccacgtctgaccatacccaagcacagagaagtgggtttaatggaccttcacacagaaggacacatcctctcctataatgctttacatggaaggttcagacataacctgagtcctgcttggggtagcatcatcatgactctcttgccctggtgtccttgcaatattccttgaaaggcatccctcccccaaggaagggcaggcactgagcacagcaatgcagtataatggctaagagtgggatcccggagccagcctgcttgggttcacatcagctccggcttttaccagttgtgtgaccttaagcatgccctaactctccaagtctcaattgctccatctgcaaaatggagatagtaatagcttttctcacaggactattggaaaatttagtgaggtcacacatgcaatacacccagcagataaatgatctatgaatgtcaggtattgctgttgcatatttaatttaaatgttgccatttttattaaatagacatatgaatagagttcctaagagtgttactctcatcaatgctgctcagggaaaagatgctgagtaaatctaaattttaaagttgcaaaatctagcaaaagattgttgatatgttgtatcaatcaatggttaaaaaaaaaagactgacatctttaatttgctttcagtgctgcaagcatgtcctagagctccgtgatcccctgagacctgtgatcctctgagacatgagccagctgtgctctccccaagtccctaagagcattaggagcatgagaagtgagcattccagccccttgttcttatgtcttccaaacattgtaacaggcttgttcatgagaggccacaatgcatgatcaagtgaccccaccactgaggaataggagaaagcctcaagattcagtggcccactaaggacgtattgccctaagtttctccaacccatcttcctattggcatctggagactatgcctcttcccaaggtgctgagggtgctgcagaccccacttgccctgcaggccccacccgcccaccagcgaagaagggctgcctttcattagcccaaaactgccactcaagaggggtcctcagacaaggtgggagccaagagatttggcgaacgtcacccttgtcccacagcttggatcttgatcactcatatcactcagaagagggacttttctctcttgtttcctttgaggtgggcggctttgtttttgacattgtagcgccctctgctgctactaattatcgcatctccataaataggtcatactggaggttgatagaaaatagatcagggaaggaaaacattctttgttcacaattcaagtcaaagctgctgcttctgtctccattcccttttcaactctgagactggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccgctggagcagcctgtagcaagaacagtcttggtccaaccaggtcagtgatactttttatgatggggctgtgtgggacctgacctgactcttgctaaccagatttctaaagccatctgcagggtcttttctcctattattccccagggcagggagggcaaacagattatatctccattatcaagagctaacaattggtagagactatgcggagcatgctggtaagaaagattctgaggccacatctatactcagaggaagagagtgatgtgtttattagcaatatttaccaagggagcagaagcaggaggcaaccccacaccattttgtatttcccattcctgctctcgatgtcattccctgaaatgagtcctgcagagaaagaataatcagagccaattctccattggattgtccttttggtaaagggcaaatttttccatttctgtcttttccatggaccatttcccctgctatcaattgctgttgcctgcagcctaagaaataaaatttttaaataaatgagaacgttctataattctctctaaaatcataaacaatgtgtcaaggccaaacacttccctggtgtgatttattcctatgtggactcatccttgtataattagcaggaataatcacaccctgagccagctggcagagcccctggggacagagaccacccaaagaaggtccttgttctcctgagtcacataaagggagtcacacaaggcgggagtggaactcaggtgtccggagttctagtcccagctctgcttctacctatctacatgaccttgagcaaatttatcccgcagagcttcagcattttcatctctaaaatgagggcattggcccaggcagctgttaaatttccttccaagtctcacattctaggatgctaatgtgtaaaattatagaactgacccaagagttattagttcatatccccctgtgcatgttgcttgaactcctcattgcccagcaggaggaaaagggaaaacatgtttcttcattggggggtagcataatttcctggttgactatgtgtgactcatcagagcctggcggtccaagcccatatgccatttgaaatccggttattattacatctgggagagagaaaagtgctgaaaacagcctttgggacactatcgatttggccaaaaaaaaaagaagaagaagaagaaggctctgtctagtgtgataacattttgttatcttattcattgtcttcatccctgaaatacactctgctctctcctatctctgctctgaaaggcagaaagagggcagccctctccaaggcaaaatggggctcctgtggggaacagaggggtgcctctgtcaacaaaggtgatgccacatccctttcaaccatgctgacacctctggtttttgtaaaggtgcccactcctgtgggtaccgggttaataggaaactgacatttggagccaacactagaggaatcatgaaactcagcaagtaatatttggcagaatttttttttctatctgaaaattatcagtgagagattctaatgtgccttaacaaacaggaacaaaagatgagtgtttaatacaattcaatttaacaaatatttattaagagcctacagttattcccatggatcatctgagtcagtttccgaggaaacattatcgttgccttaagggagctggggggttgtcaacgggccagaggtgggatgaaaaatgacaacagatttacctctgggaccgggacatggttaaccacagcggccctgggtaagtagcttagcttcagaagaaaatgtgcccaacagcatgggtaacctaaaacaccgggcaatccaaatattcttttatgattggctttagcatgtattttattcttttgtagggcaggtttatctcaccaattatatattttcttaactgacctgtaaaatctacaggggaaaagtattttaagaattatatgtttctgcaattaggctcccagcagtcaacaaagaagtggtactttttgtctttccagtgatgaaaaagggaacctggcatccctggtggcccaccagcgtctccttccctggcctaggtcagaacaagccgtaaatcagcaggccgttatcttcttataaatctgtagagcagggtggacaacaaaaggcagcctgctaggttttcagaacatgagttccttgtgtagccagagaacctgggaccatcctgacgtggctggtcctgctgtcctcacagcctgaatcccaggctgtatgaataggagaggttcaagtccagatgactgttcacgatgctggtcccccttgcatccctaatcatgctagagacatgaccagggtctgagaggaggaagttacagcacagcaccaacaggggcttttggtaaagggcctgggcactatgtgaagatcacctagatgctcaactttgggaaggggactgagttaattgtgagcctgggtgagtacctcaactccagaggtagctttagcggaacccctctatacctaacacctggcaatcagagggctgaaacacttggccagataatgaattctcttatccggtgggaaaaggctgtaaagatcaaaccacctttcctatgggtaagcaagagtctgtagtttatgtaaaggcagcagctcctgtgggaaggaaggaaacaggaaatttacatttggaatggggacgcaagtgagagtgaagctatctttaaaccaaaggtgtcaggttatttggtttggtttttgaattatctggaagttccaaagaaagaacacttctccctgaggatttgattgcaaaattctgacttcaaacttctaaaaagatcaaatgttaaatcagatagtaggcttggaaaactctatttctctatgtaaaaagtagagaactacttttcttttgtttgatcattttattttgtttaggaaataagaggattagataccctggtggtgagtggggagggcagggacatttgcacagcatttctggataaattagatccaaataatcaaatcaaagactctcagctcagaaagtaattaaagatctcctcacccacctctttaattttgcaaatgaagacagtgaaactcagagaggttatgaacttgctcaaggtcacacaactgatcctgatatcaaggtccagggcaaagccaagacagctcatagttctcaccagcccagacccaagggagaaaaaaacatcatagtccttggccacggcagcatcatttgcatcccaaacattctttacccaagacttaatgaactcaaaaagaaatcctgagttccaaagggaaataaaatcattctgcgtctgttgaaaaaaaaagcaagctaaagtggaacaataattgaacttgatattaggggaaaggtgcagccatctgcagactgagagaagggtgaaaaaaacaaaatgaaaatgctagtcttgtgttcagacaatgattatgaccatagaacactacctataagttctgtagagctaatttctttcccagtgggttgatattctatgatagattgcatcagcggtgtgattgttttggaccatagaatacgtatacagaattggcttgttgagccttctggtgtcttgaagtgaaaatcatatctctggacatatctgtcaggcctgaagccctaggctactggaaagaaagataccatgacttatccttcctctaaagcttagaagttggagaaaaattctagttcttgggaagctctgcaaagcagggttcgttaagctgatgccacaggtttttgcaaagcccctcagcacagtgtttaagaaaccagtggctctaggttgacctttggggaaggaacacagctcacagtgaatcctggtaagtggaggggagcattgaatcctctgcctgaatgtatccattttatgccaatgaattgagatatggcttcttgccccatctctgccacattcaagtcctgcttggctaaacaatgctcacggatgtgcacgtgtgcagtgggatgcagctttttctaacctctcacaaaatcacgcaaccccttcaccaaactgcttggtggctcttctgtgccctcacagcccttctagtttagcagttagaggaagacaagtgcccaagggctttctcatttttaggtcattgtggaaagaggaacgttggtgatatgtttgcctgcttgggaggaaaataataatgatgatttactcattggtttctatatgctagttgatgtgctgcattctttctcttatcacatttaatccttataccaggtctgtgagttaggtgctattattatcctcattttatagaagagatatatttatattttatatttctatagaagcacagagatgttgaataacttgttcaagccgatgaagtaagaaagagaacctggagtttaattcttggcactcagattccagagctaaaagcttttcagtgaggggattatgtctagagggaatgtccctgatgctctagtctctaaggttgctaagataatcgctaaagaactgcgctctcagcaagtaaagccaggggttggtcaacaggaccacggtgacccagttacatattcttaatccttacaacatcatcaagcagttgctgttttccccactttacaagtgaggaaactgaggtgtagcaagttaggaaacttgtcctgagttttaaactcaagcctacctgccccaaagcctgagctcttttaaattaactgcaactgctgaccagttagattaactaattacttaattaataagataacaacctaacaggctgtaaggtaaaaaagtaatcagatttgttctataggtcccctcccttttcgggaatagctatacaattgtataattttatgcttcccctgggagagtgggtggagccctggctcccagcccgtgatggaagggtcttggcagtatttgtaaagcagtctgtgggggtgtaactcagggcggatctgaaaagctggtctttggaaagggaacgaaactgacagtaaacccatgtaagtctgaataatgcttccaaatttctccctggaaccctgatttccaaattttccattctgttttataacccaggtccaaaccacagcagtcccattaatggattccagtgcaaaacaactgctggtgtattcctactacacgcaggtctctgttgtttgccctcatgtgctattttatctaatagctgagaatgacagtaccaatggagcactgagttaaggagtcagactgttcgaaggcttcattcttcgttataattggtgagattttccatgggactaagagaaaattgattaactctctgagcctctattttcctcctctgtagaatgggggaggcagttcctgttcccattttaccacagccggcgtgctgtgaggggatgttggtacatttccaataaggggacaatgagtgtgaagagaaaggaaggccccaggtggtccgtaaactcttccaccagtcccacactataaacagctggttttatcagggggattcttggatgacaagtaagcacttaagtaaatatcaaggggagtttgggcaactgagtttttgtagatcctcgtgtcattgtgttatactggagccaatagtaagctgacatttggaaaaggaataactctgagtgttagaccaggtatgttttaatgaatgttatttgtttccaaacataagccaccatccttagaaattcagtgaaagataaccgaatctcctgcccagttattagcatctttcaccatgggtctttctggagaaaatgacaatgtgggcagcccctgactgcagcccctttgggactgtttctttaacacctttaagtacttgggaatgttcagtgtgtttttgttaatgttggagatatgtgtctgacaaatggaatctgaattgaagttttagtgtgtaggggcagaaagcatttagaaaggacaaaagaaggacagattagactaaaatacataccaatggctgggagtatgcaatgcaacccaatccaaaaggaaacagtgagatgtagcctgctgattaaacaactgagccagcactccgtgtcagctgacttgtcttcccaaagcttccatgttggtgcaattaggaaaagaattgtctaatccccataactcaaaatcttggagccaagctaaattgggtaaagccgtgtaagattttctggtactgacactgactacaagctgatatttagggaaaagttaagattgaaagcaaatattcaaattagtcagaaagaccacgaacttctgaaaacaagccccagggtgctgttaactgctgcatttctaattgggtcctcatggaacattttcatctctgccttgtctgagctttctgcaccagagaagccccttttgatacccactcacttctgagtccctcattgaaaaggtggcaactaagcttagagaaggattccctaatccaaatgcaatacttgggggaatattttgagtattgctccaccattctcaaaacaaacctaatttcagttaacttgaatgtagctgaaattttgttccatgagggaatctctgctttctatgataatgcaagctcatttcaaacaattgtttgggatttaacttttgctcataattcccaaaagataccaactattcaatgagtatcttaaaataaaactacttttatgaccaaattattatccccattagaatggctagaatcagaatgtcctagtatgtattatgtgaaccccatgcgaccttcctaaagtttcttatgcctaaaacagcataagagagaaaagcatttccacgctaacctgtgtgttcactggttaacaaaggtctaaagagcaggtgagtcagctgctccatttccaaactggactggacatttacagtcctgcagatactaaaaatgataatcaggaaaagcacacacaattctactttttcttataattcccatctttcccaaagaactgttataaattctctcccaaaggtgttatattcatccttcttttgttgcctctatttgtgatgtgtactgaggtgaaatatttgttgagattcaaaaaccccatgagatttaacttaagctttccctgtcagagagattctaagagctaaaagatgggaagctggtatttgggaactagattaaaaagaaaatccaaattaatcccaaggagcaaggctcaatagatagttatttagacataacatgtccaccctgcaagcctagttgctcagttgactgggctgcccctatcttagtcttgcctggaagagaaataagttgtttgccccatacctgtcttgagaaatgtcagcctccagacctgaaagcttcttgtgatttggtttatttctgtagagtttattattatacacagtgttcttgaagtaatagagaagtgcattagaagctcctgcaaatggaaatgaaatgtaaatttagattgtaaatacatgactgcggtaaatagatagcaagaaaaaggatgaagagattagaaatttgccacatttctctaaccctaaagggatgtttctataaatagtttaaaactgtagaagacgaagggggaggaggaaggagaacagaggcaaacagattttctcctaatcctttccatttggcaaaattagaaatggtttttcaattaaatttccctgagcagaggaagaaaccatgtctgtttccacactaaaattcctgtgggtgggagtctctagagttgatttggaggatggatccctgttagtgacaagtgctggtaatgctcctgttggggaaaggggatgagtacaaaaataaatccaagtaagtgtggagggacaagaagatctcacagtgcaggatttcccctggattttctgcattgccttttcacctttcctgtcttagcacgacaaattaggtcccagatgagcaggccctcgcattcaaaccggaaattttaaggaggaagccagattaactttactcgggagacctagtagactctgactttaaagattcttttaatccagctgtttttagggagagctctgtaaaagatgaaagaaatgttttaaaaaaaaattaaaattctgtggggtgaaaacaaagatgttaaatatttgattggcaaggcaactggaaaatctggaccatgtctacaactgctaaaggaggctttgtgaaagagaaaatgagcagcccaaggagatcctgtcctaaacttctctggccagtgaaattcgggccattctctgccacagccctggactgctaggagggcagatcatatgtcttcctcagtggggagaggtgggccctcgctggcagtttctgtaaagcctcgtgctgtggtgtaattcagggagcccagaagctggtatttggccaaggaaccaggctgactatcaacccaagtaagtatgacagggtgaagctacatgcagctgagtacagtcttttcctttctagaccgtgtcctgcaagctctccttgagggacgtatactcattttgcattgtcctttgtagagaagcagaccaggaaagacaggaaagccctcaaatttccacttttaaacacctccctgtaaaaactgtctcgcttccctccccttctacaatcagtttctagtaaatcagaatccggtgaattgatatgcaatttcaacgaaaaaaaaagcagagaaatagttaccccaacaagtgcaaaaagtagaaactatctgagtaccagccaagggaagataattaggaaagaaaaaaaaagaaagaaatggattactggaaccatgatggcagcttagtcacaaagaaaatgataaaaaaaaattaaaattaaatttcaaaaactttaaagatatatacatatatatatatctatatatatatgatatattgtcctctggaactccagcactcacctacagcagctgcattctggacttattatcaaataacctataaacctgtagcttaatgaagagttgagcaatcgtgactatattgacccccaggacccttctgcaaagagcagcttctgttcctgtttctgtaaagccttctgtggctgtgagaatagtggaggtagcaactataaactgacatttggaaaaggaactctcttaaccgtgaatccaagtaagtttgaagggagtgggggaaggggggattcaaacacttctgatttaattacttgcccctccaaaacattccagcttaggttccaaatctaatgtttgtgctggggggatatggtgcccatcagagggattagaactccactgtacaaagactaaattactttcagcccaaaacattcctatcattcatcttaaacaagattattggtgcaaggagaaaaactgaatacagaatcctgagggatccagctaagggtcaggaaatgtttgccgaaaagataaagaggaaattggcatatcgtgactacgcaaatgcagtagaccaaatataaattgtcctgacttagatactaacactcctcttaaatttatcgcctgaaataatggaaccctgcaacttcattaactaatgctgaaaattctataagcaggctccttttcttcttttaccttcactttacctctctgaaaagaactgttctcaatccccagtctggtaactgaggtccagtcagttaactgtctggttaactcaggcagagcatttaaccccactttttccttggttaccaaaatagtggattcagcctccactttacttagttcacctgagaaggggaaaattcatctgtcctctgagtcgtgagaatagagcagtacattctctccttcaaatatacacccacccttccctaatggtaatgtgtgagtacttagaaaagtttttaaatgttagatataaaagtaaggcacagtggttgctaatggcacttcttgaaaatctgcgctgctggtggacttctgaaagtggtgcttataaactaaggctggagaagactgacttgtaaaattcagataaaatgaaaatgggaaaaacttatcaaagggccccggtctcctaagtgccctgatgttgagtaaaggccaaatgccccagttttacttactcagatctgctttctgtgattaagaagagatgcacactagagagaggcactttgaaaaacacagcccaggcaaaattcttaaaaagactggctctggtggcggggcgggtggtgaaggactcagggacaccgtgcatgcagcattgagggagttaatgcagacttgctagcagacagcttggaacgttctgggataggccctgcctgaagaacatgcagtgtggttagccatcaagttcccatgtgcagaagtgccttgctcagcaggggcaaaatcagcacgtctgtggcaacagcaacaatgaataatatatgatgttaaatcccaggggttccgcagtctccactgaggtcttatcaaattaaagcttcaaggggattcatatgaacatcccaggagactcaaggactcagtcgcttttcagagggtgggcagccaatgctagggaccagacagtaggcttttttctttggtttcttaccggaagcacactagggcggggctctgcagtgggttttccagaatgcagagaagctgggagcccctctcagcacttggtcagcctcttaggggactgagaactgtaacaactcctaccctttaaaacattgacgaggtcagggtgtttgacagcctaaccaggcaaagaaaatatctgtgcaaggctagcattcttccagagctctggacagtaatcgtatgccagattttccatgcagtggactctagctgcaggaactatatggcaaggctggagtccaaggaacccatgattaaattctgttttcctgcagtaagtggaacacagagattattgccacagcaacactttgggtgcctgtctgtttgagggcctcagctgagggcaggcatctggttttgcttatgtcctgcggaggctgaagagagggtgggaagccctttagacagtgaatactgtgaaatagtgaagagatgggaagggtcgtttgaatccctgactgctgtccttaaaaaaaatggatacgtcttcttagctaaataatagcctttttctctcacccttttcatgatagtaagcaagctaaaactttaaccctttgtaacaagtggttgcttgaagacatgactaaacaggctagcataaattcagcccaaaaaaagtctgagttaagaaaactaaattctattaaagaggtgtctgtttttcacacccctggggacagggtttgatcatcaccacatcatgaaactgcctggattttgctcttcacattttttgtgacatccagacacagccagggtgactcccaggattcctgtggttgtgtctgttggcaacagaagcattatttggtcaagggatgaaatttacaggaaccccaagtaaatgtgcaaaagcctgcccctaatagagacctcacttaaccctaccactgtggtcaccgggctgctctgtgaggtcagaacacctcaggtgagactgtggagtaaccagatgccctggttttcctgggtttcaggggttttccaggacaaaggtcattctttgctaagcccagaatgatccccaggatagttaatcaccgtaagaaggcacagataaaaacttttttctgtgagctactacttacatttcaccaaattcaagactgacaaaaaaactacgttgtgtgaaagctcagttacatgtgcccatcatttttatttcttatgctagggcatgaagggaagctcaggagatcctgtttcatgaggctacagtctaaatctcatctaattctagtcagtctccaaaaagctgaacactctcctcttgtctccttgtaatcaattcattgtcatcagaaatgtgtgacacctcgaggggaggggaggacgtgtcttgaaaactgatcagagaaattgtcctgaaaatgatgctgtaaaatggaaatgagacctttagaaagagagatgctgaacatgagaaatcagtaagcctcaagacaaaaaccagaggaaatggagagagatgggaggcaggaagccggacctcgggggacgcagcaggtcagtgtcccaggaccagaggtggaaatggtcttccagcctttggtgggatgaaactgagcctcacagacccaggcccctttgggtgagtttattctccccagaattaaaagaggaggaagtctgcgagcttcagaagtccccctagggttcttgtaaaggcctccagtgcagtgctaatgctggtggtactagctatggaaagctgacatttggacaagggaccatcttgactgtccatccaagtaagtgtaacaagacacagcagtatactggaaattctggaatgtcaccccagtgtcaggttttaaagaaccagatattgcttaaagttaagtggtgtcctctgaggtcctttctcttctttaacctcaatattcacagattttcttttggaccctgagttgttaggtctgtctccctgctgcgtgtacagctgaccttgaccctggaaagtcagaatctttcctgctttcagtgtcttctctggaggtgatgccctaacttttttgagggggaggtcatcctttccaaatgactcccctgagtaacctgttctaatgtttagtagcattccctgtcagaagtccttccttacctcaatcttaaattattcttggtatagccgaggccgtttccaccagcatcatccacaataaagaggaaaattgagagcggagtttgaataggtatgtggtatttggttcagaatgggttttaaatgaaagtggagagggaaaaaatgaaacctgaatgggaatctgaggtcttatttcaaatccctctctgtttcctgtctgtcatctccttttgcttctatagatgcaaaactacagagagagaggcggggagagaaaggatagacagaaataaacatccactgtgtccattccctgtcactgaaaccaccaggcaagggattacaattaattccaaagagtttcagatacacggcttaatacctttctccttgtggtgacttgtatcctggctgataattagagcagatagaaagatttggctttggtgtgtttgccgctgcaccccgctgggaagagacagaaacttgactgttttttaagattcataaagttccttctgtcagtcgtcgtaaaactccctgaagcagggagatgcgtgacagctatgagaagctgatatttggaaaggagacatgactaactgtgaagccaagcaagctggaaagacctaaactcacagtgttccttatgtacttttgctcccttccccgtttcaggccttttggctgtttcctgtagggattctaagagagtcaaatggaaatggattgaagagagtctgaagccccgtgggtgctcagaaatgataaatgaaaggaataagagacagaaagggaaacaaagttgaaaagcaggaatatgtctttcactgcagcttgataagactgagatgtgaggtgggtgtcagagaagggcatgatcgctccagctgctattgcagaacactctgttttcctaggatctctatcaagggcagtgtcctcttatgccaaagggatgagtcaagtccctatatttctggagtagctgcccttgtgcaggcatagttggtcaggcagacagcacaatcccagctcagtgtgtatggaggaggccacctgacattgccagctgtatctgctccattcagtggcagcataaatccataccaggtgggtgtggatttggaatatgccagtgccactacaaggctgaatgttgagttgttgtgatcatcttgaatgtgtgagatgcctccaagtgaagtctggttctaatgagcagggtgcaggttggaccaatattgcccattttctgttgagtttctccaagcccagtagtgtgggagccaacattgagagactgacatttgagctagggatcctattgactgaaatatgccaaagggatctgaaaggtcaaaactgccttcagagctcagcctttgttgttatctctctggcagttgtcatttcagcaaaatgcatccacttagaaagctcagctcttcattaggcagacaaatgagaacaacatattgaccagagataaggagttgggagcccagatctcagcctctgagagcctggcatttccagttctttaatcacgtgagccagtgagcatatgctatctcagagaaagcagatcaatggtgcctgaggacctggtgtcaccaagctagggcttagagacagaaatgagatgcagatggggatgttgtgtgaattggggaataatagagaagtgaggaggagacagggagttcaatgatgctttttaaaaccagcagcatgtgagaaattgtaatgacacaaaggtgaagaagtatgtattgcatataatcctagcaagtttcctaccattcccaacagaatctagcctcactgtggctccaactcacagatcctataggtaatgctgaatcgtacctgagatgccttttgaagtggcatcaagactgggctctaaaatctttaagagtcacctgtcagttattgtaaaggtttggatggctgtgtgaaaacctcctacgacaaggtgatatttgggccagggacaagcttatcagtcattccaagtaagtgtccctggggtgctgcctgtggagtgcgctggggctaacagtctcatacattagggcttaaatgactgtgcagatggcatcgtggttgaggacacaaaactgagagaatcgagatacattgactctgatcagaaaaaaaggtcacggaatagcaaacataggtttagtccttaaaaggtagcatagataacatgggacttgaacgtggcaatttgaaaaacaacctgtggtctatcagcacgttctcactgcacacgggggataaacaggggtgggggaataagcaatggacattgcatgataggggtgctagggaaatgaggcaggtcaggaagaaggaaggtgatcagagcctcatacggagttaatctagagaagatgaattgttccataagtttcacaaagaaataaagtccaaagatataataagaagtcctgattaaaatccacttcagaatcatatgatcatcaggagagaaattaagtcttaaaagaaaaagaagtttttaaatgtaggtccataaaacaaatggacctacacctttaattagacagcaagcagcacaagatgcacgttagccttccttttaatcccctctcaggaggaatcagtctctccagctgcacatggtcacagctgctctaagccctggagctccttcccagtaatacccttgctcctgtgcctgcacagggaaaggagatgcctgcctgcctgcctgcctgcctgcctaccggtctgccttttggtccgccgcttggtggggccccaggtgtaacctctggctgtctcttctgcctggtttttgttgagcttcctatcacagtggaacaccggtaaccagttctattttgggacagggacaagtttgacggtcattccaagtaagtcaaagaaaattttccatcaccattgtgttgagcaaaccctttaaactgcagaaagagctgtcaaagtctgctactctatttctctgcttctaggtataactttatctggaccagagtaaagaggcccccgacccaccccgagaatgatttatgcttggacaggtctttatttcattccttgaactatctatctgtctatctatctatccagctatctatgtatctatctatctatcatctatctcagaaatagttgtttttaacagttgattctgtgcctcacccaaattgtcattaactaaatgcagatgtgctgccacactgataaacttcattggaaaaaaagaaaaaaccaaacccagagaatgttccttgaacattcctgaagtgggggggcaggcgatgtcacttgcagtgacagctggcctctctagctcacccccacatctgtgccaaccagagaagctgggccctttgtagcacaagcctcaggagcagagaatggagggacattctcaactgagaggagagggactaggaggctagatgggaaatgaggtgactctacagaaaatcgaatatgggatggtataaaaggatgagaaagatggcagggggtccacgatcgctcttgtatttagacctgggggatgcactgatagataccacctggagagagaaagaggatttctgtttccctctgaagaaaaatgtggcagaaaaatcaaaacagatcgcacatgtcaagcctctcctaattacagcctttcattctggtttctctcagctgttccagcaggaaatggtaggaaagggtcattggtgcctttgatgttgtggaagcattgcaggaaggagatttgcaagaaacggggcaggggcttgcagtagagtctggagagtttagaatgatggtttttgcaatgacttagaacactgtgtatctaactttggaaatgagaaattaacctttgggactggaacaagactcaccatcatacccagtaagttcttcatccttggtcaggaaatcagcctgcataagattctggggatcatagtagacatgcaggcttagagaattttcatctgtccttgttcataactggtagagacaggtggcagccaaatatctgagttttccgggggaactccagtcctgactatttaattcaaaactagaaaatatgattcacaattctgtttttgctgctgccgtcaagtgctaatgtggcatgtgaagagaattcaggcagaatgactgcatcttcactttcatcttgtgtgataattttagctttgagtactgcaagtgtttgggagaaatggtagaaacatagaatatcaaagagacaagcaaaccaagagacccagagaggcaggcagacggaacgtcaggcagtataattttacaaaactaattcagtgttgtgtctctctctgcaaatggcaaggtatcgggaaaggtgctaagagctagtgctccgggtggggcaggattatctaaatagaaaactaagcactgatctcagggggaaagtttaaacttggaaatctctgggtttggttttttgtttttttccaatgaagtttatcagtgtggcagcacatctgcatttaattaatgacaatttgggtgaggcacagaattaactgttaaaaacaactatttctatgcagccataaaaaatgatgagttcatgtcctttgtagggacatggatgaaactagaaatcatcattctcagtaaactatcgcaagaacaaaaaaccaaacaccgcatattctcactcataggtgggaattgaacaatgagatcacatggacacaggaaggggaacatcacactctggggactgttgcggggtggggggagtggggagggatagcattgggagatatacctaatgctaaatgacgagttagtgggtgcagcacaccagcatggcacatgtatacatatgtaactaacctgcacaatgtgcataagtaccctaaaacttaaagtataataataaaaaaaaacaactatttctgagatagataaatgatagagagagggagatactggatatatatacacagttaatgacaatttgggtgaggcacggaattaactgttaaaaacaacatttctgagatagagagaaagagagagatactggatatatatacacagggtagaagaatgtagagagaaacatgggcaaatatattcttttgcacctacaattaaaagctgtggaaaatttgaatatgttcactttgtaaccaaagacaaccacacaaaatggaacggaaagcatgcttgcaacagcgagaactggaagtatggaacctttctgtcttaaccactcagttgcctagaagaatcttttttctattttgctgcattagaaattaaaggcatgagtattgaggatttgggtaggtcagacttttatagtgacaatcacattacaaagcacctcttagctaggttggataaagcacctttaaacatcaaagtctttttcttctttctggatgagatagaaaaatggtctctcctcactctgtatctaaggacagggggctcagagagttccagacttacaaagtgagactgcagcagagctgagccatgggacctggagggacccagtgacggttagtctgctccctcccacgggtgctatagtagccacaaccgttcaggaaaccgtccccaggtgagaacgtaacacacgcagggaaaatcccactgctactaagagcaactcagcataagaatgcattacccagcaagggacagtcagaggggctctaaaccagagccccaaatatttgaaaactttatgtggaagccagctataacaagttcgttttccaagccgtgcttccagaagctgttagtggttggtagttgctaagggttttgaaactggaggacatcatagcagagtggaattatttggcacaaggggctatgattagaattaatgagatgaaagaaaattctggctagaagactagaaaaatccggaaagaaaagatacagtaaaccttgggggagttgtagcatttatcctagtccaagcagcaaagagcagacagaagccaaattccaataaacaattggcctttttacttttacaagtttctgcaattatcacaatgtcttcagcttcttgggcaaatatcaacaggtcctaaatgcaaagtggaacagtcctctgtttccagaaccgagtagcttagccccgccccacacaccacccatgctcaaccactgtttttgtagaggagtttgacgctgtgtggaatatggaaacaaactggtctttggcgcaggaaccattctgagagtcaagtcctgtgagtataaaacacactcaagtcccaacctgggtttcattgcatattaaataaactttttctggctgggaagtatttgattctaaagaaaggaaaagtgaaattccaagcgcaacgcaagcatttcattagtgtgattcattaagaatttccatgggttgccttcgagagcgttaatcacatccattcactggtgagacccacagtttgaaaattgagttaaatttgaaaaaaaattgtcaccatctctgtagaccacagtgcttgctgtttgggtgtctagacttccaaaatggaacctcaatctgtagtttcgagcttggagatttatcccgagcccgtgacttagagatgtgtaagaaaagctgcacactgctgggccttgtagggcatttgtgggatcagtgtcatgaaatagcctgggtagacaggttggtgaggagacactggtgacaggtgtctgccctgtttctgtaaagctgctgacagccgtgagaagaaaagcagcggagacaagctgacttttgggaccgggactcgtttagcagttaggcccagtaagtctgagcagaaagtaagatatttatgccttttcctattatttgttctagcctgacatttgagttgtcctcctttggattccagatcaacaaaccatagtgtcttttcatactccttttaatatttgtggctaagggccctccgttcttcccatctgtcctacatgagggtcctgtggccaggtccacattcataaagaagccaacagtgatgcagttggttggcagtgtgtcaagaaactgcagtcatcatctccagggcccttactctggttatgtgtgtttcaagcttttatgccagcaacagaggagagggagaagtgaccagtagcaatgaccagggctattagctgtacctggtgtctgtgggtttcagagcagctgtggaggttacgggaggttcagggcatgagtttttctggcagaggagtttatgtaaagggttggcccagagtgtgtattcaggaggaggtgctgacggactcacctttggcaaagggactcatctaatcatccagccctgtaagtgcttttgcctgggaggtggggttcaaaatgcagtcctcatggggacatttctaaaccttggctcatgtgcttctggtgccactaccatttttggcactatcctacttacatgggaggttttgagccatgtagacaaggaggtgatgcagtttgtgctttggaggactcctgagatctgccctttggcaactgtgtttgagtaggagtccctcattggaaaatctggatgccagcagacaaaagatatgagcttaggatgggtcacaaacaaatggaggccactttgccagcagcacctttgcaacgaaaattgctttcataggaaatgtggaaatggctgtgtagatagagatttggccatttctccttttctgtctttataccctcttctctgcctgacttagggaccttaaattagagcagttattaatcatttgatttctcggccccatcactcatcaagtatgacaagagggattcattaagataaaacccagaaacagaaaggacaaagaattcaattctcaatgtcttcagagttgaacttgacaactcctcagccttaaccatctagtcagcaccccatgaccaactgaggtcaaagagggcaaccagcaggtaatgttagtcaagtgagtatctggccagagccagctgccctcataggaattaatactgtggagtttgggaaagggaaatgcatctgtgagggctcacccaggctgcccatctgggagagatcatggggagagttctgagtgagggagtgaacaccagatggaaagtcaagcaacaggtttctgttatgaagcatctcacagtgtaaataccggcactgccagtaaactcacctttgggactggaacaagacttcaggtcacgctcggtaggtaacagaaaccgtgaggtaacttaactgtgtgttcctttaaaacaggggatactgcagaggggatatcctggctggatgtagtccttccttccttccagtgggaggtgatctcactgaggacacatacctgcattcagtcagttcttgtgctatttttatacctgttacggaggctttcctttccacctgtgaaaacagaacctctctgctccaagcttcttcagtctttattaccctatgtatttcctttagaacagtggtttgggaattaatttatcatcaggactttgtctctgatgatatcactctgggcaacaaaatgaaagggctctcaaatagagaacagagagtcctgaatactcggataacttctccagagtgatatgtgttatgcgtaatgggatgaagtgggctagaatgaccttccaatgactgttttggagacacactaaggaaacttgcttaacatcctatatccttaacttgttagaacattggtgaagtaaagcaaaatcttgaccctctaagaacataaacaaatgccaactcctctcccccaaagcactgccatgtttcattatgtgcaattatgaaacaaatacatgataatttatatgaaattacatagatgagtagtttgagtattttgacccatgagtaagatgcaaattgtagaagttctcaggtagttcttcataaaaagttgtccctgaagacaaatagtgtacctgggcataatttgtttgcagtgttggtttatgcaccatttgggacctgtttgaaagctgattatgtcccagtgtgccaatttggggtctcaattaactgtgctcagtgccatgataagtgcccatatttacagtctagaagcatgacaaaatgaccccatttctgtaggaaaaggagaatggaactgtgtgtggcgtggtacttgtcagtgctgctcccccttgtccctgccatgctggaggtggctgcaagttttccccaggaggtttttgttagagcatgtattactgtgacaataacaatgacatgcgctttggagcagggaccagactgacagtaaaaccaagtaagttgggggaatgggtcaatcttaaaagctgacctgagtgagcaatggtgctgttctgggcagtttctgtggggttaagacactgccactcccaagaggatctaagtacctggtttctttgtgcctgagaccctgagctggttggaagtctgttagttgatgaattcctggcaatcttaaggattaggtcaacgaagaagtagaaaatttcactggtttcttcattggcttggctctggatatataaaaatgctaaatataagccgggtgcggtagctcactcctgtaatcccagcactttgggaggccgaggcgggaagatcatgaggtcaagagatgcagaccatcctggccaacatggtgaaaccccatctctactaaaaatacaaaaaattagctgggcatggtggcatgcgccggtagtcccagctactcaggaggctgaggcaggagaatcgcttgaacccggaaggcggaggttgccgtgggccgagatcgtgccactgcactccagcctggcgacagagcgagactacatctcaaaaaaagaaagaaaaagaaatatggctgagaaagtggcatggtgctcctggtccctaaagtagcccctgggacctcaatgttgacctcctgtgctgggtgggatgtttctgcccaaccttgctattgtgcctctggcacaagcattctgtcagaacccagtgtcctaggaacaaaacaggggatttacgatcaagttcagatctatctgcacagccagctgttaattttagagaactgtcctgaccttgcaaaggaactggaaacagaggctgcaaggtggggagacttccactagaggggaaggtgatctcacttgctcagccttcccctccatccttcccacctgttgattattgtaaagccccataggactgtgtgaattatggaggaagccaaggaaatctcatctttggaaaaggcactaaactctctgttaaaccaagtaagtgttggggattcaaagtcctgatttatcatcagtactttgtcactctgggcaacagaatgaaagggctctcaaatagagaacagagagtcctgaatactcagataacttttccagagtgatatgtgttatgtgtaatgggatgaagtgggctagaatgaccttccaatgactgttttggagacacactaaggaaacttgcttaacatcctatacccttaacttgttagaacattggtgaagtgaaaacaaaagcagtaagtgcaactaaagtgcaatgcagagtgagtgagaagagacttaccaactcctttctctgtgatatcttccccccaccttcacccttgaaccccacagaattgtttctgtccatgcccctggctgttcccagtccagaccagcacgtcgttctgctggacataggaaaactccagacttcataacatgtcacagggccccctccctcagatggcagatctcaatattgatcacccacatcactgtggggagtggtgaccttgtcagcaatggtctcatggaagagggaagctttatttacaccatcaagggcccatggatgacccacagtctgtgtgactgctgtgtgattggttttcagacattagctttaataggaatcataggagaagggacatggtggctactgcaaggggttttttgtttagggagaacgcactgtggaactcaaattccgggtatgcactcaacttcggcaaaggcacctcgctgttggtcacaccccgtgagtttttgtggtttactaattgtcctctctggaaagaaatccaatgggacctgttgaaacacagctgaatttaattgctatgcttagcatgcagttgttaactatgtctgatgtgtgagcaagatatgaatacatgtttccctggaggctggatttggttatcaggtctcggggcagtttgataaattgtactaatgctgcaatcactgtttttcaaaggtccacaaagcacgttatggctttgggaaaggcagagataagaagcaaagctttgtgatagagacagaaacaaggccatgaaaagggaagctaccaaagcaatggcatagccaaggaagtgtgtcctcaacagataagtggcaaggaccctgttgagttgatgcttgtgttgtctggtagaattaaaaaataagatgagtgggctgggcgcagtggctcatgcctgtaattctatcactttgggaggctgaggcaggtggatagcttgaggtcaagagttcaagaccagcctgatcaacataatgaaaccccatctctactaaaaatacaaaaattagccgggcgtggtggcgggcacctgtaattccagctacttgggaagctaaggcaagagaatcgcttgaacccgggagcagagattgcagtgagcctagatcgtggcactgcattccagcctgggtgatagagcgagactccgtctcaaaaacaaaaagaaagaaaaacagaaaaataaggcgagtggactgaggactccagtgaagggagggcagcaggagttccaagcttggcatggctttcttccctatcgagatagcagaacaatgtaactttctctagagagagaacagagcccttgatttatcacatcaatgcttctgtttaggtagcccccttcctcaccgtagggacaaagcaggcccccacatggacttcacccccttaactaggctggccaagccaaccctatgggagaggcagagaatcccaggactgcagagggcctccccatgtccactagattatctgtaataaaacagaatatttatccaagttgtgaagctgtgagggagagggtaatcgtgatagattataaaaagcaatattgaaaattatacaagctgtctccacacttgcagaattcagtgtgttttttgttgttattgggtttttttctgttagaattacagaaacaggggtgctttcctgcaggcaccctgtttgcaaaaatgtctgccatctcacatttcagtagtatttcatcaacaatcttctgcacacgaaccagctgtgacaataaggtaatggggctgatttgttaacaaatcgagtttatacatttcaatgagtggcctagtcaaaacactcagcttgaagcatccaacactgtccattgctttccccctccctgaaaccaccctcaaaggccaaaacactttctttttgtagcatccatgatggctttatcttttaaaggtggattttactcttgataatcaaaatcctttcagaaccaaggctattaaatagaggagagaatcgactagttactgatactgttttggatccaaaaatagatgtaactataaaataatgtcatgggtttgtttatgtggctcataaactggctctcggggggaatcctagatggaatatttcagagggttcaacagtcatttagatgcttaagtcctcatatgttcactaaatcagactctttaattaataaacatgcataaagatagcatgagattgaagaacttttgcaaactcggacccaatagaagcagtgaagactttctgtatgaattaagatataatccgaaataaattacttgtagaaaaatacgaggtcaaggcctttcaatggggaaagtgcatgtaatgccccttttattcatggagagtaaagctgcttccataaatggtaacattatgttggtttatgtagagacacataacactgtgactacctcaggaacctacaaatacatctttggaacaggcaccaggctgaaggttttagcaagtgagtattacagacaagacaggctgtattttaaaggttgttggtgttcatgtttgagggacaagggaaggtaggacaagggaaatacccatgtaaactgtgcaagctaaaatcactgctatctgaagcggcaattctgggtccctctactctggacaggaggggcgaaggagagctctgaggcttaccatgatggacttactgccgatttcataagaattgtatccatcattagcaaaatgtttatgacttgaaggcctcaagaaactcctgttaacacaacaggagttctgtgttctttattcttttaaaactatattctcactttacatttttcactcatttttctgcctttttttatgcgtctctcctctgtgcaactcaatgcttcatctgggcattcatattttgagaaatcatctcaagaggaaatcatgtccagatcctagcatgtcactcaaagctctctgaaatctgggccctttctattctccaaatttattcccactgattccctttcatgaatgctctgctccaggaaaactaggtatctccctcccttgaatatttacacatgcccacacctgtaccctgtgtccatacatcagacatcctggacccaccacctaaaacaggcttgcacaggtgacaaaatttggcctcatcatctctcagccttgagacccagcacaggcatcaccagatttagtttcataggaagagcatgaaaaatcatatcattttttaattaagcaggccaaggtaagagatccatcagacaaagaagcaaagtaggaaggagagagatggcttctgtaatgggtttgcaaaggagagctctgtccctgaaatagcactaatataatccaagtaggagatttacaggctgcatgtttcttggtttccctttggagtgctccattcctaacaccagttgttaagcccctggtcctgaatgtggccgggggtgaggaagtgggaggagaccatgctggccactcagtggtggtgcccatggagtttcgggctcagattttctgtgagatacctcaaaattgagagaagctcaaaaggatcatgcagcaaaaatgggagaagtcaccttcttagtcataagaggattatttctgattagtccttgagctgtgttatgtcctggggaagggacagtaagagtagaaaagtctctcctaggacaaggataggaagtggtgaaaagtccttttcctggtgactagcaaagcaggggatgaaaagatctggagttggagtccagggtggattccagggcagacaactgcataggactgtctcgagttctgtggattgaaaaggttgggcatcccttcagatgttcctgagctgacctcagtcagaggtgcgtggctccagcacccagaaggtgttgaccagcacaccaacccctcctcccaggtgggccgtgacagcttccctcaatccctcccactctgacaacagtctctctgattgcttttgctttggtgctctggacataaactgttactactttgtccaagtgaggtatataattttcagaacgctggagaattattatctaaaacaccagtggatacgctacaattttggcattcagtattctgggcttgtgcaggaaaactctttctttagaacatgtagaaagactatcctttagttatccagtgtggaaacagtcctgaaatccaaactgatactgcgatcctgtgccaggttattactgtgacaattacttaatattctctgtgctcacgatatcactccttccagaagatctttagggaaaacttagttcagtttctaggaggtttttgctcagccgaagatcactgtgtgaataataatgcaggcaacatgctcacctttggagggggaacaaggttaatggtcaaaccccgtgagtatctctgctgaatccataatgaatgctctaatttcaaaaggaagccgtagcactgagctctgttttctgttttctctacttaattttatcttttatattaattctaatggttacatgttatcgatacatggcatatgtatatatgaaaatggacatacatgtaactgtctggcgtgggaacaaatgtgctggagaaaaacagatttcttgtcctttttgtcttaaccatttgggtcagaaggtctgactgagtagaacatgggctgggtgagcactgcagtgggggaatccttctccagcagctttgtcagaattatgctctttgctggcctggtcagaaggcagctttgtcaggaggtggaaggatgaactagttaacctcagaagagcctttccactccgaccatgctgggaatagaccgccataataaacagtcttttccgctgcctctttagccaacgtcccagctggaggagcacgccggccagatttggggattgaaagggatttcctgatacacattggcctggtcggttttggtaaagctttctatgactgtgtaatgctggcaacaaccgtaagctgatttggggattgggaacaagcctggcagtaaatccgagtgagtcttcgtgttaactctgtcaaacctgtctgtgcagtttgaaatatctcagaaactgcctccttcttttttagccctgaggtttaagatatctagttatggctagtgttttcttcctgtccaccaaagctgaacccttgcctacccctcaatcaaaataactagatagagggatccatatgagcagggtaggaaggccattggagtgttcagctgttttcttagagagcaaatacattcgtgcattccaaaaaggcctgtgtgggagcactgaatattacagaaggtgagtgtgtagcacatttcatggccgctttagtctgcactatgccaacctcaccgtgggccattggtaaatactgttgctttctggccaaagacaggtcaagtgctgggaactctcgggactcacagtcacgctagtgacgtgctagagcacatctccccactgtggattatccagaatgactcaaacttgcgatataactcctgcatctctcagttctctttggcttagagccttattgtggatttgctagaggtaacaggaaaggaactgatttcatcctaattctagcctcttctgagaagttattctctgcaagagtcttcagggagcatcttacagaccacctacactattcagaattttgttccgcacaccacattgtgttcccagcagtgtttgctgtggcttttgctggggccaggtcctgagtcagttctggagctccaggcttggcaaagctggataagggcaaggggagttgtacagcagaaccaaagggcttcaggaaagacatctttgatatagacattaatgaatttctaaatgggcttctatatgctaacctgataagactctctggggagaaggtcatgctttcctttgcagctctaaatataagacacatgcagaaaaaaaaaaaagaatgggaaatgtctgttacagtgccaaaatgaagataatcagtataaatattagatttgtcttaatattaagtttatgaaatgtaagtctttcagaagaactatctcaggatatatttattaggtcaatgaaatattttatccatgtgactggtatacacacttcaaaggagaacccaaaatggcaggcaggggagggtggctaatgaaaggtatggcatagtagttaagaatatgaattttggaataaaactgtttgggtaaatcctaattcagaaggttacttaatctctttatgcctcttttttctcatctgtaaaatggggatggtaatagtacctagctcactgagatgttacgagatttaaagagctaatacctataatggactttgcataatggcagcccgattaaaagttttcagttaatatgtttttattgctactatgtcaggttgctggagggaaggaagaaaaatggaaatgatccccatttatagtttttgtaaagtacagcattagagtgtggctctggcaacacaggcaaactaatctttgggcaagggacaactttaccaagtaaaaccaggtaggtctggatgtttccaagtgaagtgcagttatccactctgttcattttttgtttaatcttctctgtctcaacttctaaccaaaaactcttactcttaggttatattttccttttataaaagtaagtagaatgtgtgtaaagtctggttgatatgatcctttctaactcacttggtttcagctagtggcaaaaagaagggtgtattggatctggaattcttaggttaaggctgagagaatgtgagtttggctgacttggaagaaataaaaacatcaaatgtgggtggttcacacaaaagaaggtgatttttcataataatatactaaagtagaatccacccttgtgaccaccagaattattcaagtacagtcttccaaggacaaaatgggtagcatggaaatgatatgtttttttggggggaaaaaacatggggagagagagagaaaggggactattagttgtctggattgttaggaaacatggaagacagcacttcttgttgtaaggtttggcaaaggttatcaccaagtagaagtccaaatgtgtgtaacatacccctggcaaacgttatagaagaaggaagctggggccgggcacggtggctcacgcctgtaatcccagcactttgggaggccgaggcgggtggatcacgaggtcaggagttcgagaccatcctggctaacacagtgaaaccccgtctctactaaaaaaaaatacaaaaaattagccaggcgtggcgggcgcctgtagtcccaactactacagaggctgaggcaggagaatggcgtgaacctgggaggtggagtttgtgccactgctgagatcgcgccactgcactccagcgtgcgcgacagagtgagactccatctcaaaaaaagaagaaggaagctgggagcagtgtctctcacctgtaatctcagcattttggaaggctgaggcaggaggatcacttgaggccaggagttcaagaccaccctgggcaacacagtgagacccccatctctacaaaaaataaataaataaaatttttttaaaaatagccaggcatggtagcatgcacctgtcatcctagctactgaagaggttgaggcaggaggatcacttgtgcccaggaggtcaaggttacagtgagccaagaacacaccactgcactccagcctggacaacaaagtaagatcctgtctctaaaaatatatatttaaaaatataaaataaataagttaaagaaggaggaaggagatgaagaaaatttggcttagtaggaaagtgtttttgtactgggcagaaacactgtgtcaaactggggcaaacaacctcttctttgggactggaacgagactcaccgttattcccctgtaagtccttacctcttgacaaaaaagctcttagtctgtaatgacaagttctcacatcccagacacctaatgaatttctaaatgagcttccatgtgttaaactgataaaactctctagggagaaggtcacccttacctttgcggctctaaatgtaagacatgttgtaagaaaaattgggaactgttaattgcagtgccaaaatgaagacagtgattacaaatattgggctagttttaatgttagatttataaaatataagcctttccaaagaaccatctcagggtgcatttattagtttgtgtctatacagcccaattgtccagttactttgattaatgttggtagctgatgcagatatttagggacttccttgagaaaacttctttgtgctcaaaattgcatgaattgaatggcacattacctaaataattgccaaatctgtttcactttgtgctgtatagactcagcctaataaaaacaaatgctgttgtgctttttcccagtctgtctcctctccacacagaaagtttccctttctactaaacagcatctcttcacacgaagaaaagatgcccagcaagccatttgacttattgctgctgctagtttgcatttatatgactcctttccttagaagggatgaagacactttatacgacttattagctaaacagattgacagcctaattaggaagagagaaacagatctgagtatctttttgtggctgctgttcctaccccctcgtgtagaacatttggtcagatggctctttgagacagaaataagacagggacgtggtctctgcttgtagtgtgggacgtctcagctgcacctaagaggttgtcacaggagtactaaataggtcagggcaactgacacagccaggaaaaatttctttcccctagaacttgtgtgtgctcaccaagcaaagcgtgactaatttgacatccattgttagtgtgtgtctacccttcttgcctttgttttcagacccttcctctctagatcctattccttccatctccaactcctgtatgtaaatccctgctctctcctttgaattcctgactgctatgcccatgcccagcaccggcacccccacgcacactgctgcctgcctctgtaaccatcagctgtatttctgaggactttcctagctccttgagtgatcctcaaatggctcagggcctgagggaatctttgctgagggttggccccagcagagccgctgcagaggtagaggtggccagcaagggacacagactgcctgcatgaaggctggagctgggcccaggatgaggaaaagcctcaggaaggaagggctgacacgaaataaggaataccatggcattcatgagatgtgcgtctgaatcctctctcttgcctgagaagctttagcttccaccttgagacacaaaacatgtggttatgaagagatgacaaggtttttgtaaaagaatgagccattgtggataggctttgggaatgtgctgcattgcgggtccggcactcaagtgattgttttaccacgtaagtatatcttttctcatttctgtgggctgttatgtccgtaaatcatatagaacagttcttcttatgcacacacacacacacacacccattttccagtcactgaggagaaacagtctctgggtctacctacacagccagtttgaccattaagatggtcaaattcatttttcaagataattttaactggttccatttaatgctgccaacagccaagggcattagcatgtcgtgggaacctaatctatgttcactcactgctgtgggaggacagtcatttcttcttctcccctggcagtcagacttcagaatccagctgaccttttccatgcctgtctcttctggcagattaagtggttatttccactaactttcttgtggaaaaacacacaagacagatatattctccttcagtttttactaagaaagttttgtggttatcattttgacaataaacttcagctagcatagtccctactattcatgttaataatatcttgacttgaaccatcatattttccccacatcattcacaatgcatttcaatgctgtaacccactgcaccatccccagcccttttatcttcacaacgttctctaataaggtaaacaggatcatacatcatcaaacatatgtcacagacagaaaagctgacacacagacaagttaaataatttaagtcaaaccaaaaaaaaatcataactgggattagagcttgagattccctattttcttacagtgaagtgtcttgagctgtcacttaatgcattgaaaacataataagcacaggccataggcattttcagaacatgaaacttgactgaaacaaaaactgactgtttgattgctttggtgttttaaatgtatccccaaatctcctttgctattgatagtcatttggtgccagtgacagggaagagcagaggggcttaggaggtttttgtagatctcagtatcactgtgtcttataacaccgacaagctcatctttgggactgggaccagattacaagtctttccaagtaagtactagaaaccaaggagccattttgaaaaggtgttttctttttctttttcttttttttttaaatgaagttttgctccttgttgcgcaggctggagtgcagtggcatgatctcggctcactacaacctccacctcccgggttcaagcgattctcctgtctcagcctcccgagtagctgggattacaggcacctgccaccacgcctggctaatttttgtatttttagtagaaacagtgtttcaccatgttggccaggctggtcttgaactcctgacctcaagtgatctgcctgcctcggcctgccaaagattacaggccactgcgcccagccttaaaaggtgttttctataaacaggaacgttctcacagcactgcaggccacccttaccaactccgagctctgtaggggcctttagcacctatagctgcagaaccttctataaaccaattaatctatatgtgaacaatttaacctatatgtgaacaccatggtgctgactaaaatcttatcagcagtgaaaagaaggcactagagcgtcagatgcattatgactctaaacaaatgatctgtttccctcttttgcatttttatttaaaatatcagggaaggtgaagcaagttcaacttctccaatttgaaaactgtttctgaattatgcttcccttgtatgcagagagacctagattgactttggatgtttagtcattcgatttaatcaaatgtaattaaatgagcaaataatctccaatagccaatattcctatgttgtttcattgttttatgtgctttgctctagactttttgtctgggctttgtctctaataggatccccggaaggacagtgaaggtttttgttaaggtttttgtgtctgtgtggatagcaactatcagttaatctggggcgctgggaccaagctaattataaagccaggtaagtctcagagatgtgactgcacgggagaggagacactagttgaataatgcacaaagtgtagcatgcagattatatttttaagaacaagtcagcctgctggagacaatgcactcaacccaaatggggtctccactcccagtgagaagcatgtcagccgctaactcttttgtttggtctagtagcttccggaatgaataatgcttaagtagccctctaagagagcagaccaggttgttagggaatatctaattccctctgatatggttaaaactctttgccaagggcagaaaccagcctcattccattggaagagcaaattcagagaaaaaggaaagggtcacacagccaaagacggtaaaatgttcaaaggtgaaaaatagccaagtctgcagctctcctgacatccttgctcaggctgctgtcccacgtggagagcagatgcctgcaaagctctcggtcacttgctggagtcactcagggttctgggccttgggatgtaacttaaatgacagtgtcagggcactgtcagaggaatatgaaggctgcagcgatgcctgcaagtcagcttttgctacactgggactgaggtgttctaagcctggaaagacacaaagctgtcctcatcccaacctgccgtgcccctccttgagggttagtgtaaggctctgaaggactgtgtgaattatggcggtgctacaaacaagctcatctttggaactggcactctgcttgctgtccagccaagtacgtaagtagtggcatgtgtcaggtggattctgtgtccatggcaagtaggaagcgacagcacccttaggtggaaaggatggctgaaggttgactttgttcactgctgtcatctcttatctgccgtgatatagcaggctgtcaaaattcccattctcctggatggcacaccacagtcaggggaggagaaacatgctaattttatgataaaccccaggggagaaaaagactactgtgggaaaatttagttgagaaaatcaaattgttctcaactaaatgctgcaggctttatgcttctgtgaacccagtttcccagttattcattgaccctgaacatacgtttacctgtgcaaatacaatctctcctaacctatttatacaattatgtgtctgccggtccaaatgccttcttctataggccatgtttttatttctcttccaaaagagactccagagccatccttgggaagagtgctgagaagtcaggcaggcctaactcccaggggtcagggaggggaaagagaaggctaagggtaacttagctcagtactagaactgtgatccacgtatctgtcactctatttcctacgtttgcttcccttttgttttctctagaataagttctttttgtttgctctggacacccactgctcccaggatgaaaggagagaaatgagatcagttttgaacacttcctcttgaaatataaagaatcaacaagttacagtcatgttggggacttcttctctctccaagcttaaatttctattacgtaagccttacttttaaccaagaaagttagtgacatggtatcactgtctgggatgctcacccctctctcttttctccagatactccgtgtatactaaagctcagccaatgctcagctttgtgataaaggagctgttgtgtgtctttatctctgcctttaggatacagtcttttttataacagaaaatgttcacttctcccatttatttcatggctggactctctaccccttcctggctgaaacagcatatgggtccatggtggaacttctttgggaaaaaaaaaaaaatagaactgtttgacttttgccactcttccctcatgaaatgttttttaggctatcaaataagcattattacacattgagaaggctttgaaaaaacttgatcactgagtctggaggtgagctgggatggctctgtagctggaaaatatccctgtgggtgtaggaatgtaccgtcccttcaaacttgtgtgtttagggctgagctcacacatacgacagcaagagttgttaacaaattagattcagctttggcagttttatgcctagaaatgcaaaagaattttaaaagctcataagtttggcatttttaaaggagacattgtttgctttatgttgcagagccaatttttcttcctatcataaaaggccagaaacacagagaaagcaaaaaaaaaaaaggaaaaaaaaaaaaacacaaggagagtctaactgccccctcaccacagtgctatgtgtttggtagggttttactatgggtttcagtaaaggcaggaagtgctgtgggaataacaatgccagactcatgtttggagatggaactcagctggtggtgaagcccagtaagtggccatgttttattgatatttgaccaaacaaataaatcccgtgaagttagtggagatttaatttaatatgtaaacaaatctacttcttgaaaaatgacttttgtgaatacatgaaacactcgtgattattgagactagagcaataatgataaataaaggcaaaatgagaccaccccaaatcacctttaacattgtgcttagccctctttcttctagagagatatggggccatgagctatttacagccgcagtatctcttaaactatgttctgcaatgacttgtgtgtttactctgattttagccacagaatttgttttccattctattaaaaatgagaatctatctcattttaaatgctactaatatttataaggtaccttctttgtctcttgtgcctgcatatatattcatttcaaaaagatctcataagaaacccaaacattgtcgcattttgacaaatgtccacatctagtcccgtaatgtcaaatttcactaaaaacacagcctgactatgcaaatgcagtggaagaaaaaaacaattcagaaatggattgacactcccaggtggctttataaacacctaaaaggaaatccagagtgaaataaaatggcaggtatgataacacgatttttttttaatgatcaattcctccatggggaataaaagtttttaaacttacctccttgaaaaggagggaaataggagttcaggagcctggcattcccaggtgtgctcctggggtgtctgtttctccacattgccattttggagacaataggacccatccaaatgtccaaccaaaaaactaatattaagaggctggagtcaccacattgactgtctgttattaaaccctataacaggttataattaagattatggaatgactaacccaaggagctttaaaataggatagcctagttttaaacggttcagccttgggaaatgctggaagacaaggaaatgagatagatgactccataggtttgttttacgtctggtgaacatatccatcccatgttaattttttttaacgactatgataaagagcttctttggggtcaggtagaacccaaaggaggaagagaaaatgggacttggttctttaagtgtcaaacaaggatccagccagggttgagggcaatggcataaggcttccctctcttggtggtgagagaccacatccatggactgtggaaggagaacattttctaaaagacggggatcccttgggctaaaatgaatgatgctcatgacccccagctagggcagggctataatgagtacagcaaacataaggcaaggtatcctcagaatttggtgacagggcaaattctagaacttaaggcttagagccagggtgaagggaagactctgtaatgcagttccttctcaggtggaaatccagatatgtgccctaagtgacctattcctgccccatttttgtttgggctctgaaaagtggattcctagctcagtggctgtctgccaggtatcttttgccttcagtaacagaattatgtttgatattggaaaggagtttgttgtattgttggctttataattcactctcagtgtcaaatgaggtcattcaacttcctctcgcacatttgcaataagcagcatgaaattcaagcagaacaactagaagacacagagaaagatggctgagctgataatgaggcctgtttattacaggagaagagacaatataggaatctgttaagtcccatgaggttgaaatatccaccaaaaaatatgcagctgtcccccaaaaaaaagtcactaggagtttttgttatggtcccaatcacagtgtgaacagagatgacaagatcatctttggaaaagggacacgacttcatattctccccagtaagtgctgtttatgtgattttctgacattaactcccactgagttcaaactgctgagagtgttcagtaggaaagtttctaagacatgtgggtggcctgtaggtcctgggctcttctcttgcagaggtccagtcctcagcctttccacagctgagccaaataccaaattctcccctccaggctggaaaagttgctaccagtcctctgctacccaaatataaattatttttttattgtttattaagaagagtaaaagaatcgtgacactttgtccagaacctattttccagtcttttcccccaggcttgtccctggtaacctctgtttggactcattgttaagcccagcgtgatttttggctccaactaaattgattttggaaatgactccagcatacctatgacccctctccttccaccctccataaaagatttatttttctttatttggcctctgctgagattcctggctttgatgccccaggatctctcatttcccttgttccagggataagtgagagatgactttttaaagagctactttcatcttagagacaacaaagagagtatgccagcaagagcaacatcttgcattgagccttctcactctatgccattttccaaatctttttctttatttaggataagtgaccactcctttttatttctagtacagcaaagagtacatcatgatgtcagaaacagggatttcctttggaatgtttttcacaggctaacaataagctagaagtctgcaagcaattcagaaatgcatccctgagctacaactccatgtatggaagctcatcagcagggtagacaggcaaagcagaaacattttaattatacccatactttgtagagattgggtgagaagtgggcaaatgcgtgctaaggaaaaacaaaaactatggttaagtggggagatttctagatggttctaacagggaagaagaccaacaagaggaaacttccaggaaaaccaccaaggccaggcattcagggtttttgttatggaggaaatcactgtgggaattcaggaaacacacctcttgtctttggaaagggcacaagactttctgtgattgcaagtaagtgtttctagccatccttgattttgatcagcaatggcttcttcccttgaattatttttcagtgtacctagaatgcttttgcccccaagaaaggtttggaaggagctgggtcattagcattgcgcaggaaaattacaggttattctgttataattcgaaagccaactggacagtcatgaatgcacacagatctgggccctgcattgcaccctggcctagttgcctccagcttgttctgatcgtaatcctggcccagtttcctcctctgatcccaggagacaaaagccctgggcagagaaccagactacttagcctgggggaagcacaaaaaggcttgtctgagatccataagccttttttttttttctttttcttttttttttttttttttttttgagacagagtctcgctctgtcgcccaggctggagtgcagtggtgcgatctcggctcactgcaagctccgcctcccgggttcacaccattctcctgcctcagcctccctagtagctgggactacaggtgctcaccaccacgtccggctaattttttgtatttttttttagtagagacagggtttcaccgtgttggccaggatgatctcgatctcccgacctcgtgatccacccgcctcagcctcccaaagtgctgggattacaggcgtgagccaccgtgcccagccccaaaagccatttttaaatacattgcaggtttctatttaatgttgttattcattttgatttgcccaagtaatacattaaaatttctcattgtaaaccattcaaattacagataaagtccaggcacggtggctcacacctgtaatcccagcactttagaaggctgaggtgggcaaatcacctgaggtcaggagtttgagaccagtctggccaacatgatgaaatcccatctctactaaaaatacgaaaagtagtcaatcgtggtggcaggcacctataatcccagctactcaggaggctgaggcaggataatcacttgaacccgggaggttgaggttgccatgagccgagatcgtgccactgcactccagcctgggtgacagagtgagactccatctcaaaaaaaaaaaaaaaattacagataaaaccagcattcaccttggccacttccttcagtatcagtttcctcctccccaaaagtgaccactgaaaccagcttggtgtgttgtgatgagtttctctgtggaatatgtttatgtgaaatcccatcttcaaccaggaaagcttgagagggaaagggctcagactgcagtttgcaggatttcaattagatataaggaacagttgattagatgtaagagctgttagcaaaggaaaaccttataaaaactaggagctcttaataactagacaggtctttggtcagacaacacactgactgaggacaggaggatggattcgatgacctctgaaagtccagccaggactctgaggactctgaggaatggtctgttccatagcctgcctctgtaatgcccttctctcttgcctattgtccggttgttacagtctgagcttttgtcagagctgctcctatgctgtgagtggtctgattttctcagcatctctggggtttttgcaaagaaaggaaactctgtgcatactctggggctgggagttaccaactcactttcgggaaggggaccaaactctcggtcataccaagtaagttcttctttctggctaattattcttcccgagaagcctgtcttccatcatgcagaagctgtcaaaacacaggtggtgttttctttgcttggtttgtgttgggtggttagtaatatcagttggaaaacaaggttattaatgcacatattccctggggcattgtattcggacatttaatatccatgtagtctctccctgtgaaaatatgtgaacctccacgaaaagaaaggtccaaggaaagtagcagggaaaaggcaggaattggatgaaaatagccaaagagcctgcaggaatataaacaaggcaggatcccaggagacagagcagtagccactttgagtgaatttcccaggaggtgctcctgccaaggcccataccttcaaggaaaattaaggcaaatagaattgggctggggagttgctacttattagtattcctcccacgttctaacctaattataaggaggttgttttggccatgggcagtcatctcaggttttgttttcctgctttcctccctaacctccacctgtcttcctagaggcctgagtcaaggttattgcaatagcactaaagactgtgtaacaccaatgcaggcaaatcaacctttggggatgggactacgctcactgtgaagccaagtaagttgtgttcttctttgcctaggccttcaggggcaatcaatcaaatcattagtttgaaaaagactttaatcctatgcatctggttgggctctttattaatgttctttccccaggccaaagagagttggttctcttccctgctttaaaatgggatatgagtgcatgtatgcacacagcatgcccacatgcagactcttgctctagctcatggtaagggcttctcaggagcatatacaacattttgaaagaaatagagaaacaaacaataatgagccaatggagctgtcaggaaggttctccaccacccctgaccaggcttcccagcaggatctctggccatataggatgtgcttgcactatatcggatggtctaggatgggaaatatctctctgtaattaattccaaaatttggcaacccttattgccagaaagtacttctcatatctaagtttgatctccctgctgcgatttaaatatctacttgaaaagaaccactagaactctgtacatctgggattgagaatcaagtaactgccatagaatatgaggctgagcactaagcccacctctgcagcacctctgacgtgtcatgggtcccctctggacattttgagctcaagtaataatggattaagcaggatagcacaagctttggaaacagaaaaacctgaattcaagtccttgctccactacttacctagctgtgtgaccttgaacaagttacttaatctctctgagcctcagtttccccatccacaaaatgaagataaaaatattcctacctcgttgagtcatcgtaaagatgaaataatacagctaaagtagttagcatagtgctcagaacatagaaaaagctcattaaaccctcgctattaataataatgataaacatcatctctaacccacagcagagcctttgtttggcccctggggctcttctgtcaaggttctgttgtgcatcagcagcagagctggaattggggggagggtggagaatgtcagcctgttctatgaaattcttcacctgggatttgaaagtggaaatacaaagaatcctgactaatttaaatacaaaatcatccaagtgtcagaggcaggggagaggtttctgcagagagctgcatagctgggatcctcaaggctacacacacacgcttggagcagggatgcggttcacaggatggcagggcaaaggttgcagaactgaaaccttgtacttccccatcaccaaaatgaccccagcatgatttcctttaaggtgtcccgagccccttcccaaaagacaggctccccatgtggaggggcaatgacagagggaagatggaaactttatgggaagggctatctatcccaaggttgtccttctcctcttcagggtagtgaagctcatgagaaatatggctcctgaaaatagccactaaatgaaactctccaacctggaggtagaggatcagtaaagtctgcagaggcaaaatgaggcagtttatttcaaagaaaagaggttgagggcaaggtgggagttaagtcacacatctaaatctgggaaaggaagcattaaacagaagacggaggggctcggctctccacctccaccaggattcagaccacaggacatggctaatactgcaagaagggagttaggttagtggtaaaacctttctaataggtttttgaacagtgaaaatgagctgtcaggagtagttgccagggcactttctctagagagtttttgaaaggagatagacaccctgctatcagaggtgattggagtgcagccctgcctcgaggcaggaggagaaatgagagaacctcttaaagcctctttccagcccccagagcctgtctccatgaaaaaggcccaggctcattaatgcagagctgcatcctccaggacacagggggttgctgggttgttaagtttggaacctttgccggcttagtggttaccaaactccctttgttctcaagacttgacttgataaatgggctggctttatccctttaaagccaaaaacacaggttctgagtgctgtgttgtttgtggtgttgagatgcccaggctggagggaggaagctctagggggtttttgctgagcccagaaacactgtggggataactatggtcagaattttgtctttggtcccggaaccagattgtccgtgctgccctgtaagtacagttaagtggagatagaaaatgagtccagtgcttgatgtggggagaagctgcagggtcttgaggccaggagtccaccgtgacctcaggagtggtgatggagaagaaggttaaaaaaggaatgagaaacagaaccataaggacaatacagaggaagggttcattttcgggaaggaaaatcacaaggccgtgtgattaacgctggaggaaatgcactcctttggagggtcccttctcaggagggctttgtgtcggggaaagctgagctgttaggtttttgatgctgagataatcactatgcagaaggacaaggcttctcctttatctttgggaaggggacaaggctgcttgtcaagccaagtaagtgacatataatttatatgtgctgaatatgattatctccaagaggaaaacttgccctcttttccacgggtgcctccttgggtcaggaggacattaaaggtgttgagcagaccaaggcccagtacctcgtcaccttcttcatccttgaaggagctttaagaggtgtggacgggaagaaacccaccaggaccccaccaataagcccagccttgagacccctccactctgtcagacttgaataagaaccatctgagaacaaggtcttcctcagaaggggactccagcatagtcatccccatttgatagattttgaaactcagggcggggcagagtggctcatgcctgtaatcccagcactttgggaagctgaggcaggtggatcacttgaaggtcaggagttcgagacctgcctggccaacatggtgaaagcccgtctctactaaaaataaaaaaaattagctgggtgtggtggcacgcacctgtaatcccagctactcagaaggctgaggcaggagaatcgcttgaacccgggaggcggaggttgcagtgagccaagatcatgccattgcactccagcctgggcaacaaaagcgaaacttcatctcaaacaaacaaacaagctcaggcaagtagaggccagtgattaacactcttccaataggaacagatcccaagcaacctgcagtagtttttccagtaggctcgtgaactcaaaacatcaagttatttaaatgacagggcaaccgttgtgatcagctgtcatttgagtagtgctgaggactgggtctgaccttgagtaaacgcctaggctggtgggtttctatccctgcagcatctaaagcggacgcccaggcttcactgaccccagcagtctggctttctgcccttgccgcccgggaggtgcagctcttggcacacaccatccttagtgtcttgaaagaagagaaattaaaagagaaagggggaaaagcttatatctcatatcatgcagttgcctcattttgtagcaagattgtttccccatgagcagtttgtcttcattcagcagctgtcttctctggggaagccattttgtagaggtgtttgtcacagtgtgacaactgacagctgggggaaattgcagtttggagcagggacccaggttgtggtcaccccaggtaagccccattccctggagcctcacctgcccttagtatttggcatgccctgcatgccaaatatttctagccgagactatgagaaacacatctgaaaggaagccatttccctgaacagcagtacccaaagccattaagcaaaaatgagagatcagactggtgttaaatagaaacgtttttggataaatagtaattctcattattctctatcagtctcctgtgtgaatacccttatttcccttataaggaaaaaagttacaataagcaggatagccatgattcatgctgtggtgtgggagcaatctgctgtggatttgggggtggaggattagaaatgtgttcaggcagactggatgtgtttttgacaggatatgtaacacagtgtgatttataaccagggaggaaagcttatcttcggacagggaacggagttatctgtgaaacccagtaagtataaaattgtatccctggattaagcaatgtctgtggattaagggctgatttagacccaattatacaccatatgaagaatgtttagagagggggatgagcatcaaataggaagccaatcgtcgtcctggctaggatctagcatctcagtgcaaaatgggctatgtaagtgtgcctctgggaattgctcctgatatatgtgttgggactaaaatgtatgactggctacttgttgtattggctgggatcatatccctggatttgtgcagtaattggtgacaagatttctaattccttaacaaaccttctaaggcactattctatttggctaagattatgtcaatttatagaaggaaagaaccttgtaaataatgatcattaaccaaaagtaatgtgattagtctctctcaaagtctgaaaaaccacttttttttaaaaagtttactcatgactactgagggacacttcctgtttctgagactttcagccaaaaattcgtacagcgtagcctcacggagcagagagaaccttgacaacattcctttttgactttctccatggatgagaaaactgaggctcagggaagagacagatcccggccccacagccagtctatggctgagctagaactagattttaggtctctaatttgccaaacctgtcagttggctcaaacttgaagtttgaagagtccgcaagattcatctgacaaatattttcatgtacttgccctctgccaggctcgttgctgaaaccagggatccaacaggaagcaaactcagtgtgatattgccttcatgaaacttacattctggaggtggattccatgtttcttcccagatatgacaatgcttaccctgatttctcttgggcatggctctcttatactatcatcacttccttaggaaatactaaaactaatttttgctgcagtttaaagtccttgagcagataactaacacacataccactttagtcaggagaagggaaatgcccaaaagtgaagtagaaaactaggaatttgtctgataattgattattataaagttattttatcagtgtgaaatgagtggccaaattaactggacaatgccagctctgtacctacctcactttgattctatagactcagtctcaggaggattcaagaattcagacagttctctgatgacataatccagtgatgcccacaacagaggaggcgtattctctattctggactttgtgagtctccttggatgaaaagattcaagtgctgttttgacacctaaaatcagagagtatttgctctatacatatatcaaaaatacacagttaatgtttagaactttgtagtggaaagtggaaagcaaaggtcccctaaaagaaaatgggattgtaaagacgaaggagggttagtttaggatttgtagaaagtcagtttggctactccagaccaaacctagattaacagtgatgcaggcctaattcaaaaggaagcactgccagctctttattcagtgctttgccaacctggcctgtttgatctggtttttgttgttgagcaaatcatagtgtttcttctggttctgcaaggcaactgacctttggatctgggacacaattgactgttttacctggtaggctgcctcaattaaatactatttgcactgatttactaatctacaaatgtattctgtacatgtaacttaatgggcctgaggttgaagatggggagagacagcaacaatgcatactagaaagggtaatgtgagcagagaattatttatcagagaccaagaagagaaagagaagctttttgctaaggcttttagtaataggagttaatgaaaatgaatagaaaaaaatttcattttaacttagaagaattgctgaataatgggaacagattccataaggggaacctctgcttctgaaaatatttgcactaggaccagcctacgtgctacaaaaactgtctcacaccaagtctagttggtcacttacatttttagcctattctagtagctatttctaaataagtcttcaaacatagaggtgcctatatttaagatatttaaatgaggctctatttctatagctctctggtgcccttccagcaaagcattgctgtaacacattgcttatcatttctacaagtgagaacaagtaagcccctggccctccaaaattgcatgagtattataattacttggcttagattgaagtcacttctgtgttacttctcataactgtgttcatttgttgagatctgtttaactccaaactgtgtgggcgtctaactgttggcactaaggtttcttttctcttgaaattgccagcaaaatattttacccataaataatgtttcatctagacttgcaaatgacaactaacactgcaggctctttttttttcttttgctttgtttccttttttctgaagggaatatgcaagcaggaagcaaaaaaaaaaaaagccaaaatgtacagtttgactgtggggtctgggaggagagtgtcaatgtggatgctaaaatatacatggttgtataatgtaggtactgtcacagagaggctatagtgatcttattagatcatacatacagagcaccactggtcagctggcgttgctcggggtgtccttaagaaaagctcaggtctagttgtcaagtgcaacccagattcagatacagagtctcagagagaagcttccagatcaccctggagctaaatgcagaatatgaattttccccttagttaagtctacctgaggggaattttcatttataattaggaaaagagaaaggtaaagaacatttacttgcagtgtcctgtttcaaatattgtgtgcattgagccagaggacacaagaatgaacccaagcagaaaactaaagaaaagaaatcaataaaaccactgaagaaaaccagttgcccttatcttgcctgtctctgataatgaatgtgccttccctgctcattcctcactttggttctcaaattttccagggaattagcaaagaactggtagggttgggttagtcttggtctaatttggttagtcatctctggataacaagtctcctttttaggaagtgccaggggattttttgtaatgccaataaacatggtgtacaacttcaacaaattttactttggatctgggaccaaactcaatgtaaaaccaagtaagttatagttgcctagaagaaaaagttaccaacacattatgctaaattcttcttttcagtctgtatttcagttcttttattttgcattttgggtccccacccatgatattttattagtccttattcatatgtcacttgaacagatatgtagtaaacaaatctcatgatcgagtagacatgctgaaactgccaatgttctcaaggtgctattctttataaggaaaatgcccaaattttaactgttgctactgaacaaaagagcatttggatataatttaaagcacccctgaatgtccaggatttcagagaggagacatgacaaattaaaattatatgtattatttaaagatgaaaagaattagatcctcttgaaaatactctaataactaacatttcttcaacattcgcaatatgcaaagcacctttcataccttgactcatctgaccctcctaacaaccctctgggatagatattacctatctccgcttcacagatgaggaaacagtgtgaaaggtaaaactaaagcaaagaggttgaaatagttacccaagggctcaccgcagatgaggggcagagctagattaagagcctggcctgcctgtcccctagcccactctcttaaccatggtcttggtgaggtttgtgtaggcgacctcgcactgtggttctaacgactacaagctcagctttggagccggaaccacagtaactgtaagagcaagtaagtaagaaagaaaagtccagaataattttaagcaaaatggtgggtaggtttttcagcaatttcacctaggaagtgcaatgtcaagaactaaattctaagagctttcccagtttgtgttagaaccataatttttctacctcacacgtctccctcgccttctctgtcacctcagaacagctcctcctaaggcatgacttcacaatggtacatttgttggtggcgcagtctttgtggtcagataaaaactgagctaattatctgaaattatctcaggtctctaagtgagagagttaactcctttcaaatatttgaagaactacgatgtagaccaggtaaggggtgagtgtggaggccaaatcaaaacgagcaggtgcaagatgtgccccaacctcccctcaaacattgttgaacaagtggaactgccctgagtggaaaggctgctttgtgaagtatggaacttttcttccttagatatcttcatgccagacccctaaggttaaccatgagatgttgcagaaggcacttctatgccattttagctattagattgaatcacctctgggctccctttcaaatctaaatgctaagatcccatgactcaagcctggaggattaataggtgagctcagacttgtttcttctatttttactattttgatagccaaagaaataattcatcaaattattcataagctaaagcctacttgggatttttacacctagaagatggtggggtatgatttcccagtgcagtaaatgagaaaacaataggagacatcaaggaggaaaaaaagaaggaagagataaagggaatgtcttaagggaggctcagaggttgaatgaaggaaatgaggtgattttgcagaggacagatgtggctatcaaagattttacaatttcacctttggaaagggatccaaacataatgtcactccaagtaagtgagcagccttttgtactcgaaaatagggccaggggagcaaagtttcttccaatttaaacacactcaaaaggatgtgtaattgctttctgatgggagggaactctgaaggtagaaagactattgttaccacagatcacttgtccctggagatatagcatctgaggactgactgtctagcttagactgctgtctgcacaagaagaagacttacagatgcttaaggaggatggaggcaaattttcaaccctgtactccaaagctgaggggagaggggatgggaaacattagggctgggttcatgtaaaggggaccagcattgtgccgacagaggctcaaccctggggaggctatactttggaagaggaactcagttgactgtctggcctggtgagtgagtcgctttctattccaggaaaatattactgtggagaaattaaaaggggagatgaattaactcctttagtcttgaaactaaagagatatgtgtacttcccctcctggaggaccccagtcctaggtagattaggacgaggaagcagagggagacaaaggcgatggaaagtcccttttaggaacccaggaatcagagagaacttgatggtccccaccaaaggcaaagaagggaggtcccactaaaacatgtgagcatcctaaaacacctgctctggtccacccacaatatttggtgaaggacatggccctccacccagaatgggcaagcaaactagaccagctttctaaggtgtgtttttcttgggtcctgtgactcttggccgtctccctgtcagaggctccatctgtcgctgcactctttcttattgagaatggcctctccgtggttctctgtaaactttccccaagaagcctgtttccatgcttcctcagcacttagcctcaccgatggatgggctctagagtagctggagggagtctgggtctgaaactttcactgagaaagtaaagttgatccgcagtatccagtggatatggcagctgggaggacctaggactgaagtactcgtcctctctttggggcctttcctgggcactcgattgaatacagaaaccctgttagcaagtgcatgcatgtatatgagtgtgttcattcagcatttccattctgaatgtatgaatagccttactctgaagactccctggagcttacagggctttctgttttcagagaaaattgcctttgtgagacaaaaatgccaagtgggcccctgaatgaggttatggttgagagctattaatattatccttattcacagagcaagatccgaattcccaaagcagagtagacaataactatgtgaagggcttagacccaaatatgtgcccacttgcaagcattccagctctatgaagaggatacagtgctaggagataggattaccctgcacattgcaaaccctccacttttccaagaccatagaaaatgtcctttgttgagcaccaactgagtgttattttcttggtccctgtggtttttgctgggccttaaatcattgtgtgatcaaagctgcaggcaacaagctaacttttggaggaggaaccagggtgctagttaaaccaagtgagtactggggcttgacccacaattgagccttgtcatcaatttgcaattcaatgtgccgtattggcccaaattaatgtctcaaacttgtctttaaaatgtttcatgttgctcttatgcataaacatgcacttatgtacaaattcagcatggataaaggatattgtcatcttgacattttctagaatctattttcttaagagaaggcacatagtaaaaggtacttttcttatttcttcacatttcttaactgattttcccaagaggcagaggaacttggacgtggcgtttctgtctattcagagtagttgatttgaatatggtcacaatagcagagcaaggacttacaatttctaaggttcaaaatattgctctctgtaccagcctgcagcctctgatgaaccattattctgatttatttcctctggccctcatttttcccaattaatgtaactgaaatattggtaaccattatcttccggttcacagaaagtgtgtgaggattaaaaagtcgctgctctgaaaaggaattgagctggagggttttcttttgggggattattgttttgttgatggtattgtctctttcattgagggagagaataagaaaggaggcatacttgaaaggcaaggtaatatgatcaatacatgaacgtgtgcaaaataaatcattaaggcattcaactagaagccaaaaaacagtatggaccccggctcagccactcactcactaggcagccatgagaagatcaccaagctctcccagcctcagttaacctaaaatgtggagattattattccagccttgactacttccaaaggatgctatgaaattcagatgagataatatatgtgaaatctccttgaaagagatgggtggtcaaatgattcatgatttttttttttttttttttttttgagacggagtctcgctctgtgcccaggctggagtgcagtggcgggatctcggctcactgcacagccgcctcccgggttcacgccattctcctgcctcagcctcccaagtagctgggaccacaggcgccgcactacgcccggctaattttttgtatttttagtagagacgaggtttcaccgttttagccgggatggtctcgatctcctgacctcgtgatccgcccgcctcggcctcccaaagtgctgggattacaggcgtgcaccgcgcccggcctcatgatttttaatagttagattttatgcaaaatttcatttgagggtaaacttaaaggtgaacaagtttaatggactttggccatggcagagaaatggttaggtttggatataaggtggacctctctaattataagaaaaaaaaggaacatgagaattggtgaacaagaccttccctggagatcttcagaaacctgaggtcactcaggagagaaatgtgtgaagttgagagcttacagtaaatggtctctgaagtttcccaccattccaaagagtgcgtgagcttaaaatttttcgtgagtttagctaaatatgtgcttagtgttagattaggtttcaaccaagcaaaagaaccctgggagaagtactctgcttggaaatgaagcatcctttggtttttgtggtacaatagatcactgtgggttttcagatggccagaagctgctctttgcaaggggaaccatgttaaaggtggatcttagtaagtattattactaatgaattcttaattgattagtttttgagacaagtaataagcttttttggaaatctaagtggactgccaaatgttctcgatttatccatatttcatggggagcagaattcttcatgccttctccatcctcacttctgccaggtagcagtttgcattgttaacagggaagcagaatggaagcttaacagagaagcagtatggaagacgtctccttagcccagtggtcagttgcatcagagaagtctgctctgaaatgcgaacactttctcttgcagctggcagccccctgcaacctcagtgccctccatggccagggcaaaagcttccaggtgcccagataacatcccaaagtcactctgagagaaaatcggtcttactttacccttttctaaccaggaatttacatggttagttttacatctaacacttcagcagggagaagacatgatctaaaggtccatgtggacactctgtgtgactcggatccaggatctgctctttcagcccctccatttatcgcaaaagggatgatgattaattcctccatgcctagacttcactttagacatcacctcagagaggcctgtcttacccagccaatctaacaagccatcaaacacagcactgcctggctgctctctaccctgttatttagcctgattttaattcacacactttcatcacttaacattatactatctgtgtatttattgtttgccttcttctagaccgtagacaccaggaggacggggacagtgtctaagtggctctcaccgtatccctagtgccggcacaatgtctttacacatcggaggtgttcagtgaacagttactgagtgaataaaggacttagcaccaactgccgctctttttcatgaaattacagagctttgctatttcatacccaaatactaaaacctactgagatttttgcaaatttccatcatttatagttatatccaaggtggatttgagtgagcaggtacatgaggtatttgcagggcctcatttcactgtgccaaccaggcagggaactgctctgatctttgggaagggaacccaccttatcagtgagttccagtaagtacctgataattattgatcatagtgcttgtacttatcctgtagtcatatattgcacaggtgaccaaatgcctcctatttctttgagttaaggaatattgacatttgatgaggaaagccatttaaacacatgggaaaattggatgttgtctctcacccctaatactccaaccatagcccctgtcctattccatgctcttaaaaaaattttaattgatagaagaaagaaagattatctacaaggatatgagcaatttgctaaacagtggtaaaatgagattatgtacaggtgttgattcctaggtaaaaatgggggtcagagctgctatcctttggctagtaaaacaagattacttggtgaaattatgtaaatctcctcgaaagaaataagtttcagagttgtctagagaatatcacttggactgttctcaggctttccactacatctattgtaccactatggtgccctgaaaagaggctttctcaggcttaattccatggcttagtctttattccagtatcaaaaagggggaatccagccagagctcccatgagggagatagctgcatgctaaccacattaatctattatcaaggtaactcggtcatttttgtcaggcagcacagtgctgtgatttatagcacattcatctttgggagtgggacaagattatcagtaaaacctggtaagtaggcaatatgtcactaaagtaggaggcttaatgtggctactgagacccactaaacttactgcagtatttggaaggcccaagtgtcaagaaattaatggtttatgcagacttaagtggattccaatgaaggaagaaatgttaaagtaatggcacagaggatagaagagctagctgtgaaaaaaaatagccatgtggatgaaccaaacgcaacagactgaaagatcctagagagttgatcctaaagaaaaaggcagaaagtctggctgagcacttccagttcttctgacctggcttgattagtgaatctgggccacagtatctttatctataaaatgaaaacatttaatatcacctcagattttttgttttaattttgtgggtacataataggtgtatatatttattttaaagataagctaatatatgtgaaagtattttgtaaattcttaaatgctatccacagtgaaaatattatttgtttatagaacaaaaaaaactatgtcagatttagaattcttttaacatgagaatttgtaggttcttagtgaaatagccatttacatgtgatctgtagccctaggcattggtaaaaagcactttctcttctactgaaatatagtggctcaaatgctacccaaatgaaaagggcaggggaagggaagtcattttgtaaaggcaggcattacagtgtgaattctgggggttaccagaaagttacctttggaattggaacaaagctccaagtcatcccaagtgagtccaatttcctatgctttcctcttccttgtgttgtcttctctcagaccgtaacatttggagcacataaagagatattatgggcctgctcttctctggctgtttcaggagactgaaaaggattgtataagaacatcctttagcatgttcttagtattgttttgtccagtgtgtgtttcttcttaatatcaaaaaaaactaagacattgcctgtgaagccaatggaaaacagtagatttgcaaagaaaagaactaaagagaagacaagtggtactttttaccaagcttaaagcagagtgggtgtcctttaatcagagggatgcttggttctgggggctggataggactcaggtaagtaacaaggctaccactgagtcactgagcttctaaaatgagttgactcgggggagcaggaagctgccactcatgatgatctgaatgctattccgtgaagtttcagattgattgaagttaaaattaggggtgacactatgtcaggaatctaaaaattgataactgtaatggaaatgaaagaagggctagctacatctgttggataaatggagttgaaaatcatgaatttgatggcgacagacccagagagttgggcaggtagaaacttcatttcaagtgatatgcagtaaataccccaaatttgagtcaaatggcctgtgtaaaaaggaagtgaaaatgtaacccgtatctccttgtaggtgaaaaggccatatctctaggtcttaggtatgaaaaggatgtgtgggcttctgggtgtttttgactgactaagaaacactgtgggatggatagcagctataaattgatcttcgggagtgggaccagactgctggtcaggcctggtaagtaaggtgtcagagaggcaacagaaagattgagggtaaaatgtcttcatgtctcaggaaatgattgtataatgcaaaatgagctggagttttttaggagcactgttactagagttctgatgtctggttctagcaaaagaaccctaatatagctgtaatccctctctagaaggaacaaggaagaggattcttctctgaaagctcctcctaagatttatccatcctctgccaaagtgtcttgtggatccaggatacttacatctttgttagcagtgctggcccaacctgctcagcctcagatcacctatccctcatttgtaaaatgaggataatatttaagctcatggcacagttgaagcccaaatgaggtagtggaatatatgcagattattaatccatttggctcataaatgaaggttttctttccttttccctatgtagatcatgggttgaaatacctaacactgcaaatcatttttgtatggggatttgctatagtgtgaattcaggatacagcaccctcacctttgggaaggggactatgcttctagtctctccaggtacatgttgaccccatcccacccatgttttccccttatctggtttaaggcttccatatgtattgcgtgttatcctcatggatttcatcatccttgttttattatcaatgttctgtgaatttaagattgagcctccatggactcttcatttaaaaatgaaaatagctaatagaagagttggaaataacagtagaactaattcactaggtcaggatggagaagggagtaataccctagacaattaggacaaacgatggtttttccagaaatagcctcactcctgtttaagcctagacgtggtctctccccgggcacccttcacattcctctaaccctccatatcccaaatttagctgtggaatcttagacaatctgtgacctatgcagctacagaaatcttttcttactgagatatctgcctatttgaaccaaaagatccttgagaatagacagtctctaatattccatgaagtgtctgatatggtccttttacaaaagtaaatacttgataaattcttgcttaattgaagttaaacacccaaagaaatcaggtttccaggccaaagggaagaagaaaattaagcaaatgacacagtacatttgagcgtgtagtggggaggaagaaatgctagattgggattcaaatagagccatgttttggtctctgctgccaactagcaatgtaacttagaccagatctcttgcctctaagcctcagtttctttatctgtaaatggggaagtgggtccaatggccctctttggcctcttagtacaaaaagtctatgaatgtatcccatttggggcacttttttctcctaggagtaactcaatagctattttaaagcttgagtgttttctaactcattagagcacatcaagaagaggggtgaagtgacaaaagggagtttattgtgaggcatcaaacactgtgatactcacgggaggaggaaacaaactcacctttgggacaggcactcagctaaaagtggaactcagtaagtatgagattctatggtaattacaaaatgtattctggtgacaataagtggaagaaaaggtgatgtaatttttgtcattgtatcttatttttaatctattactgaagcattaagaattgtgacatccagataaattagtgaaagtattcaaaggctatataagcatgctttctttagggtggaatttagctaaccactaagactttttccaagatatgagattttcagctctcttcaacgtgagagtttttaatactagtattaagctaaacgatgctcaatggaagaaaagagctagaagagcagaaaattgcaccgtcatgatcaaatagatcctttctacttccactgccatggactcagtggtgcatttagaagagggtattcaaggtcattttagccatgccccaaaaaaaccactcccaattcattccagagattgtgcccccttatgctaaacatcatccaagaagagtcagtgaagtacagagaaaggaacccagggcttcttgtttcggtccagagttctaggtttgatttggtcccaactggatgtgtgatattggaacgagtcattgcccctctctgcacctcagactcctccagtggatgagggggtcaaagccctcaaaatctgttgttctgggatttcgctattataccacccgagagtttataggactcgagagtatggaatcttgtgagtatttcataaacaaattctatgaccctcaggaaatagccctgttaatcaacaacctaacttaacatagaaataataaccaccatctcagtccctaccatgtttagatacgatgctagatgcatgacatgtagaattgttcatctgaaataactctgtgaggtaaggggaagtatcttattttacaaaagaagaaactgaggctcagagaaggaagtgcccaagatcccaaagctagtaagtaaagggcctaaatttaaacttgggtctgcctgcctgactaaaaagccctgctctttcttttttttaattttattttatttatttatttatttatttctgagacagagtcttgctctgtcacccaggctggagtgcagtgcagtctcagctcactgcagcctctgcctcccaggttcaagcgattcgattctcctgcctcagcctcccaagtagctggggttacaggcatgcgccaccacacctgaaagccctgctctttctactgcatgatgtcgtagagcttgtgctctagtttacttagaaatgagaggtgatgccaatcacagtgactggtgaaatgcttggaatttatcttttctactttagatattgctgtgagttagagagggtgcttcgggaaatcttgacatggatgccccaagtgtctaaagagttctcctcccctttcaatgacaaaacaaagtacagagttgctgggagcatttaccccaatagggagaaaagagaggggagctggctgcagccactcccttgttctgactgtccctttccttcgctgtttcttgtattttccccaggcagaccagccaccaatataactgatctacaagagcctgactcctttgtgagttatagagaaatgcagggtgaaggcactttgcacatagaactttagctctgagagacagcctcaaaatatctagttcacccctctttattttcccaataaggaaattaagacccagagaggttggctgaattgtctaaggtcagtgcgaactagggctgggactagaacctggagatcctggtcctggggccatattctgtgactgctgtttggtgaactaaacttctgataggtaggaagtgtgagttatgctcataaacaggaaaaacaaataggttttacaaggggagtataaaaatgtcctccttattactagcaccttagtataggctccctagacctgctccccagctgtggtgtaaaaatggaaggagaaggaaatggcccattttgtcgcagtgcaaatcactgtgggaaatactggaggcttcaaaactatctttggagcaggaacaagactatttgttaaagcaagtaagttccatgaaataacctgatttatattacagttgaagaacatctgttttcattgatttttttctttttagggggaaggggacatagttttgtctgccagttaaattagaagatacattggcaataataatgttgcactgtacagtatccatgggcatcactcttgcaagaaacatgtataattaacaaacagttaagtgtggatggtaaaacttccctaggtcctatctagaactgaaactctgtaattatattaataacttttttaacttgaatattagtgacatttttatataacccaaggtatacaaagcagaatcttcagttgggttctatctgatttgttgtcatcttccaatggtcttaggaaaattaaggttaaatagtaagattagatgcctcctaccactttggtacatgcatgcagacatagaaacacccttagtaactaacttgcatgtgacttggcaatcctagctatggcccagtgacagggtcccattttgtacagagttatgtcagagtgtgaacacaggctttcagaaacttgtatttggaactggcacccgacttctggtcagtccaagtaagtcaaatctgcagaaatgtgtagccctatcctcaatattgggcatatatggatataattattctggtctataatagattattattactactattttgttcttattaatcataacaatgctgctaatttcaaatatacattttctgccatattattatttttacctttaaggagaattattgtcaagatatcaggagggaaatatttgaatttcctttgagtcaagtttcttatttgttcgtcagttcccacctctctgctgagggtcatatgaacctcacgatgttttggtttttataccgccttcttattatctctcttagaaatgcttccttggtttttccttgcctaagcacttagattttgcagctcacatttacccagagtatacttagcttttaacctctcccaaaactggcctccctgtcccaataattatgcacagtaaaagtcagttcaattcagtaaatgattattgagtatcatcaacaaaccagggaatcatcattggttttaaaagaaagaaacaaagaaaagaatttttaaaaccctaagctatcttaggcttctgatctcaagaacttccagtcttatcagagaaactaagcactcataataaaaagtctaacaaaaatttatatgtgtatgtgccaagataggggggtgggtttcctgagggctggagacaggacaggtatgaccatgcacagccgcattctttggcagagaacacacatgattcccccaaatatgtttctggaaacggaattgagtctgttctgtgctgagatctttgactttcttgaggacaaaagcccccttggcagttagcatccttgagcgggggtgaggacagaaacaggaatgagtcaggcgtgagtcacccaagactctcactcagccccaagaggatggagtgactctgagtcatgccgaggcatgtctttagcatgtgctccagcagtgtgcatttatggcaaggtgaaaaatacatttttgcacatgtcactaggaaaatggtaccttcttctcaggcatggcagatgaagtaggaaaatgcccgcctgctctctggtatctttagaaatactcacacccatccagcctatgtaggatacaatgtttttcatgaagttttatgaagattctgtttttcccaaaggagaaatagccaaagctgtgtttattgatagctgtgatgaggaaaatgaaggccaacaggtagcagtggggtctggtgctgtttataccttttagggaggttccttcaagtcttcataccacccattacaaggaaaactttagcatccgcctttcagggtttccagatcttagagctactgtgaaggggatgtgtcttcagagaaggggtgggcaaaaccaggaggtttttgtaatacacttacacagtgtgactatgggaacaacagactcgcttttgggaaggggaaccaagtggtggtcataccaagtaagtgagctgggatcctcctgcacaaatggccacagcacccccatcgctaccctgtgctggagagcctcttatcatatttccatgggagcgggggaaggacatgccattcatcagtgctatatcgaagaaccttaggcggccactgtcccaaatctttgcctgtccctggtttctttcactctccccttctctgcatctccactgaccacactcccattctcatgtaagctgcccctgatcttccctgaggctggatttcagattgaacaaaggaccacagaagtgagagctggaggggaccgtggggacatcttgctcatgttgcagagggacctgatgccagggtctagcatctgtccaagaccgtgctgatggtcagtgcacagcagtggaggggccccagccctttactcccaccctgagtttggtggagccacacactctttgctaagtgaccctcaaacccagtgtgagataagctgagtgttgacagtgcccacctgctaggcaaccaagtactgagttcctgccccagctcaggactgtggcgcaggccatgacctccctgagcctcagttttcatatctctgaagtagacagcatggtctctgtttcctcccatctttcaaaaattctatggaaattattgtgacttttttctctgtaattgtagggtttcacagaggcagggccttgtctgagtcaaggtcattagaaataaaggaatccaagggctttggatgccttggcctaattctaggtggtaaagagggaaggatgaaagcacaaatcacaggaagtgcctaaatcctgcttggatttagtgttgcctcaaacagggatatgcagaaatccaaccccagggtctcccataggaagaagactaggagtgggaagtgccaaagagctctggaaaggaaaagagaacaaggagcactctgagaaaaggaggtcagaacagcttcaggaaaaacgtcacataaaatttcctttgctctctgtcctcgcagcactttcagaagctccttgcatctgactaaagagtagcagagccagaccctcagaatgtctgccccaagcaagcagagtgtggtgtttgtattggggtgctgggagcagacatggggagttgctgccctgcttctctgctgatgggaaggtggtattttcccctgggtacacgggggccaaagagctctccagtccccagcccctggctcccgcccctgggctccagcactcgggggctctaaggacagcagtaggagactttctacaactcagagagtattcaggagggtttcccaggatgttgcccaataccatggggcaattggtagagggaggtcacatgaaacaggttttatcaaaggctgtcctcactgtgtgcatcaggaggaagctacatacctacatttggaagaggaaccagccttattgttcatccgtgtaagtattatagaaatgatcaagggaaattttgcagacagattatattatggaaggatactgtagtagtgagagtttgtgttgtgatctattccatcattaaaggagtcctttgttgcctgggagtaactatcagtgtcaggtctgatgagatgattgaggctgtgccggacaagggttttgcacaatgatttcagaggacaaatccccaagttgtgaaaaaagacttcactcttggttaggtttctaaaacagaactttcttcttggcaaccaaggggtctactctgccccctcactcctatgtctcttccacctgagactctgtcaccacctcccctagaatccgtgagataccttcccctgaattagagcataccagccagggtgctgaggcactctgtggtactggaatggatggtacagggatgcgtttctgggcttctggctgcaagaagcctcatcctttcccccagtgtaaagcattgctgggaatcatcccattatgagctactatttactgaatgcctgacacgtaccagtggccattctcttgtcttttatgtaatcctcattcagtgattacacacatcctaataataggtagccgatattttgcccattttacaggtgaggaaacagaggcttgggataagtaaattatccaagattatatagccacgaatgacagagctagagtttaactcaaatctgtttgactctagggccttgttattaaccgtgccaccaccatgcctcctgcattctgtgaaggaagacttcacacctcaaaggccatctgtttggcctttggtttgcccatcctgagccttcttaccatagcgaccatggcatggtgactcagcacttctgaagagatcagcagagtcattgggttgggtggcagaatacaggtatggcagggagggaaggagaaacttagggggactgtttattgcgcatacagttagagagaaagaaaaatgtatcatcaaaccatagaataggctgcttaaaagtttttctcccaagaaactgtgagtgtatgagggtcatgggcagctgcccccagctggcagagggcaggattttgtactgtgatgtaccagggtgtggacacgggcaggagagcacttacttttgggagtggaacaagactccaagtgcaaccaagtaagtacccaaacttaggctctggccaaagacacagaaaggccctactctgctttcttagatgatgaatctgtacttcctgaactaatttttcatgtttctttatgaggcttgaatatcttgaaattttaattcctagccactagcttaatagtctgttttctaacggtagtatttgccaatgggaattggccatttcatcattgcagagacagattcctttgagacaaaagatctttatcagaaaagaaactgtgactgattatgccaaaagatttatttttgttccatttagttttcatgaaaggtgatgaattatgcttcccaaagactctgggcattggacacactttctcaaaactgcacatccaattgagagatataggaagaacttagagcctaaataatgccataaaaataataaaaagtttgtaaaaaggaaccatatagaaattaaagaagaaatgaaatagtcttaatgaaagaagataacagaactgcattagaaacgaatggaaatatttagagggtttatgtattcaacaaatatttattggacaattattttattccaagcactatgttaagtgtgaggaagggaatgggagggaagggaagggaaggaaaggaaagaaaggagaggaagtagaggaaggaccgggagggagggaagaaggaagaaaaggaggaaaggagggaaggagggaggttctctttcatccagggaaggagggagagtctctgccatctgggagctcagagtgcaaacagacaactatagcctattgtcaccacgtcatagtggaggtacatgcaagttgcaatggaagcacaacagaagacatgactagcctccaattctcattgcctggtacatacacacatcctccactataccttaagctccatgagggcaggaccctttttcatcctcacagctctacagctcagcacaatgcctggcacataggtgtcaccaaacaaatgattgtggggaaaaaaatgccttctggctagatgagttatgatttatacattaacaaatattctctaacagagagagttgttagacctcaaaaccaggagattgcagaatccatccagatgtctgtggtgggagaaggcccatctctcagggaagagcacctctgtatttatctgttcatatgtgtgcttcatcaaagcctcttctcagccatggttcaggctgaatttataaagcttgaaacctatcgtatttctcaagaatcagagatcagaggtggaaggtttacaatatctcgataagtaagcagtacaaatgagttctagcagtaaaaaagaaagaggtctaatgataaatatatgaagcctgtctccacttgagagacctcctagaaaagatttgttctaaggaaacttttctccattaggagcagaatcatcttggaaatatacagctccaagttgtgttagaaaggtgtgtacaaagaagaccaaaaattcacatttggaataaggcattaaagttgccattgtttctagtagggaaaccctgcaaagtgttggggcatcgtagatcctgcatgttgacgcctgcaactaatctgccccggagctgttccgacagtggctggagcatttgctgcacagttgcataggtgttcaacaattgccaaaataaaatgaagctatttcgtgatgattagaaagaaataatcagcatcaatgaggcctctgatgcatcttcaggagtgagtaggtggaatgaagacctggtaggtgagacttttctctcttgtcagagaaagtttgacttgggggagcctggaaaacagggacaggagatggagtgccccagccaggcttgccctgcccaggtcagagttcttgtaaagcaccatctgattgtgtgttttctggtggctacaataagctgatttttggagcagggaccaggctggctgtacacccatgtgagtatgaccctgcaagtgaccagtgcaaaaagaactgaccacttgtctatgagaaaacaggtgatgatctatagcaaacttggggatatattgagaagcactcattttccattcctacaagctctcttggtgacttaaaatgttcccatttctcatatgaaacacagaagtgccaagagccaattgcgtaaatgaaaatctgagcagaataatttatagaaacataaaaagagttccaaataatgagtgctttcaagcgaagctgataatatcggcaccagataatctgaacattcaggaaattagctaagtgcccttgggggaaagagatgagttaatggcaaacacaaattctcttttattgcagcatgtagctaaattccctggattggctaataaacatggtatggggatccctactcatagaatcttcctctctggagttaggagagttttcagcttcctcctaagggtaaaagtggcccagacccctaactgaacggcaagtataccacatgcaattacaaggtatagaggcagcaatgtagagggaggcccacagacctggggaaaatctgggctctactctcactggctgttttcaataaagcctccactttctcagcagcaaaatgactataactacatcataataatatgagataatggccagaatgtaaaaagtgatcaataagtagtagcttttctaaaatattattataattattattattgaggctttgcttatactaaggtttacactatcataaagggaaaggagaatcgcttccttgggaaataaaagatgtaagcaacaaagacccaaggagccttttagaatgttgctctgggaccccagtggcttccagcagattagcatcaagaaggttatctcaaagaccttacccacagtgggggtacagcagtgcttccaagataatctttggatcagggaccagactcagcatccggccaagtaagtagaatgaagcaggagagcaagggaggacggacaactatttcttctttgtccaaaatgccaacttgaacccaggtattttcctctgtgggctccaaaatggtttcttccacccatccccagaaaatcctcccatccagctctcggtgctctgcagacatcatccttaggctgggaccttaggaaccatgaggcaggcaatgagcgagtactcctgaaccttccacaaacatatccaagatactgctgcctggaattgaggtttttgttctagggaattattggtttattgaaatcatatgaagtcacaacctcagcccagggaatcacagcagaatggaacaggaggagaacttttgtatcagaagcgaaatttcagtgcaaaagagcagaaggtttaggcctggcgtggtggctcacgcctgtaatcctagcactttgggaggccgaggcagggagatcacaaggtcaggagatcaagaccatcctggctaacacagtgaaaccctatctctactaaaaatacaaaaattagccgggcgtgatggcacgcgcctgtagtctcagctactcgggagactgaggcaggagaattgttgaacccgggaggcagagattgcagtgagctgagatcgcatcattgcactccagcctgggcaacagagcaagactccttctcaaaaaaacaaaaaaaaaaaaaaaaaaagaaggtctaacccttaggagtgtgattatcctgttctcctgccttgtgggggagatcagtgtttctcttatttaagtaataggtaggtcctgtgagtttgtgcaatggtgtcacctacggtatgaatactggaggaacaattgataaactcacatttgggaaagggacccatgtattcattatatctggtgagtcatcccaggtggcaccacgtgcaaccccatgggccagtgtcactaatcctttctctggagatatcacttattactatggtgaggcttgctgtagatgttgtaactaattttcttacagaggtctgggaagggaaaagcattactatctatcttgaatattcatgtttctctaggtcaaacacattaaaatttgactttaatcattcaatgggtattgtaaaatgccttctatgtgactatcactctataaaatgttagactgagtatgaagtgtgagatagattcctgtcctgtcctcaagtggtataaaaactagacaaaggtactgaactattgtaaattaagcagccagaaaactattttagtattgaccagttgatgatgtcaatggacacaatagagattcagaggggatagggtgctggctgagaagttggcctagactgagaagtttcctgtggtacaaaggattcattgagccctgaaggatggataagatctgtatgggcagagaaaggagagaagggaagttctgggcgtagggaacgacaagaaagaaggcatgatcttgggaataatcaaggcacatgcaaagtagcctaagtatacatctgataataaaattggttgaaaagtagtcagagaagatgtctttttaggcatggaaaaaggaaatactagagcattcaacagaatacagaaattagggccagggccagccattgggaaactgagaatccgatttagagatgcagactagaagtgaaggtgagagcagccagctatggtgccgcagacctcccctctccttcctcagtgggctctgagaggggtcatcccacaccttagaggaggagaaacctaagggattctgtaatagagacacggggcatggtatgaaagtattacctcccagttgcaatttggcaaaggaaccagagtttccacttctccccgtacgtctgcccatgcccagagtttcctgatgctcactaaagcctcggtgggacccagagtgactgtcactaattctgatttctgggtccctagtgcccaaacacaggggacagatttaatggtaaggaagctttcaatcactgctgtgtccctagggatctaaagcactagagcacatgtgcttctgcagttcattttgaatttaaaggacagcttaggatctagaatagctgaatttccacctcaaaacattggttccgtcttgccaagcctaccttctgatatcatcagtgatgggatgtgtttttcttactagggtagaataggatgtctctccccaaaggactctggcagacagacccctaaacacctccaaattaaaagcggcaaagagataaggttgaactagacgtacatggggataaaaagtataaaaggtacatgggaatgaaaggataaaaaggctaaaaaaattaagtacctctaactcagcccctgttgccatttctcagagtcttgtgttctgtggcattgcgctttctagaccaacagtgtccaatagaactttctgtggcaatggaaatgtcctgtcaatctgcactgtcccatacaatagccaccagctacatgtggctattgagctcttgaaatgaagtttccatttttaattgaaagcattttatttcacattgactaatttttatttcaacagccacatgtagctagagactattataccagacagagcagcctagatcttctccagtctgacacccaccagccccaggacttgagtgagtgtttaaccaggactcaaagttgggtttctgccccacaaggccaccccctttcctctttaaagccaacctgcatctggtggcccctgatcccctgccttgaggatcggcacttccagactcctctccccctctgcagtgctgtccagtacccccactgatgactaacaatcagggggatgtgttggtagagctaatggctttctgtctgtcccttcccagcaaaggaactatgccttagggccttcacccagagtgatgtcaggctgcccaagcatgaggagggaagtaggcagaatcctctggagccaaagctctggatgtctctcccctctgaccatggagcccacccctgctccactgctccagggacagccctatgctgcaggcagctctgcccccactcagcatcccaggggctgatttctttggttttggatccagctggatgtctgcattgccgaggccaccagggctggctcagcaactgtcggggaatcaccagggtctgagaaatcttgtgcgcatgtgaggggctgtgggagcagagaacactgggtgggaaattctaatccccaccctgctggaaactctctggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcaagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggcgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacaggagctcaatgagaaaggagaagagcagcaggcatgagttgaatgaaggaggcagggccgggtcacagggccttctaggccatgagagggtagacagtattctaagtacgccagaaagctgttgatcggcttcaagcagggaagggacacctaatttgcttttcttttctttttttttttttttttttttttttttttgagatggagttttgctcttgttgcccaggctggagtgcaatggtgcatcttggctcactacaagcctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcacggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctcattggactctagaatgaagccaggcagagcagggtctatgtgtgatggcacatgtggccagggtcatgcagacatgtactttgtacaaacagtgtatattgagtaaatagaaatggtgtccaggagccgaggtatcgtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgccgaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctgaggtgaggggccttgaagctgggagtggggtttagggacgcgggtctctgcgtgcatcctaagctctgagagcaaacctccctgcagggtcttgcttttaagtccaaagcctgagcccaccaaactctcctacttcttcctgttacaaattcctcttgtgcaataataatggcctgaaacgctgtaaaatatcctcatttcagccgcctcagttgaacttctcccctatgaggtaggaagaacagttgtttagaaacgaagaaactgaggccacacagctaatgagtggaggaagagagacacttgtgtacaccacatgccttgtgttgtacttctctcaccgtgtaacctcctcatgtcctctctccccagtacggctctcttagctcagtagaaagaagacattacactcatattacaccccaatcctggctagagtctccgcaccctcctcccccagggtccccagtcggtcttgctgacaactgcatcctgttccatcaccatcaaaaaaaaactccaggctgggtgcgggggctcacacctgtaatcccagcactttgggaggcagaggcaggaggagcacaggagctggagaccagcctgggcaacacagggagaccccgcctctacaaaaagtgaaaaaattagccaggtgtggtgctgcacacctgtagtcccagctacttaagaggctgagatgggaggatcgcttgagccctggaatgttgaggctacaatgagctgtgattgtgtcactgcactccagcctggaagacaaagcaagatcctgtctcaaataataaaaaaaataagaactccagggtacatttgctcctagaactctaccacatagccccaaacagagccatcaccatcacatccctaacagtcctgggtcttcctcagtgtccagcctgacttctgttcttcctcattccagatctgcaagattgtaagacagcctgtgctccctcgctccttcctctgcattgcccctcttctccctctccaaacagagggaactctcctacccccaaggaggtgaaagctgctaccacctctgtgcccccccggcaatgcaccaactggatcctacccgaatttatgattaagattgctgaagagctgccaaacactgctgccaccccctctgttcccttattgctgcttgtcactgcctgacattcacggcagaggcaaggctgctgcagctccgctggctgtgcacattccctcctgctccccagagactgcctccgccatcccacagatgatggatcttcagtgggttctcttgggctctaggtcccggagaatgttgtgaggggtttatttttttttaatagtgttcataaagaaagacatagtattcttcttctcaagacgtggggggaaattatctcattatcgaggccctgctatgctgtgtgtctgggcgtgttgtatgtcctgctgccgatgccttcattaaaatgatttgg

SEQ ID NO: 37570 - DNA, 33115 bp, Homo sapiens; identical to SEQ ID NO: 35873

SEQ ID NO: 37571 - DNA, 29236 bp, Homo sapiens
aagaaccagattgccatttatgaactcctttttaaggagggagtcatggtggccaagaaggatgtccacatgcctaagcacccagagctggcagacaagaacgtgcccaaccttcatgtcatgaaggccatgcagtctctcaagtctcaaggctacatgaaggaacagtttgcctggagacatttctactggtaccttaccaatgagggtatccagtatctccgggattaccttcatctgccccccggagactgtacctgctaccctacgccatagctgtccagagaccggcaggcctcagcctaaaggtctggagggtgagtgacctgcgagactcacaagaggggaagctgacagacatacctacagatggagtgctgacagacatacctacagatggagtgctgtgccacttagtgccgacaagaaagctgaggctggggctgggtcagcagccaaattccagttgagacggatttggtcgtggacgtggtcagccacctcagtaaaattggagaggattcttttgcattgaataaacttacaaccaaaaaaaaaaaaacaacagttcttctaagtagacttataaatccaaaaaaccttatttctatttcaggagtttttttgttttgttttgttttttgagacggagtctcgctctgttgccaggctggagtgcagtggcgtgatcttggctcactgcaatatccacctcccgggctcaagtgattctcttgcctcagcctcccaagtagctgggattacaggcatgggccaccacacccaactaatttttgtatttttagtagagatggggtttcaccatgttggccaggatggtctcgatctcttgacctcaatgatccgcccgcctcggcctcccaaattatttcaggagttcttaatctttttgtgcacggacctcattggcagtttggtgaagcctatggtccctttctcagatttcttttaagtgcataattaaatacatgtgattacaagggaaaccaattatatggaaatattagcaaaacaacaaactaatatggtcataatatatgtacagccttattatcacattaaataacaatgtctaacggcgggtctagtaacaccagaaattcaaagaagtgttaaccataaatgatattctgagctatctgcaactgtaaacatgatgcaaaaatatccgtaatttttattgatcacaaagtcataggcgctgctaatgctactctggcttgttgtccacattcgtaactgaaggaaataataagtttcagttagcagtcaataaaaataatgatgtcattttatcctccttctagtgaaaggacccttctaattctatccatcaatgaactccagtttaaaacccctctctagttcaaagtcctgctcagaactgattttcgtcataaatttaaaaataaaaacactgattcctcctttgacctagttctcatctgaacctatcactatgtctccctgtttttatgcacatttatacacagaaccctgggtgtacttctgtggtttgcctagccagcactcactacaattttgccagtcaataaaaggtgaagttaaaagaaaagggatggaaacaaccaacagctccctcactttcagacctccgacagcaagtggaaagatgccaagtacagtgagtgtctgtgttaggtgggctgcccccagacccgtgtgtccagcttgtcaagcttccctgcagcacgatatctttatcagcgacactcagaagacattccatttcgttctcgcctcctatactcagttccctacctgccgggcctctcgtctctggcccccacccgaggccgccccgcggtcctcctgtcccttcccatcccatcccccacgcgtctctccctctcctcagccccaggccgccctggctcctgcgcgccgccacatctctcccctgggtctaacccagtgtcccccgacccccacctcgcccgacactgacgggaagagcccaggaccccggggtcagttggacctgacggccgggcagtcagagacaggctgcggccctaggccggagcaacccggccgcgaggcagggagccgctcacagcccgcggactaaatcgggacgcgtactcaccaagggggtcatgcgggggaggacacggaggactctgtcggaccgccactcggcctcggagccgtcgccctagccggtgactgcccccgccgccgctgccgccaccttcgccactcgcctgttggcttccctgcgtcctgcagcggcgctgccgccacgccagcgcgcgtgcgcagcgccgcgggggcctctgggagctgtagttccgcccgggcggctaggggctcccacttccgccttaggcagccctaggtcagctgccccctgaggctgtcgtgggtgtccgggtccggaatcgtcttccggaaggctgttcaccaggcctgggccctggtttccgcctgcagtaatgctggacgtgaagaatccgactgagcaagtatgtgtaaagcaaaaatgtagagcgttttatgctttctgtgacaacgctcagttgcccaggacacattattcgcatgaatgactctctctcttctctgtttctctctcacacgtacgcacacactacttacaaacctcccttccctttttttttttttttcgagacggagtctggctctgtcgcccaggctggagtgcagtggctcaatctcggctcactgcaagctccgcctcccgggttcacgccattctcccgcctcagcctcccaagtagctggaactacaagcgcccgccaccacgcccggctaattttttgatttttagtagagacgaggtttcaccgtgttagccaggatggtctcgatctcctgacctcgtgatccgcccgcctcggcctcccaaagtgctgggattacaggcgtgagccaccgctgccggcccctcccttcccttttgttctaagtgccattaattggtttggatggtatctggattttcagtgtaaaacctgccttcccacttctcagtttctaaaatcttgcttatcataaacttcaccatgcagttattttaggtaagtcaataaatgaactgtctaataatttttgtaacaccataactcatatattcagaggtcaagttagctgagttgaacagtctagaaaccttaaaattggaagatacctgcttaaaggtcactagtgcaactgttgcccaggcaggaattccctcctgtacattcagccagatggtcatcttcctgttcaacagttcaaatttcagggagctcactccctcaagtaatgcagcctgctccactgttggacagctctaaatgttagaaagttctgcctcctgctgagctgaaatctgtttccctttatttccttccattgctggtagttaggctgcctggagcaatacagaatgtcttccacttgacagatcttcaaaaaattgagaacaatgattatatcctccaatactgggagtctccaggcaaaaaaaggaaaaaagtaataatcatttccccagctatttcaaatgtcaatcaactcccaaactgctttctatctactcacctctcttgatgtcacctttaggggcatggtggcatatgcctataatcctagcactttgcgaggccaaggcaggaggattgcttgagcccagaagttcaagaccagcctgagcaacatagtgaaaccccaactctacaaaaaatacaaaaatcagcgaggcatggtggcttgcacctgtagtcccagctactagggaggctgaagtgggaggatcaccaagcccaaaaaggtcaaggctgcagtgagctgtgatcatgccactgaactccatcctgggcagcagagtgaaacctgtctcaaaacaaaacagcaacaacaacattgacagaattgcttcatatttattgccttgttttatgactacataggtagtaatagaaccacctatggtaggctggtcagatgttattgctatcgtgctgccattcaactcattcaggaattcaatcagctctgttacaagacattactcaatgcaccgctggcatgaaataagcaagaggaggccgggcgcagtggctcacgcctgtaatcccagcactttgggaggccgaggtgggcggatcatgaggtcaggagatcgagaccatcctggctaacacggtagaaacctgtctctactaaaaatacaaaaaattagccgggcatggtggcaggcgcctgtagtcccagctacacgggaggctgaggcaggagaatggcgtgaacccgggagacggagcttgcagtgagtggagatcgtgccactgcactccagcctgggcgacagagcgagactctgtctcaagaaaaaaaaaaaaagaaaagaaataagcaagaggatacaatttacaatctagggtaggatgaaactgccacagattaaggatcatcataataagccaaggtacaaagcattctgagattctcagagagaatggccttttcaagttgagggttcatgaccttatggaagaggtgacagttaggagttactggatggctggatttcaagacaagagatggcattcgtggactgctaaggaagaactcagccttagcaaaaccacattcacagtgggctctggaacactgcgtctgggtaggctggagcacccaggccagggaggaagggaaggagaggccccaaaagttgcaaaagaatcttcagggaagctgcattgcatgtgagaagtaaaaaaggaactagaatggtcagttaatcttctgagccctgttctgtcacctacaaatgaagaacttgaactaacaagcaattttcttttttttttccagtcagcacactcaaggaattcaaatctcctgctagaactatggatcactacaacagtgattcttgggaaatatggaataggtattattttcatcccttttacaaatgggaaagtaaactcaagaggtgaaaatttgctcaaaatcaataagtagtactcactgagggcagatcactgtctccctagaacctggcatactgcctagaatgtaatgtttgttttttgttttttaaatgaatggatgaatacacagtaaactctgtccaaagcccctttctttccatacacaactcagtcttccctgacatagaaggatatgaagttacttgttcatggtcacaaaattcatactggaccttgtgtagagtttagttcttcagcctcccaactccatactctattaaactactctgccttagaatcgcaaaacattttttttaatgttctttttccttctatgtgtacacagccagtcttagaagtaagccaagaaagcagatgctatggccaagtgatttaaggggcctctggcaagtatttctggacaaaaaaacactttatccccaggtccctcaaaggcccccaaacttcatcacttatattgaatcacaaatgttaacttgaggtgaaaatttaaaccaacacatagtccctgagggcgcagactccatcttattcaccactgggcgtactgcctagaatgtaataatttgtctacatttttattttagaaataggtcttgctatgttgcccaggctagaatgcagtaactattcacaggtgctatcgtgagggctcaagggatcctcatgcctcagcttcctgagtacctgggaccacaggcttgcaccgctgtgctgggctcgcctgtttgttttttgttttgttttgttttgttttgtttgagatggagtctcactctgttgcccaggctggagtgcagtggaatgatctcaactcactgcaacctccacctcctgggatcaagcagttctcatgcctaatcctcagctgggattacaggtgcacgccaccatgcctggctaatttttctttttctttttcttttttgagacagagtttcgctcttattgcccaggctggagtacaatggcacgatctcggcttaccacaacctccgcctcccaggttcaagcaattctcatgcctcagcctcccgaacagctgggattacagttcgggccaccatgcccggctaatttttttttttttttttatggagtttcgctcttgttgcccaggctggagtgccatggcgcgatatcagctcaccataacctccgcctcccaggttcaagtgattctcctgcctcaacctccagagtagctgagactacaagcgcacgccaccatccctggctaatttttgtatttttagttcagacagggtttcactatgttggccaggctggtcttgaactcctgacctcgtgatctgcccgcctcggcctcccaaagtgctgggattacaggtgtgagctactgcgccagcaaattttgtatttttagtagagacggggtttctccatgttggtcaggctggtctcgaactcccaacctcaggtgatctgcccacctcagcctcccaaagtgctggaattacaggtgtgagccatccatcaagaccaaaaagtaacattgtttaagttacaatacatctacacttaagaaagaaatatgagagttaagtgagaccaaaccataccagaaagaaaaacaggccataagaaataaagattacagagaaagaggaagacaaaagggaagaaacaaggacttcacctatgacatgattttatttcagcagtccctaacctttttggcaccagggactggttttgtggaagacagtttttccaggaaatggtggtagggggtggaggaggtcggggggatggtttcgggatgaaattgttacacctcagataattaggcattagattcccataaggagtggacaacctagaccccttgcatacgcagttcacaatagggttcgcactcctatgataatctaatgccattgctgatctgacaggaggcagagctcaggtggtaatgctcacttacccaccactcacttcatcctgtgctgctccattcctaacaagccacagacgggtaccagttcacggctctggggttggagaccccgatttatttggcacacagtttggaaaggaaaatgctgtgaaatagtagtacacgcttgactgtggaaagattagggccacatctggaagagtcaagcaaattataaactaggcagtaagtaaatacagcaataacatgaatagaaatcataattttaccattaaaaaactctaaaatagttttcatcgtttatttactttttgagacaggatctcgctctttcacccaggctaaagctcagtgacaccatcactgcttactgcagcctcaacctccctggctcaagccatcctcccacttcagcctccagagtacctggaacttcacacatgcgaagtcccttcactgtgcctggctaatttttttattttttatacagacaagatctcactgtgttgcccaggctggtctcaaactcctggactcaagtaatcttcctgcctcgtcctcctaaagtgctgggattacaggcaggaaccaccacacccagctttttttttttttttttaattctgagacagggtctctctctgtcacccaggctagagtgcagtgatgtaatcacagcccactgcaacctctactttctgggcagggctcaagcaatcctcctgcctcagcctcctgagtacctgggatcatatgcacgcaccaccatgcctggctaacttttttattttttgtagagatgaggttttgctgtgtttcccaggttagagctctaggaatcctgcaagcaaaaaaatccagtaagacccaggtggtagaaagtattccttaaaaaaatacttttcactttggagcaattaatttgttcccgtcatagccacagtccatgttctgggtcattggtggtcctacactggcccccactggcaggctcagaaataataatactgagatccatgaagctgatggagcttatgatttagggcccctcacttgcctggagactcttcaaagatcctagcaatgtattcacagtcatatggctttgcaacatttagcaaggagttaaaattatcagctggccgagtgcactggttctcacctgtaatcccagctattcaagatgctgactcaggagaattgcttgagcccaggagcttgaagctacagtgagctatgattttaccactgcactccatcctgggcaaaagagcaagacttagtctctaaaaaaatttctaaataaaaaaattttaaaaaaaacctgagaaaactgaaaatgaggaaagtggctcctatagaacaggcttatgaatcctgcaactcaaagacttcagccaaatgaagtctactgtaatccttatttttctacaagtaccagggacatccaaactgataggagctgtaattctttgttgttttttagagagagggtctcactgtgtcacccaggctggagtgcagtggcacaatcatagctaactgcaacctcaaactcctgggctccagtgatcttcctgcctcatgctcccaagtagctggaactagaggcactctccatacacgtggctaattttttaactttttgtagagacagggtgttgctatgttgcccaggctggtcttgaactcctgggctccagcaatactgatggctcacactccacactgctgggattacaggtatgaaccaccatgtctggcccaggagctgtaatgttaatgcaacataaaagtggtatattacagccgggcgcggcggctcacacctgtaatcccagcactttgggaggccgaggcgggcggatcacgaggtcaggagatcaagaccatcctggctaacacggtgaaaccccgtctctactaaaaatacaaaaaatcagctgggcgcggtggcgggcgcctgtagtcccagctactcgggaggctgaggcgagagaatggcgtgaacccgggaggcggagtttgcaatgagccgagatcgcgccactgaactccagcctggtcgatagagcaagactccgtctcaaaaaaaaaaaaaaaagtggtatattacttgtatttgaatttaacccatcgttcattataacatatgaaatatcttaccttggccgggtacagtggctcacgcctgtaatcccagcaatttgggaggccaaggcagacagatcacttgaggtcaggagttcaagaacagcctggccaacatggtgaaactctgtctctactaaaaatacaaaaattagccgggcatggtggtgggcacctgtaatcccagctactcaggaggctgaggcaggagaatcgcttgaacctgggagacggagatttcagtgagctgagatggtgccactgcactccagcctgggtgaaagagagagactctgtctcaaaaaaaaaaaggaaaggaaaaaaaaagtcttaccttaatgcaattatatatctttcactgacaatctttttgttctcttgcattacttttacttttctttttaaagatcttcaagcttgataaggtcctaatagataaacagatgtttaaataaaaagaagatgtagatgaaaaaactaacaatttactttttttttttaaggctattcaagtgaagcagtggagtggacataatttactttttgaaaaacataaaaatcagcaattttttcctccatcccctcctatccaaaaatcagcaattttaatggttcctgaatattttatcatactgatgtactgatgtatccttcttttttatttttttatttatttatttttggtttagacagagtatctctctgttgcccaggctggagtgcaatggagtgatcttggctcactgcaacctctgcctcccaggttaaagtgattctcctgcctcagccccccgagtacctgggatttcaggcacgcaccaccatgcctggccaatttttgtagttttagtagagacagggtttcaccatattggccacactggtattgaactcctgacctcaagtgatctgcctgcctcggcctcccaaattgccagcattacaggcatgagccactgcgcccagccatactgaagtatcctaatttttcacttcaaaatggaaattttttatttctgatgacaaaactccatctctactaaaaatacaaaaaaatcagccggatgtggtggtgcatgcctgtaattccagctacttgggaggctgaggcaggagaatcgcttgaacccaggaggctgaggttgtggtgagctgagatcatgccattgcactccagcctgggcaacaagagtgaaactccgtctcaaaaaaagaaaaaaaaggaaaaaataataaagcagattactcaaaagtatgatagtactataccatttattatttatttatttttttttgagacagggttttcgtcttccacccaggctgaagtgcagtggtgtgattgtagctcattgcagcctcaaactgctgagctcaactgatactcccgcctcagtctactagctgggactactggtgtgcaccactgtgcttggttaattctattattattattattttatttttatatttttgtagagatggcgtctcgctatttgcccaggctgctctcaaactcctggccccaagtgatcctcacaccttggcatcataaagcactgggaacacaccttgcccagcctacaatatttttttcttttttttgagacggagtctcgttctgttgcccaggctggagtgcagtgacaagatcttggctcacggcaagatcttggctcactccaacctccgcctcctgggttcaagtgactcttctgcctcagcctcctgaatagctgggactacaggtgcctgccaccatgcctggctaatactttgtatttttagtagagataggggtttcaccgtgttagccagggtggtcttgatctcctgacctcgtgatctgcccgcctcggcctcccaaagtgctgggattacaggcatgagccactgcgccaggccctgctttttttttttttctaacttaacaatatgtaacaggtttggtttgtgaacttgatagactgattctaaaacttacatggaaatacaaaacgccaagaatagtcagaaacattcctgaagaagaagagcaatgtggaagcacttgttctaaacgatatcaagacatcataaagcactctgagtatacagatttaaaaaataagtaagtaaataaataaatacatcagaaagctatagtgagacaaagtttggctgggcatggtcctgattacaaagtcctgtaatcccagcactttgggaggccaatgtgggcagatcacatgaggtcaggagttcgagactagcctgaccaacatggtgaaatctcatctctaacaaaaatacaaaaaaattagccgggtgtagtggcacacacctgtagtcccagctattcgggaggctgaggcaggagaaccgcttgaacctgggaggcgggggttgcagtgagctgagattgcgccattgcactccagcctgggtgacagagtgagactctgtctcaaaaaaaagaatatctttttttttctttttttgagaaaagaaaactacttgggaagctgaggcaggagatcacttgaacccaggaggagaaggctgcagtaagctgagattacaccactgtgctctgatcctgtctcaaaaaaaaaaggccgggcccagtggctcacacctgtaatcccagcactttgggaggccaaggcgcgtggatcgcgaggtcaggatattgagaccatcctggccaacacggtgaaacccatctctactaaaaatacaaaaattagctgggtgtggtggcacgtgcctgtagtcccagctggctaaggcacaaaaattgtttgaacccaggagacagaggttgcagtgagccgaggtcatgctactgcactccagtctggtgacagagcaagactccatctcaaaaaaaaaaaaaaaaaaaaattaaaacatccagcgtggccaggcacggtggctcatgcctgttatcctaacactttgggaggctgaggtggctagatcacttgaggtcaggagttcaaaaccaacctggccaacatggtgaaaccaaccccgtctctactaaaaatacaaaaaaaaaataaaataaaataaccgggcgtggtggcgggcgtctgtaataccagctactcgggaggctgaggcaggagaatcacttgaacccaggagacagagattgcattgagctgaggtcataccactgcactccagcctgggcaatagagcgagattccgtctcaaaaatatatataataaaataaaattaaaaaataaaacatccggcacatcatacataaagggtagctactctttacatatcaacaaaaggcagctccagctggacgcagtggtgcacacctgtaatctcagccctttgaaaggcctacgcgggtggattgcttgaggtcaggagttcaagaccagcctggccaacacagtgagacccccccccccccgccaccgatctctactaaaaatacaaaaattagtcgggcttggtggtgcatacctgtaatctcagctacataggaggccgaggcaggagaattgcttgaacccaggaggcagaggttgcagtgagccgagatcacaccattgcactccagcctgggcaacagagcaaaactccatctcaaaaaaaaaaaaaaaaggcagctccacaggtactgatttgtgacaatctccaagaaatgcagttaattgaataaagacacagaaccatatatgcactatgcttcagtgctccatcactggttttaaaacatggatatggccgggcgcgtgggcccacctgtaatcccagcactttgggaggccgaggcaggtggatcacctgaggtcagaagttcaagaccagcctggccagcatggtgaaaccccatctctactaaaaatacaaaattagctgtgtgtagtggtgcatgcttgttatcccagctacttgggaggctgaggcaggagaatcactcaaactcaggaggtggaggttgcaatgagccaagattgtgctactgcactacagcctgggagacaagtgtgaaactccatcacaaaaaaaaattaattaaaaaaaattaaaacatgggtatactcagacacacacacacacacgtgtgtgtgtgtgtgtgtgtgtgtgtgtagatatacatatataattttttttttttgagacagagtcttgctctgttgcccagactggagtgcagtggtgtgatcttgactcactgcaacctctgactctgaggttcaaacaattctcctgtctcagcctcctgagtagctgggattacaggcgcatgcaaccatgtctggctaatttttgtatttttagtagagacagggtttcaccatcttggccaggctggtctggaactcctgacctcgggtgatccgcccaccttggcctcccaaagtgctgggattacaggcatgagccatggcgcctggcctacattttttgtatgaataaaacatttctaggccgagtagggtggttcacacctgtaatcccagcacattagaaggctgaggcaggaggattgcttgagcctgggagttcgtgattagcctgggcaacatagtaaagcatttctacaaaaaatgaaaaaattatggccaggcacagagcctcatgcctataatcccagcactttgggaggccgaagcatgcgaactgcttcagcctaggagttcaagaccagcctggacaacacggtgaaaccctatctctacaaaaaataaaaaaaattagctgggggtgatggcgcatgcctgtagtcccagctacttgggaggatcatttgggcccaggagattgaggctgcagtaagccatgatctggccactgcactcaagcctgagcaacagagtgagatgttgtctctaaataaataaaatttaaaaattatctggccatggtagtgcacacctgtggtcccagctactcaggaggctgaggcaggaggatcacttgagcctaagaggtcaaggcttcagtgagccgtgatcattccagtgcactccatctcaaaaaataaaatagataggccaggtgtggtggctcatgcctgtaatcccagcacttcgggaggccaaggtgggcagatcacaaggtcaaaagttcgagaccagcctggccaatatggtgaaaccccttctctactaaaaatacaaaaattagctgggcatggtggtgggcgcctgtagtcccagctactcaggaggctgaggcaggagaatcgcttgaacccgggaggcagaggttgtggtgagccgagatagagccactgcactccagcctgggcaacaaaagtgaaactctgtctcaaaaaataaaaataaataaataaataaaataaataaaacaggaaaacacacacacacacacgtattgtgtgtgaataaaacatttctaagctggccacagcagcttatgcctataatcccagcactttgggagggtgaagcagggggactgtttaaggccaggagttcaagaccagcttgggcaacatagctataccctgtcactacaaaaaataaattgccgggcatggtggctcacgcctgtaatcccagcactttgggaggctgaggtgggtggttcacaaggtcaggagttcgagatcagcctggacaagatggtgaaaccccatctctactaaaaatacaaaaattagccggatgcgatggcaggcacctgtaatcccagctacaggttgggatccggctgaggtaggagaatcgcttgaacccgggagacggaggttgcagtgagccaagattgtgccattgcactctagcctaggcgacagagcaagactccatctcaaaaaaaaaaaaaaaatattagtgctgtgtggtggcagacacctgtaggcccagctacccagaaggctgagacagaggattgcttgagtctgggagatgggggctgcagtgaactgtgattgagccactgctttccagcctgggcaacagagtgagatctgtctcgaaaaaaataatcaattaaaaagtaaaacatttctagaaggctccacaagaaagtggttacagtggttccctctatcagtgtaggggaacagggctgaggactgagtggcagggagacttattggaccctttgaattttatgccttgtatatacatttactattttaaaaattttaaatttaaggccaggtgcaatggctcatgcttgcaatcccagcactttgggaggctgtggcaagcagattgcttgagcccaggagttggagaccagcctggacaacatagtaaaaccctatctctaaaaaaaaaaaaaaaaaaaaagaggaaggaaagaaatgagaaaagaaaaacaatttaaatttaagatatatcaaatattatcaaattctatacaggtagctcgtcatttttttttttttttttttgagatggagtctcgctctgtcacccaggctggagtgcagtggcatgatcttggctcactgcaagctccacctcccaggttcacgccattctcctgcctcagcctcctgagtagctgggactacaggtgtccgccaccacgcccggctgattttttgtattttagtagagacggggtttcaccgtgttatccaggatggtctcgatctcctgacctcgtgatccgcccgccttggcctcccaaagtgctggggttacaggtgtgagccaccgcgcccggccagctcttcatattttgcagcttattttacttcaaaggaaactataagacagaaggaagaaaaattaaaagtagtattttggccgcgtgtggtagctcatgcctgtaatcctagcactttgggaggctgaggcaggaggattgcttgaggccagcaattcaagaccagcctgggcaatagaaggagaccctgtctcaagataaaagaaagaaatttaaaaaataaaagtagcatttttttatataaaattaagtgctttccagttaaacactttttgagacagtcttcctatttctcccagggtagcctcaaactcctaggctcaagcaatcctcctacctcagcctctggagtagctaggactacagggggtgccatcacacccagcttcacttttacttatattaccttatttcttttctgttgttcttatttttctttttaagtttacatggacatctctaataccgtatattaccttacttgatcatgacaacagtcttggccaggcacagtggctcacataatcccagcactttgggaggccaagtcaagcagatcacttgagcccaggagttcaagaccagcctggacaacatggtgaaaccctgtctctacaaaatatacaaaaattagtaggctgtggtggtgtgtgcttgtagtcccagctactcggggggctgaggccagaggatggcttgagcctgggaggttgtggctgcagtgagccataatggcaccattgcactccagcctgggtgacaaagtgagacactgtctcaaacaaacaaaaaccagccttgttaagtggcagaattatatccattttacacactcataaacagagcctcagagagattgacttgccataagttacacagccagtaagtaacacaactggaactcaaatagttttagcgcttccaaatcctatggtcttgcctctcttttacgttatctaacacagtgtgccctcctaaatgccttcggcacacacgcacaaaatgtgatagaaaatgcactatttctatgtatgtgtggagaagggaaagttctctattataaatttacttttagaaactgaagacaaggaaggaaattaattgcatagcacattgtactttcagaagtaccaaaaaaaataaaatacatgatttatacctactattgcttctggctcaggtgttaaggtgacacttttgttttattcgagagttgtttgatgaagggtgaataaattattcttagcaccttaataaagacatctatgtgggctggatgcagatggctcacaactgtaatcccagcactttgggaggccaaggcgggcagatcacgaggtcaggagtttgagaccagcctggccaacatggtgaaacccctgtctctactaaaaatccaaaaattagctgggtgtggtgctgtgtgcctgtaatcccagctactcgggaggctgagacaggagaattgtttgaacccaggaggcggaggttgcaatgagccgagattgcaccactgccctccagcctgggcaacagagcaagactctgtctcgaaagaaaaaaaaagacatctatgtgaccaatataggattaattagatgtaccatttattttttattttttgagaggtgttttcctttgttgtccaggctggagtgcagtggcacaatcattgctcattgctgcttcaaactcctgggctcaagtgatcctcccacctcagctttctgagtatctggaactacaggcacgcaccacaatgactggctaatttttaaatattttcacagaaggaggcgatctctctgttttgccgaggctggtctcaaacacctggcctcaagtttccttccacctcgccctcccaaagtggtgggactatgggcatgagccgctgcacttggccttacttctaaaatttcttctcacgttatatttctatgattagcaatggcattaccactgttctacaaccttcacactactttcacatacaatatctcatttgatccttgaagcagtccagtaagacaggcaggacagaaattcctgacattcaatagattaagaatctgagcttggctgggcgtggtggctcacgcctataatcccagcactttgggaggccgaggcgggcagatcacctgaggtcaggagttcaagaccatcctggccaacatggcaaaaccccatctctactaaaaatacaaaaattagctgggcatgatggtgtacccctgtaatcccagctaccaggaggctgagacaggataatcgctggaaccggggaggcagaggctgcagtaagccaagatcatgccactgcactccagcctgggcaacagagcaagactctgtctcaaaaaaaaaaaaaaaaaaaaaaaaaaaaactgtggctctgagaaattggtttttgtcaaagttatgtgccttatcacctagttgaatgttctctctaacaaaacatgtggaaaattctcaattatcaggatctaaatgttaatattaaacttgtaaattacataggtcctttcctttttcttcctgctggatgcttgtcatttattattagtcctctttcacaaaggaagatttattttttactttttatttttgaggcagagtttcgctctgtcgcccaggctagagtgcagtggcgcaatctcagctcactgcaagctccacctcctgggttcacaccattctcctgcctcagcctcctgagtagctgggactacatgcgcccgccaccgtgcccggctaattttttgtatttttagtagagacggggtttcaccgtgttagccaggatggtctcgatctcctgatctcgtgatccacccgcctgggcctcccaaagtgctgggattacaggcgtgagccaccgcgcatggccacaaaagaagatttaagagctaaatgacatccaatcctaataagtcttacctctgcttaattagctttctgagatcaggtaggaaatggaaagcaattttttttttttttgagagagagtttcgctcttgttgcccaggctgcagtgcaatggcatgatctcagctcacctcaacctccgcctcccgggttcaagtgattctcctgcctcagcctctcgagtagctgggattacaggcatgagccaccacgctgggctaattttgtatttttagtagagacggggttttccattttgaccaggctggtctcgaactcccgacctcaggttatccgcctgcctcggcctcccatagtgctgggattacaggtgtgagccaccaggcccagcctggaaagcaattttcttacccataggagcacaagtgaaatgggctggtttaaatttctggataaaaatttatatttgcatatcatctgttatcaaaatatttacaaaatgtgtaactggagctggatgtggtggctcattcctgtaattcccacactttggaaggctgaagtgggaggattgcttgaggccaggagtttgagaccaacctggttaatgtagctagaccccatatctatgaaaattataaactttaaatttaaaacccaaaatatgtgactactctatatcctaaaacaaaatgtaaggttttttttttttctttttagacagtctcaccctgttgcccaggctggagtgcagtggtgcgatcttggctcactgtgactttcgcctcccaggttcgagtggttctcatgcctcagcctctcgagtagctgggattacaggcgtgtgctaccatgcccagcaaattttgtatttttattagagatggagttttgccctgttggccaggctggtctcgaactcctgacctcaagtgattcacccaccttggcctcccaaagtgctgggattacacatctgagccaccatgccgaaacccaaaattaagtcttataaatctgaagctcaagatgacaacctatagaggttaaaaatcaaactgccaaggctcaaatactggctcattatcttaggtgtgcaatctcctgggcaagtttctttacctcttggggcttcagattccttcactctaaaataggggtaagaaaaaaatgcttttttgtttgtttctttttgtttttgtttttgtttttgttttgagacagagtctcgttctgtggccaggctggagtgcagtggtgcgatctcagctcactgaacctccgcctcccaggttcaagcgattttcctgcctcatcctctgagtagcagtagctgggactataggcgcgcgccactacacccaactgatttttgtatttttagtagagactgggcaccatgttggccgggatggtctcgatctcttgacctcgtgatccgcccacctcggcctcccaaaatactgggattacaaaaaactgctttcttaaagataaaaagagataatgcacgtacgtctttagcacagtgtctaacagttaagtattgataacttgacctggatattatttttggcatttaatgttcagcaagctagttttgaccatgtactttcctattcgtaagtgactgtgctttggaatatactagaaaatgtatgtaaaatgtctggttttaaaaagatgaaaccacaatatattcaattccctttggaagttagccatgtatcgcttttctaaattttacaaaaaggagagttacaaaacgttactctgttaatcaaggataaggctgaaatggagagtttttttttttaatggaaatggactgcactataaaaacatttgattgaaatgaaagaagctgtaatgtggtcaaatgatgatttctatcttaatgctggactgatgcaagccaaagaagggtcaatgttgccgcaggattacaagccctgctgaaagagatgcatgatgcaacctctgtagtgaacagagtcaactcttgagtcaccagtctaacctttgagaagcactaaggaaaaagaaaattcttgagtactgagtcacaggctcaacatcttaataaagtgtgtttaggatgttttagtggtatctggacacagtatacccatgaatctcaaatatttcatatcagagctttgccctttccatagtaggtcctccaaaaacattcctcaaacaaatgaattttttttttttttttgagatggagtctagctctgctgcccaggctggagtgtagtgacgtgatctcggctcactgcaacctccacctcccgggttcaagcgattctcctgcctcagcctcccgagtagctgggactacaggcatgcaccaccacgcccagctaatttttggatttttatagagatggggtttcatcgtgttaccccggatggtcttgatctcctgaccccgtgatccgcccacctcggcctcccaaagtgttgggattacaggcgtgagccaccacgcccggccacagatgaattttttgttttaaagttaagagatcaggcacagtgtctcacacctgtaatcccagcactttgggaggccgaggtgggcagatcgcttgaggttgggagttcgaaaccagcctggctaaaatggtgaaacctcatctccacaaaaaaaaaaaaaaaaaaattagccaggcatggtggtgcgtgcctgtaatcccagctactcaggaggctgaggcaggagaatcgcttgaaccccggaagcggaggttgcagtgagctgagattgcactactgaactccagcctgggcgtgacagagtgatactccgtcttgaaaaaaaaaaaagtattggcaatagagtgaactccacctggttatcaatcctaactccatcactcaccagctctgtgacttgtttagttatttaatctttttcagtttcaatgtcctcatctggaaaacgggaaatgcctaccgagtattgaactgtcaagactaaatgacacatgaaaagcacactgaacaatgcttaatccacggtaggctttcagcaaatagtggtctctattattttttgcaacaggatgttatataagaataaggcattatcaagacgattttcgcctatcaaatgtgttgtctgcgtgtacatcagaccttttcctggaatgaaggtagaaaagtatcaacaataaaggatggagaaagccccgtaaatgataacctttgccccagagggaaaggatgggcagcggaggggaaagtaaagggtggcaagctagaaaaattagacatccagtgtgggagggctggcactggagtgggttgccacagtagggaggggactcagagctggaggcaattcctttggccgggcttgtcctgcgacttaccgtggggcagcgcaatgtggagaggcctggtaaaatggctgggcaagggtgcggaggggacataactggcaggaaggagtcatgattcgtggtcgaacagagtccagaccagctcgacctgtgagcaacgaacggccctgagactcgcataccccaataccggtagtggccgtgaagggcaaagaaatgtgttctgaggcgatcccagcatctaagctgcgactggtctactcagagactggatggaagctgggaagagaaagctgcttcccgcttcggggtgagggatggaggaagggagaacaagcagtagagaagaaaaagtttcagatcccacagccccggggggtcactcctgctggacctactccgaccccctagggccgggagtgaaggcgggacttgtgcggttaccagcggaaatgcctcggggtcagaagtcgcaggagagatagacagctgctgaaccaatgggaccagcggatggggcggatgttatctaccattggtgaacgttagaaacgaatagcagccaatgaatcagctggggggggcggagcagtgacgtttattgcggagggggccgcttcgaatcggcggcggccagcttggtggcctgggccaatgaacggcctccaacgagcagggccttcaccaatcggcggcctccacgacggggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctggtaagtggggttgcggatgcagggggacggggcgtggccgcctggcctggcgtgagaagtgcggtgctgatgtccctctgtcgggtttttctgccagcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggttcgaccgggtttttctcatccagttagagaacgggtgggtggtgggagtatttagagttataagtctctggaaaagtgttgagacaacagttgaaggttatagacatgatgtatgtaataactttaatactattagtatgttacaaaacttaagacagttgctgtcgtactgtctacgatagtttaggaataaaagaccgattaaaactgaactttgtaagacacctatactccctgaagtatttctagtcaatttgcagccccaagggaccaaaataaaccaaattgtggggatggtagtgggtcttttaaactttgagatgtcattgtatctgtgtctgaaaacaataattctttaaaataggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggtaaatatttctagaacaatgttaagtattttttgatcattagtattctcggttggctgttatgtatagaagccttcgtgaagggtttcaaaaattttaatcagaatggtattcatgcttgtcaggtttaattattgagtcccttactataagccaaacaaaatagacttttcatgtattatttaatgcttacaattccagggacataaaattttatatgttgtattcatcaataagttggcttaaaaactaaagtgatggtttgactgtaattttttttttttgagatggagtcttgctctgttgcccaggctggactgcagtggcacgatctcagctcactgcaacctctgcctcccgggttcaagcagctctcctgcctcagcctcccaagtaactggaactacaggcacaccaccacacctggctaatttttttttttttttttaattttcagtagagacagggtttctccacattgcccaggctggtcttgaaatcctgccctcaggtgatcctcctgcctcagcctcccaaagtgctgggattataggcagaagccaccgcctggccagactgtaatttaaataagggttaaactatgtgacaatacacttaattatcttttatccttttaggttacccatgcagttgttactgtaccagcctattttaatgatgcccaacgccaagcaaccaaagacgctggaactattgctggcctaaatgttatgaggatcatcaacgagccgtaagtatgaaattcagggatacggcatatttgccaaatagtggaaatgtgaagtactgacaaaacttttccctttttcaatctaatagtacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggtatgttccttgttttctgctttgctaatgagatctccttagactctgaattcaggacattgcatctagatacttagataacagacatcacagtaaccatgtcttttttctaggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtaggtcatcatcgcagcatctttcttagtgattcagtagcttgatggaagactcattagctattgctttagaaaataccagaatatgagcaacaaggtcacacagctagtaaagggtataagtgaagacaagactggggtagtctcaagatcattagcaactgtttaattcactgcctttaaaatgtgtgtgttagaacctaaccaaatgttagagagataaactttacatagctcatagggagaacttgaattaaaagttaaataacttatccttacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtaattacttaagtttgttaatatcatggctttttttttgagatgaagtcttgctctgttgcccaggctggactgcagtggcacgatctcggctcactgcaaattctgtctcccgggttcaagtgattctcctgcctcagcctccagagtagctgggattacaggcgtggaccaccacacctggctaatttctgtatttttagtagagatggggtttcaccatgtttcccaggctggtctccaactcctgacctcaggtcatctgcctgcctccacctcccaaagtgctgggattataggcgtgagccaccacgccagatctatctatcatggcatattttaaaagaacatgacttaatatgtcctattgaaatggctagggaactaagtaactgctgttttcagatggaggtcttaatttgaataatgttgatattagatatttagcattcttttttttttttttttaatggagtcttgctctgtcgcctaggctggggtgcagtggcatgacttgcaacctctgcctcccgaatagctgggattacaggtgcccaccatcacgcccggctaagttttgtatttttagtagaggcggagtttcgccatgttggccaggctggtcttgaacccctaacctcaggtgatccaccgacctcggcctcccaaagtactgggattattacaggtgtgagccactgtacccagccaatgattagcattctcactaataatagcatctgagctggctcctagagtacaagaaaaaggagttcacagtactttaaaatagataaaattcagttgagttagtaacctaactcattgttagtactagttgctgctccttgtagaccaatatgaaattacttttagctcgataaaaccaaaagtgtcactttatgcttcagactgaaatgcggggatctagatgtgctaatgcttgtcagtaacaactaacaagtttttctgtatgtaacttctaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttc

SEQ ID NO: 37572 - DNA, 35741 bp, Homo sapiens
ctttccctctcccaacatggcggcctcaggtgagcgagcagccgagcgcggccaaggactgggctctgaaacccccctccgagcgtgatccactgatttcctgaagtcggggaattgctggcactggttcctttctgaattgagggctgcggcaggctggcggcgtggccctgttaggttactgcctctggatgtttgggggggaggggaaggacaccttcccctccccctcacactcttttcaccctttctgcgcgagattggaataggcagtaatggtagactctggcttgaattggggaaggaggcgcagaaaggtgtgcgggtggtgcgaggccttttcgtagacgtgaatcaccgtgcccgcgtgaaggcgtggaggaaggaaggaggcggttgctgcgcggacgagtgcacattagactacgtctccaaggcgcgaggctgtagcggaccggagtggggggtaggggagtaagtgtggtgggggggagcagttggaacgcgagcgcgagttggtggaggggcgggggaaggcagcggtgcgcgtgcgcggtaggagacacgagggtagtagagacgggcgcgccttcaatgcgtgcgctagaacccagatgggaagctttttaacgcgcctgtgttgcgcacttatgtccttttaggttgtctcttccctttctagagtgtgggccctgtgcctgtattcttctaagggtgtgtgtgttagccttggaggttggtgctattggcgttagatgggggtggggaatccagttaggtgcgcccacgtgttggagaagcaccggtgtgcacctagatttccttctaggcttttttctcatactcaattggaggcattttttactcagcgcagctatatgccaggatcaggtttcgcttccggcgcttccatgttggttgaatttggatagctccaatggtagatttcagccttttttttttttttttttttttttttttaaggtaactgtgcaactaccagcaggtacttttaaaatagtgcttactaatggctggagttgcttacttctttagacaaccttggaggggagtatcagtgccttgcaagtctaattacatttctaatgggcttataaaagcagtgatgacccaacatcttgtagcattgattttagtttgaggaatatagtttgttttctctggcatgaccttgcattcttcaaaacattatttgaacttctatctctgggtgctcatttcttacctagtaattcatcgtctctattacaaagaagctaagggttttggttggctttggaaaatgttgagaaatttgaggtgcatttgaacatctttcattggtgtaacgcttgacagttgaccaagcacttttgtgcatgttgtctccttccatcctgaggtactgcagagagctagtggtatttctcagctaaggaatattatttaaggccacactgctctcagctggcagagcaaggtcataatctttgagactccttagcaacttaaaagtatcaaggtgtcatcatcagtttaggacgctgcccgaaagcatctgaagtttacaaaaatgttcatatttttttctccagtgggctagtaaaagtcctaaatatattttaaactaaccattgcttaaagtacttacttggtctggatttgccaccttaacagtttagtatcgtaatttagtgaagaaaatctgtgttttcttaacttttgtgtaatttttagaggcggaacataggacagcaattcatgtccttcgttttaccgagttgagggaaatccagactgataaaagggatttactctgacgtcccattctcttgttcttccatatttactctacccccttgaaaaccctcatctcctttaattcacttcagtaaatctttttagctggtactggtatctgagcacaagtcacatctttcagtctgttcttgaggaatctggggtttatcggattgtttccccgctcctctttccagtcacactggctttgtgaagtaaccagtattccctgatgtgggaaatggatgttatgtgttctgtgtgaaaatacataaaacaacttcatacgcctcttttactgttaaatgagaccaaaaaattctttgcagcaataccagtttccagtgtgatccattattgaccttcaagaactaaggtaggtctcagaactaactatagaatgaggatagtttgaattcctagaaacttgatacattgagccagtacacttaattccttgctttgcttcttaaaaagaattcttaaaggccgggcgcggtggctcacgcctgtaatcccagcacttcgggaggtcgaggcgggcggatcactaggtcaggagttggagaccaacctgaccaacatggtgaaactctgtctctactaaaaatacaaaaattagctgggcgtggtgtcgcgtgcttgtaatcccagctactccggaggctgaggcaggagaatcgcttcaatctgggagggggagattgcagtgaaccgagattgtgccattgcactccagcctgggcaaaagagcaagactccatttcaaaaaaaaatcttaaaaatacgaagtttttcatttttcttaaattttcattgtgactactttagtagacttgccagtaataagccagttaccgcttgaatctcagtttctttatctggaaagtggtcattatttatctgctgtccccttacctagagggaatcaaatgcgtttgatacaggttaacatttaaaatgctttcaaattgggcagggtgcagtggctcatgcctgtaatcccagcactttgggaagctgaggtgggtgaaacacctgagaacaggagttcgagaccagcctggccaacatggtgaaacccagtctccactaaaaatacaaaaattagcggggttttgggctgggcgtggtggctcacgcctgtaatccaggaggcagaggttgcagtgaattgagattgcaccactgccctccggcctgggcgacagagcgagactccgtctcaaaaaaaaaaaacaaaaacaaactttaaaattggaaataacatatgtaagctcatgcacaggcctttcatttccataatgcttcaaaatgcagtcctgtgtgacatcttatttgattatttttatagggagaagatgctctgcagtggttgttttcatacactgctgactctcacagtgaaatggttttaaggggtgccattatatattgcttacagattccctagtgtcaagttccatcctctatcatgtatatgttattctgtgagtaagatacccagaaggccaaaattaaaactctttatgaaagtttaaatacaaatacagaatagtgtcaattaagataaagcagtgtttctaagtaatgtcattgaaaaaagaggtatatttcatctcaaaacattctggaattctcttttcgtgatggtagaggaaataactgaacttgagtacagtattttaagtaattatttgtaattaggtttgccttatgtacatttatgagccagtttcttaaatttgtagtagatactgctatggtcctgatagtgggaaagtaccaaatcaagaagtttaacttgaatttgtgtacctcctgtctcccattttgtgtaatggttagcatggcatgcattgggcacttattttgtttgattatgtatatgatcaaattgagtatccctggagggataaggaaaaggtagtatggcatcttctgtcaaaatgaagtaattgggcacagagaggtcatgtaactgaacccgtacgggggtcaagatggtggagcttatgagttttgactcagtctttactatgctaaacttacccaatccccaactaaatcaaaaggtggcttgcactgggatctttttgactttacaatgggtttatccggatagtaaatgcatttttttacttgagaagggtttatcctgacagtctcatcataagtcagggagcatctatatagtgcagtaaaggtgaaggtgaaatattgtattacattgcatgaaatgtcttttcatggctgggctgtaaacaccaatataattagtctaattctaggcactctgggtggatcgattgtgtttatgcaatgttgttggtttagggaaacatttgttattcattatttaaagtagcttttgttttgtttgtttttgtttttgttttgagacagagtctcactatggctcaggctggagtgcagtggcgtggtctcagctcactgcaatctccacctcctgggttcaagcggttctagagatggagtttcaccatgttggccaggctggtctcgagctcccgacctcaggtgatcttcccaccttggcctcccggagtactgggattacaggcatgagccaccacacctggcctaaagtagcttttaattatggagaatgtggcagaactcacttttagtaacagctttattcaatgtaatttgtataccataaaatttacacttttaaagtatacagtttggaccgtgtgcagtggctcactcctgtaatcccagcactttgggatgccaaggcaagaggatcacttaagcccaggaattcaagaccagcctaagtaacatagtgagaccacgtctctacaaaaaaaattttaaaaattagccaggggtggtggcatgtacctgtggtcccagctacttgggaggctgcagtgggaggattgcttaagccctggaggtcaaggctgcagtgagccattatctcactactgtactccagcctgggtgacagagcaagaccctgtatgatttggtggggtttagtatattcagagatgttcaaccatcattattatctaatttcagaacctttttatcacccccaaagaaaagtcctttatataggactaacaattccttttcatttatctttttatttattgaagtgaaacatcacttagaacatggttctcagctaagggacagtcttttcatcccaaaccctcatcccaccccagagcatttggcagtgtccagagacgcttttggttgtcagagtggaatggggatcggggattactattggcatctaatgagcagaatcagagataactgctaaaatccccccatgacaaattacctaagctaaaatatcagcagtgctgagatagagaaactctgagttaagaagtaggctgtatttattttagtatctattataacaaatcctgtttattaagaaaaccatgaatgtgttgtctcttgtttaacggcttctggacttagcaatatttccgtttttaagatcttttattaaacctgtatgggtatataaagagctggaggtgtgttttccccactgtagaccatgtataaataattgggacaggttttgttttgtgaggtgattgatttgttaactttttaaccagttcacataagatttagagaaaattaaagaattggaccagttcattgttgaattgcaaaggattgataaacctggagcattaaacagtgctttacttataaagcagagggaacactgttgaaatctaaacatgtaatgggcctaggtattgagggagcaaagggcatggaggatttagataacatcttttctcagttaactggaatgaaacggagtggaacaaacacgggcacctactttaggtttattgattttgctttccaagggctaattcctttaaacctgctgcttatattttgactgagtcagtgctgctgctacagttaaataagttgaagatcttgtaaggaattttagcctgtttttttaagactcatctaacaggtggggcgcagtagctcaggcctgtaatcccagcactttgggatacagaggcgggcagatcacctggggttgggagttggagaccagcctgaccaacatggagaaaccccatctctattaaaaatacaaaattagccaggtgtggtggtgcatgccggtaatcctcgctacttgggaggctgaggcaggagaatcgcttgaacccgggaggcggaggtttcggtgagccgagattccaccattgcactccagcctaggcaacaagagcaaaatttctgtctcaaaaaaaaagacttatccaacagtaatttcttttttttttcctttttttttttttcttttttttgtgggggacggagtctcgctttgtagcccaggctggagtgcagtggcacgatctcagctcactgcaagctccgcctcccgggttcacgccattctcctgcctcagcctcccgagtagctaggaccacaggtgcccgccaccatgcccggctaatttttttgtatttttagtagagacggggtttcaccatgttagccaggatggtctcgatctcctgacctcgtgatccacccgcctcggcctcccaaagtgctgggattacaggcgtgagccaccacacccaacagtaatttcttaaccagagggcctgggagtgggtggcaatcagaggagggggagacttgtgatttgaaaagacattctaagatttaaaagtgcttttaatattttttagtcatgatatttaatttgtttggaaatttcaaataacgttaaagaagaaacttgtttgtcaaaggagtcaaggggtgagagttgagaaactgtgatctacaaagttgatttaagccaaatcggactaaagggcagattaattccacattctgctgttttggtagaagatacgtatatagaacaaagaggaaagggataccttattcagattgttaatgttcttttgttgaacttgaccttattgtactgaccaccagttctgtttttatcctcccagtggaaggacaggttaataattggatattagctgatggtactagattaagccccatgagggtaaggatctgtagctagcatcatattaatcccagacactatttttgaattaaatgatatgaaaaagtctaaaataagcccacgcactgtaagtggtttacctcatgtcttactcgtgttcgcttattaaaatctcccatagatctttgcatatgaggctgggcacagtggctcatgcctgtaatcgcagcattttgggaggccgaggtgggtggatcatttggggtcaggagtttgagaccagcctggccaacatggtgaaaccccatctctactaaaaatacaaaaattagccaggcttggtggcacatgcctgtaatcccagttactcaggaggctgaggcaggagaatcacttgaacctgggaggcagaggttatagtgagccaagatggcgccactgcactccagcctggacaagagtgagactccctctaaaaaaaaaaaaaaacctttgcatatgagctgcagcaataaaagtgctatgagacccaacctctctgtaaccgtattctttgaaagctgtggaataaggccaagtgcagtggctcacatctaatcccagcactttggaaggctgagacgggtggaccacttgaggccaggagttgaagaccaatctgggcagtgtagcaagacccctgcctctacaaaaaattttaaaattagctgggcatggtggtgcatgcctatagtcccagctactcaagaggctacagtgggagaattgcttgagcccaaaaggtcaaagctgcagtgagccacgattgcaccactgcaaaaaaagaaaaaagaaaaagcaggccgggcgcgttggctcacgtctgtaatcccagcactttgggaggctaatcacgaggtcaggagatcaagaccatcctggctaacactgtgaaactaaaaaaaaaaaaaaaattagcctggcgtggtggcacgcgcctgtagtcccagccacttgggaggctgaggcaggagaaattgcttgaacctgggaggcggaggttgcagtgaactgagatcgcgccactgcactccagcctgtatgacaaagcgagactccgtctcaaaaaaaaaaaaaaaagcgtaggatggattcaaaatgtgatctggttgatcataaacaatacttttggagctggattaatattaagtcacttgagagatacagaaaataccatgttcgtggtcaactttgattattttagccgggttcatctggtttgcacattgagaccgtaatacttcaggttctaattgtgtccagaaggctatgtgttaacattcatagcaaactggttacctttatttcctgaaagttaaattttgaaagaaagggataccaagtgagaaagcaaccttcagttaaacaaaggggtacatcaagtttgatattcttggattaaaaatcaggtgacaattggaacatggaggagaaattcatgattataaaaaccatgaagccaatcttttttacaacaaagctgcttgtttttttcttaatcatgtagtggctgctatcaggccagttctggaacttcactgagtccctctgctcttctgaatcagctcttgattggtggtgacttctcggaagttctgaggaccacaaagaaagagcagtgtcagttcactaagttgagccatttggagattactaaatattccataactgtgggaaacacttaaatgtgttggttattagggttttcgtgtgttttccttttagcattacatcctcatatgcagtgttgttatagtagaggaggacattttttctagagggcagagagatctagggaatatgactgttaacatttgaacactttcaaatagcagtacgttttactgtggttttgataacctgacatagaataagctgctgagatgcaaggataccttggtatatagaaagagccttagacttcgtatgaaaaaaacttaggttttatcttcagcctagccatctaatgtctctgtaactttacagacatctggtgtttcacttaacctctctgagacttagtttccttttctgtaaattgatagttgtggccaggcaccatggctcatacctgtaatcccagcattttgggaggctgaggcaggaggatcacttgagcctgggatcctccaggatacttgagaccagcctgggcaacatagggaattaaaaaactttttaaaaatcagctgggcgtggtagtgtgcctctgtggtcccagctattgaggaggctgtgggaggatcacatgagcatgggagggttgaggcttcagatagccgtggccacaccactgcactacagcctggacaacagagcaagaccctgtctcaaaaaaaaaaaatggggccgggtgtggcggttcacaccgtaatcccagcactttcggaggccgaggcaggaggatcacctgaggttaggagttcaagaccagcctggccaacatggtgaaaccccgtctctactaaaaacacaaaaaattagctgggcatggtggcgggtgcctgtaatcccaagtattcgggaggctgaggcaggagaattgcttgaacccaggaggcaggggttgcagtgagccgagatggcaccattgcactccagcctggacaacaagagcaagactctgtctcaaaaaaaaaaaaaaaaagacagttgtgattccttccctatatggtttgtttacaagtgtcaaaacagtcttcaaaactgccatactgaatatgttatgtgagatacgaatttttattgatcttttttatccaaagagcagtgaaagtagtaactgaatagaagtagttacaaaattaaagatctcaaatgataagtgaatatagtagaaaataaaaggttgcccccacactccaaacatactctccagggtgtatctcaaacactcagacccttttccgtacgtaaacatgtgtttacacataataggtattctgcaacttttaaatttcttatttatgtctgcatagtaccccttcatggaaatgccataatttaaccatttgaggagcgtccatgttatttctttctaaataatgttttacaatattgcattgtacaactctgtaaatacctgagtattggtgaataatctttctcttgccttttaaaacagcaaaaaagaagaataagaaggggaagactatctccctaacagactttctggctgaggatgggggtactggtggaggaagcacctatgtttccaaaccagtcagctgggctgatgaaacggatgacctggaaggagatggtaacttttcttttgtcatcgtgtttggaatgtttattattttctagacaaaacctattacataataattcacatcgtttgtaatctgaaaagaacttactcattttttagcacctgaaatcttacatattttatagaatctaaggtttaatctgaggtttgggctgtcagactttgcagtgaagactgaagtggtcatttaagagagctttgctagttcttgttcttgcattaacagacttcttaagttactattcttttgggcctcattttcttcattttaaaagtaagaactagatcatcttttaaaattccttttaggtctaaaattctatggggtcctcataaagtgatgtttcaggctgctcgcgatggcttacacctgtaatcccagcactttgggaggccgaggtgggcagatcacatgagatgagaagttcaagaccagcctggccaacatggtgaaaacccatctctactaaaaatacaaaaattagctgggcgtggtggcatgtgcctgtaatttcagctactcgggaggctggggcaggagaattgcttgaacctgggaggcggagggtgcagtgagctgagatcatgccactgcactccagcgtgggagacagagcgagactccatctcaaaaaaaaaaaaaaagtgatgtttcagtgtaatctgtaagctatgtttactcagagccaaggaataattagttccaggtgtcattagtataaaatcagagtgtccttgggtaaacgaaaatggtctgaggaaaaggagtgagaacagtaattatggtgggaaaataaagaagagtcaattggacaagttctgtgccttcagggagtcgccaggaataataaggagctatgttttataatgaccgggtatgacataaatctcattaccattgtttttttcctgaaaatcgtttattgcatgctgaaagaatattttttcctatgacctgttttcataattcctaaaaacaggaaattttttttgagacagagtctctattgcccaggctggggtgcaagtggcgcactctctgctcactgcaacatctgctcccggggttcaagcgattctcctgcctcagccgcctgagtagttgggattacaggtgcccgccaccgcgcccagcaaattttgtatttttagtagaatcagggttttaccattttggccaggctggtcttgaactcctgacctcatgacccacctgcctcagcctcccaaagtgctgggattacaggcatgagccactgcacccggccaaaacaggaaattttatataggtcgtacttcccataggtgttggtatctgaagtacaaattcatggacagtgctgtaggaaaagatttttgttgtgatatttttgtttgtttgttttcagatggagtctcactctgtcgcccaggttgtagtgcagtggcacaatatcttggcccactgcaactgccgcctcccggttcaatagattgtcctgtctcagcctcccaagtagatgggattactggcacatgccaccacacctggctaatttttgtatttttagtagagacagggtttcaccataatggtcaggctggtctcaaacctgacctcaggtgatcacccaccttggcctcccgaagtgttgggattataggtgtgagccaccgagccaggcctgttgttgtttttaagggaggatagaccatgcagaaaaatactcaacttcaaactcaccactaggaatacaagagttgtcagtagtggttaaatatacctggagtaagagggacccaggtttgaatcctagctttaccgtctgtgaccttgggcaaattactgtctgaaatctgagtttgcttttctgtagaatgggggacaacctcacaggactgttaaaaagataagatgggatataatgaatataaagtagctggcacacagtaatattccataaagagttgtatttatggaataatatttctttgcttacataaagattaaggtgtcataattaatctcagaagcttctcttcgtaaagtgcccttattactgaacccccactttttttggtctggttttcttgtatagcatgtttaatatttggcaattaacatgggtcctcttgttctatgacagtagtgagagaagtttcttctaatttcttacattcattcctctatcctagtttcgaccacttggcacagtaacgatgacgatgtgtatagggcgcctccaattgaccgttccatccttcccactgctccacgggctgctcgggaacccaatatcgaccggagccgtcttcccaaatcgccaccctacactgcttttctaggaaacctaccctatgatgttacagaagagtcaattaaggaattctttcgaggattaaatgtaagtgtaaaagttgtaataattaactagatattgaggataatgtctaaaaaagactaattgtggaatgggcagttgctgttgaaaaaacaactagaaatataatttaaggccgggaatggtggctcacgcctgtaatcccagcactctgggagtctgaggcgggtggatcatttgaggtcaggaattcgagtccagcctggctaacgtggtgagaccctgtctctactaagaatacaaaaattagctgggcgtggtggtacacgtctgtaatcccagctacttgggaggctgaggtaggagaattgcttgaacctggaagacggaggttgtggtgagccgagattgcgccattgcactccagcctgggcaacaagagtgaaacaccatctcaaagaaaaaaaataaaatcaaaattatatatatatatattttttttttttcttttttttttttttttttttttttgagacagagtctcattctgtcatccaggctggagtacagtggattacatgcccagctaattttttgtatttagtagagatagggttgcactatgttggtcaggctggtcttgaactcctgacctcagaggatccacctgcttcggcctcccaaagtgctgggactacaggcatgagccactgcacctggcctgaattaatctttttttttttttttttagagttaaattcatacagttcaaaattcagaaggtataatagggcatttagtaaagtttctactatccctctgcatcagttttcctcctgagacaaccatgttcttgtgtattcagaaaaattcatgcacatacagtaatgcttttgtagtcctctcaaaaaatgacaaatgaagaagaatgctgggaaactttgttgttgattcttattccttcagatcagtgcagtgcgtttaccacgtgaacccagcaatccagagaggttgaaaggttttggttatgctgaatttgaggacctggattccctgctcagtgccctgagtctcaatgaagaggtaaagaaaataagagtggggatatgaggggtgtaagttcacaaatctcatgtttattgatcaaactggtattttttaggttgagaggctcacttcaaagattcccatatctacaaataaaggcctgcattatttaacagtgtatcacttaacatcgaacatctagcaagtcacacttcagcaaattcagtaggccccaataatttagataggtacttaggtggaaagttgtggaagaaacccaccacacaccaggtctctaattaagtcttacactgatttacccacagtgttgcctcaactcttatggcattgctttttcaaagtaatctggcctgataaaggcaaatagaaaaatcaagtttgtttagtattaaaggcatatctcattttcagggaagtgttgtaatggtatatttgttcatttaagaggatttggaaacatttcctacaaaggaatattttacaggagagtgacaataaatatctagtccttctgcttgtcaacactgcccacaaaggttttcctgtcccaggacttgaggggcttatatctcagaagaaaaaagacttttttcctcctttaactccaaaaacaccttattgtttattgataaggcaatttctagtgccatttgtgccatatttctgtagtcctattttgccatatgacatgattgaaatcaacacctcttagaaatagttttgctgcctcataattgattaccatcatgataacctgtagtcagtgtgaaatagagataaaaattaatgtacttagttaaatgcatatgaaggtctaatcttgttccagagttactcttactggattatttttagatttttattaacattactggtctctaactttactcagtctggataagaaaaagaataccatgcaattgttaactatttgatgtttactagattaactattaatatattgttgtggtccatagttaagagttactttgttactagagatttcattatagtggtgtttaatatagttttgggtatttttaactaaaaatcattgttatccttcaactgtagattctactatgaaatgaggaaaaatcagcaatagaattaattgggttcaaagtatataaataatgatgtgggaaagggaagtcagagggtatctctggaagaactgatttatctgaaggtaatactgagtgaaagaacctaagattgtagacaaagcatgctttatgcaattttgctggtacatagtagtagtagaggctctataaatgtgttgggtgtttttgtttttaagagacagtgtctcgctatattgcccaggctggatttgaactcctgggcttaagtgatcctccagcctcagcctcccaaatagctgagactgtaggtacatgccactgcacctggcttctataaattttgataaataattgttgtggcaccaaatatgccttttattcagctagttatgtgagaattatttttaatttactacacttgacaaattaccttggatagttaaaaagttaattctattctgtgaaattaagctttgtaaaaatagtataattgacctaatattcaaggccagcttaaatttgtttaacttttaagtcttttaaaggactctttagcccacaaattggagtgttagctagattacagtgttttcctttatcttccttcccctagtgcttctgctatgcccagacgttcaaggtcactcaagggatttgtgcataatggggcaaaaggttggttaatatggtcctatgctctcagtctctaggtaacaggagaattcgagtggacgttgctgatcaagcacaggataaaggtaaggaaactggtagagatttctgtttggtaatggtcccaggatgacaccaagccatcctttcccagaaaatttgaataggggtagtggtgggcctgcctgaatctacagtaacagttttcaatcagttttgccccacaggggacttctggcaatgtttgaagacattgtagttgtcacaattggagggagtgctgctgacataagtagaatccaggggttaattctatagggaataggacagtccccatcaacaaagaattatgcagcccaaaatgcatgtcaagattgagaagactgattgatctagatgaacattaaatagatgataaatagattagctgcctaacagcacgttggtcacaaaggggacctaatttgtatatgtttcagggactcctggcccatacagaatttgagatagctaagcattaaaccaataggaaaaaacgggaggaaaagagccacctggggttgaattggagcatgtacttatggggcctgaggtaactgggatgacagtgtgacgtgaaagtgaaaaatagggtaaaatgggggttttctatgtgtgagaaatattgggcaaagtttttatgagataacttacggtttttgttttaatgtatctgtagacagggatgatcgttcttttggccgtgatagaaatcgggattctgacaaaacagatacagactggagggctcgtcctgctacagacagctttgatgactacccacctagaagaggtgatgatagctttggagacagtaagtttgtttttatgaagttagcttcctctgtgctttgggaggctatttagtaataggacaaatgtgttacagatgatcagatcacattaacagatagaaggaggaaagcagattaagaaaaattttggatagtatctgaaagaactgatagatgcaggaaacgaatttgataaattaataattttttttgaaaacttaaccaaacaaagggacagacatttctctttttttggagacaattgtttataaagaaacccaaactgggcatggtggctataatcccaacgctttgggaggtcaaggcaggtggattgcttaaggccaggagtttgagagcagcctgggcgacaaaacaagaccctgtctaccaaaaagaaaaagaaaaagctgacgtggtggtacgcacctgcagtcctagctgttcagcaagctgaggcaagaggactccttgagcccaggaggtctagactgggtgacagagcgagaccctgtctcaaaaaaaaaaatccaacagattctacaaagtgagctatttgaaataagagttcagcatgattgctgagtgaagagcagcatacaaagatcagttgcattactttttgatatatatatatatttttgagacggagtctcgctgtgtcgcccaggctggagtgcagtggcgtgaccttggctcactgcaacctccacctcctggattcaagtgattctcctgcctcagcctcccaagtagctgggactacaggcgcgcgccaccacacccagctaatttttgtatttttagtagagatggggtttcaccatgttggccaggatagtcttgatctcttgacctcatgatccgcccgccttggcctcccaaagtgctgggattacaggcgtgagccactgcgcctggcccatcagttgcattactatatgcttgtagcaaacaattaaaatgtaaaattttttttttttttttttttttgagacagagtttcgctcttgttgcccaggccggagtgcaatggcatgatctcaggtcacctcaacctccgcctcctaggttcaagcgattctcctgcctcagcctcccgagtagctgggattacaggcatgtgccaccatgcctggctaattttgtattcttagtagagatggggtttctccatgttggtcaggctggtctcgaactcctgacctcaggtgatcctcctgcttcagcctcccaaagtgctgggattacaggcatgagccactgcacctggcctaaaatgtaactttctaaaataaaaatattgattcactttaaaaatactcaagatatagcagtgaacaaagatacagcagtgtaatttttttctaataaaaattgattcacttaaatgctcaagatacagcagtgaacaaaaacaagaaaatcctgtctttattgggcatacattattatagtggagggaagagacagtgtgtgaataattaaacagttggggtgcggaaagataggtgagtgggaaatatcatggggtaggagtagagattaattacatacatcactttaacaaagacctttatggggaaaattatgcaactttattaaaatacacaaaagtagaccacactatttttaaaatggaaagaagctactacctagtaaaaataaataaatagtggtttgtctgtaatcaaatacttaatagcataacaacagggataaaattcaaaacctgttacattaaggggaaaaaaattgtgtataaatttgaaaacaataccatgtagtattaatgcataagttgtaaaattataaagctacgcatggtaatttaaccacccttttaattgttggtggggatagggaaaattctgtttttagtctgtaacatatttcttttaaacaaaaaacaaacatggcaaaatatgacattcactaaacctaagtaataggttcataagtttgttataatggtgtctttacttttctgtatgtttgaaatagtttaagtaaaaacagaccaacttaaatttacaagctctttgttttgttttgttttgttttgttttgacacagtctctctgtgttgcccagactggagtgcagtggcaatcttggctcactgcaacctctgcctgccaggttcagggtgttcctcatgcctcagcctcctgagtagctgggattacagatgcgcaccaccacacctggctaatttttgtattttttagtagagatggggtttcaccacgttggccagctggtctctaactccttacctcagatgatctgcctgccttgacctcccaaaatgctgggattacaggtgtgagccagcgctcccagcacaagcattttaattttgtgaggtaccttttgagctttgtactaaatataattggggaagcagtaagggatatgtataattccttttagaggagagtccttaaccttttaagatgtagaaggaagaagaatgggtcataggtctgaaagaaggataaatcagcaagtttatatctgactttttacatgactttgtgacacagcaaagccttggggagaactatgtgaggtgattaacttcagcatttatgcaagagattctattgttaacaggaagaaatggctcttgaaagaaaaagcagacaatcagaccaagggtcctgttttgagtccaggggcatgacttttctcacctgaaaccttgaatttagagcaagcagaatggataacgagtgagtgtgctgttgttatccaaagctgccccaaagtcaacttagttaacctgaattaaagatccagagactcctgtcccaagcattaggccaaaaagagaaccccgaggggtgttggggggtattacactcagtattcctatgaaatgtcagtaatagcatgtgctgcttttctccagcatggatctatgctttctcaggaaacacaagcttatcataatttcagtattacccaaataaaattaagtgtaaatcgcatctccagaaattaaaaccacatttcaaaataaacacagggctgattttcttatatgtgtcctgttttagatcatttctataatcattttactaacattagcatgttctttaatatataaagtttataataccaggaaatgttatgtctggtcagtaaaaattatgtggtttccaaaatgaaatcattatttaaaagacagcagccacaagaaaaagatccctggccgggcatggtggctcacgcctgtaatcccagcactttgggaggcggaggcgggcggatcatgaggtcaggagattgagaccatcctggctaacacggtgaaaccctgtccctactaaaaatacaaaaaaaaaattagccggacacgtgtaacctcagctactggggaggctgaggcaagagaatcgcttggacccgggaggtggaggttgcagtgagcccgcgattgtgccactgcactccagcttgggcgacagagtgagactccgtctcaaaaaaaaaagagaaagaaaaagatccctgtttgtcccccatacataaattatcagctcttaaaacgtgtaggttgttttagttagttaatttatatttagaaattcagattttttttttaactttaaaatctgggttgccagcttctctcagaaaattggaagatcctagcaacagtcagctggagctaaatagcagctatcccttttacaaacaacataacgctacccacagtttgctatctgagctactacgtttctttatacagatttctagtatttagggtcctctgatactgaaatgcacatgtgtgtgtaaaatatagtttataacataaacaacattgcaatgaatgtctttgtacatgtatctttatcacacatccaattatttcctcagtgaatttcaagaaattaaattgttggtcaagaagggtatacatgacttcaaatcttttcatgcatagttctaatacaactttcagtatttatactaatttattgatttatttatttattttgagaggaagtctcactctgtcacccaggctggagtgccttggcacaatcttggatcattgcaacctctgcctccctggctcaagtgatccttccacctcatcctcccaagtagctgggaccacaggcctgcaccaccatgcccggctaattttttgtatatttgatagagttgtggtttcaccatgttgcccaggctggtctcaaacccctgagctcaggcaatccaccaacctcaacctcccaaagtgtatttgtaccatttaaaattatgatcagcagtgcagaaattgatttaagctcctaaaattcaatagaaaattatgtcctgttagtcatatgttgcatatattgtttctcattttgtttgcctcttaaagtgatctttgaggctgggtgttacggctcaggcctataatcccagcactttgggagaccaaggctggaggattgcttaagcccgggagtccaagaccagcctgggcagcagagagagactgtctctcaaaaaaaaaaaaaattttttttttttttttttttgagacatagtctcactctctcgccaggctggagtgcgggggcatgatctcagcgcaacctccgcctcccgggttcacaccattctcttgtctcatcctcccaagtagctgggactgcaggtgtgcgtcaccacgcccagctaatttttgtatccttagtagagacggggtttcaccatgttggccaggatggtctcgatctcttgaactcgtgatctgcccacctcgggctcccaaagtgctgctgggattacaggcatgagccaccgtgaccagctaaaaaaatttttttaattaaaaaataagtggtctttgggatcaaacatgggagattcccaactgtattgttttagtgtcttgtgctttgttttgttttttgtttttgcatgtaaacctcttctccttctggaaattcattatggaatatttagggattttttaatttccaacccacccttcccaaattattagctgagcaacaattatttcaccagggaaactttttgaagaaatcagatagaaaatttaaataaacagattcttccaaattggactgatagcttaccgtgtttctattaatggtgtcagagaaaaggggatggtgttacttgtctgtttcctctagagtatcgagatcgttatgattcagaccggtatcgggatgggtatcgggatgggtatcgggatggcccacgccgggatatggatcgatatggtggccgggatcgctatgatgaccgaggcagcagagactatgatagaggtaattgtaaaacatgtcgaattgctctttcagtaactttgccttttttttttccccctccgctgtgatgattataatttgggatatatttacaggctatgattcccggataggcagtggcagaagagcatttggcagtgggtatcgcagggatgatgactacagaggaggcggggaccgctatgaagaccgatatgacagacgggatgatcggtcgtggagctccagagatgattactctcgggatgattataggcgtgatgatagaggtaatagttttctttttacgtacttcatggagcagaaactgggaaaactacggaaaatttgtgattgtgttacgaactactgagttgggcacaaatataatttgcacattgtacaggaagcagcaaagcatagtagaaagagcattggctggccaggtgtgggcagatcacaaggtcaggagatcgagaccatcctggctaatggtgaaaccccgtctctaccaggtgtggtggcagacacctgtagtcccagctactagggaggctgagagagaagaatggtgggaacccgggaggcagagcttgcagtgagtggagatggcgccgctgcactccagcctgggtgacagagtgagactccccatctcaaaaaaaaaaaaaaagcattggctaaggatgacatcagtggaaacacagcagtcgaattgttttcatctcatatgccttcacagatagatttttcagttaaaatttattgaataaacagtagaaatggaaaaaaaagttgccagatactgttatgttgtgatctcagtaaattacacttaaaacagatggttttagctccattttccaagtaagggaaatgaaattcagattaaacatagtcctgtagcccataattggtactatggggttaaaaacgaagcattaaggccaggtgcagtggctcacacctgtaatctcagcactttggaaggccaaggtgggcagatcatttgaggtcaagagttcgagaccagcctagccaacatggtgaaaccccgtctgtactaaaaatacaaaaattaggtggccgtagtggcacatacctatcatcccagctactcgggtggctgaggcaggagaattgcttgagcccagaggcagaggttgcagcgagctgagatcgcaccactgcactccagcctgggcgacagtgagactgtctcaaaaaaaaaaaaggattgctttctgtaccattataccacaataattgatgttcattaattataaaggtgagattttggtgcacctattctaaaattatgcccctaatactataagatataaaatgtaaactgtgttacaaatctaacctgttataaaatactaataaatggccaccatttgtgttctaacttcagtgatgtcatataaaaggttatggtatctggcccagaattttttctatcctttttttattttatttttttttttttgagacggagtcttgctctgtttgttgccaggctggagtgcagtggcatgatctcagctcactgcaacctttgcgtcctaggttcaagcaattctcttgcctcagcctcccgagtagctgggactacaggtgcacgccaccatgcccagctaatttttgtagttttagtagagacagggtttcaccatgttggccaggctggtctcaatctcttgacctcgtgatccgcctgccttggcctcccaaagtgttgggattacaggcatgagccaccgtgcccggccaaatttttcctatctttaacatctttgtgttagtcctaaactttgtggcaatggctttatatccatcatctcctgtgattccccaagaaaggaaaatcgatctggacaactaataaaacacagtgagatgacagaattcatcagagccatatggcaattctattgcagtgaggtctttccttctccctcagaaaatggtgaagtctttactccttcctcaaaataataataataattcaatgtttgttttttttaaaaaaaacttaggccagccatggtggctcacatttgtgattccagcactttgagaggccaaggcaggaggatcacttgagtccaggagttcaagacaagccctggcaacatagtgagaccccatctctgcaaaaaatacaaaagttagctgagcgtggtagcatgtgcctgtagtccccgtgtcttaggagactgaggtaggagggtcgcttgagcctgggaggtcaaggctgcagttagccaaggtctcatttcagcttgggcaacatagtgagaccccatctctgcaaaaaatataaaagttagctgagcgtggtagcatgtgcctgtagtccccgtgtcttaggagactgaggtaggagggtcgcttgagcctgggaggtcaaggctgcagttagccaaggtctcatttcagcttgggcaacatagtgagaccccatctaaaaaataataaaataggaaataggttttaaaaaattatattctttttttttttttttttttttttttgagacggagtctctctctagttgcccaggctagagtgcaatggcgcgatctcggctcactgcaacctctgcctcccaggttcaagtgattctcctgcctcagcttcccaagtagctgggcttgccaccacgcccggctaatttttgtatttttagtagagacggggttgcaccatgttggccaggatggtctggatctcttgaccttgtgattcgcccgcctcggcctcccaaagtgctgggattacaggcgtgggccactgcgcccagtgaaaaaactacgttcttaaaagcgatttcctcaagcaagaagcctaaaaataatagctaacatttattaaccatttactctgttccatcagtgagctgagggcttgtacaagtattgtttaattctaagacttctgtgtggtataggtaaaattacaagttagaaaagtggaggctcagatgtgggcctcatgttctccttgacttctgaccttttcctctctcacactgtcccttacctccccaccaagagctgcatacctaattttttatttctcttcttgctcttacccccccattccctctaagatttgccctcttgtctctagttgctgctgctaccttcgttgaggcctcattgctgcacccacgttactggccattgcctcctaacagagttccctttcttgctccgttcttcacattggccccagttgtcagttgtctttctggcataagatctaattaccttattctcctgtttagacctgtctagtttccccatggcctggaacatagccctttctctatacctctgacatacacgggccttcactgtttgcccagcctttacttttttcttcttgagacaggatctcactctgtcgcccaggctagaattgctgtgacataatcatggttaactgtagcctcagccttctgagctcaagtgatcctccttcctcatcctccccagtagctgggactagaggtgcgtgccatatgcctggctaattttgatattttttctaaagatggggtttctccacattgcccaggctggttttaaacttccaagttcaagtgatccacttgccctcggcctaccaaagtgctgggattacaggcgtgagccactgtgcccggctgcgttcttttattaatatcttaaatgagctactttttctgagcccctattttatcttacaaaagtgacggggctataacacagatttaaaatatgtttaggaacatatataaactgtcggcttaaagccctcgtagaaaatttagatcttgttaaacagtaccctctatctacaggtactatgtgcatatgtagtaaaagtataaaatcaagtgtgggcatgatgaagtcaccatctagtggttatttagaggacagagtacagctggtcatgtcatcaggaggttttacctctttgttaaggttacattacttaagccaggtgattgtatacataggctttctttatattctctgtatcttttgtatatccaaaatatttaggacaaacaatcatttttagaaatttaacttccttgaaacacttaggtttctcttgaaagtgttctgacaacttgaattgaggaagaaatcagactgcctgccttaagagtttatttgttcagtgttacatgctttgccccatgaaccacctgccaaatttatattatacacagagacaagggtataagatctagagtcttcctggctgggcgtggtggctcacatctgtaacagcactttgggaagccaaggcaagcggatcacttgaggtcgggagttcaagaccagcctggccaacatggtgaagccccatctctactaaaaatacaaaaattagttgggcatggtgccacgtgcctatactcccagctactgaggaagctgaggcaggaaaatcagggaggcagaggttgcagtgagttgagatcacaccactgccctccagcctgggtgacagagcgagactgtctcaaaaaaaataaagaactagaatcttccctatcatattgtattagttcttaacatgcagatttcggagcaagatactttcatccagtagtttaatgatggtcaaaaatttcttcccatataaaagaagtcttgatagattattaatttattacttaaatgtttaccatttttagtctttcctgtggtcttgtactacatcatggatgtggtagaagagtaattgaacttgggtttttttgtttttttttttttttgagatggagtttggcacttgttgcccagtttggagtgcagtggtgtgttctcagctcactgcaacctccgcctccccggtgggttcaagcgattctcctgcctcagtctcctgagtagctgggactacaggcatgtgccaccactcctggctaattttgtatttttagtagagatggggtttctccatattggtcaggctggtctcgaactcctgatctcaggtgatccgcccgcctcagccccccaaagtgctgggattacaggcgtgagccattgcgcccggccagaacttggttatttatgccacctatttttatttttatttatttttatttatttattttaggcgtagttttgcttttgttttccagcctggagggctggagtgcagtggtgcgatcctggctcaccacaacctctgcctcccaggttcaagcgattctcctgcctcagcctcccgagtagctgggattataggcatgcaccaccatgcctggctaattttttatttttactagagacggggtttctccatgttggttgtgttggtctcgaactcccgaccccaggtgatccacccgcctcggcctcccaaagtatcgggattacagacgtgagccaccacgcccagcctgagctacctattttcttttttttttttcttttttttatttttgagacggagccttgctctgtcaccaggctgaagtgcagtagctcgatcttggctcactgcaacctctgcctcccaggttcaagcaattctcttgcctcagcctcctgagtagctgggactacaggtgcgcgccccaacgcccagctaatttttgtatttttagtagagacggggtttcaccatgttgtccaggatagtctcgatctcttggccttgtgatccacccgcctcggcctcccaaagtgctgggattacaggcgtgagccaccatgcccagcctaaactacctgttttctaatgatctatttgccttctgtggattggttaggccactaacttgaatctcatgtagcatttcataggagttatatctgagaaatctggctttcagccatcagcttctggtgattggaaaactattacttaaagtttcatttaacttaggtcccccccaaagacccaaactgaatctaaagcctcggagtactcctaaggaagatgattcctctgctagtacctcccagtccactcgagctgcttctatctttggaggggcaaagcctgttgacacagctgctagagaaagagaagtagaagaacggctacagaaggaacaagagaagttgcagcgtcagctggatgagccaaaactagaacgacggcctcgggagaggtgtgttgtcttgatggatatcccatctaggaatccggtggttcgtaatgggggcattacatccccaggggcatttgggaaatttgtgtcgttatcacattagtggttgtcactgatgggcatttagtgggctgtggccaggggtgttaggcagtatgcagtgttagggacagttttacacaatgaagagttgttccctgtccattacaaaagtgtttactattaaaagctggtattgtatctaaaaggctagagacctactataataagtaattgccctgaaaaactaggcctggtaatgagtggcttgtagaactgtgttgattagtaaagaagggcagtattgtagattatgtaggatactgttcttaaccatattagttgattcttgctgaagtatttagggccaaagtgtgtcttaatgtctgtagctttcaaatagtttgagggaaagataaatttatatgcatatacacatatagatgaagtaagtgatggttcttgaggggtcagcatgggtctaaggtggccttcactgagccaggcataatgtgtattttgtgaatctctcgtacagacacccaagctggcgaagtgaagaaactcaggaacgggaacggtcgaggacaggaagtgagtcatcacaaactgggacctccaccacatctagcagaagtaagtcagaccagggtgggtatcgtgttattgccgttttccataaactatccataaccaaattatgcagagaccctgcaatatttaaattcagtcatgaactctttatttgggttgcatgggccgattggagtttcatatcttctgctccaaagaatctgaggaatgggtaccagagtagacctagatgatctgcttaataatctaccactgaagtgtatacttggttgttaggtttgtctctctcttttttttttttttttttttttggtatattttcattttatgtcttgacatctttgaatgttgtttattcagaacagtcaacggcttggagtttcatgtgagctgtcccaagaccagccttttttgatgttatcatcaccagagcagtgttctcaagcagtgttattactggttgatcaagcacttttagtgttttggaaacctaaatggttcaattgtaatacctcccttcccttaccatgatgtgttttttttgtattttgttttgagacagggtcttactctgtcacacaggctggagtgcagtggcatgatgatggctcactgtagcctcacctccctcagccctcagcctccctagtagctggaactgtaggcatgcaccactacacccagctaaattttttatttatttattttcttttttttttgagaccgagtctcgctctgtcgcccaggctggagtgcagtggcgcgatctcggcttactgcaagttctgcctcccgggttcatgccattctcctgcctcagcctcccgagtagctgggactacaggtgcccaccaccacacccagctaattttttgtatttttagtagagatggggtttcactgtgttagccaggatggtctcaatctcctgacctcatgatccacccgactcggcctcccaaagtactgggattacaggcgtcagccaccgcacccagcctacacccagctaaaattttgtagagatggtttccccatgttgcccaggctggtctcagcctcataaagtgctgggattccaagggccagccactgtgatattttttaaggtctttcctcccacctctaaattgatttgtacttgcatttcattcatttatttatttattgagatggagtctcgctctgttaccaggctggagtgcagtggcacgattttggctcactgcaacctctgactccctggttcaagcaattctcctgcctcagcctcctgagtagatgggattacaggtgagcgccaccatgcccgactaattttttgaacgggctggtctcaaactcctaacctcatgatccacccgtctcggcctcccaaagtgctgggattacagacgtgagccaccatgcctggccttctattttttttattttttatttttgtattttatttatttattttgagacggagtttcgctctttttgcccaggctggagtgcaatggcatgatctcagcacactgcaacctctgcctcccgggttcaagtgattctcctgcccaagcctcccgagtagctgggattacaggagtctgccaccaggcctggctaattttttgtatttttagtaaagacggggtttcaccatgttggccaggattgtctccatctcttgatcttgtgatctgcccgccctggcctcccaaagtgctgggattacgggcgtgagccgccgtgcccggcctagttttttatttttaagacagggtttcattctcacccaggctggagtgcagtggtgcgatcatagctcactgcagcctcaaactcctggcctcaagcaatcctcttgccccaatatcccaagtagctgttatacgacgggtgcacgcaaccatgcctggctaaatttaaaaaatttgtttttttagagatggggtctcactacactccccaggctggtctcaaactcctggcctcaagcaatcctgcctcagcctcccaatgggggctccttgtttttagaagacacttaactgcattttttaaaaaacgcacgtgtaggttgttgttttttgagatggagtctcactctgtcagccaggctggagtgcagcaacatgatcacagctcacctcatcatttctagtagctgggactgcaggcacatgccacatccagctaatttgtctattttttgtagagctggggtttcaccatgttgtccaggctggtctgaaactcttaggctcaaacgatccgcccccaacagcctcccaatatcctaagattacaggcgagagccactgcacccagccagtaggtggtttttcataaatatgattgcatcatagtccatgtgtgttgagttttaagctgaagttgagcagtggttactagagtttggggtttcattgtaggtcctcttcacatatgtatattctccaggtcaagacacttttaacattgagaatgcagaaaggctgtaaaggatactcattcctaaaaaggtcacatggctgggtgtcccttaagttgtatacatggtcattattttttctatttctctgtgcatcagtaagacattgttctggaaatacttgtaaaccactggtttagggataaatccatctttgggagccaaaacttggatgtggaccattttccacactgttgagatcctggtagatgcgtgagcatctgcagcctgataatttgatattttcactctggcttcacagatgcacgaaggagagagagtgagaagtctctagaaaatgaaacactcaataaggaggaagattgccactctccaacttctaaacctcccaaacctgatcagcccctaaaggtaatgccagcccctccaccaaaggagaatgcttgggtgaagcgaagttctaaccctcctgctcgatctcagagctcagacacagagcagcagtcccctacaaggtgagtcagtttggaaacagtagttggttaactgcagattctaaaatactgtgatgtaatgatggaagatctcctacgggatgccagcgttgtatagcaccttataagttatgctggctttagtctcttagtgtgctggaactggctcataagacctagttgttccattttctggagttccaccactttgatagcttgaaatcagctatgatgggagtactaatgccgcacaaatctgcaaatactgtaagtcagaggcttcccttttgccacatattggcagtatggtagggggtaacttcctttcatttctcttaagtcttctcatttgtaagcaaaatagcaacactattagcctggcgtggtggcaggtacctgtaatcccagctactcgggaggctgaggcaggagaattgcttgaacctgagagcggaggttgcagtgagccgagatgtgccattgcactccagcctgggcgacagagttaagactccaaaagaaaagaaaatagcaatactaatcctgcatgatgtgatgattagaaagcatatggcactttagtgttcaaattactgctttcattgtaatctttcccatattttaatgttccataacattgagtatgattttgttttctataaagcttacccactgcatttggaggatgattatgtttcttggttgttttctccctgaaacaactgatgaatgtgattacctgttttccttctagtggtgggggaaaagtagctccagctcaaccatctgaggaaggaccaggaaggaaaggtgagctcatagtatgggaaataggtttttcacctagaagcctaaataaaaaggcctccaaaattagattttgaagagcagtgtgtctcgcacctgataccgtgttaagagttcttgggttggccaggcgcaggggctcacacctgtaatcccagcactttgggaggccaaggcgggcagatcacagggcaggagtttgagaccagccttaccaacatggtgaaaccccgtctctattaaaaatacaaaaaaaattagccgggtgtggtggcacatgcctgtaatcccagctactcgggagacgctgaggcaggagaattgcttgaacccgggagacggaggttgcagtaagccaagatggccccactgcactccagcctgggcgacagagcaagactctgtctcaaaaaaaaaagaattattgggttatctaccttttcttgccagtagagggaggagtggcctctttggagaaagtatgaaaccctgccctttcctggtagaacatttctttgacggggagaaaaaaatcggaaggaaattaaccaaggtcactacagagcgtcataatctttatttccagcttgcttttcatgatggcatatccctacatggaactttttagtggattttgtttgttttttgtatttttgtgtgctgtagaggatgtggaaagaagggcttcaggaaggaagtctgggttggggtgaggttagtttccctcagtacatgtgggcacaattttcttcagcttaagggaaatcttaggagagggacattgatacttttacttgcctttaatttgtttacattactgcccaagcagatgaaaataaagtagatgggatgaatgccccaaaaggccaaactgggaactctagccgtggtccaggcgacggagggaacagagaccactggaaggagtcagataggtatgcttgttctctttctcatctttcctctgatccacatgtttgtgtaattaagaaattaagttcttggttctcagagcactgccagatcgctcattgtgagcaaactaaagtcagccaacgtagacagttaagattctgaaaatctagaagtaatacatcatccagacaacaaggactgttgactagaggtgcctgttcagtgccttgaaactgcatgcatacacatgtttgtattaggcgagtcctttcctaaagacatggttttatgcttacgtctctgcaggaaagatggcaaaaaggatcaagactccagatctgcacctgagccaaagaaacctgaggaaaatccagcttccgtaagtgttgaaggctgctcccaatttttcattctaagaaaaattcttagaattctaagtattcttactaagaattaaaaattcttagtattctaaactttttgccgttggacttctttccatttggaatacaaagtgtttggaaataagacattggtctttactgaaatagcgaaagaagtttagctttttcctggtttctgtcttcctttgttctcatcccttctgcaaggtgtagaggtggtatgagactatagtaagatcgcatgtgcctctgaccctcttccctagctcctctccaatggacaatgctgatgagcaagcaagtgggtgtcatctgactgtcatcccccattgccaaaggatcagtatcctgtgtcttgggttttgatgtgataattcagggccttcattatcctgtcactctcgttgtgttacagaagttcagttctgcaagcaagtatgctgctctctctgttgatggtgaagatgaaaatgagggagaagattatgccgaatagacctctacatcctgtgcttttctcctagtttctctccaccctggaacattcgagagcaaatcaaaacctctatccagacaagacaaaataaaactcaccatctcctgaagacctttcttacctttttttaaaaacaaaaaatgaaattattttgcatgctgctgcagcctttaaagtattgaagtaactggagaattgccaatacagccagagagaaagggactacagctttttagaggaaaagttgtggtgcgttatgtcaccatgcagttgccagtgtgattagtgcctaggggtctccatttagcagaaatggtaatgacagtgatataatgcctggaacctggttgggcagtaggggagggaggtagaaggaaaagtgtgagatttctaccttttagtttttatcctattgtggcatatatgaattctcaaacattatctgaataaattttccactcttggaaaggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctattaaaatagaaacagggattgattaatgtcccgctcctgaatacatgtaaaatttgtacaaaaatatcttctatgaaaatgatttgtaatctgtagacttattacctgggagatgtcttgatgtaaaatcccatcctttgggttgtgggttttttgttttctccaaataaatctgatctttaaagttc

SEQ ID NO: 37573 - DNA, 7048 bp, Homo sapiens; identical to SEQ ID NO: 36993

SEQ ID NO: 37574 - DNA, 9282 bp, Homo sapiens
caattgtgttcgcagccgccgccgcgccgccgtcgctctccaacgccagcgccgcctctcgctcgccgagctccagccgaaggagaaggggggtaagtttccccgtctgcccgcttccccggaaccgagccccgcttgccgtcagccccgagccgggccctggcggtgccgggaggggacccatagcccctccggcttagcccacaaactttttggcccagaaatggaggtgaggagcgagtttccctgttccctctggcggcggcggctcccccgtctctcgccgcctcagcccaacagcagcaaccgccgcggcgccgagcctgctctccctcctcctccccgcgcccctggctcctctttcttcggtgaaatcccgcccgccgccccttccccggaccccaaaccttcaccatgacccgcgcgggcctcttaactaccgcccccgggccccagcccccagttttcgagcgggaaaggggtggaaatcgccgccgcttcgcaccctggggtaactcgctttttgctgcctccccacagttgttgctaagcttcaccatcttgtctctcttctctggtcaccgaccatattttttcccccgtttctctcttccccatttcaaaaaagcaagaatttttaaaagagggacgtttttttcccttttttggagaggcggaaacttgatgcatttgaaatgcaaaaaaaacttttgcattttggagggcggcacgtggcaggggataggggtattttcgagcgatttggtgttttgtctctttggaacggaatcggatacgttttgcgattgtttccattttgttctggtcggggagccgagttggttcctgctcgaggcgctgggagcgaggcgggcaggttgggggaccctgtgccgagggacccgaaggaggcaaaaccaaaagtttatgtggtgcttggggtggaccggtcggcggatgtcgtgcgttaattaaagcctgggtgcggggcactttttatttcactgcgaagcctgtgaggactggacgcgaggacggggctttgtagaatgctcgctggtggtagctgttgttcctctcttgttttttcgagacgcctttttgtcaacataactgtaaagatgcaaaaccaagaatattttcagatatttacagcaatccatcaacagtcagacgaagggggggcagccaaagtgggggggagtaagaccttttttttgctgtaatttgactcgaccttccagtggtttgtgccttttttcttttgacttgtttgtggatggaatgtttacagacatttctaattactgctttaattaaataaattggatcaaaggccgttcgaggtatttttgttttgccgtttgtcgctcagaattggcattttgagaggtgattgatactgctaacaattttctagtactctagtttgtttcaagaagagattttgggtagacgtaatcttcaccctttcaaattatataacaatacgaacattattttttatactgatcataatttccagatttggggagggggtgatcgtggcaggaaaagttgtatgtttggtagttgcatatggtgatttttgatttttcaatgctggtaggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggtattaaaaaacaggaaaaaaatgggacaaagtctctcttgtatgtatccacataatttaacaaaaagatggataacaggaaaactttttgctttagagaaacttttttttttcatttgaacacttaactactgcttaaataaatgtactgtatgatcatttatatataaagttaagtattaggttttattgaaaacgtttaactttgaagccataatcttacctggaggtctaaggagacctcgtatatcactgataatgttaatgggatatattgacattttagttaactattagtaattctttaaaaatagttaagtgttgctttcttgaatacacttttgaggttatctttcctagtttttggcaaaataataatataatcgagattgggtgttttataaagttcctaccccctcatttacttgattagcttatttccttctgtattagctcttttgattgtgaactacctgagccactgtgttgttaagggcatctgccattagagggcagaagttgcctagacttagcctccgcaaatattacgattaacctaaaataaaagctcatacagtggaagaaataagtcagaatgagaggtaaatttcttgctgacaattacttagtaaaaaaaacttttccacgtggaaggaacactgcacaatcgggtgtattcaaatttaatagttgatgaggggtgaactgtagtcagggtagaggtattctgggaaatagaacttgaatgccacaagcagatttttaaatgaagttcattgggttgtgttggtcatctttaagggctcttaagataatagagggtgtagggaaggagagtggtgctaaattgaggggagccaacttcttcattagcctgacagctaataccttcccaaggtttatatacatgaataactttttaaaatgaaaataaatagggctttgatgaatttcttgctaagaatgcattttaatttcatgctttttgctttaaaggtattgttactagatttgaatgttcacatcttaagttgatcagtgaaatttgatactgaagctgaagaattgttgggtggcttattttttgaaagattactgcatttctttgaagctgcccacttacctttttgtgctagttatgtttttggtaacagtttctttattaattttttaaaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgcaggtaaaatggtgggtgggaagactcagagtttgtattcctgttgtgtaccaagaacagttccaaattgttgcatgtgcttatatcatttaatcacaagcctgtcaggtagttgatattgttacttcactgttgagacttcagaaaggttaaattgctcaaggtcatacacgtagaaaatggcaaaaccataatttgaacctatttgactccaaggcttagtgcacattccattataccatttaaaattttgaaacattgcactaaaaacaatatttaaagaaaatcctctggtttggtttatggatgctgcaggacattaagaagaacttgagactagaggtctatatttgtagtaacaatttcaaacaacagtgcctagaataaaagaaatgtctcttcaggtcctgaagaaacatataggtagagagagcttaatacctaggatgggaataggcagtattaaaaaattatgcattaagacgtaaaaggagcagtgagtggaggataggattggattggcaagattgggggaacggtgcttaaaggtgatactggacgtgtaaaggggccaggatttgccttgtggtttcctaaaggggattagggattgccacttacatgtggagcatattgaatttaatcttaatctctagcatgtcaggacttagagaaatactgttctagagatatttatgtatttgagatatttgtggtttaagttaagaccaaaacttgaaattcctacaagatacttgataaaggtatgtagacgtcattaacatcagtcacttaagtaacctattttatattgtgtggttggattctttagttgcaagtatcccagaatacagtaaagctaccacctccatcagaagcatgcagttgggggtcgttaaaaatgctgattgttaggcaccattgcagacctgaatcattctgggggtggggagggggcatccagaatctaagtacattccattggaggattttcaaggctgctgttgctgtgctgggcttttgctttatgtatgagaaagataggataggtggattccaccctgaagtgtaattggtcgagctgtttctatggttaatctaaacttcatttgattggtgaattccaggagtaggcatccattaaattctcagtgagttgctgaaatttcaactactaaaatcttccatgtttttacttaaaactttattttctgttttaatagccgattatcttcagttcttatttattactaaatacagaaatgttactaagattcgtaagcattggtacaaagctgctaatattttctagttagaactgtgcttaaagaacaatactgtacttgaaaagtgtagcgtttttagcttaaatgtcaataatgtagccttttaaattgaatttactaaacaatctgggtaaaagactcatctttctaaaattattcacatgtaaacttccattgttactattacatatttgtcattaagtgtggttgtattggttttaagcaaaatgttcacctcttctgtccacagttctcttagtgttagatagctctttattggaaagagtgatctttgttaagcttttgtgttttctgtttgcttttttatgcatatattttagttatcttaaaaatacagagagtgggccgggcgccgtgactcacatctgtaatcccaacactttgggaggctgaggtgggtagatcacctgaggtcaggagttccagaccagcgtggccaacatggtgtgaaaccccttctctactaaaaatacaaaaaattagcttggcgtggtggcaggcgcctataatcccagctactagggaggctgaggcaggagaattgcttaaacccggaaagcagaggttgcagtgagccgagatggcgccattgcactccagcctgggcaacaagagcaaaactcttgtctcaaaaaaaaaaaaaagataacagagggagaatttgttaatggaataggataatagaagatcgcaattgaagtagaaatccaaaggtcctttgtttttggccttagaattacacactttacaactaaaggatagcaggcagtccagtgagaatggtagaggagaaattagtctcagtttgccatagataatcaataattgacttacttaaaatatagtctttgcttttaatgtctgagaacttgaactcaaatattcttgtgttaagtggacagtgttgctttgaaatggtaaagaggcagacgttgaatatactcaaaatgtcctaaactaatactttcttgtagttcttttttttctttgccattaaatcaaaattaattcattaggtcataaattagtgtggcagtctttaattcccattacagccttaatgttttaagggactttgggttacttgtaataaaattggaaatgtatgggtcatggtcagatcctctcgtaggagttcagtctcctctcagagctgaccagacacaatccttataaactagtagccaggttctaagacagcagtgagagccccagctaccacatgccacatctgagtggttctaagtgataccactctgaaaggccaccagaaccatggtgcctgatggtttgcttgcatagtagcttgtaccacattttacaaaagcattctagctttctgtaatcccgaggtgccaggttaagcaaaattaaactgttttctttcctgatataatagctgatatgcgttgtgagcccctaaggaggctacaatatgccattttttccaggatttctacccacttctagaatatcttaagaacgaatctcggaatattaaggacttttgcttttaatacctgtggaataggtaagatgcgagggactacttgcatagaatagaaacattttttaaaactagcaaatattgaaaatctacttgaggacaaggcatttggagtattaaatgagatttctgttatcaagtaacttaagggcaccaaaaaatggctgataatgcaaggtcattgtgagtgccaaggaactaggagttcagggttgcctgcactggcaacaggagcaagagacaagtatgcgattttctccttcatggaatagtcttgagctgggccttaaagggtagataagtaagacttagttgttaataacaaatgctggagaaacacacgtgaaaatagttcaatttgaatgaaggaaacttgtagaagagtagtgatagggctaaaaaggatgaagctagaaatgtgaaagtaccttttttttttttttttgagacgagtcacactctgtcacctaggctggagtgcagtggtgcaatctcggcttactgcagcctccgcctcccgggttcaagcaattctcctgtctcagcctcccaagtagctgggactacaggcacatgccaccacgcccagctactttttgtatttttagtagagacaaggtttctccgtgttggtcagtctagtctcaagctcctgacctcgggtgatctgcctgcctcggcctcccaaagtgctgggattacaggcgtgagccaccacggcacctggtctggaattttttttattagaataaaaatgcaactataagactgttttctcccttaatatatcttcagcagagaaataacttttccttatagaaaaggagagagagccaactaacctatcatttcatgctccagatccaaaactgttggatttatgattattttttaaaatggtaatttctccatttcaaaatgagtaagcaggccgggcatggcggctcacacctgtaatcccagcactttgggaggctgaggtgggcagatcacctgaagttaggagttcaagaccagcctggccaacatggtgaaaccccatctctactaaaaatacaaaattagctggacgtgatggtgcatgcctgtaatcccagctactcgggaggctgaggcaggagaattgcctgagctcgggaggtggaggttgcagtgagccgaggttataccactgcactccagccagggctacagagcaagactcaaacctcaaaaaacaaaaacaaaaagagtaagcagatgttttggcttagactaaaagattcttcagcttttcagacagctataagtatactaagaatttgagttatgagttaattctaagtggaaacgcccctttttcctcttcacaagttaagtgtcaatgagtgattcatacactgtcatttttaagtggtagtaggaataagataacttgaaaggatcttacagtcaaatgggaaaaaccagagaaatcgatactagtactagagggcaacaaatgctgttacaaattggggtacgtagaggaaggtacttggtagaggacaggggcatgtttccggggcatagatcaaagtatataaataaggaactgccaggccagttgcggtggctcactcctgtaatcccagcactttgggaggccgaggcaggaggatcacgaggtcaggagatcgagaccatcctagctaacacaatgaagccccatctctactgaaaattagtcaggcgtggtggtgggcgcctgtagcccgagctactcgggaggctgaggcaggagaatgacatgaacctgggaggtggagcttgcagtgagctgagatcttgccactgcactccagcctgggcaacaaagagagactccgtctcaaaataaataaataaggaactgccgggcgcggtggctcacgcctataatcccagcactttgggaggccaaggtgggtggatcacgaggtcaggagttcgagaccagcctgaccaacatggtgaaaccccttctctactaaaaatacaaaaaagtagccaggcatggtggcgcatacctgtagtcccagctactcgggaggctgaggcaggagaatcgcttgaatccgggaggtggaggttgcagtgagccgagatcgcgctactgcactccagcctgggcgacagagtaagactccatctcagaaagaaagaaagaaatacggaactaacttgtgatatgttctggaatcaaaagtactcttatgataaaacaggtatgaaagggaacatagatgagaagcatgtgataaaaaccacttgttcaccatgttatactactggacaaggcagaggttcacatactgtgtgaatgggattcagagtgaggaggagactaggctgggatggggtatttggattggacatgattgcgtttataagaatgagagtgttaaattggatttcttgctttatttgtgacatttcagtttattagaaatcatgttaccattagaaaaattgaagtttcctagtaacaaagtaatttgatttgtgtaacttgataaaagatttactgacttaagcttttgttttttttcataagctgcttttgagctttgtcccacaggttgtaaaatgtaagcatttggtaaaattgtcagcatcttgcccagtcatttttttaaagggttcaaaaacctttttgttttaattcgtatagttgggtcttaactattggaaataacatcatcagtaattttttcttcattccttttgcaggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcattctcaaaaaaaaaaaaaaaaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggagacgtaaagcattaatgcaagttaaaatgtttcagtgaacaagtttcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgagttgtcctacatgcaagtacatgtttttaatgttgtctgtcttctgtgctgttcctgtaagtttgctattaaaatacattaaactat

SEQ ID NO: 37575 - DNA, 57879 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaaggtaggggccggcgggcctcgggtgtgggagcgcgggccgcggcctccggtctcctgtgcgcggcagcacttaaagccgccggccgggccgcgccgggacctttgtgccgggcgtgggggtgggggcgggggcgggggcgggggcggccgccagcggttgggggctggggcaggattccaggctagtccaggaggaagtccgcacgccgccacccgcctcgggtccccggcgctggcagcccccgggcgcagagccagcccagccgcgttccgaacgtgagggtcgccggcctgggcgctgtcacgtcggggctgccggagctgcgggggaccgggcccgaacggcccctgacacctgcggtctcccgccgggctgggcaagcgcaggtgggagccagcgaggccacccggggctcggcgtttgggactcggcgctcccctggacgggtccggtgcctttgtctctcgctccctcgcgagctgctgtccttggagcagcgtcgagccagccgtcggcgcccgcgacggggactggtctcctccggctgccaggaggcggccctggggccagcgccgcgggcgggggcggcgggagccgggtagaagttggcttagtggagccgctggggaccgggggtgcggtggcggcagtgcagtccacttccccgtgtttataaacgtcaagagtcgccggtccctgccgggcaccccgggaccaggacgcatggccatggccagcttgtgctcagacccggtccgcgagcctgagagcccggcctgtgtctagtatcattttaccgcgtgtcatttcttaggcttcataaattggatttatgagactcctactctctaagtaacttttatttaatcaaattcgtgcttttgagtccaaaactttgcactcattggtatgatcattagtaagttgcattctctaagcttccgtttcctcatctgtgaaataggaacagtaatatctacattaataattcatttttataataatgacagtgagggccaagtttagctctaggcattttacatgtattatttaattctggaaccgctctaatgagattggtactgtttcgattcccattttccgagtgaagaaactgaggcacagggagcaaaagtaagttgcctgtggtcatcaggagctcctggagaaggcatggggtctagttccagagtccgcgtttaaaccacaagtaaccttcctaactatagttctgaaaatcaaatgcaaaatgtaaaaaacttagcttgagagtagatgctcaatgagtattgactccttttcagcccttcttttatagtaaaaagatgttaaaaatatctcggaagataattggtaacatcattggtaaggtttctttgggccaacatgccacatggttaacttaggtgggtagaattactaggttatttcgttttgttttgagacagggtctctgttgcccaggctggagtgcagaagagccatcacagctcactgcagcctcaacctccgaggcttaagttacttttccacctcagcctcttgagtagctgggactacaggcgcctgccaccgtgcccggctaatttttttattttttgtagagacaggatttcactatgctgcccaggctggcctcaaactcctgggctcaagctgtcctctctcaccgagctcccaaagtgctgggattacaggcgtgagcccctgaacctggcccttaggtttttttatttttttttttttaattgtagttttaatgctacaaaaataacatgctagaggaatttagattagacacctttcttaaaccacatacgtcctttacgataggttatacagtagaccaattttagaaatgattaaggaacttcagttggcagttacctgttcatttgtggacatcaaggcccagaggggttaggacttagagtctcactataattctcatatttttaaataatgttgactcattgatcaatattatataagtgactgaagatggtgaagtgttaaataaaaaacattggtattttcattacaggcatttggggagaaagtcattttacttatcccaaaattgagtatgaaggtggaagatgttattagaatgctagttaaaaggacaaagaatgtggttaatactttaattctgtaaacaggaagcaaatagattgtttaactcgtctgtgttgacttcagacctaaacctacaattttaagtgtttgtgattttcttaatgtaaagttctatattaaagttattttttaataccctcaacattctgcacatgagaagcatggaatcagcaattctgaaagtcactggatttagtaattttaacaattaggcagctttctggtcagtataatttaatttaaatcagccccgaattaccatcacgaatgaaaatgtagctctacattggtgttcttcctaactctgggagtgacactggggacatctggtcatattataataatgaaaagtggtcaaacaacttaacatggtgccagttttcctaagcgtgcttgccactgattgtaatgcttttattgtttggcttcttgataagtaagttatggcttacagcggtgagtagtatagtgttctgtctgaaaacatattcattaatattctgtagctgctctggtttgcccttaactatgctgctagtgtgataagctgaaacatcttgtaactggtaaaagtttcagagaacttaactttctgaatatgtaacaagctgcatgtatctgaaagggttcatttagacttctgttagatattagcagattttctcactctgccagagagttaggatctgttaggttgtgggtggaatcctggagattatgccgggtaaatatgtaagtacctgtattgtattagcagtgtttactctgacttggttttaggttctgagagtttggctggttattttttcagaggtgggaggtatggagtagagacgttaagatacagaaaggtacattcgtcttctgaatcctgaagtgttatgctagaggtatctatagctgtggaaaactgaaaagatattatggtatgtacccagcttaaagggggtacagtccgtaaaagtcagaatattagcagccttccaatatgtctgtcggtaggtgaaaaaaaaagtttctctctttcaggagctgtgtacaaaaggatccaaactatactttgtacatttgttattgttttaaaagtggctgtgagtttttagaggtcagctaactttaaacttgccgtttggtttgtgactttagaaggtagagttaactatatttagcaatatgcttaagcgtgtgcatatcacctcatgaaacgtgtgtgtgcatgagaaaagctgcctccagtacacatacatatgtatatacacacatacacacaagcacatatatgtatgtatttcttataggaccaatctcattgtacataatttcaaagcacaggttcctatctccagggatgcataaaaagactcactgaagtatagggagaaaattttaggtctactattatgtttgttgatctcatcactttaaaatttaaaattttgattatgattgataatcttactatattgctgtagaagtacatgtatctgaatttataaattgcatttattttgggtacaggtatgcctagaatttttttgctgataaaggtgagtggtcagaaagctttgcagatccctatatggaggatgatttgagtggggttcaagaactactgtatttgggagggagaactgataagacttgataagagaaataaaagaaacccagtgtgacactggtttctggctaggaggtgctgttcactgaggtgagagggtgaccacaagctgggggtgctggttggctggagcagaggggaaatgatgaccttatgaggccaagtttttttttttaaggtgaccatgggacataggtggagatgtctaaattgcagttgaatacacagattgagagcttaaaaaaagaaaaaactctgagagatttcaatttgacaattcttagtctattgctggttgaagctataggctgtgcatgcaaacaccaaaggagggtgtggagtgaaaaacgggctgaaggaggacctgggaacacttttaatagtcaagggggggtggaggaagaggaatctagaaaagcatttaccttccccagtttcttctctgaacttctaattcctttgagtggcatttttgtgagtgacataggtatttctgggtttttccagtgattggcatgtttgagttaaagacagaaagacttcattggtcacatttctttgtggtaatttattttcagatacctgatcagagaagcagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatgtaagtagagtgcagttctctctccatgagcaactttttttttttttgtatcaccagagagtgtaggcactgtgccacttactctgttaaggatacctgccagcgctgaccagcaacatctgtccctgtcagctctgcatcaggatgtagcttggctgtacattacattttattctatcagtacattgagtaccagttacctgaaaaatgctttactcagtggacatgaatcaagaagttggcatgctctttgatgttgagtctgttgtctaattggaacaagttgtgttcagttcaggaaaacataaataccaaagagtgttttatacaatgtactgtaccataaaatactgtaccatgtaatattccctaacaatgttagaaaaatctcagcattggcttgtgtggttttggaacacgttgtgtaggagatgaggcctgagcttggaatggtatgagcgaaggttggatgacagatggttgtcacattcaaggacagcatgggaagaatccaatctaatttcacagatagtacctggccactttgttacctattaggagttatgtataatatcatatatatcagaaggatatgtgaaggctatataaaatgaaggcctgggttcttgccctccaatactagcctgatgagagacacagacatgaatacaattagttacaatagaagtttgaatagaaataacactatattattaagcatcactgaagatttgtcattcactctgctgggcactatcaaagctgttttggaaccacagagaaggagtagttaattaagttgattgtggttggtgaggagatgaagaggcaataaagacagaaaggaagaagaaaaatcagcattctattttgtgtagggagtatagtttcagtggagtgatgaggaaaatatttacatacgaaattaggtatgtaccatttggagtatggaagtcacatttttctgtataaatgtttattgaatgaatatgtaaataacttaagctttcgtaatctatgaaattagcaatagattattcttctccatgtacaatattttatggtttatgtatgattttcttcatattatgatttcagtgcttcttttaaaggggtggtacagggtcatgtttattggaggaggaaattggagtttgaaaaagcacatttggtagtataatgttatgttagaaaaatgttacaaaaaagtacaatagggagtaagatttatgcttattaaagaagcatggattaaaaagattgagaaacatttattaaagagtcactgaggttcttgttttagaaggccatgattaatgagttggagaacaagaagcaaatttggtaatcatgtaaattatgagctgctgaccacctagaaatatatttgctgataagagctttcatataatgatcatattttatctttccaacaattagatactgtttacagcttactgatgtgtaaaatgagaaactttttttcctatgtttatcatggttttaaaacatttatcatgtatttaaaatactgtatgcactccaccacagacaggatggagaggaagatgtgacaaaagatgtggtcaaaattagttttaatcaaggaagcattttggaatgatctgcttaaaaagtggatataattacgcagtttgagaagataattctccttaattgaaattacggggaataagtcttgctctcaggtgcttattgataccgttgatcatgctggttcttttgctggctccactcacaattatctttgacaacttgccccaaagtaaactttctcaaccaaaaccgttcccaacttctttcctcctcacagggaaaggcaaaaaagtccgcaggcatagagagtggaaagaaggaacagcatactaggctggtttgaaaaacaatcaattgctaggtaataatgtcttaccttttgagtggaaggaggagctgggaagaattaagttcgggcaggttttttgctcattttggatcagcccttcatattatggcttaatagctttgtttatagtgtatttttctgcttttacgttcatcctctgaagtcttgagttaattttgtgcccctttacccccatttgaattaaatgcttcatttttttcccgtttctcacataaagctatttttttttcaggacagggaggggctggtggtggtggtggtgctgtaccagttgtctgtttatgagatcaccattagacaacgtttctcattggcttgaattatttgaattttgtgtgattttcctgttatgttgattctgttcttggtgtctatgagttctgtagaggattccagcctaaattttcttccttagttctgtttacttttcctcgacttttgtggttttgctctttgatcactgtcaagatctatttgagattttctgactttcttgaagagcagaatgagatctagattttctcttatttttaaagaagattcttcactgacttcctttcactttttgttctgtggaagtctttcctaggtgttaagtttccaggctttacctccccctacccccaacgtattatctttaggcattttgtttgccaatgcgtactatatccattatttatctttcccttgcacttgtagattgggtggtgataaaaatcttccatatttcattttcctggagaaggcgggtagagtcactagtgatgaattttatcttcaatctgttgtataattttcttaaagtatctcgccgtgttgtgagctgttctcagatttcaaattgttttgtgaacctatagctttggagcagccaaacctttgttgttagagcttcttagcccaggctatcattatcattgtgtgagaaggggttagtgctctttaaaaagccatttttcttctgggtgggagtggtgaattttagatggttttctaattcagactacttttctgtttgtcaaggagaggagaagaggacttcaaatgtggtgttacatctttgggatcccttagcctcttctctttcatgtctccttttttttcttctctattctttctgcgaagttttgttaatcattaatgctagcttattaatatttgggccataaacacctctgtagtgaccaacacacctcttcctgccagatggaaggaaaaaaagtgttgagttttaattgttcttcctgtaaggggaaaggttccctttccatgggaggaactcatctccacatgtcaccctctcagatggtacagaattcagaaagatttctcagtttcttccattcatgtttttctcgtttttattactctctatgtgggataagtgggaggaacctcatgtctttcaatttggctctgtgttcttcttctggaatatattgatttttaaatactaaaatctgttattggcctatttcttccccttttaaaagcagatacagaaaataatgatggtagaacagacttgggatgaatccaagtttattataatttttaggagacatttatgatatacctctataggtatcagaatcttttctactattaaggtgaaaagatttgagattttgtgaaatcttttgtgtattctttttatttgagttggcttttaggtggcttatttttcaactctgaaatgaacataacatgttacatatgttacatatgttacaatttttttctaaagtgtagttgtttaatttctacaaagatagtccatataaagtttctaaagattgtaaatttaaaaggaaatgccaaatgaattatttgtaaaattgtttaaaaaaattaataaataatgagtgtgtatttaaaagtttgaacatgatataaaaccatacttttatggataaagattagtttacagtgaagattaaaacaattatgcactatttttgacagtggaaacaattgcacatatttgggttaaccactaaaatgagattatttgtgggtggtgtttaagattgtttattgttcagggaatgaattatgaccccttagataaaatttcatatggtaaaaaatgaccttaaggtgaaatgcttttataggaacaagacacaaaacctttgtctgtacttatgaaatatggcaattaaaataacttttcttggcctctattaagttcaaatgcccaagaaataaactcatagaacattataagccctttccatttctgtgccctgagtcagttctaacactagaaggatgttctttgttttaaaatagtgattaagtaggctttgaaaaaattacagtttaatgaagtcaggtcatagcttctggatacagatggtcaggtttcaattccacctgtgcaacttttgattccaccattgcaagttgtttagtctctctggttttgtttcctcatctgtaaaacaaagacactattattcttcacctcattgagttacctggaggagatagatgctattattttatcattattattatcatatccatttgaaggtgctgaaataaaattctaattttttaaagttctaaatgaaataactttttgttacaaattactttaaatcatcaaaacttagtgtattatactcttcttcttgcctgtgcctagtctggccctctcaattgagaagtcagtctttttttttttttcagtaatccacagtgagcagcagtccctgaacgaaatcatattgctagttgggtttgattaataaaacacagaattggtattctagtcctttcaggggggtttgcttccttgtgatgtaagaaccttgtcttagtctttgtgctgctataacagaatgccacagactgggtaatttatgtcagggttctgggggctgggaagtccattatcaaggggttggcatctaatgtctttctgttgcatcatcccatggtagaaggtggaagggcaagagagtgagagaagagaaggaggccaaactccgtcttttatctggaacccattctccactcctgtggtaatagcattaatccattcatgtgggcagagccctcatgaccttatcacctcttaaaagtcccacctctcatcactgttgctttggggattaagtttccaacacgtgaaccttggggacacgttcaaagcatagcaaacctcaaagcttcctccttatttctgtttgtattaggtatgttattccctcccctcaatctttttttaagggtttctgtgatatcagtgttcagagcatttgtattttgtctactatgtttttatgatattagtgttcagagcatttgtattttgtctaacatttactaccttaaatattttgtcagtataaaatatttaaggttttgctgcttttattactttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaacttcacaaaacccctacaaggtaaatactgctgtccccattttaaagatgaggaaactgagacagattaatttgccagtgtaactctgcactacacaatgttgtacaacggtagatgccacaaatatctgctgtcatgaagctcagtgttttattttttgatacctcagagtatctccagttgtttttatcgttagtttcttcatttattcaatataaagacattgcgctagatacagaaaacatggagaaacttctagaagatgacaatttataaggcaagtcaaccatgtacatcattagtagatgtataagagctacatatgccccaaacaggaaaccttttaaatgaagattattatatatgttttaacatactgtgtgtatgtacgtacacacacacacacacacacacacacacacacacacggctatatgtgaatcacctggctttagtctttctttcctccccagttcttgccataattcgagggcttcaagagttcatgcagatgatacttctcacaccttggtctagcagttttctttctttcttttttttttatttaatgaaatttcagtttattcagataaagactaatgtatgcctcataacctagtgataatctataagtttgggagttcacaacatttttacaaagcacataatattaacattcaagtgaggcattatagaaagttttataaagaatgaagtaggccaggtatggtgcctcatgactgtaatcccaccactttgggaggcagaggtgggtggattgctggaggtcaggagtttgagaccagcctggccaacatagcaaaaccctgtctctactaaaatacaaaaattagccagccgtggtggcacatgcctgtaatcccagctactcagaggctgaggcaggagaattgcttgaacccaggaggcggaggttgcagtgagccaagatcatgccactgcactccagcctgggtgatcaagtgaaactgtctaaaaaaaaaaaagaagtctttactataattcttttaaaaaaccttggttcatcttgaaagactgatgaatttttgaaatacctgcagaaaaggaaaataatcccccccccccccccagaaatacatacaaaccacttattggcacttgtgttttaagtacctggagaaaaacaggacagatttttaaaggcaattaataacagcttatacaaggccttgtttcatttgctttagcaccaagtaaagtaagagtaaatatgctgtggaagatggtcaggtttttcctccttctctcatatgccccacttctcctaccaggtcacagtacatcagcagccatccttgttgccccactgaggaatcactttagattccagtatttaaatggctgctcagatgaaaccagtagaattctttccccttaagataaggtggcagtgaatgctagcaggtatcaatttctttgatcaggaacaaagaactccttcagaaaactcacttttttggtctttgttaacctatcctgtgaattctttttattggcacaccttgtttacgaatcatgattgattgctatttatgccaagggaacattccgcaggcatgcctgatctatttactaatgacaaagtatgcttactttacataattccataggttttctcttttatttttgggaggaggggtataataacttgttatttatcagggcagatcatatatttggatcaaaaagagaaactggcaagtagatcctaaaacacatttcttaacccgagtaacatctgaaaacatagatttcaattatattttgttgaaaattcattcaactttggtgcttatccaagaacttataatgtcaatttctgacaaaaattataaccctcaatacatatgtattttcaaaagaagagtcatcttaaagtaatatttttctgtatgttaattgatacatttttatagcaaattgaaaattctgagtaaattgaaagtatgtttaacaacaaaataaatacagcatatatggttagcttatatatttattagtgtaaaggcagcagtgaatttgtatcttacaacaaatctgtgaatccagttgcttttttttctggaattttatgtagtatcaccatgctccacaatgctagaaatgtggcattaatctgcaaaaatttctgatgagatactttccccaaatgacatgtaactttttaaaacttttccaaaaaatatggacattttatcaatcacttaatcttttttttttgagacagagtctcggtctgtcgcccaggctggagtgcagtggcgtgatctcagctcactgcaagctccacctcccaggttcacgccattctcctgcctcagcctcccgagtagctgggactacaggcgcctgccaccacgcccggctaatttttttgtgtttttagtagagacggggtttcaccatgttagccaggatggtctcgatctcctgacctcgtgatgcaccatctcggcctcccaaagtgctgggattacaggcatgagccactgcacccagcctatcaaccacttaatgaacaaaaagttagattactaccaattgttcatttaattttgctctaacgtgttttaaaagttaagacatctctgatggttttgcaggtgactggataaaacacactagatgatttcaaaagattaatcttagtatctgactcgtttggcacatcctcagtatccagaataaaatcagtagaaataaaagtaatataactttcaaagaattcatacatgctggaggtcttaggaaaagcagtttttaaattcaaggaataggaggtttgctcatcttactagttacacacatttctcctcatggagtaatggcagctttctggcttctttgtggaactttagtttgtagaaaagcttggtaatattccaggactggctttgtttgggcttcataagcctttagtcttttgataaccgtctctggtttatcatcctcatgctgaatgagaggatccccagtcagatcatcagtgcccacagttttgggagggttgaattcaatgttgtagactcagccactggcaggatgaatctagcgagcagtaaggcattgtttaatgacctcaaagggcacattcgggctaatcactttgtctgtctaagaagcttagtctagggcttctgcctgtggaagtgtccatggaaaaccacccaacagctagctatactaagtgagatttttcagctcatatagggccagctgagtcatgacatcatctcggatgagtttcctttggtcaatgaaagcgttagctaacacattaatttctgtgccccgcagcatgttgatcctggagcaggtctccgctagagaggtgcttcacagtgtttggtgacgcgcgacaactagtgctgttgcctagcccagggcccccatgatcacggctgctgccgcgtagacgcccctttacagaccaaggcccacgccgcacccgaacaagggctttggcccagcctgtgaacttaccttctctgccgcccaggcccagccagctggcagcgctgctagtgggcggggactgtggctcccaggccttccctgaactctggtctagcagttttcttgtctctcaactttagtggccattggtcactgtactggaaacctcgtgtgtctttctcacatcctcttggcctctgattccagctggtgctgctgggaacagtcggtggctcactcctggctgactgcatgctgcctcaggtgcctctcttttgctttttcccctgcggctcctctaaccaactttcttgtctgttccctcttgtctgtccctgggcacgtgcactgtagttcttagaagtgttagtggagttaatgccctttgaggcgactttttacctatgcaactggagttgatccatttccccgttgactttcactggacagactttctacgtacttctcaaaagttttccacaagatcaagcccccaggtactcagtatggtaaagatagtatctttgtattggctttttctctttttcttggttcactgtcttcaaagtgtctctctcttttcctggggtcaccttccaataaactgcctgcacaccagttctgttcccaggctctgctttggacagaaccctagctaaaacaatgacctggtactgtatttttaatacaggccttttcccccaagactgcctgtctctgaaattgtaaattcttaactgtcgtaggttccagctcttttcacttccttgtttccgtggtcccctctcctctcacctccctgttgtgatgtctggtcttttgactttttcctcttgttaactttttggtagcactgcaccttctttgccccccacccccacctttcctcttgcacctgccctgcacaccagggaatagatttagtgattccaaattggagtctgagggaccatgggaggtattctcagagatttgggcatttctacaaaatttaaaaaaaaatcatgctttcatgttaataataaacatttagtttatctggttgaccatcttataacccagtaatataacttcagaatctatgtttgtacttggaagttaattttggtttcataatgtttaagagctatgagcatgagacattttatatctatctataagttggcttatatacttaaagtaattgaaaatttaagttgtcacttggatgtctatagtaacacttttctgtttagagaagttctgcacattaagtaattctgagacattcttctgagtaatgtcagagaaaaatgtcatacaattcaatatggttcagtgaaaatatttttaattttttaactttttgaggcagggtctcactccattgcccagcctggaatgcagtggtgtgatcatagcttactgcagcttccaactcctggactcatggccccttcccctggcccccacttccaccaagttttgctatgttgcccaggctaatttattttcttgtagagccaggatctctaggtgggcatgatggctcatacctgtagtcccagttacttgggaggctgagatgggaggattgcctgagcccaggaggttgaggctgcagtgagatgtgatcacaccactgcattccagcctaggcgacagagcaagaccctgtctccccccaaaaaaaaaaaaaagagagagagagagacagggtcgaggctagtcttgaactctttgcctcaggcagtcctcttacctcagcccctcaaagtgctaagattgcaggcatgagcctaacagcaaagagttttgagcatggactttgtgccaagtatttctaggtgcaatagctataaataagatacacccaggccctattttcttggagcctagaatccatcagggaagacatgttaacaaatagttagaagtgaaatgagtgttacaaatatgcctgtataaattagggtgtccaatacctggtgggctctcaccattgcaggctctcactgtaatcccattgcatcttcctaattttctgcaacccctaagccgtacctcttttcctaggagttcttcctatttcagaaaaaaacagtcatgcatgaatgaactctctttgctttctcacctcctgctctgccttagaagaaaggcaccatgtctctgtttagggtgatccacccccttgggctgcacatgccatccctctttgctccaaggaggcctggcttcatcactttccttttctcttttcctgtgtcttcacctcttcaagtttgcccccagttctcctttcttcctaagtattcttttcatcccaatcacatccattttcataagttcggttagcacctagattatgacaactctcatgtctgtgtctctaactcttgacttatctcctgagatccatactcatgtcctagcttcccaataggcatcttccctagattttgcaataaaacaaacctcattttttcccctaaccccattctccctcgtacatcttctttattttaaagtgatgattattctaaattcctttctttctcccatccttccttctccaagtaagcagcagatccctcatagctaccttctaatcattgtttgttcgtcttcttgtttgttgctgttatctgaatttagacatttgtcacctctcacttgaacctttgcagtaaattctgtatttgtcttccagctcctgtcttgccccctgtccttttctccactgagtttctgccatgtatatgtagaggtattactagcctgcccaaattttttcagttcccttcctatttatagaatggaatccaaactcttttagcatggatggtatttggctctctgtaacgtagctcttcctgcttgcttggtcttcgttcctgttatttccaactcataatttaagtctcagaaatacttcaagattccttttggcctttctgatattttaagattttaagataatataacttatacttacaatagaaaattataaggataaaataatcactcattccaccaacaagatatagttacaaaaacatacatttttctagtctttttttctataaagagagaaaaagtgagacagttccaattttgggttgcagggagctgcccaaatgcatatgcttagaaataagattaggaaggagttattataattcgcctcgggacttcatggctttgtatatgcaggccttttgcttggaatatcttctctccacttttctccacacccatctcctatgtgccttcaggtctaactgaaacactgccatgtgcctgatgcctctgaacttgtccaggcagatttcagtgtcctcagtgcactgtgtccttgtttattactgaaaccatcatatcataataatttgtatttttgtccttgaactgaaagttccctgaagcagtgacccttgtatttcctgatatggctcaaaacctgacagagttgtctgaagaggaacctccagaaaggcagggggaaaccagtagagttcaagggagtagagtgtgttaaagaatggtgaatagtcttacatgttgctttgtgtaaattctttggtagtaaaccgatgtacttcttcaagtgcatattgtagtgagtcaaaaaatttgtgaatgaatgagtgatgaacgaatgaatgcagagagtaaggtaaggcctagaaagggttcttttgcaagagtaatttcacatatatggttgggcatggacatcagttacacagttatgtgccacataatgacttttcggtcagtgatggaccacatacacgacagtggtcccataagattataacggagctgaaaaacacctgttgcctagtaatgtagtgtcatagtgcaacacattactcacatgtttgtggtgatgctggtgtaaacaaatcgaccatgctgccagtcttataaacgcatagcatctaaattacagtgcataatacttgataataaacaactatgttactgctttatatatttactgcactatattgttaatttttttttttttttttgagatggagtctagctctgtcgccaggctggagtgcagtggcgcaattttggcgcactgtaacctccatctcctgggttcaagtgattctcctgcctcagcctccagagtagctgggactacagatgcgcaccaccacgccaagctaatttttgtatttttttgtagagacggggtttcaccatgttggccaggatggtctccattacttgaccttgtgatctgcccatcttggcctcccaaagcgctgggattacaggcgtgagccaccgcccccagcctgttgttatttgagagagtatctctccttacagaaaaagtaaaacagcctcaggcaggtccaggtccttcaggaagtggtcccgaagaaggagatcttttaggagatgacagctccatgtgtcattggagacaggatatgcaggcgcaagacagtgacattgatgatcctgacccagggcagctgtgcaggctttaggctaatgtagtgtgtatttgtgtccacagtactgtgtatagtaatgtcagtaatgtcctgttcagtgtgtgttctgtgcagtgtactcacttgcccctctcactcactcactcactcactcactcactcactcactcactcacttacccacccagccatccagagcagcttccagtcctgcaagctatattcatggtaatagaggtgcatcaattttaaaatcttttgtaccatacttttactgtgtagtttttctgtgtctaactgtgcgtagatacacacatgcttactgcagcattccagttgcctgcagtattcaggacagtcttgtgctggacaggtgtgtagcctaggggcaataggctgtaccgtagagcctggatgtgtaggaggccacaccatctcggtttgtgtaagtgcactgtgatggttgcacaaagatgagattgccttcgcatttctcagagctctttctttgttaaatgacacatgaaggtactgggttgaggagagggaaggtaggtaggaaatggagaccagtgtagacaactgtttctaggtctttgaccgtgaagaggagacaagcgttagaattaggacagcaactgaaaggcatctttccctgttatcccctcatactctgttttatatggaatgccattgggaggaaaccccttcaggtccttttctcagcataagaatcacctggagtccaggccccatgctcagggattgtggattttaagcctagggcatccaggtaaacccaatgcagttgttctctaggcccacttagagaagtgctgtcctgggagctttgtggcgtaggacttgggcacctgttccttccccttccatgcgcatgtgcagggggcacccagtaccggtagaagggaaggccagcagcattgaaagcgaggctccctggccctctgcctctcctttcctgtccgggtctctgtggcttgcttccctcaggccacttctaactgtggtctcctctccgccccctggtcctgtagctcttctgtgttcttaattggagtcatcctctagcctttccctttccctgagagaaagcctcgccttttacagatatcactagccaatggcagtgcctctctgtttcttgccagtgccccgccagtcgccagtcgcaggatcgttgacatctgtcattaaactgtttccagctgctggccttgttctctcagctgttcttcaacactgaagccttgtttcgcctgcttccgggtttggagctcttccggaggcacaagggtttcagaaggttgactttttgccttgtcaaggtttatagaaggaaaggacagtgacatttaaagtagtgtggctccgaatgttaggaatcattttctgttacctaataacttcatcttagtggtgattgtctaaattgtatgatatgttgacagatttctcaaagcagtctctagtgatcattaaacagcctgagttgtatcctgaagaaacatgtatctgtccatatatggaacaaatatttgttccattccctttgtgtggaaactgcctgcatgcttcattcatcacagtaatgcatttcctcaggaacttttaatgtttcaggtgtctgttgtcatagctttggaatcgtgataacattatttgacttgcttagaattatagtctaatggatttactacacactaaaccttttagacaggccttgaaaggtgaatttggtaggcatttcacacttctgtgacactcagattttgctggtctcttggatacagtcacaagtgatatgtaagcaaaactgcaagctcaggcataacagcctgctgggctgagcacgattgcagaagtgaatgacttttcacgttacgcttaactcttttctctcgggtgctcagagcacaacttaaagcattctctctgagccaggggaatagcatcctggaatgtaagcccttgaagatggaggtctgtaaaagaaatattcagtgttaacttggaattcagtgaacttttttcatattaaaggaaatttgtcaagaaaaataattgcacagttaaattgtgctacagttgttttcattaagaaagtagaaagaagaccctaacagtttaaaaaacaaatggccctcattgtctttatattgtgcatataactctttgttatcttcagattatatgaaactattagtattatttttatattcttctcatctttttttcttttgccttgagaaagtcacgttcttctcattgtgtactttacatccaaaattattttgtaactcttttttttttttttttttttttttgagacggagtctcgctctttcgccaggctagagtacagtggcgcgatcttggctcactgcaacctccgcctcccgggttcaagcgattctcctgcctcagcctcctgagaagctgggattacaggagtatgccaccacacccagctaatttttgcatttttagtagagacggggtttcactatgttgtccaggatggtctcgatctcctgacctcgtgatccacccgccttggtctcccaaagtgctggattacaggcgtgagccactgcacttggccctctataactctaaatgttgctgcattttattattgcaatgactaataagtccctaaacttgatgcagttagatttccctgttattggatataggatatttacatttttgctcttgtgaatatactagagtactatactgaatgtgtgtgtatatgtgtgtcaccttttatatatttaagtatttccttagggtaaattcccagtagctggattattagagggtagaaatttttttatggtttttgatataaattgtcaaattatttcccaaaaagttgtatcagttcacagagctaccagttggtttctcgcagccatctgctatagttttgttgggttaaaaaactttctatttttgctagttcatcttatgttgctttaatttacattttccaataacgattaaacctaaactttttttgtataaatttgcttttttgagtatttcttcttgtggagggacagatacttatatataattattagattggctgctagtccaagagcagtaagtagttaagggatcaagtcagcaaccagtggccgtagccatctttgaccaatcaaagatatagattcatatcatcgtgaaagctttgattcagagaaaatagttatatatgtacctaatggtaggaaattggggtagttgtatttagtatatagaatattacctaattttttggttagaggttctagaagacaagactttttcagtttgtcttatgccctctttttttttgttgggggagaggtggggggtctggacactctaggaaattaaaactgagtattttacttattgcatgcatagaagttgattttcttttcttttctttctttttttttgagatggagtcctgctctgttgcccaggctggagtgcagtggcataatcttggctcagtgaaacctttgcctcccaggttcaagcagttctcctgcctcagcctccggagtagctgggactacaggcacccacgacgatgcctggctaatttttagtagagctggggtttctccatgttggctgggttggtctcaaactcctgacctcaggtgatctgcctgcctcagcctcccaaagtgctgagattccaggcgtgagccagcgctcctggcagaagttgattttcttaaaaaagagagataataggaaaacaagctcaaaaatctatttggggccttatgcaggatgttggccttagcctgaagaaataaaaactgatgaagcgcattgttagcagagggatgacttgatcaggtttttgaaaacgaatgttcagcattgaggtaactgaggcatctggatatgctggtctgggcccctgggagccgcaggagataatggagatagagattctatgggctgagaccattggtaggttttatggtgttgaggaatacttaacactgattttttttttgagcgctgttaattaaatgttaaaatataatcggtttgctttagagaaaggcacgaatggattctggggctctggtatggaagttattttcgcagtgtaggtgcaaggtgagggaaccagatagggaggggagatgggcgagggtctgtggagaggggctggagtgaaatggtttgagagccatcatgtttataaaagcaatagaaggtacggtggggtaatactttctatttaatgcatttttcattttatttctttataactaatataaggcacattttacatttcagatgaatttacaaccaattttctggattggactgatcagttcagtttgctgtgtgtttgctcaaacaggtaaaaacaaaaaattttcttagttgtcttttcatttccgtatcttgtattgcgctttgaccagttaggttcatatgagaacctaagtcataatcatgctgctccttctggaagccctgcaattgttcctcttactcagagaaaggtcaagttccttcatggtcaggctcccctcacccctgccacctgggatgatgggaggcaagttggctggtgaagtactaaaatgctagggattgaacacactgcaagaagatcttttgagaacatgagagtgtgtaagtgaacagaaggcaaaagcaagtatatttagaagcaaatgaaataaatgtgtagaatggaggattatgaactgtccattattatctgcaaagactttctagaagacattctcactctttgataaaaaagtctcacaaaatgttggcatcatctaggaaagcagtgaaaataaagctgaaaatgtatttaacccttctataaagatgtggctccacatctggaataatggatacgcagttctgtcctctgaatcttgaaaaactacactgcatagagcagttcgatatcaggattggaaggacttactacaagtagtaaaaatgaagcaggagaccgtaaaagaaagtattgataagttagttacataaaatcagtaataacaaaaacattctgtgtcagaacaccgtaaacaagatgagaaactaaacaaaggttccacttcattaatgtgtatagaaatccaataaaaactgaggaacataacaaaaaaatttgcaaaagacataacaaaattataaaagaaatggttagtaaaaatatgaaacaatgtaaaacctgaaattgataggcttcaccaatgaattgatattctaatttacacttatgaaatgagcaacagttttttaacattaaagcacttcggttggaaatgtggtaaaatggtatttgtacactgccgttttgtgggagcttatattagtagtgttgccctatggtatccatggggaattggttccaggacctccttcagataccaaaatccacaaatactcaagtccctgatataaaatggcatgatatttgcatataacctacacatatcctcctgtatactttaaatcttctctagattacctgtaatacttaatacaatgtaaatgctaggtaaatagcttttacactgtattgtttagggaataatgacaggaagaaaagtatgtacatgttcagtacagacacttttttcccccatttttgatccgtggttgcttgaatccactgatttggaaaccacagacacagagggtcaactgtatattacttttggatagaaattagtgtgtatagagaattttagaaatgttaatatgctcttcaacttagtagttaattattcttttaggttttattataaggaaataatcagatgtgtactaaggtttatatataagatcatcagcatgtgtatgtgcatgtagtacagtatgtgtatatgtgtacttggggtgtttatatgtgcatgtgagcaagcatgtgtgaactgtgcacacatacatttggaaacaatctaaatttgtccagcattaaatagagtacacttatattgaaatacataatcattaaaagctttttaattctttttaaaaagaatttgtgatgataagaataaaacacttaggataaggtataaaaaacagtatacaaaactgtacaactgtatatataaagtgcatcctcagtttcatgtaaataatacatgtattaatatatatatgcttgcttccccttgctatttatctgcataggaaaaagactggaaagaaataggcaaaaatgttagcaacagtcctctctcagttaacagattcagtgagttggttctttatgctcttgtgtgttttccagattttctataagaagcatatgctggttttataatctcagaaaagatacgttggagacagtctgtattagcgcttaccatgtagaaggcatactcttccttaggtagatgcaaagaaacctaaaacatactttgaacatagagcctgagaaattctgggattatggattagatgaatatggacttttcagttatttaacatactgaaagcaaagggaaagccttgaagattcttgtgagtatggtaggagttaaatgacaagaaataatactttgcccagttttaagagaactcatgacatttatgacagtcaagaatgataaattctgaattatgtcttgtctttgatacagaagacaaggaagataacttatgtctctctgtggctttcagtgtcaaggtgatccaaaatcacggtcccaaattttgcattgttctcaccggtttgtgggagctaaaaattaaaacaattgaactcatgaagatagtagaaggatggttaccagaggctgggaagggtagtgagaaggtggggaggaagtcgggagtgttaatgggtacaaaaaaatagaaagaataagtatgacctagtatttggtagcacaacagggtgactgtagtcaataataatatagttgcatattttaaaataactaaaagagtataattggattctttgtaacacaaaggataaaggcctgaggggatgaataccccatttaccattatatgactgttatgcattgtatgcctgtatcaaaatatctcatgtaccccatacatgtatacacctatttacccacaaaaattaaaaattaaattaaaaaatcctgctctctttggggaaggtctagtttagatggtaactaggtcatagtattaatatttaacatatgtattgcattgtcattgtgattctgatttttcattattttctctctgacacttcacataaaatgttctgttctttcttctttctgacagatgaaaatagatgtttaaaagcaaatgccaaatcatgtggagaatgtatacaagcagggccaaattgtgggtggtgcacaaattcagtaagtaaggttgctcaagtcctttccatttgttctctggtcatttagtgtggctcagtgctgtatccttcagaagcacatattaatttttatgtaaatcataaaatgaataacctaatggtttggagctatgtggttcaacacagtagccactaggcagatgtggctattgagcacttttgtacaaattagaattgctctaagtttcaaagatatacaagatttcaaagacttagtattaaataaataataatggtgaaatgataatttttgtatatttaaaaataatgttataacagtgttaaaattttctctttttctttttttagtgtggctactaaacaattttaaaatacatatatttgtagctcatctttgtggcacatattagatttttatgggagaaccttcaaaaaaatcctagtcatttagtttgactgtttcagatttccccttttttgatggggaggtataaattaaccttcttaattatatttgagttaaactactggaattgatttgcatcccaatataagcttattgaggttaattagggtttggattttattcacttttgtcatctctatacttttgctaatatggtaccttccacaaagcctactaaatgttcagtgagtcaatgaatgaatgaatgaatatatcaaaagagaaggtaaggagaagtcattttgaggttgtatagtttattcacagaatgaataactaatatcagaagatcaaggggttactgattttgttttcatgcaggcatttgggcccaagtttcaagtgcctatttttgtatgcctaagtggtcaagtgtcagatatgtcgtatggtttgaccacatgaaagaaaaaatgagaggttttgttgtttttcaaaaattttctaatggtgttttctaaaagtggtgtgttgggattacattggcaacagtggaggaaatatggagtgttgtgagtttgtctcaggcaaggcttatgtaactgaagctcttggttttcatatctgaaaatgaggatgataatatccgctttatctattgttacaataattagaattgatgaacttaaagcagtttcacttaaaaacttctaaataagtggtagctgctattattgttaacatatccattttatggggactacagtttatctgtagttaaggattatcttagcctttgagctttggagcataatccttaaaattttaaaggctttctgaatatattcagtgaaattgtatttgggtgtcatgattgtaaatttcgtggattgattagtatttagaaatgtgtaattcactaggatcttgtgctttggtaggtagtagtttaggtttaataaatagtgcagctttgaattatctgattcttggtattcccttccagttgttgattacataaatactctcattagtatgatgtttctcttaaaaaatcttatgtaaaaactattgtgtattctttaaatttaaatatcttcacttactgttactttatacagcaccgttaaattgatatttgataaataaataccatatataatgtcactgtttcccccacattttcacatttcttgaaacacctttattcacagtctttatatagatctttaacagcagtgtttttgaattcactaaggcacttttcagttatatgattaaatttttatttctaagttgtttgatgtataccacatttaaaatctctgtcattactagaaattttactactgcaaatatccattcacctgccattaagaactttttttccttttttgaaatttacctgccattaggaccttttacccttgtcatatacttactccttttacccttgtcatatacttactattttgctttttaaaagttttttaaaaacttatttacaataatagctaatacttaaagttttttcaaacctgtgggaatacttatttaatcggtgctaaatttcgtgttgtccttttaaaaaatgcaataattaattgagatgtttttaagctcgtctgttttccctaaacatcgggttgttcagcatattgcgatggggagagtgccacataatatgagacgctttgtaaggacttttcaaagggaaattttggagaaatgatctgatatttgggtgtatgtatacattattagtagccattaaccatgctcaattagtgatttcactaaagaaattgcttttgattagatactctgaattacaagatagagcatttactgtgtacacttgggtcagttctgggaaaggtattactttcttggaaatgattgttttttaacaagaacacttaccacagtttggatgaagggagcattttgtttaaaagccagaattggggtacattagatgtgatttgatgttttgcaatttaattgcttatttgcaattattatgtaaaaaggtttgaccattacaattttcatttatacctatattttatatgtcatttagacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggtatggaagcccaactctgtgaatacctgcgtgtttacttgaggcattcgacaccagctttatgcaaactctgaccagtttctgttgaaggctcgtttttacatgtggactggcactcaaaaatgtggaattgtttaaattttagaaaatttttgcagatataacaattgtaagacatatttacttggaataatattaaatgttgcctaatattcaaagtaaattttgttaaagattcagaaagtattaattagctttagtgagttttaaaaatgaaagtgttcatcctctggtctaattacataatatattataaaagcaacattttaacctgttcttttcctttgtatttgtttagtattattaaactgttaaggtttttgtaattatgtctgttagtcccacatctaaacatgaaggaaaaaacaagccctcatcctcgcttttctggtttccgacctttcttgtcaggagaatggtagagtggccctgtcccctgacttccctcccggcccctcctcaaccaggtcagccctctcctcctcatcctgctctagcaaagctccaccatcgccttcagcccgcagacccaggggacccttgtcaggattttttttaactcttctgtaccaagtaacactttgtactttttgaaatgctctgtccttgatcaatgataccactcctcggtttttctttgtgtctcttaccattgccttccaggcctctttttgtgtcttttttcttcctccctttttgcagtccacctaaatgtcagttttcctctcgtggctttaaaacccaattgtatgctgcagcaacacagacttttcttgagctccaaacccatttctccaattgcctattagaaatctatatagagaaaactacaagttaaaattttaattacattttcatccaaacctctctcctgtatttcctaagtaaattacattaacgtctcttgtatctctctcttctcctccttcatcatctctctctgggtttcttttgtagattagctagtctctttgcctcataatgataataaaaataaaataataaataataaataataataaataaataattatttttaaagctgtctgccaggctttctaaagtaaagatcggatcatgttattcacttgcagggagtggcatcccactacacacagaacagagttcacaacttcagtgtctaaaaagtcagttgtaccctatcacgtgttctgccttgccctctccagactaatttatggtgttctatttgttttcttctcttataaactgactttttgtctgttttgtccactgtggattgggaatatcttttttatctttgcatcctgaaggcctggtgtttaaagtatttgttgaatgaaactgaatacatacccattgagttacttatggaattcccaggtttttgtaaaaattatgacaacatgttttattttattgtgtttaccgtgtaaaccacatttatttggtttttctcgtttgcgtttgattgccaacaggcaagtttcattttctaatctcttgtctaattaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggtaggaatgttgggaacattgaccattttcattataaagtcttggcaattctcaaatgttgttttatattttattcctttgttactcacaacatacttgtgagataaacaagccagttttttagccttttctgagtggaagttgatattccagtcacacgtttaataatcttttctgccaccttgttcctctgtcactggatgctactgtttgacacagattgtacctcatagataatgacttgcatgcttattttcatactaacttgatcatttatcttatgacttactttattttatttttaagagtttcactcttgtcgcccagactggagtgcagtggtgtgatctcggctcactgcaacctccgcttcccgggttcaagtgattttcctgccacagcctcccgagtagctgggattacaggcatctgccaccacccccaactaattttttgtatttttagtagagatgggggtttcaccatgttggccaggctggtctcgaactcctgacctcaggtaatccagctgccttggcctcccagagtattgggactacaggcgtgagccaccatgcctggcccttatgacttattttataaacatgtgttgaatacccagattttatctaattgctaattagtatgtctgcacctgcccgtacagcctgatctcatcttagacctggatttttcatatgatgatgatctgctttccaaaccttatttttcccatttcatgcatccccagcttaacctcttttttgcctgcttctctccactcctgttgctctagaggtttagcaacagaatattagaaagatttgacagttatgaggcctaagagctgcctttcaaaaattagccctattttagtggaaacatttaaaaatagcacttgcttaaaatgttcttttattctgtaagcataattcaaggaccatggcattagggagctcctatcaaattagtgttttttaaaatggccagaattctagaatatttgtttattcatttgttcagcatgtcattattgagagctggtgtgccaagaaaatgaatgtgagttatttttaaagtagggaggcaaaataaaaagattgtcttaggtcttagtccatttgtgctgctttaagaaaatactataaactgggtggcttatgaacaacagaaatttatttctcacagctctggaggtgagaagtccaagatccaggcagattgagcatctggtgaggtccctcttctgggttcatagatgataccttcttgcgatgtactcacatagcagcagggagacagcagctctctggggcttctttgatgaggtcactgtaggagtctattcttacgttgctataaagacatatctgacactgggtaatttatgaagaaaagaggtttaattggtttacggtcctgcaagctctacaggaagcatggcgctagcatcagcaaggcctctggggaggcctcaggaagcttccaatcgtggcagaaggcaaagtggggagcaggcttctcacatggtgggagcaggagcaagagttggggagagatgccacacaattttaaataacagatctcatgagaactcactcactgtggtcagaatagcaccaagccatgagggattgatctgcccccatgatcgaaataccttccaccaggccgtaccttcaacattggggatcacattttaacatgagacttgggcggggacagatacccaaactgtatcagttactaatcccattcatgagggctctgccctcatgatctaatcaccttccaaaggaaccacttcctaataccatcatgttgggaattaggttttcaatgtaggaattttggggtaacacagacattcagtccatagtaacctacatttggtaacatagatgaattttttaaacaatgcaaatctctgtctttccatctatccatccattcattcatttatgtaccatttttttcttggcaggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggagtaagcgcattcatttcctatcaggggatattgtttctattatgtgtgtgaattttaagtgtgattttactatgataatagaaaaattgaccttaattttcatagatttgattatcttagagaagtaattttaagtaaacccttaaattgcctgtatacataaagtgcctttataaaagcatatttaatctttatgcaaaccacacagttagtttattcatgcgggcttttaaaagacagaatgctaaccatttgaaacagcggggcaacctctctgtactgtagctggtggtctggattttagaaaagcccatgtgtcctaactttctggctttgtactagagatagaattgatgttattatctgaggcatcaccaggaaccttgaaattgctcaaagggagagtgtcttgtatcattttcctttggtcagttttcttctcactgtctttgaaagacacatctttctcctgtgtcttagtaattcaaaaagagagaactttttaagctctagtttttaacctatatgaatagatgtattttgagaagtgatacaatatttgtaattttaattgtaagattttcagtagcaagcccatccctattggttcaataatttgtattttatgatccatgtagcagctatgtattttgagatgacactttaatgatgtggctgaggctgaaactagaagacattgtcatgtcaagtttgtcctgcgtacctactcttgtctcatttttgttccctccagtgcccccattctctagatgaccttctttgattttagaggcctcttagtggttatttttcagtcaatttttgctaaggtgctaattgatgcccaaaataataagtgaaggaatatggatagtaattaagaatttttctatcaccactgatgctgggcaatttactcagcctctccagggctgttttcttctctttaagaagggatcatgatagtatctacctcatagggctcttgtgaagttaaaatgcatcaatctctataaagtaccaatgagcattcagcaaatactaattcctatattgttattactttcgacttttcactagagtgtttgcaatttaaggttagtccctgctgttatagccgaagcaagtagcattccaggtagtacctagccttacacctcttttcttactagccattgatgtgtgagcctgttagcagctcgttgtggggagggcattctctgggctgcctctaactaggccttaacctgtggtattaaacaagccataacacccttgattgtggctgtttttctgtgttggtcatgctgatccactcctctagatgcaaaagaatcagacattccacttttgaaagattgccagtattaataaatgtgattcccaccttaaagtattttactgtcttatgaagatctaaacagacgtattaaataaattaacgaaagcaggtaaattcctatagtcctatgattttataattataaattaccatagtgacaagaagattttacagttactttagattctttattggaaagggcaaggataaagtaaatgagtgcataaacagtactgattgaggagttagaatgggtgaaattatccttaaacaagatacttatttctgttataaaaaaaggaagcctcatatggtgggctgataaagaaggtgcatggcatagaacatagagcagagatgggtggatggggacaagacagcagcagtggggtaaagtaaggataggctcagacactttcatttattcagcaaatgctcatcaagggcttactgcttgccaagcagtgtgctggcttgctagctgctggagatatgatgataagcagaactaaaccaaaccaaacaaaacaaaaaaacagtttttaaaaagaactgagagattgagagatacggatggtcaggcaagatatcgttgtacatgggatggaagagcttcattcagtgggctttgtgtgtttctcagcaagataattaccattgtataaagagaagacacagaaaatacagaattaggttaaaaatacaatggtggcctatatgaaaattaaaggatttttgttgaattactgtgaatagtgttttaaaattgaaatccttttcttttcaagtcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgtaagtgcctggttccttacatagtgaatgtgtttatgttggattttaatgtttaatactaagagcttgtgggtgactggcttggggtttctcagggtttgaggttttgctgttttggtaagtaggggtcctgattgaaagtgcaggaaagctagtgttgctgtttgtgaagatgcagctttgtatttgcttccttctgctcagacaagggcctcactggggtgggaaagggatgcccagatgccactttcactctttgcctcaactccccgcccacagcatttggtagcacagtcagtactctttctaaataaataatttatctagtctcatactctttgttttatacgatttttaaaagcagtcactctgcctttattgaaaataaatattggcaaagcattcaagttctagaagaaatccaaatggtaaatcttggtctttttcttaagttgtagataatagaatatttaattactgactattctttaatttcattgtccttatatttaatatacatagataaacttactatttaaaaccttttgaatatggaattttttattcatacatgaaagtaaagagaagaggattagcaattcatgtatacacacgactcacttcagcagtttatatttgatactgttatttgaaagcagtcttgtaatctagttatatgtatgcaactagatgtaatctagctatatatggattatatatgtaatctagttatctaaagcagtcttgtaatcgagttatgtgtaatcttgcatgtataactagattgaaaaattagaagagattataagggtgtatttaaatactaaattatattacttgatttcttaggattatccttctattgctcaccttgtccagaaactgagtgaaaataatattcagacaatttttgcagttactgaagaatttcagcctgtttacaaggtaaatgtgtgagataaaaagaacaagattctaaacatttttgattgttagaggcaaatcatgtctgaattgaaatgtgggaaaatgccaccagataggcaaaccgaattttacaaaagtggtttatattaatttttaatcacatattataaaactggtttctaggtttgactcctaaagttagttaggaggaaacatgggaactggcatttaaagataaaagttgctcagtggatcctaattggttgaatgaatagcagttgtattttacgtgttttatcttttaattgcaggagctgaaaaacttgatccctaagtcagcagtaggaacattatctgcaaattctagcaatgtaattcagttgatcattgatgcatacaatgtgagtacatcttaaataagatcagttttggacaataccctgttgagaatactttgtacaaagaaagtaaaacttccttcatacacactttagcgagcccaaagtactacagaaaaacttaaattctgtatgtatctagaggaaaaactttatacatattgtcttacaaaagcaagattcatggcctaaacaaagtgaaaatgtgataaaggcatgtggggagtatttccaaataactgtttgtttatcattaaggaatagatctccttgttagaaagcaattgtaaaacataacttacatttaaacttacaggatttctccaatctttttcctccccaaaatatcctttatagagtcatctattctgatgaattgtgctagaaaagtttttttttttgccaattcttctcttcccatatattcagaggatatgggtttctatttcaggaggtacacactcatatatacgtataccataaaatatataaaaatgtaaatatacatgtgatttgcctatttcaaaaagatttatagtgttgttttcccctcacagatgggaggaagttgaattgaaattaaagaggaattggcttatcctttttgagcataattcagtgtactttaatcacaccgagttagccttcattaataatcatttaaataatctgaaggcggttgtaatttggtaggtaacccttgtgtgtctcgtgcaccactttcagcccccatccccctaaccctttggcagcttgaattttagacatttttacttcatgtcatgggggtaccataacgctttggaaaggccagcctaccatatgaggcttcccttttttatggggtaccataatggtttggaaaggcctgacttggaggggtttttataaaggtttttaatattttacttgttccacagcttttcccattctcccctgtcttagataattttcctaactcttgttctttcaggggtgtgaacaagagatagcttgccattgtacccttctccatttgtcctgaatagtctcatatgttaaacaagccctggcttgaatccttccttcttgggggattttgtttttttttttttttggctgggctacaatggttccttaagcaaatttgttcctagactgcatagttgattgtttaccctagtccatagttagctggagaggtaggactacagaaatgccattttgccgatggggaagacagcatttatttcgtttttttttggggggtttctgtttttgtttttgtttttgttttttagatggagtcgcactctgttgctcaggctggagtgcagtggtgtgatcttggctcactgcaacccctgcctcccgggttcaggcgattcttctgtctcagcctcccgagtagctgggattacaggtgcacactgccatgcttggataaatttttttttttttttgtattttagcggagatggggtttcactgtgttggccaggctggtctccaactcctgagctcaggcagtccacctaccttggcctcccaaagtgctgggattacaggtgtgagctaccacacccggcctattccacatttttaagactcctcctaattagtaacagccctctgcactgtgtgatcctgagtattttaactcagtgattaaaacaggaatactcttttcaattgtgtattttattttaaagatttgatccttattaattaaaacctgtttctctggcctctgtgttttctagttactcaattggatttggcttgtagatactttattgaaatatatttttttctgagcagtttatccattggttttatgcattcaagtagcattttgtttgacttttcctgtgtataattaggcattcttttagtccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggtatgttgtataaagcattttctgtagaaaacattggttatttataagcaaatttagtttatagtttgagaaacattaaaataagtgagcaactttttgaaatattttttagtagatttaaattgtttagttggttgttaatcttttttttcccttcaaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtaagctgggtgttgtcagacagtgacagagctacattggtttagagagtataggcaggtcatattttgggacatccagagaatatctctctatttggagcaaattattttttccaaccacggttgctcaccacaagatcagtttgatgatcttgtgtgtgatatttatagaaagttccttcctgcctttttttcttaaagtgattactctttaaaataaaagattttatagccatgaaagaagtatattcaacaaattgttaaggtagcgtttctctcatgtgagagcaatcaattttctagaacaaaataagcttgtgtaaaataacgtttataggaaaatgttttggaaaaacatcaaaccgatgatggcgatttcgtctgggaaatggaattatgaagcagtagaagatgtttgtcttgtactacatgtacttctgcattgttggaataatttttaaaaaataaatatgtgttgtaaaatacaaaagagaaaatggtattttcagtatgtagaatctagtactaagaaaactaacaaaattacttcagattttattttcacactgtggttactttttgtaattgaaaatgaaaaactgagtatacattgaataccgctttctctgtaaaagaataggaagagggaagagtgtttaatccagtgtcagccccaaaagactaggcttagaaggctattgactatgaaagaaatatatggctttagctcactatcaatttttaattgtctgtgctaagtaacaatttaaatgttagagtttctttatcttccatgttgtacatatcctgttttaatcatgcaggtccatttttagtaaaatgtcatttaaccaaaaagattatcttgaaaatactttgcctttctttcctttatatttttaccagatacagaatcagtgcagtcagtgtccatgagcattatgtgttctaaaaatacacagggaacctgaaaagtctgcacatgtaggatatatttatttttaaatagtatactagttatattttaagtggtatacacagtatgttttttttcaacttccatacacttttttgcatgtgtttattgtatttttttaggttaacagaccattgctttaaatttagacagttcacctggaatagtaaatgtaatagcataccatttgaaaatgtaactaacgtgctctttaaaattaagtttattctgcctttccacatgtgtcattcactattcattgctagattacatttttgtcttgaccaaaatggttactttcctgaagaaatttttttcctagactcttgcatatattccatatgaacttgagtggctggaatgtacatgtgcgcctgtgtatgtttgtccctgcttgcacatgtgtgtacactttactacacgactgtgacttgtggcatggacactcccacctaacagattaggagcttgaagagattttttatagttttattttctttcccagtttttcccttttaaattattattattattattccctccaagatgattcttcttcttttttattatactttaatttctagggtacatgtgcaaaacgtgcaggtttgttccatatgtatacatgtgacatgttggtgtgctgcacccattaactcgtcatttacattaggtatatctcctaatgctatccctgccccctacccccaccttatgacaggccccagtgtgtgatgttccccaccctgtgtccaagtgttctcattgttcagttcccacctatgagtgagaaggtgcagtgtttggttttctgtccttgcgatagttttctcagaatgatggtttccagcttcatccatgtccctacaaaggacgtgaactcatcattttttatggctgcatagtattccatgttgtatatgtgccacattttcttaatccagtctatcattgatggacatttgggttggttccaagtctttgctattgtgaatagtgccgcagtaaacatacgtgtgcacgtgtctttatagcagcatgatttataattctttgggtatatacccagtaatgggatggctgggtcaaatggtatttctagtcctagatccttgaggaatcgctacactgtcttccacaatggttgaactagtttacagtcccaccagcagtgtaaaagtgtacctatttctccacatcctctccagcacctgttgttttcctgactttttaatgatcgccattctaactggtgtgagatggtatctcattgtggttttgatttgcatttctctgatggccagtgatgatgagcattttttcatgtgtctgttggctgcataaatgtctccttttgagaagtgtctgttcatatccttctcccactttttggtggggttgtttgattttttcttgtaaatttgttggagttctttgtagattctggatattagccctttgtcagatgggtagattgtaaaaattgtgtcccattctgtaggttgcctgttcactctgatggcagtttcttttgctgtgcagaagctctttagtttaattagatcccatttgtcaattttggcttttgttgccattgcttttggtgttttagtcatgaagtccttgcctatgcctatgtcctgaatggtattgcctagattttcttctgaggtttttatggttttaggtctgacatctaagtctttaatccatcttgaattaatttttgtataaggtgtaaggaagggatccagtttcagctttctccatatggctagccagttttcccagcaccatttattaaatagggaatcctttccccatttcttgtttttgtcaggtttgtcaaagatcagatggttgtagatgtgtggtattatttctgagggctctgttctgttccataggtctatatctctgttttggtaccagtaccatgctgttttggttactgtagccttgtagtatagtttgaagtcaggtagcgtgatgcctccagctttgttcttttggcttaggattgtcttggcaatgcaggctcttttttggttccatatgaactttaaagtagttttttccaattctatgaagaaagtcattggtagcttgatggggatggcattgaatctctaaattaccttgggcagtatggccattttcacgatattgattcttcctatccatgagcatggaatgttcttccatttgtttgagtcctcttttatttcgttgagcagtggtttgtagttcttcttgaagaggtccttcacatcccttgtaggttgtattcctaggtattttattctctttgaagcagttatgaatgggagttcacccataatttggctctctgtttgtctgttattggtgtacaggaatgcctgtgatttttgcacattgatttttgtatcctgagactttgctgaagttgcttatcagcttaaggagattttgggctgagacgatggggttttctaaatatacaatcatgtcatctgcaaacagggacaatttgatttcctcttttcctaattaactgatgggcttccctttgtgggaatattgttatgtgttatttctttctcctgcctgattgccctggccagaacttccaacactgtgttgaataggagtggtgagagagggcatccctgtcttgtgccagttttcaaagggaatgcttccagtttttgcccattcagtatgatattggctgtgggttgatcataaatagctcttattattttgagacacatcccatcaatacctagtttattgagagtttttagcatgaagggctgttgaattttgtcgaacaccttttctgcatttattgagataatcatgtgttttttgtcttaggttctgtttatatgatggattacgtttattgattgcctgtgttgaaccagtcttgcccagggatgaagccaacttgattgtggtggataagctttttgatgtgctgctggatttggtttgccagtattttactgaggatttttgcatcgatgttcatcagggatattggtctaaaattctctttctttgttgtgtctctgccaggctttggtatcaggatgatgctggcctcataacgtgagttagggaggattccctctttttctattgattggaatagtttcagaaggaatggtaccagcttctgtttgtacctctggtagaattcggctgtgaatccgtctggtcttggactttttttggttggtaggctattaattattgcctccatttgagagcctgttattggtctattcagtgattcaacttcttcctggtttagtcttgggagggtgtatttgtccaggaatttatccatttcttctagattttccagttaatttgcatagtggtgtttatagtattctctgatggtagtttgtatttctgttggatcggtggtgatatcccctttatcattttttattgcatctatttgattcttctcttttcttctttattagtcttgctagcggtctgtcaattttgttgatcatttcaaaaaaccagctcctggattcattgattttttgaagggctttttatgtctctatctccttcagttctgctctgatcttagttatttcttgccttctgctagcttttgaatgtgtttgctcttgcttctctagttcttttaattgtgatgttagggtgtccattttagatctttcctgctttctcttgtgggcatttagtgctataaatttccctctacacactgctttaaatgtgtcccagagattctggtatgttgtgtctttgttctcactggtttcaaagaacatctttatttctgccttcattttgttatgtatccagtagtcattcaggagcaggtcatttagtttccatgcagttgagcagttttgagtgagtttcttaatcttgagttctagcttgattgcactgtggtctgagagacagtttgttataatttctgttattttacatttgctgaggagtgctttgcttccaattatgtagtcagttttgcaataagtgcggtgtggggctgagaagaatgtatattctgttgttttgggatggagagttctgtagatgtctattaggtccacttggtgcagagctgagttcagttcctggatatccttgttaactttctgtctcgttggtctgtctaatgttgacaatgtggtgttaaagtctcccattattattgtgtgggagtctaagtctctttctaggtctctcaggacctgctttatgaatctgggtgctcctgcattgggtgcatatatatttaggatagtcagctcttcctgttgaattgatccctttaccattatgtaatggcgttctttgtcccttttgatctttgttggtttaaagtctgttttttcagagactaggtttgcaaccactgcctttttttgttttccatttgcttggtagatcttccttcatccctttattttgagcctgtgtttgtctctgcacgtgagatgggtctcctgaatacagcacactgatgggtcttgactctttatccaatttgccagtctgtgtcttttaattggagcattttgcccatttacatttaaggttaatattgttatgtgtgaatttgatcctgtcattatgatgttagctggttattttgctcattagctgatgcagtttcttcctagcatcgatggtctttacaatttggcatgtttttgcagtggctggtaccagttgttcctttccatgtttagtgcttccttcaggagctcttgtaaggcaggcctggtggtgacacaatctctcagcatttgcttgtctgtaaaggattttatttctctttcacttaaagcttagtttggcttaatatgaaattctgggttgaaaattcttttctttaagaatgttaaatattggcccccactctcttctggcttgtagagtttctgccgagagatctgctgctagtctgatgggcttccctttgtgggtaacccaacctttctctctggctgcccttaacattttttccttcatttcaactttggtgaatctgacaatcatgtgtcttggagttgctcttctcaaggagtatctttgtggctttctctgtatttcctgaatttgaatgttggcctgccttgctaggttggggaagttctcctggataatatcctgaaaaatgttttccaacttggttccattctccctgtcactttctggtacaccaatcagacatcgatttggtcttttcacatagtcccatatttcttggaggctttgttcgtttctttttactcttttttttctctaaacttctcacttcatttcattcatttgatcttcaatcactgatatcctttcttccactggatcgaatcggctactgaagcttgtgcatgcatcacatggttctcatgccatggttttccgctccatcaggtcatttaaggtcttctctacgctctttattctaattagccattcgtctagtcttttttcaaggtttttagcttctttgcgatgggtttgaatatcctcctttagctcggacaagtttgttattaccgattatctgaagccttcttctctcaacttgtcaaagtcattctccgtccggctttgttccgttgctggtgaggaggtgcatttctttggaggagaagaggtgctcaaattttagaattttcagcttttctgctctggtttctccccatctttgtggttttatctacctttggtcttccatgatggtgatgtacagatggggttttggtgtggatgtcctttctgtttgttagttttccttctaacagtcaggaccctcagctgcaggtctgttgggagtttgctggaggtccactccagaccctgtttgcctgagtatcaccagcggaggctgcagaacagcaaatattgcagaatggcaaatgttgctgcctgatccttcctctggaagcttcgtctcagaggggcaccgggctgtatgaggtgtcagtcagcccctactaggaggtgtctcccagttaggctactcgggctcagggacccacttgaggaggcagtctgtccattctcagatgtcagactccgtgctgggagaaccactactctcttcaaagctgtcagacacggatgtttaagtctgcagaagtttctgctggattttgttcagctatgccctgcccccagaggtgttgtctacagaggcaggcaggcctccttgagctgcaatgggcttcacccagttttagcttttttttgctttgtttacctactcaagcctcagcaatgggggatacccctccctcggcctccctgctgccttgcagttcaatctcagactgctgtgctagcagtgagcgaggctccatgggtgtgggaccctctgagctgggcatgggaccctctgagccaggcgcgggatataatcttctggtgttccgttttctaagagcattggaaaagcgcagtattagtgtgggagtgtcctgattttccaggtaccgtctgtcacagcttcccttggctaggaaagggaattccttgaccccttgtgcttcccgggtgaggcgatgccccgccctgcttcggctcacactccatgggctgcacctactgtccagcaagccccagtgagatgaacccagtacctcagttggaaatgcagaaaccacctgtcttctgtgtcgctcacgctgggagctgtagactagagctgttcctgtttggccatcttggaacctcttaaattatttttgttttgtgtgattgcaattttggcatgtttcttcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggtaagtaaagggcctgaagtggttgtaagatgtgatcccatctaatgccacgaaaaatcttgagtttagttggtgcataagtagaaaaggggtagcttgagggtcagtctcgcccctaggtatactttctcacatgttgttgcttattttacttttcagtcaatactgtgattgtatatttttaccattttgagaaatgatatgcttaattgcaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataagtaagtatttcctaattgcttgaaatagttgatacttcctcttggctctcctaagcctgtattgtttctagaaccagaacagtgccaatattaaaatatactgtaaataaaatgcctgccatgtggaagcctactctttaattcttaaaagttctttctcaacagctagtatatattacatggtatgaagtgtgtcatgtgagagttgtactattattttgatctgaatgtgctagataattgaatttacatggtaacctttattttggcaattaagatttaatttaatttaatttgtcattaccaatttcttaattactgtcttttgacaaaactaagccaaattaaagatttttcctcttgaaggattattatactagtaacatattatttaaattattatgattttggccgagcacagtggctcacacctgtaatcccagcactttggaaggccgagacaggtggatcacttaaggtcaggagtttgagaccagtctggccaatgtggtgaaaccccatctctactaaaaatacaaaaattagccagatatggtggtgtgtgcctgtaatctcaactacttgggaggttgaggcttgcttgaacccgagaggcagaggttacagtgagccaaggtcacaccactgcactgcctggatgacagaacaagactccatcgcaaaaaaaaaattattatgattttatgttacatatttaatatgtgatagggctaatttattttactatcttttatttcttaatagggttttaatttgaactgtaataaatctttaattttattatggaaattagcatctttttacataatttttctatccacaaatgtaatgttcctcttcatttattgaaatcttccttcatagctgtttgttcaatttggtcacaagagtttagcatgggaaatatgtttaagcaaatatttactgaaataataaaatgtaaatatcataatttgtgttttttgtaacagagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccaggtagaaatgcgatgattgcagacattcttttcatatcttgtatgtcttgtttctgcttatttaggcctaacatccagaaacagcctccagctggaatattttaggtcaagttgggaaatttttcatctctcaaagcttaaaatattatctaattaactgtataagaaataaggaaaagagagttccacttttaagttttctgagtggagagtttgaagattaaatacagtgatttatataagacgcttagtgatttatataagacacttagaacgatgcctgacaccaagtgcatattaagagttttttgatgattgatgattttaaaattagagcttgatttaagcttgaatactgggaaagataatttgttaaaggatattaatataaagtgttgaatttgttcaacttctccggaggtgaaactttttttttttaatcttagttttcctagtagcctttttgtagattctttggaattttctaccatagtgtacatgtttttgtgtgaacataagctttcatttctcttgggtaaatactaaaaatggcattttggagcatatggtaagcatatgtttaactttgttaagaagctgccagactcttagactcccatactgttttgaattatcagctaggtgttttgcaaatattgtctcccagcctgtgtctccttatcatttcatttttttaagtgtcttctgaacaccacaggttttaattttgattaagtacagtttaccaagtttttcttctgtggctcttgcttttacattgtctttaagaactctgcctaacccaagattataaggatttttctcctctgttttttggtagaagttttatagtttctggggtttcacatttagatctgtaactcattttgagttagtgtgtgacaaaaggctcagtttttttcatgtcagtgtccacttgttctaggggcatttgttgaaaaaagactgtcttttctccacctttgttgaacatcaggtgaccttacatgtgtaggcctgtttctgactctgtattctgttccatgtatctgagtgttagctataccacatggtcttgtagctttctttatagctaggcctgaaagcagggtcttccaactttattcttttacaaaagtgtttttgagacacttccttagttccctgccttccatgtaaattttagaagtggcttactgattgctacagaagttctgccaggagtttgagtgggataccattgagtttatagatcaaattgggaagaattgacgtcttaacggtattaggttttgtaactcctgcacatggaatatctctccatttattcagtctgaaagatttctttttatcagtatttagtaattcttaacatgcaaatcttgcatatattttgttagacttatatgtaagtttttcatgctttttcattctgtagtaaatattactgtttaaaaacttatattttcaatatgtagaaataaattatatatatagaaaaatacatgatttttgttcattgatcatgtatcctgcaaccttgtaaactcacttgttagttctaagagctattttatagattctttgggatagtgtgcgttcactctcttgggtgtttattcctgtatgttttttataagacactgcacagctctttgtggtgctcattattaccttcttattttccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggcttttctttttgtatgttaacttcgcgtttagaaagaccgtaaaataagtaatgtgatatagaaacagcagccatgttgtagtgaaaagagaatgtgctttgcaatcagttagacctcaggtcaaatcccacctcttccacttagtaagtagaacagcattgagtcacttcacttctctcaactgtcacagggagtcagtactctgttttgtatggggtggttgtatttggcaaatgcactccagtatatgaaatcagcctgtcagctctaatcctcataacagtcctgtgcctagaatgatattatcctattatcttttgttctttttctgtttatttatttatttattttgagacagtctctctctgtcgcccagcctggagtgcagtggtgtgatatcagctcactgcaacctctgacttccagattccagcaattctcctgcctcagcctcccgagtacctgggattacaggtgcctgccaccatgctaggctaatttttttgtttttagtagagatggggtttcaccacattggctgggctggccttgaactcctgacctccagtgctctgcccacctcggtctcccaaagtgctgggattacaggcgtgagccactgtgccccaccagtattatccttaaataacaaatttgttatgagtaaattttagggttggatagtgaaaattgatcacgaaatccaaattgcaaaatagaaaaatataacctactatgatatttgtatggtatgcaactacaatatcattattggttctcaaaagatttgagatcaatttcttgaatataacttgaaatttcattaaaagccagaagaccatatatatgtatgtatattatatatatatgtgtgtgtgtctgtgtgtgtatgtgagaatgattctaattttcaaatgtaagtttgtaactgttcatatctgaattttcatgaaatgcttccagcatattctaataaaatcatgcaagcccctaaaactctgataacaaaggttaattgtgattagaactaaattctcctgactggtggttgagaactcttcttctctttcccaactgactgactgtaatagggcctggaagatttctgcttttctcactgcctaccttattgtgcagataaagatggtattgggaacacttacataaaaatcactgtgtctcaggcatgattctgaccacttaatctgtgtttaatcttcatagtgaaagttgtaggaatgttttacatatgagaaaactgagacacataagggttatgtaacttgaccgagttcccacggctggttagtcagagagctgagatttgaacccaggcagttgggctccagagtccatgttcttgtctatgacattgtacttggtagcagttatgtatcttcagaagtcccgttacctggttaggaagaggtagatcactctttatagagatttacagcccttttacaatttgttgttactctgtcagagttaacactgctgctgttggcaaacatcatgttagggaaatcactttaatacatggaacccagtgctgttgttgtgttttttgactattgagagtgtgcttacaaactgatcatgaataagagcctacagtacaggaatgtttaatagttacaagtgatataggaagtgctgataacattagaaatcattaacttgtcagatttttatttctaagtagaccgtaagatttttaaagttaaatttgatggcagaaaattatattcaaattcacatatgggcaggttggtacatatttgtattagtctgagacaatatatttttctcgttctcacttagtactttacagaaagtcatttttagaggaaaactgattagccaatgacattgccaggcttttttttttttttaatacatatttttttctttagttgtaggtcaaaaatagtcaaatgttgacaatttcatgtggttatttctcacaagagaaaaaatttctgtcctactgaggtgaaattttcacccttgctgtacctttcattgtattttgaaggaaattatcagtaaatgttatttaaacttaatgtttataatgtatatatggctaaaatgttgctaaaataagcattttatgtaattcaggaagcagaagtttggtaaaaatttctctatgcattattgaagtccaggcaatttgatggctacagattattttaagagatgtttttctcaagaaaaagtagaaattaacaattgaaataaatgaatgagcatcaagaaattacatcatggattgtaagaaacttttctgatatggaccaaggtttgccagtcaattatgtcattgaaatttttgaaataatgggcaggcgctaattactttggcagaagactaccatgtaggaacattaagaagaacatgtcacattatcagcttctaactgttggagtgggttaaaaaaatggtctgtcctcatctgctgctatgcgggtttaaatgtggctcccaaatctcccacacttctgcattatgtatttaatacattgtagagatggttctgcagctaccactgtcagccattccagagtgagcacaaagatgacattttactgagcttgagggcttcctttcataatataaccctgttctcttgctgcgggtttttttggggtggggtggtgttgcactctgaatgatggaaactaatttgaattattttagtttaccttcatttaaaatgatgcctaatacagatagtgagcttaattttacctctaaccttgcatgttaaacttttgtttgagtggactttgaaataataaatacaaatgtttgtgtatacgacaagacagatttttctccaaaggtaagttcttccatataaattacactttggactcatctatatagggctttttttctttattttttgttttcttttttttttttgtccttcccttataattcttgagtattaaatactagatttagcaaatatattgtattaaagaaatttaattagatgctaatttattttcccaacatatttgaaggaatgtgtagcacttagcctcaaatcagataggatataaatgtggagtgtaatttatttgcactctggctttttaagatagtagttgccaaaatccagtttcctgacccccattttgaaatgtctgctctcacagctgtataatgtattagcttcagttgggactagagctgagagtttgatgtacacagttttgtcatccacattatatgctgtttgtctctgagggatcctgagtttgtccatgtttctgaaacaaccagtcaaggtgtattttgaggagaggggagtgagggctgaggtatgttgtctggttctgattggtatcacatgagctgctgagctgaaatcacagtggtttatttggtgtcttgcaggacccagcctttatatgttaatgtttttccctcattggtatgggatacctacaggatgaagtttcagacttcatagcaaggcctctaggactgttcttcctttgtctcctcacctccaatcatatgcccccttaattcttttttttcctcttttttttttttttttttttttgagatggagtcttgctctttcgcccagtctggagtgcagtggtgcgatctcagctcactacaatctccgcttcccgggttcaagtgattcccctatcccagcttcatgagtagctgggattacaggcacccgccaccacacccagctaatttttgtatttttagtagagacggggttttaccgtgttggccaggctgatctcaaactcctcaccaaaagtgatccacccacctcggcctctcaaagttctgggattacaggcatgagccaccgcgcctgccctcccctaactctagaaacttctgaactgtatgtatttctacttaaatgtcccattcttttccctacaccttgactttgcatagattgctatttaccaaccaataatttttctagtcaatttcacaatgaaaatctccttaatcttcttaaagttaataacttttttcttatactattcccagattatgttcataactctattgtaaacttcatcagagtgccttattttcatgtctctcacccaccaaactataccttccttgagggcagaaattgtgccaccaaaaggcagatccaaatacagtctgcaatgaagtgtgaataaaatttaaaaacaaaaattacttttagatcaaaaaatgttttagatgctttctataaatatttttttaaaaatcacctgcagttggttctatagtgagatataaaactgaacaacattccaaaatcttaattttttcttaaaaaaaatttccctggtagttaacaagtattttttatttgtactcactgtaattttctctgattaagtgttatttggtcacacttctcacttggctttcaagcctgctttcaatttataagaacaggagaaaaaagaatgctatagcaagtatttaaatgtagcagttatagtataagagaatttttaaggaaaagggtgatacagtgatatgtttttttctgcttaaaacatcactgtcagtatatttttggatcttgaaagatctcttgtgtttatggcttggggcctgcttgctaggcttgacttcagtactgtttactaaattatagcactgcaataagacatttcaccaatatgatattgaagcataacaagttatttcataaggaatggtaattatctaacattctaagcaaatttggcagtgtgacttggtggggcgcagtgctgtccctgacacaatgacagccttactctctaaattagtaacttccgtaggagaccccagaagcacacctccctcccagcagtgaaagccgaggattcccgttttgattagcaggcgccttctgttcacgataaagggataagaatcaggcagtgatggcagcggagttcatgcttcattaaggcaggcattgcaaactagttcagaggagagaatccacgatgacagcacattctgtgccatggagaacattcttaaatcaagcctccagtggaggaaggactcaagaatgaaatagcaccagataacggggcatcattagacttgtaaagcaaagcttccattttctatttttatataaaccattattaatgcctttaaaacaactgtgatatctggacaaataaaatagaaatgacttcttaagatgattgcaacttttagtcttgatttataaaaattattctacataattttagtagggtaactgataatttttctcactttttttttgttgtagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcgga

SEQ ID NO: 37576 - DNA, 11511 bp, Homo sapiens; identical to SEQ ID NO: 36812

SEQ ID NO: 37577 - DNA, 135417 bp, Homo sapiens
atggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagaggtaccgggcggcggctctggcgggcgacgctgttgtggggggaggggatttcgagccggatcgtctggacccgctttccgggccgccccctgcccccttgaggatccccgccacagccacggcttcggggtcccgggcccggggagactggcttgcctgggtttccctccgccaacgcatgtaaatcacctctacctcagtttcccctctcgagcaaaactttagcggcctccctgcgggagggcgtggccggacatggttgagagtgagatgcattcgccctcttaagggaatgttcacggggctgccccttgggtcaagtcacagatgagtttgcatttctcgcccgcactcatcctcctagcctgggccggagcggagccgtacggtataatttaataacggtctccccgcggtgctgtaatcagtgggggcacgtgctatttctgtgactgaagccactagctacattgatgacctctttttacgttgcactccttgtgcattcctactgtatcggtctttgattaaaaacatttcagtgtgtgtctgagagatcattttcccagaggatgtgtggtgtgtgtgttctcttgctgcctcccatccccctcgcattaaaatatcatcacattcttttacaaacggtactatctgttggtttccttttgtgtgtttttgtctttttgcacagcgattcttagctagtgacagttatgtaggtacaaagatggtgatctcagagtgcctgccttttcctgacatactgtgctcagagcagtctttcattagtttaatggtagacttttgcttttaaagccagactgactttcatttttctagccatacctcatttcagcaactccctgcaattgttaactgggtcattttagcttcacgatgacaagggtatatctagctgctatccagaggttaaaaattgctatttgttactcaaaggaggcccacggtttgacaaattgtttttgtgctttttcttgttgtagacttgtaatcctttggatgcagagtttttaacaaattataataaaataatggttgagtttggtaacttcacagtcagctttacagacggattttgctatctaatcatcaggccaggaatgttctgaagatgtaaacaggtttcaaatatactactttcaaattacgtggctgctttttgttttaaacatttggattggcagtatttttcctgactcatactcatgttacgtagaatcagtaacgttccagtctttttagagcatttgcttttatgtttttctggacatgagctggataggttataaaatattaataatttgttgacacccttccataaatcctgtattctggggccacctttaaagctgtaatacttaaggaacaccctccaaccaaatacatcactaggtttgaattttgccatgtatgtggtagtggtctttgccataccctctgtttgtacaaataatcaagagttgtatttgtagacattaataagatctctctttatggcttagaaaataagtccaaactgatgggtctttggtaacgcatttattggaaggcaagatctctttttttttttttttttttttttgagatggattcttgctctgtcacccaggctggaatgcagtggcgccatctcagctcactgcaagctccacctcccaggttcacaccattctcctgcctcagcctcccaagtagctgggactacaggtgcctgccaccacgcccagctaactttttgtattttaagtagagatgaggtttcaccatgttagccagaatggtctccatatcctgaccttgtgatccacccgccttggcctcccaaagtgctggaattacaggcatgagctaccgtgcccagccggaaggcaagatcttttaagtcttctggtttttggagctcagttagctttgaaagcctatgtgtcctctgcaggctgtgtgagaggagtatgatctaaagaaaaatttccagaagaaatacctggcttacaagttctttacagtgagaacagctaaacgtatcaagtgttcagtttgttataaagcaggcgttggcaaacgtcctgtaaatggccagatagtagataattttgggacatgtggtctctgtctggactgtttaactctgccatcattgtgtgaaagcagccacacaccatatataaatgaatgggcatggctgtgtttaaaattatatctatgggcactgaaatttgaatttcatgtaatatttacatgtcacaaactattcttttgattttttttttttcaaccactcttagccatacaaaaacaggtgacttcctggatttggcctgcaggccatagtttgccaacccctagcttggagcacacaaattataccctgctatcattattctggttttcaaaagttttatttatttatttattttttggagacagagtcttgctgtgtcacccaggctggagtgcagtggcacgattttacctcactgcaacctacgcctcccaggttcaagtgattctcgtgcctcagcctcccaagtagctgggattatagatgtgcgccaccagacccggctaatttttgtatttgtagtagagacgaggtttcaccatgctggtcaggctggtcttgaacttctgaccgcaggtgatccgcccgccttggccttccaaagtgctgggattacaggcgtgagccactgcacccagcccaaaggttttatttatttgtctttctaaaaagtaaaggtctcagaattgtgggagtatgtcttgcataggaagctatagtaccagatgaaagccaacactgtagatgctgaggtgggccttgttgtctagctaatcagaggttgagatgtctaggctgccactttagttctgtgttgccactcccatcttctgcagtttcctggtttttttctcttgttaaacctgccatgtttttcttccttgtcaccggggaccatctgtttttctgttgcagtctactactctctgcttccttttttgatatcctggctccatcatgccaactcttactttcgacctggtagcctgcttagccattgtatttatctcttgaccattgagaatgatgacgtgcttgagactcctcagtacaccacattctaccttcttttatagttgaaattgaccttttgaagaaaaggtagattaaacgttcctaggtctaacccctgtttcttaagtttgactttgcaaccaaactgaaatagaggaggaattgatcaacatggatgagttggaaagcatactctcaagtcattggatgttttaaaagaaaaagatatctgaatttatttaaagggaagatttttctctatagcatgtagctagctagcatgtcttttagtagtaaaggctactaaaatattttttcttttttaagagacagggttggctgggcgcagtggctcacgcctgtaatctcagcactttgggaggccaaggcaggcggatcacctgaggtcaggagtttgagaccagcctggctaacatggtgaaaccctgtttctactaaaaatacaaaaaattagctgggcgtggtggcgcgcgcctgtaatgcccataatcccagctactcgggaggctgaggcaggagaattgattgaaccagggaggcgaaagttgcagtgagctgagatcgcaccattgctatggcaacaagagcaaaactccatctaaaaaaaaaaaaagagagacagggtctccttctgttggctgggctggagtacagtgggacgattatagctgactacagcctcaaactcctgggctcaagggatgctcctatttcagcctcctgagtagttacagtagctagctagactacaggctcccaccaccgggcccagcttaaactcttttttaacactgttacttattacatagtttaaagaacattttaaacacactgttacttttccaagccagaaatggagcagaactagctcaatggagcacataccgtccatgggattagttagtataatcattgctgaatgtagccttctctgttaaggtacagataattcctttcttaactctgtgcaagatacgctggtgagcatggttatcattcgacaatttgattgactctttgtagataaaaagaaatatgctccttctctctgagccaattctttctgagctgacctggcctttttaatgataaacctgttcgaggtttctgtttccagatattcactagaatttagggcaaagacacctactttggaagggggagactgtcacaacattcccattagataatgcacagtcatttcctaaaagtcttcaaaggaagaaagggatgcactaatgctgtgatcttttgaatttgtaagcagtaggatgcaaattgataattgacctacaggaaaaaaaaaaaaaaagcccgccaccaaaagatagattatgattgtgagattagtctttgtgactactgtttctatgtcttagtatcacattaaccacagatttttcaagagtatgagggaagtatctgaaagacagttttcagttctttagtcaacatgcagcagattatagatagaaagataggaataagcataatggattctatatatactagagagtacatgaaactgatgaggggaaaggagcttgtggaatttctaccatttacaaaaaagattgatagtatgatattgaagagggagaagggaggtgaatccttagtcttttatgatgcccctcctcagattccatttcttcctaaaaagctagatttttccagaccctgccagttctttttttacttacacatcaaattggatttctctgacctgtctgcttagctgctgtttccctttgtactctgcatcacatttatttggtatagagtataaaagcttcagcttctctgtctatccacagtgtttcacgctcagcggtgctgttgttgcagttcattaggagcgacaggtgattcaggaagatgcttgaccaaccagagcaaagatgtactttcacctctatctctttattttccttcccgtgcttatatttgcttccatttcttcattcttctccttcctacttaactttttgtcctttgttccatttttccatttcttattctctggtgtcttggtgtcttaacattttctcagggcatgagggtgaggttggaaattatggcagcacatccctattagctgactcatgcacactgtttctttaaaatcaagagatatgacaatgtccattacttctctatttcctccttcaagtcttcaaaaccaatttttcccaggtttatccttagttgcccagtgcacattataagtagagctgaagaccgttccatttttcctctgccaatgtctatctttccccaaaatgcattcttcctgtttctttattggaataaggatgttacgtatttctaggggaggaagttgggttcattagatcacaataggatgacactgaaccaggcaattaaatgagtttactcctatatatatatatatttttttttatatatttcattatcagaatgggtatgaaagcaataggctaagtccatcctttgggtgggcagtatttctcttagatttggtaaacctgttcagctggaaaaagtggggataagcagctctgaactttggaaataaatcaggaactttggaaataaacccagtaaaataacatcaaatgacagagtgggaaagccttagaaaaacaaataagaaagtataagggtggggccaggcgtggaggctcatgcctgtaatcccagcactttgggaggccaaggcagtggatcacgaggtcaggagtttgagaccagcctgaccaacatggtgaaaccccatctctactaaaaaaaaaatacaaaaattagccaggcgtggtggcacgcacctgtaatcccagctactcaggaggctgaggcaggagaatcgcttgaacctgggaggtggaggttgcagtgagctgagatagtgccactacattgtagcctgggcgacagagcgagactctgtctcaaaaaaataaagtataaggctggaagtaaaggaaaaactaagtatatgaggtagaaacagggggatttagtagggagttttctgctgtacatgtgagccttaaaactgtgtttagtcaccagcaacttttgagtgctgcttgttgtggaaaggtttttattttctcctttttatgtaccctgacaaatggaaaaggacccttagtgggcaggaggatccttgcacacatcatagatgctccataaatatttttttcttggtgaaggagttattctaagggactaatctttgatacatacccatttatccttgatctgcatatagcaaagtgctcgcaatgccagactctcaagtgttattcaaggtgattcatcaccgacattggcaccttccaaatagtgacttgtccttttggctcctgtgttcatttggcaggcagatagtcttgcaggcagtgaatggagtgttcactctgtttacatttcccttcttaggatgatactttttttttttttttgagttggagtcttactcttttgcccaggctggagtgcagtggcacaatctcagctcactgcaattccacctgccgggttcaagcaattctcgtgcctcagcctcgtgagtagctgggactacaggtgggtgccaccacacctggctaatttttgtatttttattagagacggggtttcaccatattggccaggctggtctcgaactcctggcctcagataatccaccagcctctgtctcccaaactgctgggattacaggcttgagccaccagctacaatgcgtcccaccataggttgatacttctgctggggattgactcactaagtaaactgttcaaccacactgttgttctttccatttaataaaatatattttagtctttgctttaccttcatgtttctttctttttttttttctctgagacggagtctcgctgtcacccaggctggagtgcagtggcccgatctcggctcactgcagcctctaccttctgggttcaagcaattctctacctcagccttctgagtagctgggattacaggcgcgtgccaccacctgctaatttttgtaattttagtagagacagggtttcaccatcttggccaggctggtcttgaactcctgatctcgtcatccacctgcgtggacctcccaaagtgctggaattgcaggcatgagccaccacacccggccagccaccgtgcccggcccatgtttcatcaattgtggattagcacctgatttgatacaatgactttaaatgtatccagcctttaaacctagttggtctctagattttttcagaagagggcatttccccagctaaggataagggatgtggttaaaaaaaaaaatcaccgactcttttgtgatctcgctttagtctacagtcagggggatggtgtaggggataactctgttatccagtgaattttggactttagcactgatcatatgacttcttatcttgagttgttgattccttttaagttactgcattacaggccagccttatttggtctaaaattggttactttagtctgtattcccactaacagtatattgagtattctggtctgcccctttttggctatcaataatgaaggcatattagctgttggtctttgccagtcagtaatatagaacagattgatatcctgttaggtctttacttgcatttcgttagttctgcttgactttgaaaatgttttctgtttgttagtctctgcttcttccctagcctgatgaccttgaatgagatatttaattttaattctctaagcttcaccttcccaatctttttttgagatgaagtcttgctctatcacccaggctggagtgcagtggttcaatatcggctcactgcaacctctgcctcccaggttcaagcaattctcctgcctcagcctcctgaggagctgagactataggcacgtgccaccacgcccagctgatttttgtatttttagtggtgacgggttttcaccatactggccaagctggtcttgaactcctgacctcaggtgatccacctgtctcatctttcccagtcttgaaggggaataggttgatgatactatctaccaggtagtaaggattaaataatgtaatatccataaaggggtatctggcacatagtaagcgctaagcagatgctggctgaattattattatttttacagtgaatcagaaatcctgcaccatgagaagcagtacgagccattctactcatcttttgttgcactttccacacactatattacaacagtttgcagtctcagtaagtattccactcttgtccttcccttctgagggcttgtgaatagggggattgtttatcctctcgttagtgtatctgaaaaagttgttaatgaagtctaggttttagcactcctaagctgctcacccaagagtagagacaactgtcagctaggatgaggctccagaggttcccttacctaggctaaccaagtggaattttaaaactacttggcttggacacctgctttataagtattaagtccacctcctttcccttcttaatccaaagcattttattgatttctcatgtaattactggtgtgttaatttccctggggggaaggcggtggtggatactgacctctggagttagcagccactcaaggctctattccttatttggttttggtgaggatgtggattctcctttgtgttctctggtatatgaagggatttcaacttcagttctccattttcttcatttttctacccccaaaatggctaatccctattttacatttctgaatttttacatttgtctaaaatcttgactcaaatagttctgaagaattctaattattttaaatttgcttttttagagacagggtcttgctctgtcatccaggctggagtgcagtggcgtgatcatagctcactgcatccttgaactcctgggctctagtgattctcctgccttagcctcctcagtcctagctgggactacaggcacaagccaccaagcccaattaatattttatagtgacagggtctctctatgttgcccaggctggtctggaagtcctgggctcaagcagtcctcccagcttagcctcccaaagtgctgggattacaggcaggagtccccatatttgtttatttgaacagtttgctaagcaagtaaactgaaaggacattgaagaattagtgtattttttgtgtggcccaagacagttcttccagttgctgaggaatccttcagtgtccaatactgtttattataagctctggctactggcagaagaatcagttttagcttggagaaactttatgtaaggaagtcattttatttttttaagttatacttaaaatttttatccatttatttatttattttgagatcgggttatgagactaatttttgtatttttggtagagatggggtttgaccatgctggcccaagctggtctcaaactcctgggctgaagtgatccacccgcctcagcctcccgaagtgatccacccacctcagcctcccgaagtgctgggattataggtgtgagccactatgcctgaccaggacgtcattttagaatccatgggaatactactacaatagtagtattgtctagtgcaagcttgtccaacccacagcctgaggaccatgtgatggctttgaatttggcccaacacaaattcataaactttcttaaaacattatgagatttttttttttgcctttttttttttaaagctcatcagctattgttactgttagtgtattttttgtgtgacctaagacaattcttccagtgtagcccagggaagccaaaagattgcacactcctggtttagtggttaagagcatgaactctagaggctgactgcctggatttaaacctagctatgtgacttttgtcaagtcatttagttagctcagctgttaaaaatggacagggataatatgaatatctgcctcatagaattggtttaagaattaaatgagttaatacctttgaagtgcttggcactggtgtgatgtaagtatttcctattatagttatcctgatttctagtaaatatgagataaattgatctggtagttattgatgtcaaaatgcctttgtttaccccttgggtttttggctctgaataattgttacgatattgggaatgttggacatagagctcaatacttactttgcttaatttattgaccaacgctgagcagtctgaaattgagtaatgtttattactttctcagttccccggaaccaacttcagtcagtggcagcagcctgtaaagttctaattgagttttctctcctgcgtctggagaatccagatgaggcttgtgctgtgtcccaggtgagagtgatgggcccatttcttgccctattctgaagcagtgttgtgactgactagtggaatagagtagaggtcagtgaactttttctgtaataggccagataggaaatcatttgcaggctgtatgttatctgttgcagctagttaactatgcctttttagtgtgaaagcagccatagattaatatataaatgatgaacatggctgtgttccagtaaactttatttacaaaaacaggcagtgtttgaattggagctgtagtttgccaacctctggtacatggggctacagagtcttctcaaggattgcaaacttacatacctgcaggggccaggtaggtaacagaaaatgagtaaagtgtgctagttgagaagattgcaggtcccaactaaaggggctaaccactatttggctctgggttattactgccatgcaggaatggaggtgcaaggttgctatactgtgaattatttgagcgtgagaatttcagatttgcatgtgaatcttttcattcccttcaaattttaaaaaaatattgtgagaacaataagacaaatctataagctacatacggtctaaggacatcagcttgcagtctttgctttagtgtttatatgaacctaaatttggccctgtgccagttagaatttccaaaagagtagaattttctgaaagatctatttgtttttgttttcttttgtttgcatttgttttcttttcagaaacacttgattctcctaatcaagggcctgtgcactggctgtagccgactagatagaactgaaattatcacatttacagcaatgatgaaatccgccaagctgccccaaacagtgaagacactttcagacggtgggtgttcctttgacagatctgatcacatgaccacccccatggcaccttttccatggcacctttgccttctagtggcactttcctcagcccttttttttgcctttgtattttacagtggaagatcagaaagagctggcctcaccagtaagccctgagttgaggcaaaaggaggtacagatgaattttttgaaccagctgacctcagtttttaaccctagaactgtagcatcacaacctatcagtacacagactctggtgagtttctttagtcaaatgtcttcttctctgtgggttttgttaagatgataacactaggggagaaaaagtgatgtattttatgtttgtgatataaaatgatatacatgtctgtgggacaaaagaaattgaggaatacaaaataaaacaagtaaaattcaccccaactccttcttctgtccacggttattactgttttgacgaccattctaggcttctctcaatgcaaattaacaaatgtaaggtgtatgtacagttttctatataaaggcatcactccattttggttatagaacatatatatattttaaagctgtatattttttccctcctcctgaaaatgtaacctgtattttctccaacatgagtaaggaattttcccttcactaactggggagtctggagagtatccgtgcagctactgctcacttttgacagttggtttggtgaagagataatagtatcttgacaggccttatgtttcttttcaggtggaaggagaaaatgatgagcagtcatctacagatcaagcctcagctatcaaaaccaagaatgtgttcatagctcagaacgtggctagtcttcaagagcttggtaagactcccaactgttatcagaaagctgatttctgggctgtcaaaaattccttaagtgtgcttctgtcatatggataagaatcaagcatcagacaaaggcctgtttgtaaggttgtggttttcattcatttaggtggctcggagaagctactgcgtgtatgtttgaacctgccatatttcctacgctatatcaatcggttccaagatgcagttttagctaattccttcttcataatgcctgcaacagtagcagatgccactgctgttcgtaatgggtaaggtgcttcacagtgcacatgctttactttttttgtttttgggacagggtcttgttctgtcacccaggctggagtgcaggggtgcagtctcggttcactgtaacctcgtctcctggttcaagcagttctcccacctcagcctcctgagtagctgggactacaggcacacaccaccatggctggctaatttttgtattttttgtagagtcggggttttgccttgttgcccaggctggtcttgaactcctgggctcaagcaatcctcctgccttggcctcctgaagtgtcggaattataggcgtgagccactgtgccgggcccatgctgataatttctttaactgtcacattatagaagtgaatgattctaagagacacttgttgatctctgtcatgttccagctttcattcattggtgattgatgtaactatggcattggataccctttctctacctgtgttggaacctctcaatccttctcgtctacaagatgtgacagtcctcagcctaagttgtctgtatgcaggtgagaagttattatatctggtctcattttctcagtcaagcagagatatactttcaggaaaccatgaaaatcctcctgaatactctactcatcccccttgcttccttctctcaaggatcatctaacgtcgcatcaaggtgaaatgaggtctcaataggaatctttgtaaatggtcctgttgtttcactgctgccattgcgttataggcatatttgattttatagtatgtgcagatactaaatatttactatatgaaaagcaaattgcctaagactgttgagatattgagatgaactacatgtagtctctgccctcaaggagcctacatctgagcagcagagaacacataaagctaaatagtataatataaaacagtattaaaggcaatagaagtatagaatattttcggtacacagagaagagagggattgagtcttgctgtgggatcaggtttgaagaaggcttcgtggaacaggtggtatctgtttatactgataaatgcgaagaatgatattctttaagcttccataaaatccccttttttcctgttgatcttactgcctttgaagcagggcctgacagctggtgtttactctcttttaagttattgttaaaaggactttttagcccagatcactgatccttggctttaagttccgagacatatcatatctctggtatgtcttggaagttatagcaatttcagaagtttacttggttttgcaagtgaagatttgagcagatagtcttggagacctgaccttggggacaccatgaaattactgaggttgatctccctacattctctgaacagttttaatttgaacatctgtgtgtgaataggaagataaagataaaggcatttgtgctctcagagaccttactgtcttttagaggatattagtaaataacttataagtgaagaaactgaatgagagatgagaaagtactttggaagtttagaggagggagagctcactttcagttgagaaaggcagtaatcatgaaggagctctgatgttgaatcttaagtcaggtaggatctcggcttggctatttctaggcagaggcagaagcagacaaaacgtatccaagagtttgggggaacatactacgtaagtttgtgtgtgtgtgtgtgtgtgtgtgtgtgtgtgtgtgtgtgtgtgtgtgtataagtaagtctgtaggttttatggctgttcgtgggtgttgtataattggacagaaagtaagactcaattagaaatgcagactaagtcatttggaccatatcctgtagatagtagagaccattaaagattctgagctgtgagaggatctgagctatattttaggaagaacattcaggctgtactgtacaaggtattttggtgtggggaaatattggaggcagggaaactacttaggaggaattggcagtcattcaggcagcgtacatttagggcctcagctagggcagcagcattaagagtagaaagttaaggatacatgtgaaaatatgttctctcatagctaatttccagtattgagcttcctcatgctctaccgttgattttgcatttttaaatttggggtttatttattttgatttccaggggatttcattaccctcacatggatctcaatgtactcagtcagtaagtgattaaagtcagtaaggactagagattctttaaaaattcatagtcggattaaagatcccaaatctggtttgttaaaatttgatcacttgggatttgatttaaggaaagggatttggctatgatgtctttgagaaattccaggtataggatttttttttcataatcttaaaatttatttttaattttttgaaattattagattttactattattattattattattattattttgagatggagtctcgctcagtcgcccaggctggagttcagtggcacagtcttggctcactgcaagctccacctcctggtttcacgccattctcctgcctcagcctcccttgtagctgggaccacaggtgcccactaccatgcccggctaatttttttttttgtatttttagtagagacggggtttcaccatgtcagccaggatggtctcgatctcctgacctcgtgatccgcccgccttggcctcctaaagtgctgggattacaagcgtgagccaccgtgcctggccagatttcattatttatttatttatttatttaagaaatacagtcttgctatgttgcccaggctagatttgaactgttaggctcaagtgatcttctcacctcagcctctggagtcgactgtgcctgcttctagattttaaatttagtgaatgaattaattatttaattataatttttttgagatggcatttcgctcttttgcccaggctggaatgcaatggctcaatcttagctcactgtaacctctgccccccaggttcaagtgattctcctgcttcagcttcccgagtagctgggattataggcgcctgccacttcgcctggctaatttttgcatttttagtagagatggggtttcaccatgttggcgaggctggtctcagactcctgacctcaggtgatccacccacctgggcctcccaaagtgctaagattacaggcgtgagccaccgcgcccagccttaattatttatttttattacttttttaaaaagagacagaatcttagtgtttcagccaggtgggagtgcagtggagcgattataactcactgtagcctcaaacccctgggtgcaaatgatcctcccacatcaacctcctgagtaactggaactagaggcatgcaccaccacacctggcttagattttatttttaaagcaattttaggttcatagagttcgcatatcctccttctcccttatagctagtttctcttatcagtaatacttttaattagtacggtggatttattattgatgaaccagtattgatatattattattaactgaagtccatagtttacattggggtttcatttttgtgttgtacaggtctatgggttttgacaaatgtatagtgtcatgtgtccatgattaccatattgtacaaaatagtttcactatcctaaaaatcccctttgcctattcattccttatcccatccctcgacccctggtaacaccactgatctccactgtctctctagttttaccttttctagaatgtcatgtagttggaatcatacaataagcaggattttcagattggcttctttctcttagcagtatgcatatagttcctccatgtcttctcatggcttaatagtccatttctttttattgctgaattaatattccattgtatggatataccacagtttgtttctgtgttctcctattgaaggacattcgtgtgtagtgtgtgtgtgtgtgcgcgcgtgtaagttttcagcttatttggataaatacctaggagtctggttactgaattgtatggtaaacctatttagtcttgctcttaatggcatttattttaagtagtcaaatcatggaattgcttgtgggtggggtgtgcttttgtgtttcagctttggtggattcttggatgcactccatggctgagacctgtgcatcttctttttcaggtgtgagtgtggcaacgtgcatggccatcctccatgtgggtagtgcccagcaagtgcggacagggtccacgagctccaaagaagatgactatgaaagtgacgcagctacaattgtccagaaatgtgtaagccaaagatctggggataagggaaccttgattgttcaaatgagggagtatggccagttccactttcttccatgatagaagaaagaacttagagtattctccacactactttccctgggcactagtaggtctaagaggtaggcatccagcttgttgatttggtatattggttgatctggtatattgtttccctatctctgtagaacacacttgaaagattagccattaattcagcaaatatgtttgagggcctactgtgtgtcagtgtacttttagggaaatgcagtaaacaggaaaatttccgatagtgattaagtgcgctgaaacaatacattgtgattgatagtgatctgggccgggtgtggtgactcacacctgtgatcccagtactttgggaggtgggtggatcacctgaggttaggagttcaaaaccagcctggccagcatggtgaaaccctgtctctactaaaaatacaaaaattagctgggtgtggtggtgcatgcctgtaatccccgctactctggaggctgaggcaggagaatcgcttgagcctgggaggtggaggtttcagtgagccgggatcacgccatcgtactccagcctggacaacaagagtgaaactccgtcttaaaaaaaaaaaagtgatctgatgtggagctgggcatgctgcttttgattcggaggagggatggcttctgagaaggtgacatttgatccaaatgaaaagagggagtcagctccatgtgaaggtcaaggaaagtacgatggaatgtatcattgaaaagaggatattgaactcttcaagttaaattgtttgggtaggatttagcatttatgatgaaatctgtcagcttgttcagatttttgtgtctgtttgatattgtacagctcgaaatctatgacatgattggacaagcaatcagcagttctcgccgggctggtggtgaggtaagaagcgtatctgtctctgctgcatacttcctatcttgtcctctctgagatgtaaatatctctatgattatgttttttattttgtgcctttcacaacagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggtatgtgtctacttgattataacttatattttgttttatttcgctaacattttatatttacagggagctagtatgacttcatatcaataggaaaatttgccttcctacctggcttgaatttagcaactaagataatgatcatgacctgttatctccacagcatagctttgtgatttttagataagtcactcattctctttgattctatttcctcatctgtcaaaggggaaaaatatctgtgcaatgtgtatttcaggaattttatgaagttcacatcagaaaaacatgtttctgtcttgtaaagcgggcttgtttgacttggagttgagtacttgcgtgtataacctgtaagatgagaatattgtcagggcctcctggtttgcttcctgtaatatttgctgttgttttgatgaactctgaaagaagagatatgaccaatgtactgttcaggtttcgttttctaagcccaggtgtttctggattttattttttcattcaatccctattatatactaggccctattctaggcattgaggatatagcactaaacaaagtgatgtccttgcctttatggagtttattttatatctggagaaacaatgaacaaatctattaacgagtagattatagataatcatatataaacgttgtgaagaaaaagatgtcagagcgaggggccggagagtcataggggcttttattattttattttttttgagacatagtctccctctgttgcccatgctggagtgcagtggcgtgattgtggctcactgtaacctccacttcgcgggttcaagcaattctcatgcctcagcctcccaagtagctgggattacaggtgaatgccaccacacccagctaatttttgtatttttagtagagacggggtttcaccatgttggccaggcagggtctcgaactcttggcctcaaatgatctgcccacctcagcctcctagagtgctgggattacaggtgtgagccactgcgcccagcccagggctattattttagttatttagttatttaggatgatccagaaagggctccaaagacatgatgtagagaccatatgtgaagtgacagagctatgtaagtatttggggtagaattgttcaggtttgagatggaagtatcattgacatttctgagggtcagcaaggtcagtgtggctaaaatggagaaaccaaggtgggagagtggtagaaaattaggtcagacaggtagccagtggccagatcacctagggccaagtgcagtcagtaactgttagaaggattaaacaagggagagatgcaacctgatttattggtgatctgaggatagactgcagggcataagataagaaggagggagaacagttagcagcgaatgcatcattccagatgagatatgaaggtgacttggatagggtggtgcggcaaaggctgagaaaagaggccgaattgaaatatatttggaaggtacagctggcaggatttactgatggcttgtatgttgggtgtgaaaaagatgacatcacaattttttggcttgaggtcactgggttgtataatttactgatactgggaacacttgtttaggagtgggttgaatgggaagatggggaagaaataaaaacgtaatattggccatgctgagtgtaagatgactgtcagacctctatgtgagatgttgagtgggcagttggatatgtgagtctggagtttcaggaagaggtcacagcctggactgcattaacaaattaccctctgagcatcttctgtgtcccaggctctgtgttagttctggattgctgtgatgaacataaaaatggacatattctcaagagacatgaactaggtatccatacaaatatatatatatatatatttttttttttttttttttttgaggcagagtctcgctctgttgcccaggctggagtgtagtggtgcagtctcaactcactgcaacctctgcctcccaggttcaagcaattcttgtgcctcagccaccaggtagctaggattacaggtgtgtaccaccatgcccagctgattttttttttttgtatttttaatagagttggggtttcgccatgttggctaggctggtattgaactcctggcctcaagtgatctgcctgcctcagcatcccaaagtgctgggattacaggcatgagccaatctgcctggccatgtcaaattgtatctagagagtattagaacaggggcatttgacctggctagggacatcagagcaggcttccccaaggaattgctaattaagctgaaatctgaagccggtattgacatggtaagttgatagatactaggcgaagtaaggaggtaagagtgttccagagcaaacggtagtttgtgattttatgagtggccattttcattcttggcattgtaaagggaaatgaaagaatgccaagaagtatatccttagaagtagcagttatgcttttaaaatggctgttgtttcttcatattttaaaagaatacatgtatgttgtataagtgacaagccatacagatggacataaataggaaaggtaaaaatgatcccaaattctaccactcaaattggtaaacattccttcagacatttttctgtgcacatataaaatatatataagtttacaaaaatgggatcagtgtatatgaaatactgcatcatcttttcagtgacactattaaaatgtctaagtttttaatggccagcagtattccactatgtaaatataccgtagttgcctaattcccctattgctaagcgcttatttagattgttccaaatgtcttgttttgataacttcctgaaatataaacttttgggaacttaattgtcctgttgggatgaattcccaaaagtaccgttgttaggacaaagggctcacatatttaaacattggaaatgttttgtcaaactactcgttagaaaagtaacactaatctgcattgacaccagctgtgtgcttatatgcccatttccccatgctctctttgacaatgggcatcattagtcttcatgtttgcttgtcttagaggagagaatgctatgatatttcatgtatttgtatttctttgattactaatgtgattgtatttcctttcacctatttattggtcatttgtatttcttttgtaaactgccttatgtcctttgccttggttttctttttggtatttgtcattttctttttaatttttttattattatttttacagaggtagagtcactttgtctcctaggctagagtgcaatggtaggattatagctcactgtaaccttgaactcctgggctctggtgatcctcccacctcagcctcctgagtagctaggactacaggtgtgcaccaccatgcccagctaatttttaaaattttttgcagagatgggatcttgctgtgttgaccaggctggtcttgcactcttggccccaagcaatcctcctgccttggcctcccaaagtgctgggataatagatgtgagccaccgcatctggcctgtgtttgttcttttttctttttgatttatatgaacttgcaaatcatatatattaaccttttgttatgtggagattttggacaggaggaaaacactttacttgaatgtaattttcttttctctcttttgttttaaacaaaacctcactctatcgcccaggttggagtgcagtagtatgaacacagttcactgcagcctccacctcctgggctcaagtgatccttctgccccggcctgttgggtagctggcaccacaggtgtgcctcaccacttctggctaagtttttcatattttgtagagatggggtcttgccatgttgcccaggttggtcttgaacttctgggctcaagtgatcttcccaccttggcctccccaagtgctgggattataggcatgagccactgctccaggcctctctttttattctcttagatttgtttccagatattttatagaagttggtaattcaaacctttttcttttcaaaataatgattctttaaaagttcaatctacatttaaaagtcagcatctttgtataacccattagccttgaactgattgtttaaattccaaaaatttttccatttgggagtttcttctattccaggaggttttatttatttatttatttatttatttatttatttatttaattttttgttttgagacaaggtcttgttctgtcacccaggctggagtgcagtggtgcacctcagcctcccaagtagctggtaccataggtacatgccaccatgcctgggtaactttttaatttttttgtagagacagggtctccctctctaggttgccaagctggtctaaaattgctgggcataagtgatcctctcatctcggcctctcaaaagtgttgggatttaaggtgtgagccaccgtgcccagcctagtccaggagttctaaacctgaagcctgcagatccttaggccatctgtggatggggttcaaggagattgtgaacttcagaaattatatgcagatgtatgtatgtacaattttttttttctgaaggtccacagagtctgaaaggggtctgaaaccccaaaatggcaagatccactgcttcagaagttgtaatttattgttaattattttaaggattgtgttttcctttttctttgtgtaggcatcagggatttggggtactctcagtaatattggcaaaccatgccatcaaactgctaacgtctctctttcaagacctacaagtggaggcccttcacaaggtgaggaggttatccccatggtaatcagcatattgattgcgggatccacttctggccaagcaagcttgatccatcaactcaagttgttttttctggctgagtagtatcattaattgccctttgatatcattgccttcagggttgggagacagatggcccccctgcagccttgagcattatggcccagagcacctccatacagaggattcaacggctgattgactctgtcccactgatgaacctgctcttgacgttactttcaacttcctacagaaaggtgggtgggagttaagccattgataatttagaagaatgtctcattttatatatatgatatatatatgtatatatatatatatatataaaactttcttgaaatgaataagactgactacacaccatgacctttatagacccaaagttttggtactggtgttgaagaagtgaaaaattcttagcgggttgaatctatccaaacatttgaatcagttattaattatcagttttgtgatacacgtggctacttggtgatttgtgatgattggcatactgaagcagaagcatagaggacactatggaaacactcctgttttcaattcttgtccacgtctctggttggtagtgtttttgtagggtaaagtgatgaaagtccttaattaagggagctattaagaggcatactcttggatttaggaaaaaataaaagagattatggagaaagttttcatgcgatgcatgagattaaataggatggctccggttttgtaattgtcattttcctaggcatgtgtcctgcagcggcagaggaagggctccatgagcagcgatgccagcgcctccaccgactccaatacttactatgaggacgatttcagtagcacggaggaggacagcagccaaggtagaggccgctcttttctctctcccagagataagctatagagtgcaacaggagtgttctcagcagattcctgtagtttcctgaccaaacaaaagtttccattttgttttcacctgcttagcctggaccttggttttatgtgcattcaaagatgacatgttatttaagagcaagttgagctgttgatgaatgaatgatggaaacaactttcagccaagcctgggttacttttcattcctttccctccaaaatcagaaaacatctcaattgttccatatttcttcctgtgttgactcattttgtgacctctgctctaagctttctcagtgaaactcaaaaggtcacatgtgaggtgttcggtttggatgttatcatagtcatagtttagggaagcttgagtagagaaacctaatcctgttgtagtgaacccactggcatgccctcctgccttagtttgatgagagaatgaataaggtaagtacctcagattctttcataatcaggtttgtgggaacaatgtgaaatacgaagggaggtgtgattcttaccgtcctgtgatttatggttgataaggcaagtataaattcgctcttgaaaatatttggcttgttaccagtaaaataatgtgaagttgtttttctttctttgttgggctccttaaagaaaaattggctgggcgcggtggctcacacctgtaatcccagcactttgggaggctgaggtgggcagatcacaaggtcaggagttcgagaccagcctggccaatatggtgaaaccccatctctactaaaaatcaaaaattagccaggcacatgcctgtagcctgtagtcccagctactcgggagactgaggcaggagaatcgcttgaacctgggaggtggaggttgcggcgagccaatattgcaccactgcactccagcctgggtgacagagcgagactccctctcaaaaaaaaaaaaaaaaaagaaaaaagaaatcagttttattggggtataatttacatgcaataatgtgagaaattcttaacgggttgaatctatccaaacatttgaatcagttattgatgatcagttttgctcttattttatgtatgcatttagatgagttttgatacacaaatgcaatcttgtaaccatcatcacaattgggatatccttgtattccttttgacttaagtacttttaggaagcagatgcaccaaaaacacttttaaaaaatatttattttcgttactttatctttctctattcagacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttggtaagagtaggtttctaaggtttaggggaagtggacatggggagctaggggtatgagaagcagataatttgaatgcaaacattttgtggcttggataactgtaatgtttaaagatatttttgcttaggacttatatgtcttgattatgtgtcattaaataacttacgtgactgttactgtttctctgctggcctttagaatcacttaatggctttgtgactttgggcaagaatctgaattttttctagccttagttttgtctcctatcatatgggagtgattgtacctgcatctaaaggtgttgtgacatcttaaagagagactatttataaagtgcttagcataggtctgatatatcatcagtgcttgctgtggttgaactgttggttcaactagtattatctagtaagtgtcagtccccgttctgatgatgtgagtgagtcagatacagttcttgccttcatatatatagcttacagtcaaggatgtggacaaaaaacatttatacaataattcaatttaattttaatagagaagagctaggaattctatatatgtgtaataatcattcatataggcttcaggattgaatatatcagtagtgaattggagccggacaaaggaccttaggagaacaaaagaaatgggtcagtctatttggaaatcctgttttcatacactgttttgtaacatctgttatattaaactggaatgccattttgtgtaagtagaattaggtgggaaagagagactcataatgaaacttaggcccactgtaagtgatttaaaatctgattctttcattcattgtgtttattgcaggatacctatgagcatattttattttctatttgtaatcagagtttataggaacgctgggcttatgaccctgataagagcttttttgtgtgtgttcctttcagttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggtcagtagacaagatatgtgcctgatggattttttttctcatggagtttggctgttggcagggaggtgtggtgcattcaatagctgcttaaataattggcttttctacttgtctttaaggttcatcagatgaagagtttgctgcagctctctatcacttcaaccactcactggtaacctctgaccttcagtcacctaacctgcaggtttgtgtgtgctgtgaccatctaggcaagagctcatgacaccagcttccataggctgcagctccaattgtttgtttgtttgtttttttgagatggagtcttgctctgttacccaggctggagtgcagtgacacggtcttggctcactgcaacctccacctcccaggttcaagcgattctcctgcctcagcctccagagtagctgggattacaggtgtgtgccaccatggctggctaatttttgtatttttagtagagacagggtttcaccttgttggccaggctggtctcaaactcctgacctcaggtgatccgcccgcctcagcctcccaaagtgctgggattataggcgtgagccaccgcgcccggcctgtagctccaattgttaaggaacagtttgtcattaaatcccctccctggaaagagcgttgagaggtgattctaatatgtccctgtgccttatatttaggatcatttccagaaaaaaaaatatgtcttttatcttaagtcagtaagcttaaagaaaaggaaaacccacaaaaacaaacagaaactcctgatgattatgctagcagaaaagtggacaaatacacaagcaggcagtttatatgaaaagaagtataagtggtcaataaacataggaaaagtattcaacatccttagtaattgaagaaagacaaattaaaatgtgtgttttaaaagaatcaatcaaattataggagatagatgctctcatatacacttgtacttgcaaactcaccaccaaaacaaaatctaggacgttgactgtgaacttccaatcttatggttctctctcccctctgaaatagctgatgtcttgaatcctaaatctcaagttcctcatgtccttagtcatatatgtatatgtatgtgtatgtacatatataatctatattccttaaatttaaaaaaagttttaataattgcttgtagttttatagcaaatgacatcatgctgtatgtaatgttttcaagctctctcttttttcatgtagtatgatatagtactgtattgccaagattcatctatattgttatatatttctatagttcttgtttggactactgtatgatattccattatgtttgtgactcaaaaccacaatgagataccacttcgcttacacgcattaggtggctgttattaaatggaaagtaagtgttggtgaggatgtggagaaagtggaattcttgatgcattgctggtgggaatgtagaatgatacagtagctgtggaaaacagtatgtcaattctgcaaaaattacatatagaattactatatggtggcacgtgcctgtagtctcagctactcgggaggcgaggcaagaggatcacttgagctcaggagtttgaggctgtagtatgctatgattgcgcctgcaaatagccactgtactttagcctgggcaacatagcaagatccccatctgccaaaaaaaaaaaatagaattactatatgatccagcaattctacttatataccccagaagaaatgaaagccggggcttgaacaggtgtttatccacccatgttcatagcagtattattcacagtagccagaagatggaagcaaccctggtgtccattgacatttgaatggataaacaaaacatccagccatacaatgaatgttatacagccttcagaaggaaggaaattgtgacacatgctacaacatggataaaccgtaaagacatgatactaaattagtcagtcacagaagcacaaatacaaccttgtatggttccacttctgaggtacttaggtagtcaaattcatagagacagaaagtagaatggtggtcgcgtggggcagggagatgggaaaatggggacttggtgtttagtgggtacagtgtttcagtttggagagatgaaaaagttctggacgtggatggtagtaagggttgcagaataatgtgtatgtgcttaatgccacagaactgttcatgtaaaaatggttgaaatggtaaattttatgttgtgatactttaccacataagaaaagtaaaacaaaaatagtgcttggtacctagtactagtaccttctaaatgttagctctcttaataattgtattattgtttaatattattattgcagtctcttggttcatttgttcaatacatattcattgagcacctactatgtgccaggtactattatagacactgaggaaataaagataacttgagttagtgtgggatcatgaaaaaggagggagataggcataggacattttgcagagatcatgggccattatttgaatggggtgaagagcatggagaggaaggagtcttggatattgcctgagtttaaaactcaaatgaaactagaaggatgctattgtcattaatagagacaggaaagtcaggaaggggagttggtttgggggtaagagagattgggttttgttttgtttttttttagaggtggggatgttactgtatctcccaggctggtcttgaactctgggctcaagcagtactcttgccctcagccttttgggactatgtgtgtgtgccatcatgcccggctggtccgtccttctttccttccttccttccatccgtccgtcttcctgatggggtctcgctatgtcgcccaggctgctcgaactcctggcccaagtgatcttaccacctcagtctcccgtatagctgggactgtaggtgtgagccactgtgctcggcctaaggtttcagtttaactatgatgaagttttggggtgccagtgtctagaaaatagtttggaatgtgagtctgaaattgaggaattaaattggggcaatttttgaagtaatgagaaacagtgagactagcaagatagctgaaggctgaggctgaacccttagaaatgccagtatgaaagaggagtggaggaagggaggactcagccagagttctgctgctagatggactgtggtgcagtttgacttcttagagagtcagttaccttacttagagctgagaaggaaggataggggtggaagggaaagaccaggttcctatggaatgttaactcatttttgtggctctgaggactgaaaaactgacacaaagatgaaaaatgagcaaaaaaaagcattaaaaatagcattataaggaatatatgttacttatccatatatatggctaggtacgccccttgatttgaacatttagattttttttcctgatttttccattattagaattgtgctacagttagtatttttcatgtagctcaggtaggtttttttttttttttgaattgtttcatttaacttaggaattaagaagttgtttatgactttgttgagcatggtggttaagaatgtggttttagaggctgggcgccgtggcacttgggaggtgggtagatcacctgaggccagaagttcgagaccagcctggccaacattgtgaaaccccgtctctactaaaaataaaaaaattagccaggcatggtggcacacgcttgtaatcccagctactcgggaggctgaggcacaagaattgcttgaatccgggaggtggaggttgcagtgagctgagatcgtgcaaccgcactcctgcctgggtgatggagtgagactctatctcaaaaaaaaaataaataaataaagaacatggttttagagataaacctggctttaccacttagagaccttcaccatcccttatcagtgacatggagcacataatacttcctgtctctgcctggcacatccggtgtgacaacaaagtatgctctgcatttagctcaacctatggtaactgtgtagtccacggaaactgctcttgaggccagcgacattttgcgaaacattcatttccagggaagagtccttgaggatgtagtataaaaatataatttaatttggcagacttagaaatttatcctacatcccacagtaaccatgctttgtgtcttctgaagccaagtgagaaagcaggcatttgtctggttttccattggcatcctgctcagtgtgtgtgtgtgtgtttgagaagataatttgcagcttagttactgggctgaaaatgaagctcacttgaaagacatgctccacctggaggtgaagaacagccttgttgagttctgggtgccttgagatctcataggcagaatttctctgcgaatactgcggatctctaaattgttggatcttccccttttgggtgttatttgtattatgtaactgattattaaagaaaaactattagctattacagttgttcaagaagtttgctttcaaaggcaacaacttctcatgttttgtccatttacaaaattatcctgattctggtatctcaatgcttttctcttttttcaggagcccatatctgacactcattaactataaatgttaatgaggttagatcagtaagttttcacttatgtttttctcatttgttgacctaaatgatctttatccaaactattccaaaatctgaatttctgggtccttctttctttaaaatattctgttcaatattaaacaaacaaacgtttgagaacatgagtaaccttttgactttatcccgtatctgtttgctaatgttctgttccatgtctttcttgtcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtaagatgtctgtaagagaaggcctatagagaaagttatttccttttttatttgtttgacttctttgtagttaatctgtggctttgaggctttgctgtaatgataatgtttagagtggggagggtagaagagggatggacttggagatgtgctgttaaaaaacaagtatgtcaactttggtctggaaataaatctccctgtagcacatgggggatttggttataattatgcgatggaaccacaatcttgaacagaaccaattttatcctgacctgcttttttgaaagacaagcagggaagccagctctgtccttggttattttgctttcaacatgaaaccacttaggggcacttgcagtgttttttggagaaattttaaagaatttttttccttgggggaagctcagattaatcatctaaatccactttagatggacctgtatttgccatttttgtttacatggttagaagtcttcaaagcagtttgttttcctaaaaggctttgctttctgttccccattgtaggatcaaatagctctaatgctggatttgagaaagcataaaccttcttgagtgccaaagacccgctatatttttcctggtggaatcttgcaaaaaggctgagagggtcgaggggtgcaatgagggaaacccttgttaaacacacaaatctctttcctaatattaaaacacaaatctctttccaaatagccaaaggcaatggaaacagttggctacattcattccttttttgcattaaagctcttctgacaaattctctgaatagtatattttcttttttattgctttatagtctatcgagttatttttgactattatcatgcagtgatttttaacctgtagtataaactctcaaaactagaattaaatgatagaatcaaaatatggggaaaagtaattgaactggttcacctgtccaagtttgttaatcagaaaggaacaatagcaacatttttgtgggggagcttgtagtacttttcatggccacaaatgacagggtgggcattaacacgcctgtgttaaggcttgcctcaagcaatcctcccctcgacctcccaaagtgttaggattatagactgagccactgtgcctggctggccaagtctgactttttttagccaaaatttagtttctgtcttgtctttaccatgtagcctttttttcttccttaatttgttatcttactgcctgggtttaggaaatttaactcttctagtgcttgacattataactcctggggaatgctctttttcccaccagatatagtcatcttttctctctggtaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagaccaacacgttcttttttgcttcaccattactgagaactttattcttctcaatggttaccatgatccgcagcccaaatgacctacccactttaggttttaggttttggtaggttgatgggtaggattaggaggaccactgagactttgtacttgatgtttagccagaagtgatacatgtagattacttgatttgatgcattttttgaaagtggaatgtaggctgtgttcaaaggcattctcccacgaattgccctgctctacctgtgtctgatgcagtgccctgagcatcggcccttgatgagtatttgttagtggttgaatgacagtcaagtagtaaattttatggattggtaaattcctttgttgtaaggatccaaaataaggataggaggatccgttcagacttaactgtgttcagcatttcttaaaatgtttcattgagcactataccctttatgttgcaccaaaaattgcattccaaaagtagtcacagaaaaatctttaaatttttattttggtttgtgagtttcccaggctttggtataccaagctattatcgtacctgagtgaaaagctgaatggtgcccaataaaacagaatatttgaatgtagaacacccacattcagattaccaagattcagtgtaccgagctattatcatgcctgagtgaaaagctgaatggtgactgtgtatctttcttaatttcagtatttgtgttttaaaaggtacagcataacctgctaagtcctccctttgggtgggcaagtggatcccaggacagcaacagccgccgggcaaccactcctctctatcatggattcaaagaagtagaagaaaactggtctaagcatttctcatcaggtcagaaagaagactgttaataagaaactgacttactgattctcattggtggggttgaatttgaagcttggggactcttggaggatctttggtcatttgctttagtgtaatccctatgggtggcaaatcacctatggattaaaacatttcagaaatggactcccacatagcctacatttatattttttaaaaaattgaagctgggcactgtggctcatgcctgtaatcccagcactttgggaggcagaggcgggcagatcatttgaggtcaggagttcgagaccagcctggccaacatggtgaaaccccatctctactgaaaaaatacaaacaacatttagccaggcttggtggtgcctacctgtaatcccagctactctggtggctgaggcaggagaatcacttgcaccaggaagcagaggttgcagtgagctaagattgcaccactgcactccagcctgggcagcagaacaagactctatttcaaggaaaaaaaaaaaattgaggctgagcatggtggctcatgcctgtaatcccagcactttgggagggcaaagtgggaagatcgcttgaacccaggaatttgagatcagcctgagtagatcccgtctaccaaaaattattttaataagtagccgggcatggtggcacgtgcctgtggtgccagctactcgagaggctaaggtgggaggatcgtttgagcttgggaggttgaggttgcagtgagctgtgatcacgccactgtactccagcctggttgacagagtgagacccctgtctcaaaaaaaacataaaaactaaaaaataaattgagacacaagaaatcagaatcctcgtgtctggccatagggtacagtatatggattcttgccactctgtgtcattaattttccttattttcccttagagttgtggttctaatgtatagctaaatttccttttgggtcttggtgatatgctggtctgaaacgaatgtgaacatgagattatctctagtgtttttctcatatagcaattgtctgttctttggatgaagtgtttgttgtgttcatttttagtgtgtgtttgcacttaccctgaggattattagatgttaagtgtgttttgtggaaacttttgtgaagccttagtgtgagtttactgttatcttttactatttgatgttagggaaacagcatgtaagtttaatgtgtgcagactaatgatataatttgttgattgatttgattctagggcaccctacttaactcttagagcaatggttctcaatgggtgattttgccctctcccctccaggacatttggcaatgtctagatatttttggttgtcacaactgggggtgctactggcattcagggggtagaggccagggctgctgttaagtcacctagagtgcataagatggcctcccacagcaaacacttatctggctccagatgtcaatattgttaaggttgggaaaccttattataaagtattttctgagttttacattgcatactagtcagatagagttaagaatggaaccattcttttaatcagcatattacttttcagatgctgtcccacaccccagattctactgtgtcctgtccccagaagcctcagaggatgatttgaaccgacttgattctgtggtactaggaattttaaaactgcattttatatgtgggtcagatggtttccaccagaatcagcctactggggggaaagggaatgactgactttttatagtgaggaaatgtggtctgtgttacgatttgagcttattctaataggaaaatgttacttggatatttatttgttgggtgcacttttgctgtggggtttgtcctttctggattggcacctctgacacttgatttttgaagacagtctttgttagcatttttcacatgcaagtattttaatggacaaaaataattgtcttactcccttattctaaagccagcagctgtgtgctcacaatagcttgcaaacagtgtgagtaatgtcccagaatgggaatctgttccaaggagaaattaatgattatgatttgatgggatattttgtcaatcatgaggataagtgatagtgtataggcagtaggaaaaaatactttaaaagtaaggaaatgactctctttctttcttgatgtcaggcatgtgacgtccttttctccaagcttgtcaagtatgatgagctttatgctgcactgacagccctgcttgcagctgggtcccagcttgatacagttaggagaaaggaaaacaagaatgtaacagccttggtaagaccatggaaccctgagaagtctttgggttgtgtttgatcattgatcatttctatcagaaatttccttctgaaatgtaaccagtttattgaatattgatttgcaaaactgactgatacttgagtatttctaggtagtttgtgtagctatgttcaccttaaagataatttaatcagctgttgcatttttttggttaccattgagagaactgtaatttaagagttagtggtccccccccaagtgctatatctcctgtcaatactggttgatgtgtgatattgaaagcctcacgcttgagatttttccatggctctgttaatgtgtctctatattctagaagcaattccaggccacaaaaacggatagctgattgcaggtctgctaagcagaatgtcctgccctcttttggttaattggtaaattattggggagccaaagttgtcttggaatagcctttttggtctgtgaaatgtgcagaatacggaacaaattatttgtatgtgtgttctgccattttctgctaggtgcactctctagaaagatctggagaatggacttgggggccaaatctcaatttaaaatcaggactctatacagttctggtttaaaagttgtatttggagtagttcgtactgtgagggagatcttgaggccataccaagtgctacctctatgctgcttttcctttctccaggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggtaacacagagcttgctgctaagactattcaaagccaaagtgctttgtgcttactggagcttttaaatttgaagataatgaaagctttgcctatagtcatctcctaaacactttttcttgctgtccaaataggatcaccttatcaaacagggaatgaaggctgagcatgctagctcgcttctagaactggcatccaccactaagtgtagctcagtgaaatatgatgttgaaatagtagaggaatacttcgctcgacaggtatgtaatattggaacctaaatgatagaacttggtttctaccatagcccattgccacagctaattatattttgcatatttttaaagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccaggtgtggcgaactgcctgcccagagatgcacatgcactcttcactccgtgcagatcccgcattgactcagaatttgacatttttctctttcttcagcttaggggtttttttccccacgtataatgctttcttctctagtatgaaggggtgcttgatgaggaaattttcaaatagtgcaggaggagtcaggaggaagtttaatgtctataattctttaaatattttgtacgattttactcgtaggatacagagaaaggtaatttttcaaaacactgtcatttctgttattaactgagttaaagctccttaaatgctctttatttattattattaaaaaaatttttttctgagatggcatctcgctctgtcgcccaggctggagtgcaatggtgcgatcttggctcactgcaacctccaccccctgggttcaagtgattctcctgcctcagcctcctgagtagctgggattacaggcatgcaccaccgtgcctggctaatttttgtgtttttagtagagacggggtttcgccatgttggccaggctggtcttgaattcctaacctcaggtgatctacccacctcagcctcccaaagtgctgggattacaggcatgagccactgtgcctggcccttaaatgctctttacatgtgatgatatgtagttggagaaaaaaaaaaatctctaaatgagttagaaattatttgaaattcaactctttctataacaaacactgcaaattgcatgccctgtagactttggtctgtatgatgtttaaatatttaaagttaatttcagtatataaaattgggagattattcacaagtttagatttctggcttttcttaaattggaagaactggcaaaactgggcctgacttcccaaacaacagtaacagactggagctgagaattagttccctttgcagcagttttcaccgggctctcttaagcttattgactttatctggtccctgtaggatctcagtgttcactcctgttctatggtgcttttttgttttgagatggaatctcactgtgtcacccaggccggagtgcagtggtgcgatctcatctcactgtaacctccacctcctgggttcaagtgattctcctcagtttcccgagtggcagggatgacaggtgcataccaccatgcctggctaatttttgtatttttgtattttcagtagaaatggggtttctccatgttggccaggctggtcttgaactcccgacctcaggtgatccacctgcctcagcctcccaaagtgctgggattacaggtgtgagccaccgtgcccagctctgtgggctttatgctgctttaaagggacctagatctttgtcagacttaactaaccttgtctcttagtatgactgccttgcagaagatagagggctgttgtttgaggcaaattttttttttggctcaaatttgtttgagccaaacaaatatgtatggctgctacgtgccaggtacttttctaggtgctagggttatggcagtagccaaagcagaccaagtcattgccctctgggaatttacagactctaatctggcctaataggccagtactttccacactgagctgttaacgttcctggtcaagtaagtttgcaaaatgttggataaacagttttttttgttttgttttgttttaaaaaatatagtattcagagcctttactgtatacattgtcaatcttctgaggtggggaaggaggatagatatagtattcactgtttctcaggcttacttgtcaggcagtcatgttttgggagcatttcagaggaggggacattctttgggaaatgattacccattggaattcttagagaccaggaaggggcaggcactatcaactacattaaatagataggaaactgagatatagggttttcagccagtctagggccagtttttcctaactggtgggattagaatcttatggcttcactttccccctgttttttccccagagcctatttgctgcaaaactttaatgaagagggaacaactgagaaaccttccaaggagaaactgcaaggctttgctgctgttttggctattggctctagcaggtgcaaggcaaatactctgggtaagagaacaaatgtgcttttgagtaatattattacaacagctactactgctagtactatggcttctctcccttggtgcctactggcgtttactatttattggagcctttttgtgtatcaagcatttaggtaggtttgtctattttgatcttcacaataacccaagaagtgttactttgatcccctttttactcattataaattaggcctagagaagttatttgtccacaatcctgcatcttgcaagagatagagctgggatccaaaccaggatctgttggttccaaagcataaggctattttgtctttagcacagatctttgctctcctcccctcccctccccactctcttctctcttctcttggcagggtcttgccctgtcacccaggctggagtacagtggcgctatcgcagctcactgcggccttcatctcctgtgttgaagcagtccccctgccgcagcctcccaagtagctgggatcccaggcacataataccatacccgtataatttttaaatttttttgtagagatgaggtcttcctatgttgcccaggctggtgttcttttcatttataggggacaggaagattagcaagctagtactttgtgcctggaaaaatctctttgctgggttaggaatgatctggtagaaatttagggtggaaaatcaaagggcttgattggagttaagtacagtagttaccgtttaaaatttacaatcaatcgtttgtattttccttaatttcaagctttaaatattcatttaacattcagatagtctcactttgtactgcttcattgaatgctgttcttaatgtgtgttatgatccctgcccttaagattcgtcttaaagagaaaagagatcaagagaaaagtgatacctatttatagaaggggagcagatgtttaatggtgatttcagtctgacttgcaatgactcaccctcactttgcatcttattttcagttgtcttctttacttgcaagattagaaagtgaacatgatgggaaatgaaaaccttacaattgagagtgttagctattaagcaattaactggttcttggacatagtactgctattgaaatatctatctaagctatcttactaattattttgacagcctgggctgtactgtttctttctgcatttgggcttggcttttaaaatgctctgtgtcgttccttctttcttgtgatgattccttgtcctttctgtcgcctccaggtccgacactggttcagaatttgccatcgtcagtgcagactgtgtgtgagtcctggaacaacatcaataccaatgaatttcccaatattggatcctgggtgagtccctatctgttccagggtagaaatactgagtgctagccattctgtcttttgttcttaagcctaaaggaattaggcttaaactagctaccaagatatcttcatatactgcagtaatattggctatggctgaatcattaatcaatgcatttaatcacctagttggttctcatatggctttttgcttagaagtttgtgttatcaaaagacaaaccattttatttatttgagcctcagtttcttcaccaattgaatattgggctgtgacgattcaatgtattgaatgttaagtgcctagcatattacctggcacacgaattcccaatacgtgttaactctgtttcctttgtaggttgtatgtcaggaacctgctccttttgtaacagttttacagggtcgcttttagcttctctaggcttttagatactactgagtcttctttttttttttttttgagacggagtctcgctctgtcacccaggatggagtgcagtgtcgtgatctcggctcactgcaagctccgcctcccgggttcacaccattctcctgcctcagcctcccgagtagctgggactacaggcgcccaccaccacgcccagctaatttttttgtatttttagtagagacggggtttcactgtgttagctaggatggtctcgatcgcctgacctcctgatccgcctgtctcagcctcccaaagtgctgggattacaggcgtgagccaccatgcccagccaatactactgagtcttctgtcagttaacttactctttgtatatcctctgctcacactacctctattaacagattatttgcttactgaagttcttttcaaaagctaaatattatagtcttgttatccctgctttatgatcgtgacctctgtttacaccacccagaactttaatagagaccagatgcattgcaaaatccagttccttctcagtcattatagacaaacaatagttttactttagatatagtgcattatattatactctaatcatttgaaagtggtattggatattcgttgcatttaactgttaactttgtactaattaaaatttaactgcttccttttctgtaccccacttcccttcccagcatgaataacagtgtatactgagtagaggctattgtttacaaacgtcagtggggtcttagtttatgtcagtttttttttccatgtgagaattttttccagggtagatggtctatccatttacatctgctttgcttcctttcagcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtgtaagtacctactacctagccccaaggactctatgtctgtattctattgtggttaaagagggacagtgagagttttataactatgtagtaatgctttcttatatacttctttagcaaaaagaacctgttgctttaaagtataagcacttacctagaatgattttttaacttagatctgaaagacaatagagtacttcctcctttgtgtagtatttttcagaaaagacttgctggctttaagacatattgcaatttggagatgtcttgggtttaaattttaaagtgatagtgacagattatttgataacgtttctccagaatcatagtgggataaattcccaccattgtagggactaggtcaggccaatggagggactattgtcttcttatacataggtaacaggtaaagtcttatattgtattgccctaaaagtgatccaggttcctggcagttcttctagaaggcttgtctgggatggaatacttgctttggtttcagttaattttctttgttgaatattataaaatgcagctcattaatttgacgttttaataaatggatttttcaaatgaaaatgatttttgtttctgatataataatgaaaaagaagaatatgaaattgtatgatgatacctgtgtataaaatagctatcatgggaaaaagactggaataaaggcccttgcgcaattccccttcccctcttccccggcaagtaattgaattaccctgtccttgctttgcagctttttggaggagtgtattcactaactcgatttcattttctttgctgaagttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacaggtgagcctgatggagaacagtcaggtttcctatgacctactgctgctatcagtgaaatgtactaacactgctgcctttaggtcattaatagcttattgtttttgtgtgtggttttttttttattctgagacatggtctcgctctgtcgcccagggtggagtgcagtggggtcactgcaacctctgcctccggggctcaagcaatcctcctaccttagccttctgtgtagctgggactacaggtgcatgccaccatgcccagctggttttttttttttttttttttttttttttttttttttttttttggtagagatggagtttgccatgttgtgtaggctggtcttgaactcctgagctcaagtgatcctcccatcttggcctcccaaaatgctgggattacaggcgtgagccaccacacatggccagcttattgttatttgtgtttttcaacagaaaattctgtacttgtgtgcattctgcattaatgtggaaatgtgtgaagagttttttggagtcgttttttgtgattaattcttaggaatagacattaagaaaatggaagacttagatgtttagatttggagacttaaaattgtttttaatgactatcaagtgctgcactagctctgatgagatggacagaggagctcactgaaattgatttctaatattttgttgactgtgctgctgaaatgagtgtggaatgggcggtcccacagcatagctggaccttggtagtttaggccacatggctgtagatgagctgtaaagaacagttctgtttcactttcaccccacggagaattgtacaaatgaaggtgccacatgttggaatttcctgtctcttcgttgttgagtagtccaggttttcatcaaggattccttttattccctgtctcctcttttctttttaacagataaataatttcagacacttttagctgtgtagaaatgatttgtccaaagtgtctttttccctaaatcactggcagatctggattaggactgagctttagatgcctttcctgttcatcttcctaatgaagaggatagaaaaataaagttgaggggctgctattaattcagtaaacatgtattgaacacctactttgtgccaggctttatgttaagctttgccaaaacaaaattagacattgccctcaaggtcaaacagacaaactttggattttaataaatcaccataaggaggacattgaaacaggtcttaatactggtggttaagttttccgtttgatcctcagtggactggatgaatccatcctggaggaatgtctccagtacttggaaaagcagctggaaagtagccaggctcgtaaagctatggaggagtttttctctgacaggtgagccgtgttttgctttattcagtgaatattttttgaatgcctcttgaaagcaaggagctatatatgttgatttaggtacttattatcagcaatatttaaggcctggttaggtgtctgcactttggggagttaattgctgactccttggggttgttggtgagggggttaatttcatgaacaccttgtgctattgactcataagtggtcattttccccagaggagatgagattgtgaagaaaggatgctttttatgtggggctttaatgtgattctttccatttttctcccatcttgcctcccagtggagaacttgtacagatcatgatggcaacagccaatgagaacctctctgctaaattctgtaaccgagttttgaaattcttcaccaaactcttccagctgagtgagtgacagcttttagtaatcttcttatgggaactttgatgtccggctaatactgtgcatatcttctgcctgagtttaactacagcatgaaaatgctaacgagtggagagaatccctcagagaaagtttggaaggaagttgaaaacttgctttgaagccatttccccttttcctggctcaacagtttgccccttctttctcttcctcttgcccttctttactgaccctggcctcttgttctgctcctagctgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacaggtagaacaactacatttctgtcgtgtttccctagcaaccccagaaacacgttgatatttgcagttatctttccttcgggcaccagtcttagcattctcagcatttttgtatctacctctctctagactcaaggattctagtgtagctccttgatttttttcccatggaaaaacttttggaatgacttggcctgtcagttacaacctgaatgaatgttttatgctctactagcccaagtccaaagctgggattggtattgtagttatgtatttaatgtttaatttaaaacttcctttataacacacagaatgagattcctgttgattattcaccaacttgctctttcttttctcctagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatggtaagatgatgaagttgtatctgtaggttacaacattgatcttgagaagtgggttactttctttatagctcaaagtgagtacagaagaaatttgaatctctaccctttcattggagtttgggagttgggtgggtagcaaatagctctgttcactttagacttcatcttcatcattttcttagtagagtttcctgttcattgttcccaagataattcttggggaaagtatgccaagtgttaatgataattctaaggccagagcaccccaagctatgtaactatatagtacttatggagttttctaagaatgcttctgcttcacagtgtcctcagattgattcaaagttaatgaagatgcctcatttcgttggtttcttcgatgattttgtgtctcctctttcccctcttttttttctttgggacagcaagaaatacctgtcacagaagaatgtagttgaaaaactgaatgccaatgtaatgcatggaaaggtaagaaaagtgaggaatgacaatggggggtgaagggaaaggtgattctcacctctgtggtcaggtggaagtctctcgttcctattgagttctgtgcctggctagcctaccaaggataaggctgataatctcaaagactggaaatatgtagttgctaactgtgtgcctttaggcatgttttggctggcaagaagtgatgggaaggaaatatactggtaaataagcagacagaatctttcttaaaacatagagttcctgccatcctaagatattggaatgttatgggaaactgtctccctgctcaggctttggaactgtgccactctgagtcagtgttataaaaggccaaatacagcctcctcagctctagtccagatgctaagctttgtttaatttgcctgaaggttctggttactctggtaagaaaagcggtttgaaactgacagaaatcctgcattcaggcattttctcctcctgcccaacccatgaactggcataggtggctaggaacagataactagcttctgagaaccactttggtaccattcattactccctccttttttgctgatctttatcctttcagcactgacatgtcagagtgcagagcaaaggaacttagaaatctgagtctttgatgccaattaattgggttttctaggcaagcatgaactatctgcaatgatttgctagaatttttttctcttgatttctgaaggtattcctctcctgcattactttaaagcctgataattaaaatgactttcacttaatggttaaaaaatgctaatgttaggggggaaatgctaatgggagtctcttcatactctaatctggtcttttcttgaatgattttaatcagtttttactctattcttctaatttcaatcctacttcatcttacaagactttgtaaagagctgtctttgtgcctaagaatgaatgaatacatgttacttcagtacaatttactgaccagctacgtggggacggagtggtaaaacctggttaataaataaaaacacactgtttttcttctctgctctcataccatttctctgatcttgagctttatttgaaaaagcttgagaaaacatggtttacataatgaaacatggagaatctgaagttgctgtggggcttctcttacagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagtaagtactaagtaacctcgaagttaacctctcaaggtaatgactaactggcatggtaccaagcttttggctctgttttccagcctcctgtgagcttcaaaacttcctagtccttgttgctgccaggccccaattttctaggccttcagagcaaggcatggggatctaatctcttgtggaaaggactttttcataagctttttccagagtcacttgtcctgctttgtcagtctttaattccaaatggaattttagggataagttcttcatggggggtagtggaagctcccctatagagaaagcataagatgttttttcttaaccacaaacccctaagatctcactcacctgaagtaacaacagattttcagccagctagctatttccagttgtggtagatttccacgggtcatttgcgagtcaactattcaccccgccatagggcgttgaggcacatgtgtttttgtgggtgtttatatgcagggatatatttcgaattaaaaagacttattatttttgaaggatgaagattctctttgcaataaactctgcacttttacgatcacacagaaagaattcatgaaccagcattggtaagggtagttcttcctttaaggtgaagatttgctgggcaccgattgttgggacttctgagcttatttgctggttcttgttctttgtaggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggtgagaggaccctccctgagctataaagggtggcttgttagtgacacgggattactgaagccaaactggaaaattcccatcacctccaggatacctgagtctaggaatatgttccagctcactcatcgatgatctgcacagttgtggcctaaggacttcatttagaatatcagaaccagcagattccttagagatcttgtagttcgtttttcctaagacctccccacaatttcacacgttataataaggcctgatactgtgagtgggtaaagaagttagatattaggtgaatactatgaagatcagaatttaggcttttggataacattgaaacgcttagccagtttcttctttgggtcaaattttcctcggagatctcaggcagtatttcctctgtgcttgaggcaagaacttagggactctgacattttctgtccctaggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggtggggctgactgatgctccctagtaagcagacagagttcagagcctgttgaattggtgtgagagtaaataatgcacatggctccccttgcaactcattttctcctttacccattttcatagtgtgaatgcaaatactatgtattgtcgtcacgagggaaggatttatgactgagcactattaggagtattatggggggtgatggaagcataaattttagttgtgtcatactgtagagtaccctttcttggccagggttccttatctgaaacacagaaaacaaaacgatttgagtgtatatattctcaattttcccatggatggtacaaaacccaaaccattctagaaacgtaagagagaagttagctcatttcatatgagggatgcctttgcgcattaggatatctatgtgggacccctggtttagaaagattgctctggagttagtaccacaaatgcatattgattggaatcaatgccaggattatgagaatgagaagatggctagaatatccaactggaagtgaagtagctggattctgaaggaagttactggcaagatgatttttacaagtattatccattgtttttcttttttttttttttcactggtgtattttttctatttttctcaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggtgagtgtcttggggccatgatgtttggtggctgtgggaaccaacaaatttattgagatcccaaaatgtgctagatgctctgaggagtatacttagagcagttgatgcttggccatccaaaacttagaatctaagacatcatgacatgcccagaacatattatgaacagtgtgaaaatcagcatacgaggtttggcttcaaaagaagagaattggccaaggatgcacctataatcccagcactttgggatgcctgaagcaggtggattgcttgagcctgggaatttaagaccagccttggcaacatggtgaaacctcatctctaccccaaaaaacacacaaaaaatttagcttggcatggtggcacagcaactatagtcccagctactcggaaggctaatgtgggagcatcacttgagcccaggaggttgcagtgagctgagatcgtagcactgcactccagcctgggcgacggagtgagactctctctcaaaaaaaaaaaaaaaaaggagtggggctggggaatccagggtcattttggccaatgaagagaataaatctcctttttagttcatataaatatatgaatctccaagaggtggggaactccattttggggcaattagaatagttagagaatttttatttttagaaaatagaactttattgtatcttctctaaagttcatctaacttacaaaataatgtttgtcctcttttgcatatagtcctttagataactttcctttagtttttcatgtcacatgggttataaggtataagtcattattcactttaaaacctgctgctcagcactgaatatagacttctgatgtggccttcctggccttttttagcagcagagttaagtaatagaaagtaaagtggtggcgattccaaaaaggaagtgaacaaatattgcgaatgagatatatgaatagatctcataaattggctttcttttttggagatggagtcttgctctgtcacctaggctggagtgcagtggcatgatctcagcttactgcgacttccgcctcactggttccagcgattctcatgcctcactcagcctcctgagaagctgagactggaggcatgcaccatcatgcctggctaatttttgtatttttagtagagataggatttcaccatgttgcccagaatggtctcgaacaactgtgctcaagtgatttgtccacctcagcctcccaaagtgctgggattataggtgtgagccactgtgcccagccaaagttggctatttttaagggaataatagtcagttggaaatatacacatacatacccatatatattctggcattttattaaaatcagtcacagtttttgccaggtgcagtggctcatgcctgtaatccccacactttgggaggctgaggtgggcaaatcacttgaccagaggagttcgggaccatcctgggcaacatggtgaaaccctgtctctataaaaaatatacaaaaataattagccagacatggtggtgcatgcctgtggtctcagctacctgggaggctgaggcaggaggattgcctgaaccggggaattcgaggctgtagtgagctgatatcacatcactgcactcaccactgaactccaacctgggtgacagagagaaaccttgtctcaaaaaaaaaaatgagtcacggttttatttgatactcttggaattaaaagaagtcgtaaaatcagtcacacttttagagcattggtttttagatattaaagatgaagtgaaaaaatacttgggttgggggcccataaagttgctgatttttatgttgccaggttagatcaatgaaaacaaatgtcatctgtcaccacaatttgtaagagattggacattttaacatttttttaaaagaccagtactttgtatttaagtttagctttatgaaaacatttactatgttattcttaatggattgataataactttaacacatttacacagccatccacggtttggaggccgaaatcactgcttttgaatgactgaattgtgcagtgtctcaggcacatgaatagtgcgtgaatccacttgattttatttgcctcattactgcccactttctctgcttccttctttgccaggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaaggtgggtcctccaattcttgtgcgcttactttaggtcatattgtcttaaatgctaagcaaaacaaattgatgaccacattcggattagccctctgtgggaaaaagtccactgcgttctaagaatgcttcagggacagatcttgttgagcttttcaaatacttgaaccctgaattgatttgattagacctagagctggtatgactaggactgttcctaattagtaaatttccactcaaaacgtattcttcaaagccctcaggaaaaagtaatgattagcagttaccgaggacggcttggctcccagtcttgccctgtttggtcactctggcgggcataagctgagagacaaaagttttcataggaacactcagtgttgcttatgtagtgctgccgtgccatcccagctctgttaagcacataagtaagtttgtattgtgttatagagctagtagaagttggaagagtgctaggtatcttaactcacacttttctgtattctggcctctccatcaccactaatgttgttttaacttttattttaagtgaaaatatggatagtccttcaaacaactctaaaatcattttaaaaacagtttcctagaaaactagaaaaggacagtggtacgtaggtattcttaaactattttgtgaactatataaagagaaattgttttcattacttacctgttctgtcctccatggaaatacattccatagcttttagccaggagtaatagagactaatactgatctaggattttctactagacttatctgtaaagaaaaaagtgtgcaacctgttatccctattgaaagagtttttgttacttgctttgacttctctgagaggaccaggagtaggaataaattagtcattgttcctttgcagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggtaaaaatccggatctaggtttgattgccttgagctgtggattctagtcattttctctcccctgttctcagaactactttttcttattcgttgtggagattaaaatttaaaacctactgaaatgcaaaaggaatttttctttgaatttctcccagatctttcagatttctccaatattggaagtaatctttgtgttcatgaaacctgaatgttactagacagtctaaatactgtctgaaggcaggggatattagaggaaaaaagggaacgtcattactctgaaatgaattagcccacttttcagatcatcttttcaccattttgtttcttaaacattgtccaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaaggtacagttacagttctttgatgatatggtcctagaatttttctacttttaaatccagaatcactatgtgctagcttctcccaggagttaaaaaaatcagctgggtgccatgactttcacctgtagtaccagctacttggaaggctgaggtggagaattacttgaggcttagttcaagggtgcagtgagctgtgatcatgccacgccactccactccaatctgggtgatagagcaagaccctgtctctaaaaatgataacaagccatattttgtcacttttgctatgttgctgagtaggagctttctgtctttaggcaatagggaattgattctggttctaccctcactgtaccaagtgcacacctattaccatacttgtttcagaatttatttatgtatgtctgtcccctactcattccttgaaggagagtgaaaggtgttctgttcatctttataagaccagtgcctaacactccatttttttactgaatggagaatgaatgcctgttattggtcagttccggctatttggattcactaagatatttgggggatgggactgagatagatttcccttatttaatttttcttccatcctgcagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggttagagcacatgttgctatttccttctattccggatttaattatttagcaactcctctattcttttttctttgttcttttataacatttttctgtggacttcatctaactggatctttttttctttttctttgtttttccatctaactttctacctaatagcaaactctcttatcctttagggctaaattaattcaacttcaagttccatttttctcagggtctttgtaagatttacccacagggatctcatgcttagagtatgagagcacctgatcatgattgaaaataataaccagtataaaccggaagttggtagccaaggcaacatgaattactgcaaatatgtgtctttgtgccagcaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaaggtgggaatgaacatttaatgttcaacttccgcaatgtccacattcaatgtgggatctccactcccactatctgctatctgttctgagttttgtgaaacttaattttctccagccaacctttttttctcccctgctaggtatctttaaaatcaaggaacatccgggtttggcaggttgggttgtctgcacggtttgtcctccactgtggagaccccaagctgtcagaggtagtttaggggtccactgttactcagaaggaaaacctatagttaatgttataaatgtgattttaatgtgagaagggaacctaaatttctcttagacactcattctgccataatgccctttaagtttttctcctggggagacttactctgttagcaaatagaacgtatcagtaatgggggcatggttggatatgggggaggaagagactttcaacaagtttgcaaataatagaggggtgtgtaaggtagtgagagtttcatttagggaggaggaagaagaggcttatggtgtcttcccttgtttcttatctgccattgatgacccattgtagcactttctctcagacctttctttgggaattacatggtttgggatgaaataaaatggataccagttcacactaactcgatgtgtttggagatcctgataggacaatgggtcattagccttaggcagctccatggccctctgcagttgatagcctctaggcacatagggccacctgttcttcggacatggaacctcacagtggagactccaaatgaggactgccctgccataagcacgcattggggtgtatgagcatgtgtgcatggcttggaataaaactaacctgtggataatctgagtccctggccaaggatattgctttggagtcacgtagccagttagaggatggtttttaggtcaagaaaagaactattaaatggtgactgacactctaactgtggccagttttgttgtctgcagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaaggtcagtgccagattttcccattcattactttgctgtgaacctggtctctttttatgtttgtatattcatttcactttcccagctctttcaatggaggcccataaaagattttcagtcctttttcttctagatgccttttctttgccacccttctgtacagcccctcaactgaccatgaaaccagttgcatctctgcctctttttctgtgaggatgctgatctgtgggtgtgggaacgaagaccctcctttgtcctctcctcctagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcagtaaggctccttctcagatgacttgtgggggagtaggaatggtggtcttctagacagtgactcagaatagactgttgaaaatatctgtgaagaaatgtgactgtcctacttgcacattttgtaaagttaatttcccaaaagcagagttatgtttccaaatgtcaagcacccattggctgcctgtttcaggccagcagttctttggtgcctagtaacgagttatgtcctggaccttatttgagagattgttctctctaggtttaggagaatgacttccctgaagaactgattgaagtatagacctcttcagctggttaatttcccactgagtagtgaagagcccaccacaggtctctgagctggtggtctagcacttgactgactcaggactcttcaggaaagtgaaagcttgagtttagcagtgagcaaatccagctaagcaaagaccattacagggatcatcacattaccttaaatttgctctacagtctattttgaaagaatggtttattcatttacattcattaaagaagtagctcctattgtttattttaaataacccagttacaggagagcctattgttattagctgtacacccaataccaatgccagatttcttggtattgctaggacatgtcatagttagggataacaaccattggagagctaaccacatgtaggcatcatgccgatgcaaatgttataatccagagtttgcttagattagagtgtgagtgtgggctctgtctgggaggagtctttaccagtggtgttggggcagaggtgggagagactcttgacgatctggtaccgttctctgcagcaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaaggtaagaatggcactgggctgggatcaatccctgggtagaaggactcaaacaatatggtttgagaacacatctccttttagaaagcaagtatagagtatatactcacagtcacaaccctcggttctagttaaatggttccttagaaaaatggatattcttactcacttggcaaaggacttgtacaggttgggtttccaccaataccagcaggattactgtgtagaggacatcaaagaggtggttaatactggggagaaggaagcctgacattgaagagaatctgctctcttttcctattttcccatttttagaaacaaggaagtcattaccagggagttaaaaggataagttttaatgagcttcacatgttgagacaatgtcagagaagaaggagtcctagttaaaacttaagaacttctgtagtttcttgatgtgtgccttgtctccctacagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcagtgagtcaccaacccctggtgcagactctgtcctcattgtgactgcgaaattgggagccactggcctgtggctgtccaacattctgggatctctccactctgctgatttttctgtcctttcatcaggaaactttgagcttcatttgatgtattaaagaggcaaggtgacaggaaaggagtacaccggagcatggtagcagtaaagatagggctgcactgtgttgagtattcatttcaatagtgttgtgtccacctcactaatggggctacttctgtgtttaggccgagaggaggcagattgacatgaaattgcaaggctttcttaacgcacagaggaagacctcaggtcacacatggctgagagatggttggcaatggcttgctatgccactgaaaactaaactctcagaatacaaatccttgagccttactcaagactgcatttctctgtcatttattggccactgtctgatattctttcttctagatatagttgctgttagtgtgaatgatcatgatctgtactttgaacaaagaaagtgtgtagagacccctgggagtgaggggtaggggatacaatactctgaagcagaagaggacccttgcagtgatggttagggactcttctgagtaggagacgtaatcggcttttggtccatggaacttttaccacatgtattcagcatatatacacgattaaagtgctgcaaatatctcagaagataaagtttctctatgtctataaaattgacgtgatttacttctttgctccaactgttctggtctttgctttggaggggtggctttttagagaatgtgcttcctaaaggcctctcttgcttattgcagttggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggtaccagtgctggcaggggttggcttcagtttttacatattccactcactgcagaaccttcctgtgtcttgagagagccagcttctaataaccatctcaaggctagcctggaatttttttaagttttcatacaactcgcccacattcagtgtctctttagcgtgcaaagcctgaaaaatgtgctcagagtcatctgacaccagagtctctccctggacagaagttctgtcccttctcttaataatgctcaggtaccctttagagtagccagaggccacaggctagacgatgctcaagccagtattctagattaggatccaggcttgctgaaatgataggaaaacatcctcccttccattctgagctcatcatcttttcatcatctttctctgcgtagctacttctgtgataataacattgccagcaagagaggctgtctgctgcctcttgtagcagagtctagagtttccttaagtctccctacagtggcatattcttaagcattgtgcttggcttctttgtgctaggtagctgctggtttgccatggtagatgaaatattataattcatgatgtaagattttgagtttcttacattgtaagtcacaagaatagccttgcttggaatcactgcctcccaccaccagcctcctccctcccttcctttctctttctttttccccgatgccctatccatacatggtttgcttaggatgtgtttccgggtttctctgagcttcacatttttttccttttttttttttctttgcttctcccccaagttctgaaactgagtccctaaccaagctggaccggttagtatgccctctttcttttctctgcacgagtgagtgtgtgtcagagagccgtgtaaccaatggtgtggctttgcattgattctgcttctgttgaagagtcttcctgcttctttctgttctggtcattgcatggctacagagctgtccatgtgtaaaaatggagtatatggaagatcgtaagtgcactcttggtgttggccatgtcggacactctctcaactctctcttccttaccctagtcctctctgctccctttctaagtggatgaaaagggggtttggggtagagggattaacagcaaagtcctaccatctgataacccactagagagctcgttctatccaaatttgttttatgcctcagtttcctcttccctagttctttattgccttcctctaccccttaacccctttctttccagttaccttctgaatacttttctttctctgtccagagcttcagctgtcaggatgttgttctttttactatgccacattaaattgaaaggagtaaaccctggggagcatgttacttggtacctttaatagtaatagttgggtttcctattcctttcctaaggggaaaagttttctaaagatgctttgtatttaccccttgaatgttggcaattggcatgcacctaaaaaatagtttgttctctcccccatacttgggactcctaggaaatgcctttgtgcatatatagctttaaactttccaatataagaggatggtttttacctttccctttgtgtgtccttttgcccactgatctctgggcagctgagctttgggtcccattgcatcaagactgttaagcccatctcagtgatccctgccacaggcagcagaaggaagcacatttatcctctttgaggaagaaaagccctgtctttgagttacggattacgaacatggcctcaggttgatctctgagcaggagccaggtttctcctggcctgtaacgtaggaaacgatatgcatggtgcctgtggcaggtcttattgtgctttgattttgtatttggcattcattagctgtccccaaggtcctcatgactatagtttgcttaggctaaagcgcaaggcggagagaacggtgttgtactcaagccaggttttctgtctccccaggctggttgtgagttctttagaagccctggaaagctgctttgccgttggcccaatcatcgagaaggcaagtcactttttcaaagcacatggaagctttctgaagaggcaggaagtcagtggagttgcccgaggccctgaggcctcgaagctaaagaacatttatagtagcataatcttgatttgctaagaagctccagagaagtcttcagcttaaggcctatgtcctacttttcgggcccatagtgagcgtgtgtcacagaataggatgcgtgttggtacaagaacactgttctgggaatcatgagcttggattccatgtcttcctctggtaagaaggaggattataatttctgaaacttttttttttttctctttgcagtccatggagcataacctagccctggtggcctagaaggaaggaagggcaggcagagtgtagatagttcattctgccttgagttggtggggttagtgataaccctgctgtcttttgccttaggagagaaacaagaatgctgctcaggagctggccactttgctgttgtccctgccagcacctgccagtgtccagcagcagtccaagagccttctggccagcctgcacaccagccgctcggcctaccacagccacaaggtaactgttctctcagggaaaggaaattgcagtgctgacagggaatcaaataagttagcttttcattgtaaagcaacagcacagcaaagtaaggtagagggaggatagcattcagattagacctacattttacagagtttctcctgagaaattctcaagtgccactcaaaaccgagggtaagccagtgactgggcccctggtttgtacttatttttctgtcactctaacaggatcaacaagacttaagaaagagaaggagggatattgagcgtgggtagccttctcgctggaaaagggtgaggtgagggagtccctcaggaaatagactgctagtgttttcgctccctcaggtgtggcacagcacgagaagtgtactgtacttgttggtgagacaagtgttgaatagttcttggagtgcctctgatgggaacatctggggaaagagggtatcacttataaaagaaaggcattgccaaaggagacaaactgggccaatttctgtagatggaaaagatgagagttcagacccctgaggaggaaggctctgagaggagccatcaacccagagctttggttagcttctgtgcctccaacccggagaactgagaaatgtgagtttaacctgctgtctctcaaggaaagacaattttggaaacactgtccttgggtaatatgaatttgctaagaaatgactcttctattgtaagagaaagaaatctagcagttctggagaactgagtagatttgaattttcccatcatactttgatactgcagggtttttattttttaatgacattaatattttatgtattaagaaacttaactatatgaggctgctttgaagatctgttgtaggtgattggtgttcattggcctgttctcttgagaggaggtaataatcctggtgatctgccagcttttctctcctctttgcttttgtacccagctcttgcttatggctgaccctctgtgctcctgttgttttacaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacaggtgaacttggcctctgtggccgtggtcctgagatctgcttcatatgcctatttaccctctcattcttactgttcttactggcctctgactgactgcatgctcagagacagggattttgcttcctggtctttataccttgtagggccttttgacattgagattgtacaattttaaacacattctttttccagtgcttatactttcgattatccttgagtttatttagtgttctagacatcagatataatctgtctctgaagttattacctcttaggagcttcaggggaaagctaagcttggttgggccctggttgctttaaagcaactatggcatatctttcgctttcatgccattcttttgccagtgctattattaataatgtgtagcaactttctcagtgctcagtgctgtttcctcatctcctcttctgttggctgggtagcaaacctgttttgtcattgtcaaattgagttgattgctgcctttacaattctgtgttatttacatgctcccatatgcatcatcattctgttcctccttttaatactacaatcccagaattgttctagagagatctctagaatgttcagatgttcctctacgttttagaagttgaacagttggaactgagatctttgaatctgcggtaaacatcctaaatgctccccgttctacttaattctaacatacaatgttttctgcgatattcctttcccagactgtttttttcctagatgtgcctgctggagtctagggatagttggcatattgattggggccccacttgaaactccctccccaggcaagcttccttgacctgagttaaccttaaaacaaattaaattccatctcagatttaccatcgttgataattttctttctcctgcttagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggtatgttaaaagggatatttgaatcttggtaatgaagcctgatgtaagttctgtctttgaacagctatgaccgttagccattagctttcattcttcataatccatttcttccagaactcataattgggaagtagaagtctgcgagataaatgcaatgttcctgagacaggaatttagcagtgtggcagagtgggattttcttctaccatatcttttcatcggggttgaatattttacataaagaggcactgtgtgtgtgtgtgtgtgtgtgtgtgtgtgtgtgtctcagtggtttataattgtttttaaaaatctttgacaacttggcttaaagccagctcaaaaggcacaagtatcttgaggattattctatttctaagctatttggtctctaacttcttacactattgaaaattcagatggaagagtaaagggtctgaatagcaatatagaaaagtaggatgatcctggtgctcattcatgtttggaggacatttgggtggtaaacctaaaaggcaagtcaaggtcatgttttgtcatcacctgaggttgggggatattagggaacatttagtatctgccttcctcttcatatttccttgccttgtcttttgatatccagagagagtggacagctacttatttctgtgactcaagatatctggaaagacttttgaggacaatttgggagtttaggaaactgttaatgaaacaaatcataaataatacaggctactgtgtgtgaatgagtgtgtatgtgagtgtttgtcattttgtttgcatgaccttttacatggagataaaaggttacacttttgtctcagactctcaagtagttagagttttttcctccagattttcaaataatgtttgtctctcctttaggactaactcatattgaagctactgtcaatgctctggtggacatcatccatggctactgtacctgtgagctggattgtattaacacagcatccaagatctacatgcagatgctcttgtgtcctgtacgtagcattacaatcccagagagctcgcagcagccagggaatatctggaaaattgtttttagcttgctaagctaatgaaataaaatatatttagaggaagctgaagggaatgaagtttcaaatatcaataaaagctttaagatcttactccatggaagagaaagatttggaaaggggatgggctcagtctttcttattcagtgctgaatcaccagggacagcctactgcttgctacatagtaagtgctaggtaactcggtgaattgtgacttaaatgagcacatgaatgaaagtagtacatcaagatttctatttccagtgaccctttcacagaagctaagtgttaaaactactgattttagcacagagctaagacgtgcgctgggggcttgatcatctgataaaaagccagaaccatttgtaaggggccaaaatggcctcaggagcaaatgacctgccagtccatccccaggaactgagagacaggaggttagcgaatggctcttaatgtgtgccagaacaggaagcggggattaacttaacctgctgaacttggtccgctgggttgcaggtgagagtagagaggtattccacttgcatgtgagtgagtgaccaagaaaggaaagtgttttatagagagtttcatgaataatatgagagcaaagcgtgacagtttccttttaaacctcaggatcctgctgtgagcttctcttgtaaacaagctctaattcgagtcctaaggcccaggaacaaacggagacatgtgactttaccctcttcccctcgaagcaacactccaatgggtaatatgaggtctgggtttaggctcaagcctgtatttgggaggaggggagagagggaggtacagtagcattgggcatgctgctcatgttgaccaaggtcctggagactttatgtatctgtcttttttctaatcctacctcaccccataaagaatttaggtggcacatcaaaatgtatatagtaagtaggataaaaataaagattaaaggccatgggaaaataaaagtaccatagtaaaatcaaaatacagaaaattcacatcacaaaggtcctgcatggttggtaagcgagggtcttatatttggctgaaagcttcctaagagccatagcaaaaataaaatcacagtgaccaaagacaaaacagaaacataacttttcttgggatagaagctcttcattaaatgtccattttgttgccaaaggggcagaatccttagtggacttacctacaataagttggatagcaaatttcacaggaatttccctcacaatacacagtacacaatacacaatacacaatacagtcaagggcataacattttacgattcagtaaaagcaattctaaaaggtgtctgaataacagaattatataattctggttacttggcttgatttagaagtaaatttcaaatgaaagtcactatgtacttttaaattttctttctttctttctttctttctttctttctttctttctttctttctttctttctttcttccttccttccttccttccttcctgccttccttccttccttcctttctttccttccttccttccttcctttctttcttttttcttccttccttcctttcctttcccttccttctttcttttcttttctttttttcttttctctttctttctttctctctctctctcgtcttttttcagagtctcactgtgtcaccaaggctagagtgcaatggtgccatctcagctcactgcaatctctgcctccctagtagctgggattataggcgcgtgccaccgtgcccagctaatttttgtatttttagtagagacagggtttcaccatgttggccaagctggtctcgaactcctgacctcaaatgatccgcccgcctcggcctcccaaagtgctaggattataggcgcgagccactgctcggcctgtacttttaaattttctaatagcaatattataaagagtaaaaagtaaaattgatttactaattatttaatccagtatatcaaatattatatctacatcttgtcaatataaaaaatttattagtgaaatattttgcctgttttggtaccattttgggaatccagaatgtattttacactagtggcacatctccttttagacagccatgttttaagtgctcagtagtcacatgtggctggtggacagtgcacatctagaggattgtacacaactttgtgactttcagaaaatcttccttgcatatcatttatcttgcctaagcttttgggttaggcagcagtttgtggctcttttccctagcaagaacctagagtggagatagtttatgtttctaacggacatatttacaagctttagcaatccatcgagtggaaggtgaggtctctatcctcttctgacaattaggagtctcacctggacatcttccttattagaaggccttctcaccttcacacaaaagtgggcacaggcaggacctgcagtggtgtccttggtttccagtcaatggttttacacttcaattctggttcttctcatagtaattacgtagtgtgaaaatctcactgacctagttgttttagaaaaaaatagtgaaataaattctaatctgccatgacagacaaaaggtaaagatcccaatcatatgatttttcctgtcttatccaaggtctcctgagagttagcgtgagtttgggaggcctactggttttagatctctcacctttatggaaatccctttggaatccaagtttgtttccttcaccagctggaacattttatttttgtggggggcaagctgtcgcagccaactccatcttcccagatgctgtaggtccaagaagtaagagaacaaggccaggcatagcaccccggagttctcccgctaaagcccagggtgctagctggtagcttgtcttgggtttttgttgccacctgacttatggcaccatgtgccaagggaggaaagcaagcaccttcaggtgactggggtttctttgactcaggagacaaggatgatgatgacgatgatgatgcagatgagaaaatgcagtcatcagggatcccgaatggtggtcacatccgtcaggaaagccaggaacagagtgaggtggaccatggagattttgagatggtggtgagtctctggcagcaggagaaggggaggaggagcttcacaactctcctctagctcttattcagtggacttccaaaagttaccacttaccatgggacactgacagagctttctctctgcagtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggtagaaggccatgccaagaacaaagcggcccattggccttgcacaggaaaagagggtttggcagttactgatatccagctgacttagtttgtccccagatatggggagaggttgatctgggtgagagctgttcagagatacaggtggagagtgagagggatgtggtgggaatttcagtctgagtgccaatctcatagtttctgccagtttgggttatttcctcttgaatcttagattcctccagcctgtgtcctgcctgagctgaaggaagcattccaccatctctgtaactgaacttggtgggtggacagcagtggctgctagctaacttcctctaggccagagggggtcacatgctggtgtttggagactcttgagggcagcaggtggccaaagcagcgctgtggatgggacctggaggggatgttgtgctcactctccacttgtttcccaggcagcagcagcagtgccctgggcctgcagagcctgggactgtccggccaggcacccagctcttcctctctggacgcaggaaccctctctgacaccacagcatcaggtaactgtccacagcaaggagcacggctcagggccccaggaccctcaggccttgtttccactgctgtgagagtgtaatgggcagctgctttgacaggccattctggacttcctgcttctgccttggctttagaaagatgggtgtggagggtgtagtgctgtggctcggccccgccgcgcacagctccgcttcctcacactttgcatgctgcctggcttcagctacttccccacggaaaagccgagagagcggcatgcaggctgatcagctacagggcttccacttcagcttccagcgttctttgtcagagttctaacattttagacagtattaaaagagagacaagaaatagaactcataccttttaccttttttatcttcatttgcaaataaaaggagagctataagaagctagattatacttcagaattcttgttcagtgtgaccaaccatcaggatctgtgagcttgagagagagggtttttatggacaattaaaatctatagcaaatctccagaactcatcttctctttattttcaatcttttccctaatctgattaaaaaaaaaaaaatgtttcctgaatagagagttggaccaaatggagatacctggtcaacccctgagtaatttaagggttgatttatagttttttagactgatgcttccttgtgtttgttttttttcttttcttttggaagttttagcctgggtagttaagaaagggagagagcggctggccccacctgctgccatggcttgttgcttttcttaggtctctttagttgctgtcatttcaggctctgaggttgctgttgtgttgtgccagtcgtgttcccgctgtgctctgtggctgtcttggctttcctcccccatgtatctcatccagcattttcctcctgtctcagctcagccctgatcctggatgctgtggctgtctctggggaatttccttgcttcattattagcatctgatgaggatgattaggaggtgtgaaatttcccaatgagctcccctctggaccacttgctaaaaaaaccaaaacagggttgattcaagagctcatgctaagtgatttcctaacataagcaaaacttgactgatttcaaaacaagtctcattaaaattcagagttctatgctttgaatggtaatggctagtttcagatctctcagcaggtgtcagtaacacctaaacaatggtgaccatgaagcattttagctagaaaactcagcgtccatgtcacagattcttactgaatctctgcactgttctacttgcactgtaatgtaaaacagtgaaggaaatacccagtgaactgggttttcttcactcctgtctaagtactgtttgcaatgcaccgtgtatagtgtttgttcctgttagtgattaaccagcaaagcaaatctctcccttttttctttgacgacaggatatataaactgcattgtgtcctatgcactatgtggtttgatgctttcatcccaaggaggggttttttttgttttttgtttgtttgtttgtttgtttgttttttaacctgtaacagctctcgttactctctcagctccagcctcagacgacgagggcagtacagcagcgacagatggttctacccttcggacctctcctgctgaccacggtggtagtgtgggctcggagagcgggggcagtgcagtggactcagtggctggcgagcacagtggtaatgtgccatggcgggggtcctgtctccttgggcagagggtggggacaaaacaggaatctctgcttgggtcttggggttggtttttgcaaagaaaaggtatagagactcattgaaagtcttgtggactctctgaaagtcttgtggaattcatttggcctcagttttcgagtttcaaatgtttagtggcttaagctcagggggttagtattgaaatattttacagatatttactaattatctgttagtggaaaaaaagcaatgacatgcgtaagtcttttttttcctctctgaaactgcgataatatgcataattataagtcatgattagcctaaaacagttattatgtgaccttgaaacccattatcctatggtttctcctcatttatttggggaagggtttttttttaagcgatcttattgttaatgatctgatgtgttaacatagcagaccatccccacagtctactagctgatgaggtggggctctagaatgagggaacatgacaaagccattttggtttgaccttccatatcagtctgtggttagcaactggatacaatttttacagaggagatgaagagcagctgataatttctagattcccctatcagtgtatgtttcctctgaagtatgagatagaaatgtattagcatctgagattaagatcattcatataggtgggtcttacatactggggaagggtgaatggctactgtgagagtgatttaacatagtgctgtggggtcttacttagctttacatataagacaaaaatgctaccagttattgtctaatgctgtcagttactgtcttaactattgctgctgctttagaatgcactgggttccttcatgctttgggagttgatttgtgctttttaaaccatttccctctagtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggtcaagacctagtccttcacagttaagaggcttgcctatctgagactatttcaggaatagtaggactgatcaattgcaggaggtagagtagtgataacagcatatttcttttgaaatataaaggtgtaaacttctgaaacagtttaaagtcttaggaagtgctctaggtctgtctttgtcttcgaattatattaattacggagagaatagaaagtggtatttctcttaaggctcctctaaatatcttagtaactgtaaagtgattgtcataaaaacatgtcttccttactcaaatctttccagtttcatcaatatctgtacactcaatatatggcatcctctttacaaatggcaccgctggaggctcaacatttaggtatacgtattaggtgtcctagaagcgctccttgttcagcatgtttgtaaggtaaaggagaaataagacatagcaaatatatgcatatggctagaaataccagtggtggagcattttgaaattgaaagtggtctataaaatcctaatccatttttgtgttggggtttagtactagatggtgaagtgaatgtattcttaacccagagataactagagaaatagaagaaaaacctgaaaataagactcatgatacaatgtttgttgaatttgttgaggtcagcagttgttacattagtgtaaaaatagtaagtcagaattttttttttttttttcgagactgtctccctctgtcaccctggctggagtgcagtggtgtgaacagtgctcactgcagcctcaacctcccaggctcaggtgattctcctacctcagcctcccgagttgctgggactacaggtgtgcggtaccacgcccggccaatttttgtattttttgtagagatggagttttgccctgttgcccaggcctgatctggaactcctgagctcaagtgatccactcacctccacctccccaagtgctgggattacaggtgtgagccactgtacctggcccagaattttgaactatatgatttctatcaggtaaaaaaaatggtgcctgatgcagtcaggcatcagagacatttaaagggggcatcaaagagtgccttccacgttccccgaatcctactgcttgaacgtaagccgcttaacatctctggatgaatttctctggttctgttaatagatgatattttgatagagttttaaaaaaatcttctaacatttttcttaatgtgatttctaggttaattcccttatgttcagttaatttggtctctatgattttttaaaaaatttactttaaacatttaaaatccagcctgcttttgtcttctatttgatatagttgagttcatttataattaatgttgattgctaacagatttggaatggatgtatgttattactttgtgcttcttatttgttctatgtgtgtccttttctttgtggccttcttttgagttgacttgctagttttttcttcctgtttctttccttttttcctccaactctgcaagtttggaagttgtttactctgtttttaatctttcagtggttatactatgcattttaacatgcatacttaccttatccaaaatgaaatttaactaatagctgtaccttcttcctgaataatatgaggatcttagaagactttactcctttgtgtgttttaacttttttaatgtcttcttaaagcctttaggattttatagtttataaggtcagtgtttgttaaagttttactcatatgtttaccattttctgtgcctaacatttctttatgcctctgagacctcccatccaggattatttttttcctaaacgatatcatttagattttcctttagggaggttttctgatttacactatctcagattttgttggtctggaaatacctttattgaacttacatttggggatgtatttttgatgggtataaaattttgtgttggcagcacccccgacctccccagttgaaaatggtattctgttatttcctcgcttttgttatttccaatgagaaatcacctcctattttaactgttgcttctttgaaagtaatgtctttactgctgcttttaagatcttcatttgtcattatttttgcagttttaccaggatatgtgatttatttctttacatttattttgcttagtagtctttgggactcttggatgtgtgggctagtgtcttttattttggaaaaatctcatctattaatcttatcagatattctttttgtcttattttctgttatttcacttattttctgggatttcagttaaatagatgtgagaccatcatattctcttcttcatgtctcttagaatctctttttcttttgtgtttcttgtgcttaattatttataaatttcttgatctatttgagtagcattaaaaaacatcaaataggaataaatttgaaagatatgtaagacttctactctgaacactgtacaatctaagagaaattaaagacctaaataagtgaagaactacatcatgtttatggattgaaagactcattgtgaagataattgtcttcaaattgatatagagccatataatcctagtcataaattttggctggagttatgtgttaaaattgacaagttgatactaacatttatgtcgattagccaaggcagtattgaagaaaattcataaatttagaggactttatagaattatagcttattataaagctatggtaattaagacagtgtgataatggtatgaagatagacaaatagattagtggaatgggctggagttcagaaacagcttctcacatacctgatcatctgatttataacaaaggtgacacttaggtacaatggaggaaaggagggttttttcaataaataataatgggtcagctggaaacgcacatagaataaaatgaatcttgacttgatcttatatgcaaaaatcagttgaattatagatgtaaatacaaagagtaacattttattgcctttaaaagacaaaatgtcttcataacttgggtttggcaaagatttattgaataggacacaaaagcattaaaaggaaaaaaaaacctataaactggactatattctcagcagctattcattttctcctcccctcttctcagtattaagatttcagttaggtagttttccttataggctcctaggctagagtggggtcgggggtgcaggtgcagggaagagtgtgaagggaagtcatgtattacagtttacttttaaaatgagggtatagccttctgtggttcttctgtgaggttctctttgaagaccttccccactgtccacagaggaggtctaaagaaaaaaaaaaaaatgaagaccttccccacttgaggaagatcctttgcttttatttctattccaaatgccctgtgaggtcctggcagccagaaggtcaagttgccttcagaacatcttggccttaacttttcaaatttcagatttcctaaactttgtctctgagttctgcttacatctttggccagtaactttttaattgctagtgagctcattattacttttattttgactatgtatctgataatctttcttagtttacttattcttgttgtttcttgttttgttttcttttaagacagtctcacctgcccaggctggtatgcacaatcatagctaactgcaaccttgaatgcctaggctcaaggactcctcttgcctcagccttctgagtagctaggcacatgccaccatgcccagctatttttatttatttttatttatttatttatttttgagacagagtctcactctgttgcccaggctggtgtgcagtggcacaatcatagctgattgcaacttcaaatgcctaggctcaaggaatcctcctgcctgagtagctaggtgcttgccaccatgcccagctgtttttaaattttttttttttttttttttttttttttagagacagagtctcactctcttgcccaggctggagtgcagtggtacaatctcagctcactgcaatctccagttcccaggttcaagcaattctcaagcctcagcctcctgagtagctgggattacaggcatgtgccaccacacctggcacccagctaattattgtatttttagtagagacagagttttgtcatgttgacgaggctggtcttgaacccccaacctcaggtgatccacccaccttggcctcccaaagtgctgggataacaggtgtgagccaccgtacccagcctagtttttttttttgttgagacagcatctcactattgcccaagctggttttgaactcctggcctcaagtgatcctcctgcctcagcctcccagtgttgggattacatgtgtgagccactgcacccagctcatttatttattctaatgatagattctagtggattttctgtatccacaatcttatcacctgcaaataacagtgtaacttttttcgttccaatctttatactttttaattttcttttcttgccttattgcgttggctaagacctcttgtacaatgttgaaagaagtgatgatgatgaacattatctcattcccaaactcagggtgtaaaggttcaatactttctcattaagtatgatgttagcacaagggttttttatggatatttatcagattaaggagattttgttcctagtttgctgggagatttttatcttaaatgggtttttcaagatttccagtttcttgtgtttcatgtattgaatcacttatatggtttttcttctttattttgtttaaggttatagattacgttaattgatttttctattattaagcctatttagtcatgatgtattttcctttatatcatgtgacctgatttgctaatttttagtttaggcttaaaatttttctttgagatgtctttgtcagggattggtattcacattattctggcgtcataaaataagtcagggcatgatccccttttctcttgctctagaagagtttgtataagattagtattatttcttccataaattcttagagaagttcaccagtcagtgaagtaatctgagtctggactttatttaagggaagatttaaaattaggtgtattctttaaatgctagagaattatttttatttattttggtttcaattttggtatatcgtattttacaaggaatttgttgattttattaaagttgtcagttttactggcgtgagcctgttcatatatttttctctcatctttttaatgtcttgacaatctgtagtgatttgctttttttcatttctgacaatagtaacttattctttgtcagtcttgctctaggggttatcaactttatttgaaagaattggcttttggttctggtttttttctgttgtatgtctgctttctattcctgctttttattatttcctttcttttacttacttttttttttttttttttttaccattttttactttttttttgttgttattgttctattgttcctgttctatttctggctcatgagatacaaacctaaatcatttaatcatatgtattttaaacctactttaaaaatacatattcagccaggtccagtggctcacacctgtaatcccatcactttgggaggccgaggcaggctgatcacttgaggccaggagttcaaaaccagcctgctcaacatagcaaaaccctgtctctactaaaaatataaaaattagccttgtgtggtggcgtgcacctgtaatcccagctacttgggaggctgagataggagaatcacttgaatgtgggaggtggaggttgctatgagccgagatcacgccactgcactccagcctgggtgacagagtgagactctgtctcaaaaaaacaaacaaacaaaaaaccatatttgaagcaatatatttttctctaaaattccatcttaatcttgctttggctgcagctcacatattttgataatgttgtgttttgataatgctgtattttcattgctattcaattcaaattattttctaaattctgttgtaatttagtctttggcccatgggatatttaaaagtatgttactaaatttctaaacatttgggaattttctagttatctttttgttattggtttatattttaattttaccatggttgggaacatactgggtgtttgtagatttttttgtttgtttgttttttcagacgtagtttcactcttgttgcccaggctggagtgcattggcatgatcttggctcactacaacctctgccgcccgggttcaagcgattctcctgcctcagcctcccaaatagctaggattacaggcatgcgtgaccacgcccggctaattttgtatttttagtagagatggggtttctccatgttggtcaggctggtcttgaacttttgacctcagatgatctgcccaccttggcctcccaaagtgctaggattacaggcatgagccaccacgcccagtgtattttagattttttttgaaatctcttgagactcatcactgcttctaaaatggtgttatatcttaggattttcatttgtttttaggagtagggtgaatttaggtaacctagccatattgacaatggaattctctatagtggttttaaattaaccttttttcatgaataagttaattaaataattggttaatgaattatttttaaaaattttggttttattttcagtttttgcttggttgaaacatgaattattttaaataaaacagaattttactttaagtcactaaagaaaaggaaactgcagtttttggtgctgtgtttattttttttttttttttttttttttttaagtttcaagagtactgtgtaagagtttgaaaataggttgggtatgatgacttaaacctgtaatcccagcactttgggaggctgaagtgggaggatcttttgagcctaggagtttgagatcagcctgggcaacatagggagaccctgtctctacaaaaaataaaaaaattagcctggcatgatggcatgcgccagtggtaccagctactcaggaggctgaggtgggaggatctcttgagcccaggaagtcaagactgcacggagctgtgattgtgccactgcactccagcctgggcaacagagtgtcccaggctcaaaaaaaaaataacaaaatgaatgaatgaatgatgtttgaaaatactctgctgtgatcttggtccaagtctagactctgctcattttgttgacttttttcttcatgtgtgtgtattcacttgtatgttctccaaatctgaagatattaatccatctcaaaacaaagccgtcttatgttttatgttcaaactattgaactgctgctgtcatctcacctttcctcacttgtaccttgttcatctttgagcaattcttaaacgtttgtagtccccacctagcttggctaattattaacagacacatgcgtggtattctgaagaacagttagctcattcctttgagttctttttagaatgacaataatttataattcacgtaagaccccgtactttctttcattcgttctatttttagagacagggacttgctctgttgttcaggctggagtgcagtggcatgatcatggctcactgtaaccttgaactcctgggatcaagtgatcttcctgaggcaggactacaggcacatggcaccacgtctggctaatttttaaattttttgtagagatgaggtcttgctatgtttccctggctggtcttgaactcctgcctcagcctccaagtgttgaaagacgtgagctaccacacccaaccctagaccctgtactttcatccagacttgtattactttgaaaatattctgggctggggacagtagctcacttcagctctgttgcccaggctagtttgcagtggtatgatcatagctcactgcatctttgaattcctgggctcaaccaatcctcccttcttagtctcctgaattgctgggatgataggcacaccaccatgtccagctattttctttaaaacaatttttttggtccttttttgtatttaaaaacattttgtttttaagaaaagaaaaagacaatattctggatacctgctaagatatgtaacacatgccaatcacacattaaaaaaaataggtatatggtttcttacaaataatctgaagataaaaatgagacaaggaccatttgctaattatgaaagtgaatccattgatttattcagcaactagattcttaatctgtatgagattgtgtattaggtgagactagcaaccaaattgtcagtaggactttaattaattttcatcatcctcttgaatcagcatattagctagagatccaggggcacatacttagtacagaaggtcagctgtatatctgcagatgaaggctaggtaatggccagttgattatacgggaaaactcatgggtccagtaggacagtgtggcattgaaacagaacattatattaggaagatggtggacaaggtgtgagagagtagagcagtgactggactttataagaatttgggaaacgtgagaaagaaagggctgggtcactgtgcagctgggtgatatagaatttgtatatagcagaattctagaaaataatgtctggaggcagaatagggccacatattagaaaaaagccataaatcttgcagttggaggtttggttttgaaactgagaactactagggcctggaggcttgggaaatactttgaacttccctgtagtaggatttaattcagtgccatcagttgtattttagaatagtttcactttcttttaacagagtgggatctctccttctgtgttgctgactggcataccgattaggcagttcttaacttttttttttaatgctggagattgttcctaagcattaggcttcttgttgaccttggtagcagggtggggttggggagggaactgtattcagctgtgtcctgttggagtacagctcatattttctatcttttccccacccttttaggctgcacatggtccgtctaatgctgttggagagattactgcagaccctgcctcaattacgaaacgttggcggtgtccgggccatcccatacatgcaggtatctcttagctcacctggatctctgtcaggtcatgattggaccgtccttaagcatgcccacatctctcttccagaggacctggaagccttcgtttggtgttaggccacagaataatgaaatctaatttttgagctacaaattatagctcttcattttataaatgagaaagctaagggtcagagaattttttaaatgcacaagttcatccaggtagttattgacagagccagtgcaaaagcccacttctgagattctgagtctctagtctttatgttgatattagagtgtgggccaatagctgttcttccactcactagctgtcttcctcagaggcaaaactgttctttaattcttagtttggtgtaccaccctttctcaagctacttgcttggatataatataggttagtccattaattttacaaactttttacaaaacatttttttgtaatgtcaagtgtggcatatatcagaatttgacttttctgactctgaacactgaagctttggatacctggaatttagaacgctataatggattacagttatgattgatagggatgtcaggaagattaggatttcttctgaaacaccccgtatttcaagtcgttcttctttaggaaattgggttttgtgttttctgtctttgacttctaggtcattctaatgctcactacagatctggatggagaagatgagaaagacaagggggccctagacaacctgctctcccagcttattgctgagttgggtatggataaaaaggtaaaatctgagaggcagactgtgtgagaaacaggattggctgagatcctttctcaggttcccattcgtttcatagaggaacttcacctcgtttcaaggggtaaccatccactgagggctgcattctgttgagtcaacaaaagcgtattcagggcctgctttggcccgagcatagttttggaccctgagcatagttgagggcaaagatgaagttcttaccctcatggcccttttgtgctcagtgaggtgagaacattaaattagttgttcgtatcttaatatggcctcttaagtgtatcgggctctaggtaccccaagtatagtccatggatatactgggggttgttttgtgtctgattcaatctgaggaacattttagggctgatgggcttgacttgaagggatcttgttcagaggatgcctcaagcatcgagtaagtagaggtttctggacttacgctttggcctgcaggatgtctccaagaagaatgagcgcagcgccctgaatgaagtccatctggtagtaatgagactcctgagtgtcttcatgtcccgcaccaaatctggatccaagtcttccatatgtgaggtatttttgctttgggttcatgggtttggggaaaggtaagcggattgtctgggtagtgctagggccagcacagaggtggtagtcctctgtaagaataaagccattgttccctgaggggagtaagattctaagctgtcaccttttcaagagcagaacctccaccttttcccgaatcccttccaagctctggtctttggtaacaatccctccaatggaggggtaaaagggtttggaagttccattattgaagagcagggctctcttctgcaaggcacagagtggctaagaggattcccctagtgtatgttgctataaggtatggtaataaagcagagagaaagcaatgtgtgtgtggtgaaaggagattagcataaagcagagaaggtagaaattgaggctgaactgcatccaatcttaatgagcttagggagctgtggggtttgctgggatttgcaaggctcttctaatggtcttatttacagtagcttttctccttttttatgcatgtgatcactcacccccaactcctttggaagctggttctatggaagactctacagggggtggggtggggtcgttcagaagtgcctataatggaaagttttctctctccttcttgaattgggcttcttttctagttgctcaagataaaagaggaaacgcgtcccctccagggggaaaggttatttaatccttgcctccctggcttctggcatatgtgcgtgtagcaaggttagagttgagaacagatgtgtttctttgtttgtcttaccatgtggttgttcaaaaaagttctgaaaaacctcacaaacttccttggggaagtttcagtgcaagagcctgattcactcactgccataaaagctaagactgttgtgagtgtgtttcccatccccaacacccacctggatttcacattgtttttacaagccattcttcccatctctgtattttctctgtctcccagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaaggtgagatctttccctcatcaaagaaacactcgtcctttgttcagagcactcttctctttcctcgcggtgcagagagctcaaggggctgagggtgaagagccataggaaggagccggcattccttggtgggggttaatctcggcgtgattgaataaatgaccacttctcccaaccttctgtgggattctcattcctgcctctttgtaaattggaggaattgaatgagatcatggttatctcgtttcacattaagtttagaaaaagatgagaaggtacaagctaatgtcatgagttgtgggtcatgacatgtgtgtcagatattccctgtgctgtcaccactgagaggccctttaacgtacttattaagaagatgggccttctgatcagattgatctgggataagtcccatcttgtgttcttacttaccagtcttgaagcatggagaagttctgtctgtctaacctccctaaccttcagcttctacagctggaaaatgagcatacagatggtatctgctttacagggctgttgtgagcattgaatgaggtgccctttgtaaaggacttagcacaatgcctagcatgtatcaatgcccagtccgtattaactgatatcaccagtctcttcctcactgccccctcagaatagctttgagtagggtaggaatacgataggcatagagtgtggatctgatcgttgtcttgctcttttttcatgactctttggtggttttccataacttacaggccaaagagttctggaggacccagccacctgcttgactctagctttgtcacctataacaccctacacgcagccctgccagcctgcacatttcccaaggtgtggcgtgttgcctttgttcatgctgtcccttctggaattctttcctctccctctgctcccctttcttctcctgtctagcgaattcctagcccatcttcaagatccagcacgagctttggatccttgggaaaacttccctaacatatactccctgccatcaagtctgctcaagagagccttgtcctgggttcccggagcaccctgtgtgctccttcacctgtcttcccctctacactctcagcagaaaccatattttattcctgtttacaactccagtgcttgatacagaactgatgaataactgggagttgaatatgtgagacacgttgtgccctcaaactcttacagattctttttatgggaccacacagcttgcaggatagctgttgtttccactgtcctcacatctctcatttacctctgcctttttgtgttacatgaagccaggaatcttggctgagtttagtgatcttgcccaccttggtttatttaacaatttcttgttatcatgggaaattttggttctagggatagaatacatctcatagaagtcagagatccttactccctttttcttttttttttccaatttttttggcctttctagcactcatctttatgtaggcagagtacaatcaacccaatgtcaaaaaccatagagtgaaatattaggacttttaggaagtgaggtctgcctccactgtaacctttgcatgtaattaaattggccgcagaagcctgggccttctgggtttatagaataaactgtcagtcagtcttgattccagctctgaaaggcaccctttaccacctccaacatgtaatacgtctaatgagccaggctttttcctaattgtggtcatggaaaatcgatagtcacaggttctcatgcaaattttcttctcccagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgaggtaagtgaaagtcccaagctgcatgcttgttgggctgaggacacatctgcattcacctctgtgggcccctttcttcctcatccttacttggtatttccccttgcagagtccctttcacctttgtaggtcttggtcttgcccttctggaacatactgtgtggtagaactgtgggagatgtgtatcaaacaagccatactttaccttctgattctgtgtgttgaacttcgcctcacgtgctgataatgggcaagtttaataatttaggttctgtcagaaaaacaaagtatactagttatcttaatagagagatttcaatatgggaaattgggtaaatgctgttggacaacaaaaaagataaaaaggaaacatgaggtaacacagggatagtaactgcctgaagcagttatcaggaagtgggttccctgaggggatgtgatgcggttgatgctgggagcagtgagagaagctgatgattagaactcactgtggctgccagggtgcagggctgttgctaggactgcaggcagatgggaagaagcaagccccttcttcctcctgctgccagtgtccctccctgttggcagaacctaagagggagccagctggcaaagaagtagtgcattggcataattctggcctcagcatcactgggcagtgtcagtaggggtgggttgggaactgagagacaatggctttaataaccttagtaaccagacagcaaccctgagatagattaactctgggaagaataatctgttagcaaacctcagatgaggattttgagttacatagttgtaccaacccaatcttctctttagctcttttacctgaaaaagagatttggaatggtttttttcttgatagtttccctttgggtgggctgaagtggagtccagcttgcctgtagattcctaagggcacaaggaagagatgcatgaatattggtattttcctctttgatttctttctctccctttctttctcctggtctcattaaaggatatttaagtttaagagaggctggtttggtcaagaggaaatagcttggtttgtgtttctccccagcctttgtttttttttttttttttaagaccaagtctcactctgttgacccaggttggagtgcagtgacacgatctctgctcactgcaacctccgccctctgggttcaagcaattcttctgcctcagcctccctagtagctgggattacaggcagtgctaccacggccagctaatttttgtattgttggtagagatggggtttcaccatgttggccaggctggtctcaaattcctgacctcaagtgatcagcccacctcggcattccaaagtgctgggattacagctgtgagccaccgtgcccggcctgtccccagcttttaataacagtttattaaaacccagggtgtgagagccacagttgatatagatacagtcccagagtcatttactctttgtggtgtttttcttctcaagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctggtacgagggctgggacctggtagggcagggaggggggatgtgataaggcttagccaagtaggtaatagggctggaggtaataatgcaggacttttaactgtgttgacaatggcatggttagggctgagatgagggtaaatccataacccctgtctgggtgctgtaccatgtgtagttggcttcaggatctgggatgtccccctcagcactctcatcccacctggcagcagttcctccactgtgaggtgagtggcccgagcttcttaccagtgccatttgcttacatcctagtcaggactgatctctttgtgcacctctggtttttacccttgaatactaaagaaatgatgaaggttcgagtagaaaaatgtattgctgcctaaagagaaactgtttggacttagaggagtaaactgagtattttgtatgtgaacaacctagaaagaacgtctttaatctagctggctcatgttcttgcttatcgttatatatcaagaaaagtaaactggattatagtttcttaggtcatggtctaccttttgctgttgccttattgagtagtctgaaggttcctgaaaacagcgccttgcgtggggatggggtagaacaaaggcaggttcggtaagagctgcagcggttgcagcagtgtgtgggtcatggtcccaggttgaccagacatctcagcaagcatctgccttgctcagaagatcatgttcaggtgtagtccaaagtcagggagatggctccaggcagcaggtgtggtgcttgtctgggcaatgtggtggagttactcctttcccgtggttggttcctatttcagatggagcacctgaaagcctgtgcagagattgccgcccagcgaaccatcaactggcagaaattctgcatcaaagatgactgtaagcaatgctgctccttttgattgctgttattcattcattcaggaactgttaaggcctactatatgccaagcactgaactggatgctggagatatagctgtgaacaagatagactagacagaactctgtctagcaaagaagacaagtaaaaatctaaaagagtggtgagggctggtcgtcaaagtttggggagctgtagaagcacaaagtaggagtctctgacctccaggtagtggcagtaaagtcaaagaggagtaggtggagtctagagaaccccttattcaaaggagcagggggctctggtcggtgtgtagttaaaatacttttcagagatttccacagaaagtataacttcttcacaatgtccagcagagagaacatggcaaagaaagctggtgagaacagggcagtctcagctgtagggagacgttgttttggttctcctgagtctggttgaggtcgtctcagaggtgagcctctgtctcctctgcttgcagccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtaagggtcaccctcttgtcattgtgactacaatgatgtatgtaaatctctcttggagcacatggtttgtcctgttgtaaaaggtcttttaatcctgatttagaggggacttaaagcccaaatgttctctagtgtctacttttggtctcattttcaattatactgaagtgacaccttaaacagcatgacttctcataccaagtgacagtaataagaaaagtcaaagtgcactgaacatttttagtagaccaaatttcttattctgtgaaataataacaccttctctatggagctcccatcagagttcagtgaaatgacactgagtacattggtaaatgctcagtaaatgttagctctcttagctgaccctcaccatcagctgcactgctttccatggtccttggagacctgagatcagtggtcagggttgagagccatggtggtggttcacattcccccagttaatgatcagacatctctgtgtaggcctattgcaagcccttgaaaggaagttcctcctcctccagtgtcactgtatttgttcagtgccagcttacatagcactttatcctgtggtttttagtgtcattattgtatgtcttgtctggaaggcagctgtgctcaccactgcatcaccaacgttacacatatgtctcatttggggctgacctatttgtcccccagtaaacaactaaaaattgttttgcagaatatcagcattcagtagaaacttttagaaatggacagaattccctccctcaccatttggtagcccaggccttaggaccctggaggacttcttcctactcttcagcccttagtcctgtcctaatcttgcaggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacaggtagggccagggcttggtttgacagatctgcaagggtgtgaggccagggtgcgtaatgcagttctattttgttttcggttacatatggtcacagagtcagtagttacgccagcctgaatcctcttgtgctttagagatttctttattgttgtctgctttttagccattaaactgacgtcataggcaggagacgatctgttttctactcagaaggctatgtatcggggtttgtaacatgaccaagcttgacccttcaggctaaaaaagctcagcttctgctctgggatatgttgggtgatgggtagaggcagcaaatgactatgctgcatctggtaggattgattgtcaaaagtgaaacaaaaccgttcaaacttaacccataattgtggggaaattgaggtaccagagcctcaatgataaacacaggtgcctcagggttttctgctgcttggtaacatgagctgtcatatatccacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaaggtaacagttgctttatggtcagaggggccaacttgccatatttaaccttttttctcttgagttaagaatattatgaacaacccagatatagggagtccatataggaaacctcttttaaatatatctagttttgcatttcttggtaagcactcgtaatatgtctgtgatgtagacagtatacactaacaaatctaacttaacataggacgtaggtcaaggtcaggtggggaaagaagatagaactcattacagttccttggaaaagcaagtgctccttgttttgctagtagccctgattatacataccagaaaatgtttctgcaattagctaaccattttatggcttctccataaaaataaaaatgatcttcctccatcaggtcagaaaagggtactacctatcactaaagctcatggaaacttctaaaggagatagaatccatttaaatgattgaaattaggcccagctttgtatgattctgactgagaagtctggtaggtctagggcagtattcagctagaatgcagaagacaaaagtcttttccaataagacttcaccttgggctttaagttgtttctttactgaattctgtttcagttgaaggagtattcacagaaggctgtggagattctgcggactcaaaaccatattcttaccaaccaccccaactcgaacatttataagtgagctttgttttgctttctacctgtgggaagctcagtcagcattctgaggagttatttgcatggtgataggctcttacataggaattgacaagcgcctgagagaagagcgaatctgcctagttgagattccaatcccctccatgtaggccagggtcttgcaaatagaaggtactcaaaatgtcattgctgagttcagggtttggtgagtagtaatgtagaaaggtctgtatagcctgggcaacatagtgagacttcatctcttaaaaaaaaatttaaaaaagttagccaggcgtggtggcgtgtacctgtggtcccagctgctggggaggctgaggcaggaggatggcttggggccagaagttcgagggtgcaatgaactgtgatccacgccactgcactccagcctgggtgacagagtgagaccctgtctcaaaaaaaaaaaaaaaaaaaggtctttagtttcaagggtttaagttaaataaggtgaaacaaatttaaagaaaatgtcttcctttttttaaaaaaacttctaaaagaggatattggttaaattgacagtttattatttctctggtttagtagtgactgttctttaaaaaaaatttaaaaaaactttattgagataatttatgtattaacctattttaaatgtacagttcaatgatttttagtaaatttaattgtgactcttgagtcaaattttactactttttagaattcctctgaaggatagatcaaagattaggaaacatctaaggtcagttagttgaaatttctttcctgtggcttcgtaaccctattgggatttctcctgtgtccttgagttctcactagggtggggctcactttgggctcactttggctcacattgagccatggctttgtcatgatttttttgtgaaactcagtgcttcctaagatgaaaatgtgttcatgctaagactggtttcttccttagcactttgtctggcttagtggagtttgatggctattacctggagagcgatccctgcctggtgtgtaataacccggaagtaccgttctgtgtaagtaacatctgtacatggacagtcctgaggccaataggtccagtgggattcttgtttccagagatggatcattatcacatagatgttcctctcctaatggttggtcaccgatagtaggaatttttatctgccacatttattaccttaaatagaaacttggctgggtgcagtggctcaagcctataatcccagtactttgggaggctaagatgggaggatcccctgagcccaggggttttagaccagcctgggcaagatggtgagaccccatctctacaaaatattttttaaaaaattaaatagaaacttcatcttgtggatgaagagtgggttacactgatgaatttttaaaaaggcagtacgagtcttgaactaataccatgttttgtgaactcttgtatttagtatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagtacgggctttttaggcctcgggaggggcagcaggttgtaaggctgaagctcagttgctgccttcggttcctggaatggagtaaggcagcacatccctagaggcctaatacatcctcttggcccctccattcatgaccaaaggacaaaagtgaaacaacagttctaagcatgttgacaaagattatttctaaattagcccagtggagccataggggtctgtggaagttcctcaacagcctgcctagggaggggaagctgagtgaggggacctccaggcttctcatgcccattttaactattcttacacaaaggtctagacttagataaaaccttctgtattgggaagtaattgtcatttcttggattaagacagctatgctcttgctcacagggcagaaagttatttctcaagaagcttctttagtacacacactcttcgatttccacatggtgccttttctctgtatctgctgatactggatcttcctagcccatgtatcccagtgactgaaccagggcatgtcatatttaggccaagagaggcactcacatgggttatagtgttgactttcacagagacagatcgcctttttttgaactctcaggcattgctactgaagggagaacacaggttgacactacttgaatagtaagacttacagagctgttctgcacacaggatggaagtattgctgttattccaagaggcagaataaggctcatgtaccacagcaacacgtggccatgaaggctgcctagggaggttttctcttcttgccttgaaaagcctagtttaaccttggtgacctgaaagtagatgctgcacattagggtggcccattcccctccagaggaggtgggtttgatttttcattgtgtggagtcagcagagctactggtagactatttgggttcagatcccagctctgctacatagctctgtgaccttagagaagctgcttaacctcagtttctgtaactataaaatggaggtaggaccccacttccagggtttaaggattaaatgagttagtatgtgtcaggtgctgagaacagagcctagtacatagtaagtactcagtaaatattagctctcattgtgttatataatcaccccaaaattattacataccttcctctttatgacttgacttagcacttggttcagaccctgattttcttcctctgcctctctaaaatagcctgggtttatctttccaaggttgctgtcaggatgggaacttggcatgcatcatcattgcacctcttacaggcttcagtgtggcatgcttttggagtcatggtttcccttgttatatacttctgttgttttcctggaatttcaaaaggtatcatgtataacagcttaaagcacttgtatgttctttcctttttttatagagaaaaggtagtagaaaacttttttaaaactggcttcctattatatgccagatttcttttccttagagtaaccacttaattgccttagaaaaatacatgggacagtcttcctctttgtctcatcagactgttatcactgagggttagatgagaaaatctcaaggctgtctgtctttcctaggccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcaggtaagtcattggtcatcccctaggccagggctgtgcacattccttgttatttttctgtagtagtgtcagtgtgagcaattacagtgtctgattccctcagaacatttagagaattatgggtttgtagagtgggttcaagggtagaaagggaggaggaagaagagagagtgagtgagtgtgtgtgtgtgtgtgtgtgtgcatgtgcacacgagtgtgtctgtcctgtggcaggggtggagggtaagggcggagggaggtccagaagtttagctctgggtcttgctttcttgttacctggctgcttaagtcattcatttgttattgtcccttcagtagcccctgcagtagttaccagagtatataaatgtggcacaatccatttcctcagagtgacccccaccccacccagccttgtcaccttactgacccaaacgctttggttactcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggtgaggccagatctggcctagactcagggctgtggccttgatctggactttgggcagacctggtgcagtgcagtgcactttactttctagcctaagccttcttcgactcaacaccagtttcagggcccagcttttgggtgggagcaaagaatggcatgaggtatattgtattgaaagacatggtttgcataggattttagaaaagtgttgattggtaatgaaactagagtatctccaggtacagataactttggatttggatgctttgccctgcatttcttccacagactgcttcatattgaggctgctggccctccctcagtattagattgtccagtgctagttcccagcctgcataatatgggcaggggcggggggaggttctagatattaaagaacagtgaaaaaggggcacctatagggttaacagaagaacatttagctttggagtcagaaggacagaaattctaattccagccatacttttaatacttgtgtaacctagtataagttacttctctcagcattgtattattatatatcacagatgtgtattgtatttttattagaaataatatacccacctcacaggaaagattattgtgaagaacagagataatgtatgaaacacagtgcctgacctataggaaatgttctggtaaatggttagcagtgaggattactcagggaaagtcatcagccaaaaagccttcactcagtccctgtcttttcctgtctaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatctagcagtccaggtcttggtgttgtccctgcccaatctagctgaaaaggcaggcagatggctgcaccaaacggcatctcccccaccgtgatttatggcgctggtcagaatgctgagttcatgctagataactgaacatactggtgatgggaaggtaacacagataagggttttttttagccattaacaacccatctcttagtagaggggttactggtcttaaaaaatttgatgccaagattctgttccctcttctgataacgccgtgtttgcaggctgtagggtaagggcataccaactgcaatcaaccagggtgggccttgtgtcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggccttgtgagggaagggaagggagacacttgaactcgagaaagactcacatgaaagaagcagagcagtggggcctggagattaagagcttggactctggattggaaaggctcagtttcagtatctgataccttgtactatacgccttggacagattccttaatttctctgagtctgtgttttcctcatctgaaaaatactgacagtaggctgggcacagtggctcttgcccgtaatcccagcactttggcacctgaggctggcagatcacttgaggtcaggagttcaagaccagcctggccaacatggtaaaacctcgtctccattaaaaatacaaaaatagggccaggtgctgtggctcatgcctgtaatcccagcactttggcaggccaaggcgggtggatcacctgaggtcgggagttcaagaccagcctgaccaacatggagaaaccccatctccactgaaaatacaaaattagacaggtgtagtggtgcatgcctgtaatctcagctacttgggaggctgagacaggagaatcgcttgaacctgggaggcggagattgtggtgagtcgaaatcgtgccattgcactccagcctgggcaacaagcgagactccgtctcaaaaaaaaaaaaaaaatacaaaaatagggctgaacaggctcacacctgtaatcccagcactttgggaggtcaaggcaggcagatcacgaggtcaggagttgatcatgaggtcatggcaatgtctcagcagtgggctgcatgcctaggaagtagcaagtgggtagttgagagcaggcacctgccaggaatgctagggcatcacaaggaacccgtgtagctggagacagggatgcagtagggaagactcgggaggaggcttaggtcagagggtgcgagggccagatcccatagggtcttgtgggcctctgtaaggactttggggcttattcagtatgttgggaagcaagagtgagtgatacggtttgtgttttttattaatagtgggaacattgttacaaagagacgtaaactggaatatgagggccttgtggaaaatgaaatgcaggcagatggagaagacagggaaagagttgtgaccaagactgagagtggacgtctaggttttggagactgtgtcacaccagacagcaggggctctgtcgcctgggacatgggccccataaggtggtgctgctcttccctcagttagcttctgttcataggcaaggcggctgtaatgggccctttattattaccgaccacggttttgtgaagctaaagttctagtcttgccccgggaaggaagtagaaaatttggggccaggtagccttagacattgatttcattttccctgggccccttcaggtggaaaggagtgtcacacctgattgtgaattataggactccatttctatttgcttctgcagagacaacccagaagccacccaacagatgaatgacctgattattggcaaggtctccacagccctgaagggccactgggccaaccccgatctggtgagccggcctagcaggcccagctgtcctctctgacttcccctcacatgccttgtgtttctcagcttcccctcccaggtcctgcggtgactgaggagggaaggagcagaacattaccccagaatggttttcccagggaagagcctggagcacaagggtctccgtctgtcctttgtctctgttggagccacctaggaccagaaattgtattaatagttaagagtcgctggaccggagctgaccctcttgactcatgtctcttcccattgccttctaggcaagtagcctgcagtatgaaatgctgctgctgacggattctatctccaaggaggacagctgctgggagctccggttacgctgtggtgagttaggggattttcagagaaaggaaaggaggctcaaaggagcagtcctggccggactgggaggggaggagggaaactgatgcttgggcggcctctgcagagcagatgtgtagtgttcctgattgtgactctgcctttcctgaccatccctagctctcagccttttcctcatggctgtgaacattaagactcctgtggtggttgaaaacattaccctcatgtgcctgaggatcttgcagaagctgataaaaccacctgctcccactagcaagaagaacaaggtactgggccaagcaggggtctaacaaggaagggcagggcggccaccctcctcattccctggcagtgtgccctgcctcctcatggtctccgctttgccttgagcccacctcccctgagaggctccagtgcagcctttgccttagttcagcagatatgggttgggatttttgagaaggatggttcaagtaaaataaacatgaaactgcaaagcagagagcaaagtggctagctgtgaaggatgaactctttccagtcatgttagataacttgcagcccccagaaagcattgtgtccttcctacccctgtgcctttgcacatgcagtgctgtgcggtgatagaaatcccaggctctgaagcagacttcctgagttcaaattccagcgcttccatttattagcatcatgatgttgggcaagttgttccttagtttccccatctataaaatgggaatatagtctccaccttgaagtgttgtgaaaaataaatgacataatgcagactaagtgatcaaaacggtgtctgcctaagttaatccttaacaaatgttagctgtggctatctcctgctttctttgcctagaatgttttccttcactttgttagctgctccttagagggtcagttctctactaggctagctgtgagctccttgattccaggaactggaccatcttagtaatactttttatgtctagtatataggatggtataacatctataatagctgcttagtgaattattattaagtgaataaatgaaaccaagtttttatcctaaaataactgtagctgagccacagattgacttgcttgtatcagcttttgaattgggaggccatagttctttctttgggccatgcctaaggctctgccaccaacttgccctggattgggccttgggtccttctgactcctgttctgtctgatgggccatcccttttgggcaacagagtcctcatggcaggaagattgctttttgagtgctaagcactagggttatgatgtggggaagctggacattgaagctgccttcagaaaaggcagcacggggcactctgcttccttccctttgatggaggaattatttccccccagattcccagcaactaaaatcagcccttggttgagaagaggacacccatccctatatgaccatccttgtttccacagtgggaggcaaagggagatttttcacggaattacttgccctgtaaggactgaggcctggtgtggatgttcacaatttgctccgtgtaacttagcgagagcagcagttcctaaaatctggctcacagactccggggtgttcttgagactgtcaaagatctgtgaggacaaagttattttcataattgtcctaagacactatttgcccctgtaattcttctgatgtttgtgctgacggtagaaaacctttgctgctggggagacagccagtgccttaggttgacgaggcggtggccctgtgcagttcttcactgccacccggtttcatcaagaatatccttgatgaaacagtacaaattaattttattaaatctccactcttgggtactaatctatttaatgctcagtgtgacaaaatgagtacacagaaagcgcctctgctgcaccccaagtacagcagttgtgctgagaaaaggcacttgtgtgagatgcaagccaaaccagctgcctttccatggatctccgcttgtgcttgaaaaaaatggctgatgggcaaattgtggttgttcaggcttaggtatttggcagatttttcctcaaaatgaatgaagtgagctttaagaagaactgacataactgtgtaaaccagtgttttctaaatgaccaatgcatgttatagtatcctgccgggtaaaagatgaaggttagtgtaatgaagtatgaaaagtttattgatgtgatttcagagtccatactacagctaatctttcagaccctgtaatttgttgagttttggtatagtctcaatgaaaaaaatccacaactagttgaaaaaggtattaaaatattctttccttttccaactgtatatctgtatgaggccaaatgtttttcatatacttcaaccaaaacaacctgtcatgacaatttaactatagaaaccgatatgagaatccagatgtcttataaagcagtcattaaacaattatcaaaaatgtaaaacagtgccacgtctttctgtaggttatttttgttttggaaaatataaaatttatgttgacaaataatagatttactcttctttttcaatgaattaacaaatatcttcagaatttctcagtgttttattttttattttttttttgagacagggtcccattctgtcacccaggctggagtgcagtggtatgatctcggctcactgcaaaccctgcctcctgggtgcaagcaatcctcctgcctcagcccccttagtagctgggactacaggcatatactaccgtgcccagctaatttttttgtattttgtatcgaaatggagtttcaccatattagccaggctggtctcgaactcctggactaaagcatcatctgtctgccttggcctcccaaagtgctgggattataggcgtgagtcaccgcgcccggccagttttagtttttaacatgagaaatggcaatagatacaaccatgtaaagcaaagctctctggagtccgtaataatttttgaagattgtaacagggttctgaggccaaacagcttgagacacgctggactggagtgtcatctgtggctctctctctgcaggctgcttctggttagtgacagtttgcattctggaggctgcttgtgaccctaggaaggtttttgcttaggaaactgcaaatcagccgtgggataggaattagtgtaagtgctataggattgtaggaagccagccacagcttctgctgcacaataaaaatgagtgaccttaagctcaatgtggagatgctgctgctaaattggatcaaaatggtttaacaggaacacatatttgggcataagagatacacgtgttgatcctcctgatcttcttgcctttgcacatcaccccctggggcaccagtgccatgctgttggggctatggctcaggtgtgcccttgagcgccctcaccttgctccacttgcctcctccaggatgtccccgttgaggccctcaccacggtgaagccatactgcaatgagatccatgcccaggctcaactgtggctcaagagagaccccaaggcatcctatgatgcctggaagaagtgtcttcctatcagaggtatatctttctcttcaagacgccgggaagtcctgcctgcgctctgacagccctgccttctgtcactctcatttacttacctactacccctgcaacccttggccttgcagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgagtggccacttctggactcttcaccccctgcgcccctgaccccagactctgagcaatatgtttctgcccctcaccatgtgtctgcactgccatctcttctttctctttgctcttcttgcttcctttcaaatagggagtgagtacaggttcttggttgtagctgttgggctagcatggtggactggccgaaacagaacttcctctgcttatcttaacacgctccttgtgctttctgctttcctccctgaccatagtcccttttctccttccatttttcgtatcttctgctgtcctttctctccctcctctctctagctaaagtaattctatgttaggtaatccatttgtccattgatatataaaataagaaatacttggtttacatttaaatgaaagtattcagcatataagtgtccccaaaaaagaatgatcagcatctttgctaaggaagatccctttttcctacttcacttattgtaggtatgttcttcacatctcctgatggagaagtctccaggcagaagcagggctctttcacagcccctttccccatctaaaacagtagagtcttgtgttagctggtgatttttacctcttaacattttcctagagaggtgcccagaagacctctcctagatgggtggcagttgactgccctgctgggggcctggtgaggcagggcatcctctgagtctacgaccccttctctcccctgtcctgcaggtgcttttcactccagcaacgcaggccgcacggcaggcagcctgtaccattgtggaagctctagccaccattcccagccgcaagcagcaggtcctggacctgcttaccaggtaccatttgggagtgggatgaggagcgtggttagacttgctctagagccttttcatcttccccggggaatccatggatcagggtaatgagaggcacacctctgggtagaagaccccagaaacaacaaagtgttaaaaagctgacttttagtgatggtagtggtggtggtcgttgtggtgagggtgttagcagcagcagcagctaatatttgagatcttatgcagctaatattgatcgagattgagtgcataaatgcttggcatgcattatcttatttaattctctcatagcaatcagtgccaaaatatgaatgcttagattctgtggcattcactccctgcagtgtgctctgaatgcttcctagatgtgggaaattcccatgtgggaattggagctgtcttggatgctgttcctccaccctctaggaagcaggagagacagacagcagaagataggaaagattgggaggagaaaggggagccttggagctgttcgaaatgctagagttcttgactagagtgccctgtccctcttggtggcagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggtatcctaccctattgcccaagagagccccttccctaattcccccttgtaccttgatgtaaactctactatggtgttttgtttgtttgtttttgctgagaagaaatatttgttgaaggtgtttggaaatatttttatgacttcattgtatttattatgtagctgtagcaaactcttgggagcatttggactgtttacagtttttaagcaatcccttaccagcgctgtgactgttggcttcctggaaaggagttctgcaagggttcgattaagaagatgtaactacagagtgtctggtgctgcaagctcctgggacagtggtggaggtaactggtatccttggcagtgatatcacactgactgcacttgtcatcctgtttaggaaatagctcgtctgctggccctggaggaggctaccctgagtaccgatctgcagcagggttatgcccttaaaagtctcacaggtaaagagccacctggaccttcctttagggcatcctgaatctgtttagggacaacccttagttccttgggtgctggggttgactctcttctctctggtactgaccttagtgcagatttaagctctgcattttttttctgtattgatacgtttatgattttgagaccctgtttgctattgactgtttccgcttgttgaacacctgctctgtgccatgcacaaagatagattttccctgctttttgagttgctcataatcttttgagacacagactgtccttatgttttcatccagagctctcacagcaacattttcctgtctccacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtagcactgcccagtggcctggagcctaaggcactgtcccttctggggctgccgaggtgcattcgaccaatttcccccagttccacagatccagaggaggggtggcaaacatctccctgcattcaaagggagactcatttcttgacaaagtgttggctcttggaattttaaattctagagctgggctcagtcactttggatttttcatgttgagcttatagagtggtgcaaggtcaaaggctctctcattggtgtcttctatcagtctggaaaattctcagccattgtctctttaatcccctctgctgtattctctttcttttccttgtgaaactccattttcactctgtcatccatatctctccatctctcataatgttcatctcattgtgtatttatgctgcatttttgacaatttgttcaattcagtttttcttcactgtgtgcaaatgtttaatctacctgttgaattcttgtggttctagattttatggtctcttttttatttttcattttttgagaccaagtttcactcttgttgcccaggctggagtgcagtgacgcgatcttggctcaccgcaacctctgcctccaggattcaagcgattcgcctgcctcagccttactgagtagctgggattacaggcatgcaccaccacgcccagctaattttgtatttttagtagagacgggatttctccattttggtcaggctggtctcgaactcccgaccccagatgatccgcctgcctcggcctcccaaagtgctgggattacaggtgtgaggtctctttttaaaaattcacatttccctcctttatatgatctataagcatattaaacatttgtgtctgataattctaaaatttgagatatttacatgcctgattctgcagtttgttattttggctcttgctgatgataccttaaagtcttgttgtgttttatgagttttgactgtgacctcatattttttagctttatctgtggaaattctttaggactgggccaaagatgggtttctccagaggaggtaaagaactgcttctgtgaggcagtgcagggtactgctgtcccagttctgagcctcaggattttcagacctcctaggtagtgagaggtttgagccgcaaacccctataaggggacagctcattacaagttttcagaggagatttttccctgccacttgatggtaaagtttaaggaaagtcaatttcctcagttatttggttgggggaaagggatagctgatctctgcaccaagggtgtagctctttggggtactagatttgtatttgtggggcatggggttgggggttcctgctagactctttgcctcagtggattcggggctttatccacctctcaaatctgggcagggcatggaaaccaaagctcaacgcaaaaactgactcgtgttttgcttatctccctggcttcccgatttctcttagtttatggcttttggctgttctgtgttagtgtggcagttcactgatggatttttattcaacactttaaattgtttttgagtggtggagagtgaggagtaggtcagggaacctcgtttgccttattgcccaaaatggaactctttctgatgccattttcatcgtgccatactgagctggtttgtgacttcgtcagggacctttacctttttttttaattttaattcagacccacccagtaatgcaacagtgggactttttttttttcccgaagtttcactctgtcacccaggctggggtacagtggtgtgatcgaggctcactgtaacctccgccttctgggctcaaaccatcctcccacctcagcctcctgagtagctgggactataggcgtgtgccaccacgcccagctaattttgtattttttgtagagatggcatttcgccacattgcctagcctggtctccagcttttgagctcaaagtgctcacaagaccttattttttaaagaccatattttctcaccttcatgttactttaagttgtgttttttcgcttatagaggacagtctacctaatcttttagaatgaagctaaaaactaactgtaacttccttttgatttgactggaacacaggattatttgacattttctgagtgcctgttttgggcaaggagatgctagttaaataaggcacagtccctctccttgaggaggttatatcctgagagagagcaagacatgtacacagccaaccatgatgaagtgtgtggacttgggtgttatgggtttcaaactgaatgtggtctgaggataaaatcaatcagcatcaaatttccaatttgaactattgatattgccatgtagggcatttaaagacttaccaggcagaaataatttgtcagtgatggtacttcagttagaattctcatttcaccttccatgggagaggctctttcctaacttggccgctttgatttctggcaggtacagaatcagaaaccaaggccttcatggctgtgtgcattgagacagccaagcgctacaatctggatgactaccggaccccggtgttcatcttcgagaggctctgcagcatcatttatcctgtaagcagtgcggtgcttcccatggctctcgagtgtcagcacagcccactttgccatgaagcctcttggtgattcattaaagttatggggaattgtaccagctgtgggccacttagtcattagtgaaagaagatccaccgccataaaagtgaagcaacctcataattttcctcttgctaacgatgggacatttaatgaccttccttggtcttatttcctagattcaagtaaagaatcatgtttttttaaaaactaggtctaacctccattaccaaaatcccattgcatatcaatccaacatactgtggaagaagcggtattgagcttgaatataaagatatttttactctcttccttctttagctgccctgtattttgtgcacacatgcagcgtgtgtttttttccctagcctgaactgtgtagaagcacagtatcatccagagaacccttcctgctattgaggaaagatgaacactagtatcatgagctagcaatgagagctcattgggggtgtgtacctgagtgtcatgtcccatagagaagcccttttcttgacttcagggtcatcagtgacaaagtcctctggccccaaattggttagcatcacatgagaccagcaggaggaggaaggaaagtccctcctcgcaccccttccccgattttttaatatatctctcatatgtcactccttgtctgcttgttttgttaggctttatctcctaatccaccctggggtttcagggtagatgcttgatattttagtctacttgagtttgtttagatttttggaagtacctctgagtttcctgtcctttgtatctttaaatgtttggggggcttgctgagtttggtgtgttttcctcgagtgtccatggaacaaggtagcatggtataaatctccacctctgccatcccttctgatgcacccttctgtctgtcctccaggaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggaggtaatgaccataggacagtgctgcccacgtttacgattaggggcttcctcctaggctaaccaaatccaggtgcttcttcctagtagctgattaacttggggcaggtggccttcagtttctccactctgtaagttggggttaatgattcccacctttctacctcacctagtgctaaggttaataacctgtaaagggctctgcccagtgcctggcaggaagtaagcatattgttaatggctgttggttgtagtggtggtgggtatttattatcgttattgcctctggcagagacttctcggtgagtctgagttacctgagccccctaaatattggcgttttaccccctgtgcaggtttatgtccccgtgtcagttactttctggcagaccgttgagggtctgacatttttacatagtgaaaagccttttctggtgctgagcctgcaggagaaggtccccggtgggtgtgtctaagctggagcctgtgtgtgggttagggacgttagcagcccctgaaattgtgcacaaaattctgtgtgtttttcatacgtgcggattttttaagagtgggagagttgataggtccatgacatataaaaattgtgaattatcaaccattgccgtaaggtgccctttgctcttggattttacttgtcttacaattatttggaacaacagcttcacctgcttttctgttcagcttctagtgaacaataaaatcattagtttggaccttcctgtggctgaagtttacaagaaagtctggtgtaccacgaatgaggtatgtgcctgctttctcgtttggaggtgtggtttcacttttctgacttatgcagacttgtaccagcaggagccattgttcatcatcacttacctggcttgtagcagctctctaaggctttactgtccctgtttggggttgtgtggagaaaaccaatcttgttttcctttggaggcatctgactaatggagggacatttaatgaccttcatgaagcttcaggaaagcaaaagcattttgctgggctgtgcaagttgtcaaaccccaagaactgaaagccagggggtgtcgaaggaggctctgtgctgggaatgcttgctgtcttgttcccttcagtatggacacctctcagctgagattagttctcagcttttatgggcctgctcgcttagtagaacatttttccagtagctgtgtcaaggagcatcatttctgttttactagttggggaatggaggctcaaacaggcagttattcttgaggaggggaaaagggaaatgaaggaagtccagcgctctgggccttttggccaccacgagtgatgctgtttgtccacttatggaagtattagatggtccccttcacctttccctcctttcttactctctgttccttccattcctctcttcctgtttctttttcttcccctccatttctctctccccctgccatttcttcccttctcttgtttctattgggaggagaggtctttagcacatgaatcagataagtaacttaattacagcaaactagtgtagcagggatgcacagcaaacttttctagacttggtcccaaatacttctgtagagtttgagaaactaaattggcagtatactatttgtagattttgatcttcaatttgttacatatttccgcctctctcctttcttttctcccactgggctgggaatcctgcttactgttgactgttggtctactgccagtggggtcgttgttgcactgttggctgagggacaggcagagaactgtcccagccagtacctcttgttacagacattgtagcatcaaaacagaacaatacagatttaatccctgatgcatataaaaaattaagaccaagcttctgtgggcactctggtaaatggtggtagtgaacccacagaatgcaccagggtatctcccttgaatggtgaagcaagatagaagttgagaatcatttgcccctcacattgatgtgcttaatccagttagaaggttttctggcaaagttctgagtttgtgatagcctatgttctgggacttcagcttcccttctctaccttgccctccatttccctgataagcagcctacctctgtagctactgactagaactagaacctgctctgtgttcagtgtctgtggtggttctctctgaggaattctcactgggcttctatagccggaaacacttctgcaactggcctttctggcaggttgtcttcctccagggtgtcctgtcctgaagctcagcatagacttggaggcaggctgcttgaattagcgtgctaccaaatcccccactggatttcatcagtggttactttgagctccaatttctagtctgcaaaatgagaataatattaatatatgtgctcagtgccagacatacagggaactttccttattctccaatttagtgaagttgctgtaattttgtcatttataaaagacttgattcttatcattctagtcagattgtgggtttagcttaaagaattgtggatgaaccccctccttgtatggttatataaagacgtctgaatctctgtaggtaaagattgatgtactctcttttcctgttttgattcccgaggcttgagtcaaagctctttgatttaaatggccttgtttgtcctgggtagtagtccctattgattggagacagtttctactcctgaggaaggtccaggcttggaattagacctccgcttatagcttggtaaccttgaacaagctgtgtaaccttatgtaaaaggatcatagaaagtacttaattagcataggacctggcacagagtaaaacattcaataaatatttgttagattattacatagtgttctaatgaaattgaaggagatagtgtctttaaaatgtttcatacaatgtctagcttctagtagacacaaaataaaattagcattctttcccctaagtgaattgctgtgcatttggattctagatgttgtggttgagactttgtagaaaaatagaggctctccacattgctggggctttaagcaagaccaagtatggagtcctttgcatttgtctgggcctgtttttaagtacctttctccaactttctctgctcagggagagcccatgaggattgtttatcgtatgcgggggctgctgggcgatgccacagaggagttcattgagtccctggactctactacaggtagatcatggcactgcacattggatctgaggcttgggactcatgagcggctcacgtcccaggacttaggggcattctcagttgcttctctcttgtacctctgcatcagaattgtggggagattgtttcttcaattgaggaaaaaaagaggtgtctgtggcatgatgcagataccactgagtgttcaaaaaaaaaaaaaagaataccagcaaacttttagaggaaaatgcaatgaacagtaaactggagttcagatttatttttaactccctctccccccactccattgatggtattggtgctcatactttgacatttgagtaagtaattttaattgacttgaaactttaaaaaagctcctactgagagtgggacagtttaatatcatccatcattgaccccttttattggccgtgtctttattggagatacggaaaagggctgtcagccatcagccaggaatagggctgtcttatcctggcctattttattcccatcttcaccttaccctccatttctgcttggcttcccttctcccctagatgaagaagaagatgaagaagaagtgtataaaatggctggtgtgatggcccagtgtgggggcctggaatgcatgcttaacagactcgcagggatcagagatttcaagcagggacgccaccttctaacagtgagttgggggcagcaagttgtgggggccagcctttctgcactgggagaggcccctgtggaaagaagctatggccactgtgtcattttaccctagagggcagcatggtgccgtggagcagtgcgagccagtgaaggacctggcagttaggactacattcttaggcacaccttttcccgtcctgctggcccacttcccttctccaatacctctctatagagccagcatctgactgtctttccccaaatagctgcacttgtgttaactattatcattgttgttgtttttaaaatggattttgtaatgtaactcatttcttgcattgtagggttttgtttgggtattcatccaactaatctccttagtgaggattagagcattccagagaggcaccacaaatactacactgttattttcactactccccacccccactcccccagggtttatgagaatatgtattattgttattattgtgcctttgttttaaatgacctatgtggttctgagctctcacaggccacgagctttgggatcattttctttactattagtttagggtctgagttgatgctgggatttcccccaagacaacaaacagagcatcacctcttccattaggaactgctgtcattgccgttgtattagagatggtagagatatatcccgccattggagctaccagcctaatgtgagagcccagccatctcaccatgtcccctgaagagccgcttctccctcctgtcctcttcatttcaggaggagcccctgctgatggtgtagaccctgcttagacatccctttcctactggcccccatgtcctacactctcatgtggcctcatgggttttgactggcttttcttgtcaggtgctactgaaattgttcagttactgcgtgaaggtgaaagtcaaccggcagcaactggtcaaactggaaatgaacaccttgaacgtcatgctggggaccctaaacctggtaaggagcatggactgcaggtgaagaagagtgggccttggaagtctgggtgtgaaagacctctcagttctgggctcagatgaaatggactcacggcttcttcaagcccttcatctctctggctgactggtgcagaggcttgggtcattcagctgcccttctcctctggctggctcacctcctgcccccatgctgctgccatggcactcaagagcttccttgctcctttcctgagttcagatcagagataagaggaaggcagtcccttaaacagtctagactacacaccagtgggaaagaagtgcccctctccttggggcagcaaagctgcctgtcatcaaaagctcacacgcttgtctccctctcagaacatgcatatacacgcacatacatacacacggtcatacacacatggtctctggggagtaaggctgtgagggcatccttgagagcaattgtcctcagcagttagtggctgtggtcttattctgagagtgactgagtctccttctcctacaggcccttgtagctgaacaagaaagcaaggacagtgggggtgcagctgtggctgagcaggtgcttagcatcatggagatcattctagatgagtccaatgctgagcccctgagtgaggacaaggtgagtggggctcggcccctccatctgcaggcactgagagcctgcactgtctcattgcccacaacaggcctgtttgtgtctggcttagcccacctgagaatggcggagcctgcttaagcattggaatgttaggactcaactaatgatgacataattgtatcgaaatgtgaaatctttggattcagagcaagcacaattgctaaggatagtctttcactcaaaagctgctcgttaatggaatcctggcatgtctcagttgatagacagaggctttagtccaacctttcatttcatagttgaggaattgaatagcccacttcatttccctggacttggcatttcctcagctgtggtacatagttggttactggtggaatcaggcctagaacccagatctccaactcccagaatttctctccacctgctatgcctgtaatttcctccattcttattggtgctaatgatttggctagagctatgaccaagtgaatgtccagcagcctgcattcttttacagggagggaagattgtattggtatattttgaccacctgagacaattaacagcactgtcacagaaatttagaaacgaatttctcaagtgaaactccgactgtttgttattccccaagaagtgccgagacatagttcttctaggggtattcctgatgactctgatggaagtggtgacttttggggctcagatgttggctgcagccacagtcctgactgcattaatggcatgttcaccctcttttctgttgcagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataagtatgttactttgatttcatatagtgaaatgagagtctccactaaaacgccgaactaggtctgtgagatgaggaagaatcctctgaatacctattagatttttgtgtcctcgttctggcttttaaggagctcagtctagttgggaagtgaatagttaaaatatactgtattagagtagcaattggctagtcagagaaggcaaagtggttggtgagatgggaggaatatgacgagatggagccacgtgtgcgcaaatgtgagtgcaagagaaggctgtgagcgtgggagacatagcaggtaaacagggagagtggcaggagccggggcagataggtctttgtgtcacgttagggaatttagccttgatcttctataggctgttgacagttgttaaccaagagggtgacatgactgggttttgtcccgcctttcacaccctcaaactctgctctttcctcctagatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaagtatgaagccctcccgcagcggggctgctttgccttcgctttgccctttccttttccttctccatcagcatcttggcataaagcttcacgtgtgccccttgccctccttggggcctcccaaccgcttctggaaactatgtgggtgaccattcaaccactgcagagtcctcggggcttgccggaaaaggatggcaactttttggtttctacttagagtactcacttctttctggcttttcagctgagctgggtggttctatgtgattctttatgacactcggagagggtcacggttaatcatgccctgggggtttaaacaagccagagtcaacaactggtttctaggtagcctttgcttccctggcctgctaataagccttcctttgctttgcagtttggatgccgacatctggaaaaagtttttgtctcgcccagccttgccatttatcctaaggctgcttcggggcctggccatccagcaccctggcacccaggtgggtagccaggacaggtagtgtgagggtacaggggtacaagtataactaccctagtttaccttgagacatgacttaccctaatatatgagacttctagagtagaagtgagcctcagaagtcatctacttcatctatgtgtgctgagagaagtaagttgtatttgtgatttcctcattcaactcattcttaagtggggcttcattgtctaatgggtcacctgtgcaactgttgaactgtgagggattggctgaccagagagtaaaacacttgggtgtctggccacagtcactaggacacttatattaccatcacctctatcttctctgcctcaagcagctgaaccccttgttcttagggagtcccacccattccactccgcagctcattcctgatttctccccacagggctgagcgttaacccctcacaaatccaatcctaactggccctggatagatggccagggctgggttttttttttaaatcaaagttttaatttggagattattataaattcacatgcagttgttaagaaacaatacagagaaatcatgtgggtcctttccccactctcccccagtggtaacatcatgtggaacccgagcacacaccacaaccaggatatagacatcagtgccatcaggacgcagggcaggttcatcagcacaagggtccctcttgttggccttttgtagccacatctatcttcccctgctcccctgccacaagcccctggcacccaccgatgtgttctccatttctgtaactttggcatttcaagaatgttgtataaatgcagttgtacagaatgtaaccttttgggattgtcttttttttttttctcagcatgattttctggagtttcatccaggtttgtttaactgttcacccattaaaggacacctggattgttgccagtttttggctgttatttataaagctgccatgaacacttgtgtgcaggtttttgtgtgaatataagttttcatttttctgggataaatgcccaagagtgcagttgctgcgttgtatagtagttgcatattttgtttataagaagctgccaaactgttctctagagtagctacagcattttacattttacatttcaccggaaatgtatggctgctccagtttctctgcgtcttagccagcatttggtgactatttttagtttgaactgtttggaagatgtgcagtgattccgtgtggttctgcgttttcctagtggttcatgatgttgaacgtcttttcatgtgccctgtgtatcttcagtgaaatgtctgttcatgtcttttgcccaatttctaactggattgtttgttttttaatgttgagttttgagagtcctcagcattgcgttttttctgtttgtagtgttctgcattgaaaatagttccactgtctcatttggtaatctgtttcggtaactcattccaaaaacatggtaacttgagtacagtaaagattcttcactgtgtctcactgaaatcccttttctaaacttctgttcaactcagtggagtcataattgtatatatttgtggagatactttttcctgcataggaatttcacatgtattgttttccatatccttgtaacatctctcttttgtatatggataaatcaaggaacacggttgtgatttggccaaaggcaacacaatgagtttggaactcaaagtcagctgatttccaggcttattcttttttttttttttgagatgaagttttgctcttgtcacccaggctggagtgcagtggcatggtctcggctcactgcaacctctgcctcccgggttcaagcgattctcctgtctcagcctcccgagtagctggaactaaaggcacctgccaccacacctggccaattttttgtatttttagtagactcggggtttcaccatgttggccaggctggtctccaactcctgacctcaggtgatccgctcccctcagcctcccaaagtgctgggattacagacgtgagccattgtgtctggccatccagatttattcttagttaccaaattgaattactttctttagaataaggctttatctagttagatacttggcatttatgctatggccattcatttttcttgcaacacatcttgttgtgtagctggtcctgtgttagactgaggagacagctgtcgcctgtgcctgttgggagcttactgtctggtggaagatagagccaaatacagagtagtaactaaacagcgagatagatgcagtgtggaaggggcctcaggaaataggattgttaagtagagggcatggcacctgcaaaggttcagaggccaaagagagcttaaagccttccaagaattgaaagcagctgcagtcggaggcgaggcatggcaagagctgccgatggagatccaagcaggggaaaggcatgttctttctcccagaagaggagtgtgggttttctcctgagggcagtgccctggccatattacagagagtgaattgaagggaggtgagattggaggtaggaagaacagttgacaggcttttatcgtaattgaagtgagagaaatggcagcttaaactagttcatggatagattcaacagagattgagctgggaggaagaataaatgggatttggagagtgaccgaacgtgagaagctaagaagctgaatgaatcaagaacctgctcagtttctggaatgagtgatgaggtgaatggtggtgccactgagatggagaagatcagaggtttgcgagtaaggtggaggagagttcattagactatgctatgaatgtatggtctgtcctattaataactagaatgtaagttaaatgagagcaaggtctttgttttcccagcaccgaaaacacacatgtgcaagcatgcacacacagtaaacagccagaatgttgagtttggggtacctgtggaaaagctcagtaggagttgaaatatgggctcagcatttaggagcatgagacatgagggaataggtaatttcgctgagacacagattggaagtggacttgctgtgagaacagatttatgagctactgagtgatctgctggctgtgttattttcagcctgttgtctcatatgtaatcattgctgtcaagtcacttgtgacaggttggtgaggatttcagggatgtggtaatatttctcagtgagctcacctggagtgctttttccaactacacctgtctttagccttctgatgttctccacccccgtttatcacatagcgctatacgtagtgacttccagctttttcaggcacagaggtttcttgttaatatcttttttgttgttaaagtttttcatgtccatacctgcttgtagtcattgcacctctagtatccctagcctgagaaaactgtgctcctaggtttggtggacccaggggctcccgtggagaactcagggcaggtccttaggagaacgtccagtgcctgctctggctgctggttcaccactcagtacacatcaggtgttgctgcttgtcttaccagaatacggggatcttctcctggcccctttccacatcctctgtgatggatgctttgcatatgttatctagtttttagtcatcacagcagcccttgcactatccccattttatagatggaaatactgagcttagagcataggaattggtcagaggcagtggcagagccaaaccctcttccatttgtctgtgtctgtcaaagtgtggaatcaaaggacctgattgcagctgagcaggtgacatgagatggtgcatgctggttgagtttctaaacctttaagctcccgggaagaaggtttgtctacataattggaggcatgtgtctctctggtctcttactggcaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacggtaaagctaccacctagagtccccatatttctgcccacactgttgatgaggaggtggccatgggacagccctggggttggccatggggaaagagaaggctggacagagtaggaggaaggaactaggtgtgttcggccctctcagaggtggaactactatcgttctatcatacagatgagactcggagtaagtgacttacgaagtttaccaaaacagtaaaccagtgataatagccattaagtttattgaggacttatttaagccctcaagtagttctaggaggttgatattgttatacccattttccagatgaagtaactgaaactgagaggtgaagtaaataggccaaggcacataactaataagtggttgacacaaagggttctgtgctcttctaactgtcccaccttggaggaagcagagtcctacaagctccttttccaaagcacagacttgagtgtcagcagttgaaaagctcacctgggaacagtgaatgaatcatagtgcaacaacccttggaagctgagacttggcattgctggcacgaagatgctggcatgaagaaagggggcttttctgatggcaggtggcaccttgccagggctccagctggatgacttcctttgcttcagtggttcctgtaggaagagagaatagcagaagggcctgggtctttatccttattagaagacagctcaagggctttcctctcatgcacctgtccttttagtggaggtagaaggttagccctgttcctgagcatctccaagctagggtgggagagggtgtgtggaaatccccttgacatgccaccggggttcccctacagacaaatgaaaagggccaggtcgtgaccaagacagcactcctgaagcagatggaagagctgatcgaggagcctggcctcacgtgctgcatctgcagggagggatacaagttccaggtacagctgctgggcctacggtcggtcctgagggcccagcctgaccccttgttctaggtagcatccccctcctccaggccattttgttcttagctaggcaagatcaaggcctgcatcttaggagattaacaaaaggaccagctgtcctctttagaggcaggaaggcgagctcatccgaactttagactttgttatctttatcatcatcatgacaaatgctgctcattggattcttcctatatgtgaggcctcatgctcagagctttgtgtaaactggataattttatttaaacctgtaaaaagtctcaacttgtggttaagcaaacaaaggtcacatggcagagccagaattccagcctaggcttctcagactccagacctgggcttttaaaaacataccatgctgcctccattcagggtaactggggagaaaatcagaactttctaggcttatccaaactagattccacctgaaaggagcagagcagccagtgacctgctggctctcctgaaggctcaaaggtggcctcttctttccagctggaacttactgcttagaatacaggctgtgaaagggcaggtgcctgggccacagggctcgttagtcctgcgtaatgcaggctcttcagagctgcccagcaggttttgaaaagcaagggaatatcaagaagtcacttctgcattttcagacagatgaagcacaaagtaaagaaagatggccgaggcttgcttatgtgtatgcctctgcatctgcaccgcatccccttcttgctggttgctcccataatccttgtttcactagggctgcggccagccaagtgcttcaccaacagactgaggggctggccttacctgctcttctgaacttccctagtgagagcaacctgaaacccaaggcattgcccaagaagggcggcagttcccctctattctgcttctcctgagcctgacttggagtttctcctcccctctccttatgttgtcgtctttgcagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggtaggccctggctcttgcggaatggctccttcagtaggcctgcctgtgggcctggagcgggtgggactgccatcctcgtggttttaaatctgctccttagtctctggagagtagggtgttctgcctgacaccatataggtccccaagcagttatttgaatgataggaaaatatgctttggcctgggcccaaggctagtgagaacagccctgcctacctgagtcagcaaagccagtgtgtaccacattgaggctacaaatagcaaattctcttcgcagggtcaggagcctgggccgactgacttcttagtgttggcatgcccccacccccacccccgcccccccgcccaggtgcctggttgccacgttaatgccagcagtcgcttgtccctgctctcctccctatccaggttggctcgaggccgggaagagtgggagagtgccgccctgcagaatgccaacaccaagtgcaacgggctccttccggtctggggacctcatgtccctgaatcagcttttgccacttgcttggcaaggtgagtgttgagtatttttcatggtggaatggaggggatttgcaggggatgggacaagacccgctatcagcccaatcccctggtgacaccatttcctgttaccttccttgggaatccatgtctgtctgcttgctgactggggagctgtccagagcatacagggtgggggatggaggcttactcaaggggtgacctgacatggcccaccacagggtgggaggaaccagcacccttagcttccagggtaccagatgaaatttctgggtcttcactattcctttgctgatcttatgacagaagatgtggggccaacttggtccttgaggccagaatttctgagttcacttctacagtgtgtggctctgaggtttaaatacgaaagtggcttagtggcaggggggatgttgggctccttagaaggccttcctggtcctaaaaacccagataagaatagctaaagcatctgtgaggtcctcatgtcttgctgatgccttgtggagtggtgccccaccccaagtcctatttcaaagctcagggataaaaagatgcctgtcataaaacaggcagctggcagtgacaatggagagcatgttgaaatgcttaacctctattcttttgttttgagacagggttttgctcttgtcacccaggctggagtgcagtggcgtgatcttggctcactgcagcctccgcctcccaggttaaagcgattctcccgcctcagcctcccaagtagctggaattacaggtgcctgccaccatgcccagctaatttttgtatttttagtagagacggggttttgccatgttggccaggctggtctggaactcctgacctcaggtgatccacctgcctcggcctctcaaagtgctgggattacacgtgtgagccactgtgcccggccaggcatgtattcttgtatacattgtacagatgagatgcagagtttgagcaacttgctcgaggtcacccagttaataagaggcacagcccagatagatgggaatgtgtattgacataggaaaaacaaaagcaaaaacaaaaaacccttttatttggagattgaagagctcattcttatggacaggtcactttgtcagtcagaatggatgagttctacattgcttcctccaaaatgtactccacatgcagccacggtatgtcctacaacattagttcattaagaaatgggcgcccaagagtggtgggctctcatcaaaacttggcgagtgtcacgttcagtcactgcagaaatgaaaacgtcctatggccttgtcgtcctgctggccccagccttggcctcaactttcccttgtattcttgtctccgtttgcaaacctttgcagccatcaggcctgggagtactggaaggaggctctgtctcccaaactgggttttcaccaggaactcacttccatttcattgtttgttctgcttccctctagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacgtcagtaccctgtgtcccaggggcggcatctcgcagacccaccctgcatccctctgcccgagatcccctcagctttttcatagcctctcatgctagttccggagcaagcgtctggcctaaggcagcctttttgccgaggtggggatgctcatctgcattcttttagggccatgcagaaaaagcaataaagggaacttccttcccccaaactgccctgtctcccaccatgggcagcccaagaccgcatccttggactgacgttcagctcacaggggagcaggaagtgggaaaagtcaggccactgaagcctctacttcgatgcagcggctacttctactttccagactgttctcttgaatggggggaggccacaggtcggagctgtgcccacatcattagtcaagggcatatagattgttacaggtgatggtttcccatcaaggggatgcagcagagctgaggacccagttcataaatggaaaactggatttgttatccctgttttctctacagtgggtaatgcttctggcaagtgtgaagggaaagggaatgttcaagattatctgggaaagtcaaccgacaaggaaggcagccaggaaaaaaaagagattggtagttttatccatatgcacattatgggacagttaggttggtacctggaagtgtaattttaaagaagcacttaggccaggcacggtggctcacgcctgtcatcccagcacttgggaggccaaggtaagaggattgcttgagcccagcctaagcaacatagcaagactctgtcttaatgaaaaaaacaattgttttaaattagccaggctcacacctgtagtcccagctattcgggagactgaggtgagaggatggcttgagccaaggaggttgaggctgcagtgagtcgtgatcacaccactgcactccagcctgtgtgacagagcaagaccatgtctcaaagaaaaaaaaattaggagattgactatcctttagctcttccatttaattcactgtttcatgcttgtaggccccatctcctagcaagaggcttacggttccctgttgaaaggttgtgtacagctcaccccgggtagctgcagcacagtttaggcaacaggacaatctgtctcttgtcttttctagttctttctcttcaacaatgttatcttttccttccctcccatttccttgtgagttaaaaggctgacctcgagaccacaggcttcattgttaaaacacgcaggggcaggttgacatcagagtgcattacatcatctgctgaactgcttagactggcgggagcagcacctggcagcactgatggcgcagaccttcccactgtccaaatttcgctccttctcagtgttcctggggccctggacagagccctgggtgactaggtgtcagtatgtttctgaacaagccagacatttgtaattgtcaggtcccttcattggaaagggaattggctgtctcacagtttctttggtcagccagaggctgacccagaagcttcacagagaggccttgcttctcggcccagactgcttcccagtcgacagctatccaattgacattggtgggagcttggtcacagtggggctgagtgcctttggtggaatatttgtttatggaggcaagtatgtcacagcatggccaccgtaagccagaccagagcctgagcagatcctgcagcagccaacagcctcagattccctacagggctggaagatcaagttgaatgtatccatccatgcccatctgcaggcagcagaagcaggcagggtgtccttgcaccctctcctcctgctttcccagagtccagcatctgtgccagtgccacctatagacctggtaacttttttttcccggttctagtgttgtgtttgtccccacctctccctaccagtgccccatggagttaggatagggcatcaagcattcatggcatgagagcaccattcaggatctaaggagagagtgtacccagaagcgtgtcatcaggaaggacttaagtcacctctcagtgctgattccgtgaccttttgtcaaagcttcagcgtggagaaggaggtagggttaagatggacaggctacctggcttcagaacacagttttttccacgatgtgagacttgggcagaatccttacctcctctgtactgcagttttctgtttctttaaaattgggatagtggtggcactatcccatagcattcttgtgagtactaagtgaaataatcccgtaaagcacttagagcagtgcctggcactgagtctggtgtggtcatcatcatcatcatcattgcaacttaggacgcatgaggacaagaagcagcgctcatctggaagaggctgttctaacgaaggcgggaggatcctagatcagaagaagacaaaccggaagagggagcctaggaaaggaaccacatgcacatttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggtcagtacctgcttccggaagctgctgctcactatttcccatcatcagttttgaaaagctgcttagtggtacgcacgtgctaggtgaaggcatgctttgtgactgcggtggttgacaccagcccttctcccttctcagtctgtcatgtcaagagtctaagctgatggctggcaggttgcctggtcatttctgggttttctgttccgctactagaaaggtagagccagtcttacctactgtagaaaatgttaggaaggcagccaggcacagggtgataaaaccaatgagatgatcagggctaagaacagtaatcaggttttccacatcttgctggtgttggcataagccaggaaagtttcagtgtggccacatggggtattttctaataattaaaaactcgtcttcattctctcttcttggttacattcctatcccatgcgtcccacattccatgaacctttcttcctctagaccactctcctatacgtgtggacacctccccaagaaagagcatgtcagaaaggaagtggtctttgatttatgaccttgggctgtgatttgggacagatggtctcaagagaaacagctggaaactgccaccacagcatctctttgaggacccccatggattgctgtgcgcagaggagaccccatgggtaccactcaggctgccaatggccccacacagtctctacctttcctggggagctacggagcaggctctgggtttggcattttgcttctgtccctcgagtgaaatgtgcctctgcttcatttctggaagatcgggtttgtgatttttgtgattctgctttagcccaggattcgagggatcatgtccacatttgtaggccatccagggagcagagagaaacttttagggccgtgataaagacaagccaagtggaaaatagcctgtgccctcattggcacacctggtgtctttatttccattagccctgattgatcaagcgttgctggtctgtgggcacttcacgctcccagagagaccagattggagctgtcctgttgaatctggcctgtaccagatcatcactggagagtgggagggggcgtcttgttagattcctaggtaacccctgcccccattcctaacatatcactttccagtatttcccaagagcctgaattaatagttaactagctgctggaaatcaaaagttagatcttgagaatactaagttgataagtcaggcttggccagtatccatatgctgcatccacagcaaatagagtggccatttattgggcacagtctctccatggcgggtgtgcaatctgaacccacaggagctgttttgctctcacttaggagactagcattcattattgtcccaggcagttcaggaaaagctgatttggtcacagcttaattaggaaatccagtgtgagctactacattcatgagttgctgttttctctgtagcagtttcgtcacctttactaattggccttaaataattaagttgggcagggtcactcaggatttctgcttaccaaagcacaacagccacagcaaagggccaaatacggccgtggtccggggccgtgagcccggcactcatcaggcagactaggaaaggcactgtgggttagcccgatactgggaggagacccatgggggagagaccgcggctggaagggcgtgtagagatatcatcctgatgctggggcagcctcactggcggcaggctttgtcctaagtcctgtaagtcatggggtaaggggtagtagcagagacacagaaatgtagctcagcagaagctggcctcttctgcacacttgacattcagaaaaaaagttcctctgccaggaacttgcaagtacaaagcctgggacattctcaggcgtctgtcagaacttgatctgttatcttgtctgccagggtaaagagctgcagagaaatggattcttgtcctcatccacgggtccaccttccaggactttaggctgcagcatcatcacacgtatgcgggagagaaagtgggggcttgggaaggtactggggcagagggaggccacaggaagcatatttcagtagagagggaattgtccccatttaatattatttgttttttgcgagttatttattgaatgcaggtgtggatagcctgtctcatgctaggcagccccttcacttgaggcccatatagttttagcttctataatgaataccatctatgtttcttatttttatgattcttatatatacccatgcattttaatactaaacattttaatatatgtccctttagtcatgggatgtgttccagtgtgttttgaggtgtagaatactctgtgacaagggctcacctaggctttacttattacagatgtgatggctgttggcaaacaaaacctccgtagagcttgggtggtagaaactgaatcctgacactgatatttcactgtctgtgccgaggggagcctgatatttctgtgtttcatactggctctacctggtgtaatcattcctcaaacctcaaaccaagaattctgctgagaaggcagtggacattgttagaggcagtctccccctgcctgtcgctccccatattccaaggaactggctggtctttaatcctgaactgaatcattggattaagtagcaacgatactggttagaaacaatggggtgtggtgagcaacttggattatcccaggatttaggtgatgtcagggtggctgcatgctccatcttagacattaccattgcttgataccaacttcctagcagcttgctgccatttaacacagcacatgtttgacaagttaccgtgtttgactggtttaggtctgctggcttttaagaaatttctcctagtgggaatgtaaagactgaattaaaaccttgtttcctacctcatttattaggttccatcaaattccaagagcttgtcggggcccaaacacaagggatacataggaatcctttgcctttctttaagtcactagccttgcatttgccacgtctgccctggcgatgtctcccccggttccattttaccctgatctggaagatgagcactgagagaatcagatgaatttcatggagcatttttgtaaccaataaacttctgggtcccagggctccagaggttcttgcccacagctgcttttttccaagcagaaggctagtcgctggaactccgagatgcatacaccactgtgactcttcccttgctcccagcatgccttgctctgtccttgtgagtatcctcctagggacttcatgtgatggaactggattttcttttccaggctgacagataaggcagtgaaggactattccgcttaccgttcttcccttctcttttgggccctcgtcgatctcatttacaacatgtttaaggtaaggaggctgtcagaggcccagtgggttttggcaagagtgtaaaatgtctgcactcctgtccctgactctgcctcagcacccacatggctgctcctccgctgggcctgggggcgcttttttcctagaaacaaacaaccccaactgtgggagggattgacactggcagcctggagccttgtgtctgtgaggtacatttgttttgtttggttttgtttggtttggtttggtttggtttttttgagacggagttttgttcttgttgcccaggctggagtgcaatggcgtgatctcggctcactgcaacctctgcatcccgggttcaagtgattctcctgcctcagcctcccaagtagctgggattacaggcaggcaccaccacgcccggctaattttgtttttttagtagagatgaggtttaaccatgttggtcaggctggtctgaaactcctgacctcaggtgatccgcctgccttggcctcccaaagtgctgctattacaggcatgggccactgtgcctggcccacatttgtagctgagatcactcctgtcacctgctcccgagcctgctccagactcggctgtgcaggaagaccttccccgccgggtctctctttgctgctcttgccgtgctattgggataagctctgttgccctgagtgagtctgacttaccgcagccagcttataacaggacactcctctccggagagaatctgagtttttgagttggttcctttcatcatcggaatgagacagctcatggaagcacattgacaagtccctttgctctggggaatgcgaatgggaagtgtacggggagggaatgcagccacttgttggagcctgtagcttcaggtgacacagtgcctaataaggagggcctaagaggaatgaagtgaaattgtgtcgttcctggagacaaaacgcacgctctagggtgcctgttggtatgctttggtgtaggttgggagggctgtcctttgaggggttgaaatggcctgactgacttgaggcggaagatgaggcagcagtaagtcacccacctctcttgtctcctgttgattctcgtagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggttagtgtcaaggttttctcttttaaagatcctccgcagcaaagccccatgtcttcctccgtgggtcatccgtagctttatcttcacgaccagaggaaacgcagtatgaaccagcctgtcagctgccactgaaagccctgggaaagatgcgtaaatagcaagtcaccgataacgagaacagcagctctaacatgtactgagcaccccctctttccccgacatgggctgttcactgtatgtgatctcagccctcgaggcagccctatatgaggcaggagctttggttatccccattttatagatggggtaaatgaggctctgaagatcaaataagtggccaagggaacatagctagaaagtgatagcatccctgtttgagtctgttttttaatggcagttcagagaattaacatgcaaattggaatgcccctgtcttcctcctgcgtcttaggtcacagttgaccccagggaggcatgggcgacccagcagggccgctctgaactgtgggtgtgggagacgtggtcagacaattccttatcctactgctagtaaaattgaaattctttgtgtaacaaatttgtcattctaattgcaaacaaacacattagaattggtttgtatttcataaccaagcaccaagtgacagcagggggaggtgacttggcccgtgcctgggaaatccacctagggttaaaagacagtgccctgtgaggttgtgggcgccgcggcattacagcccccatcagagcacccgccctacaaaggtcagctccccagagccaacgcacaggtaaccaaacctgccagctcttttttatgatcttgtttcatttttttatggcattcgttgtgggaattttgtaaagtataaagaagcaggaaaacaaactccccccagatcccactgttaggagaacgcctctgctaacattttctctatcttgttatcctctgggaatgagacccactaaagggctagagtgttgctcagtgtgaattcctctttcttcccagctcagagccagctgaccgattttcccaaacagctctgtgcctccgcattggctgccccttgcagtgtcctcagcggaagctctgtgctgggatggtcttcgtcgacctggtgcctgcctccgcgtctgggcgggcctgtgctaacactgctcacctctgtgtgtttgttaactccaccacctctttacggctcccactggctctgtttcagcctagatgtttcaccagcatcataccttagcacatgcctcgcgttcttcccagaaagtcagccctgggaccaggtgggctggtaaagtcctcagtgctgggccctgtgcctgttgcatgagcctgtgtcactgtgactgtggaagttggagctagtgagaggaggaggaggtgggcagaggaaggagggtcccttgggctcgagctccacatcagccctgagctgctggcaagcacccctggcctgcagccagggagagccagagcctttgccaggcagcgagcctccgtgccttccactcctaggtcaggttttgacagcaccactttattactttgtttaagctgttagaaaatttcagaacatcagacacaccctattcaaatgtgagaacaaaaacaccttccagcagtgcctgcttctggaacaggactcctcctgcggaacagggttttgctcaatgactacctccccggtcatgctgctgtccagtgagcagccgggccagagcttgtcggaccgcagtgtgttctctgctagatgcggcagctgtgactcagggggaatgggggctgtatgcctgctcctgacacacctctgcccgttgtgctttgcaggtcttttatcagaaatcaccgatccagagagcttcctgaaggacctgttgaactcagtcccctga

SEQ ID NO: 37578 - DNA, 70621 bp, Homo sapiens
gacctcccacaactggagcagccgggaacagctctgaccacagtaagtcatcccaaaacctcacattcagatgaaaccatttaagaatttcatctgcactgaggaacaatttagcgtgatactggagggaaagagtttccctgtgagatccaggaggtccctttagctcgtctcctgacgtcaccacagtcatacccaagaggaaggaaacgtcagagacaatgatttggagaacattctacacaaaaaccaagtatgaaacaatgacgatttcatgatggctcattgttctttggtattgtgccttacgtgagctggggactaactctgtatccttaaggaggcatcacttgattagagttgcccaaaagaatgtgggttattatcctaaaggtctgtgttgccatcctgaaacagtcagaaatcagtttttatttcacttaggtggttccggggagaagcctttccaggacccatgtgtaggcacaactgttttccctgatcaggatacttgcggcactcaagtgagtctagaattatcagattttgttctgtctctcttcactgtgaattctattctttatttcctttaaaacaaaaagctcctgctattttctcctataattatgatatctgtttcttgatcattttaccttctattcaccaattaattgaaatccaacccatcaggattatctaccctgctttcctatagggagaataaaaagtgcttagaagcagtatgattttcactgcctttaatttctcaaatcccaagatgttccatttaaaatctttagagtatctattttgtcttctgtacattatggttgtattccctcagaggccgagtatattttatcttagttttcagagatcactaaagtcaagtaaatgaaggaaaacagaattcattttcattatgggaaaacaaaatcaatccctaagtagtcaaaagattacttacttaaggaaccacctggttaacttcttctcctagaacttaatcccctaactaggggtaaaaaaggctcattgtcatcttataaagtattagataccagggacttgtcaaatgctaatgcctttattatagaatgtttaatttagaccttcctaaacagttttgctttcttccgtcatttgtctgtgatggaacctcaaagacactaactagtatgcgagacagatttgtgttggaacattgtgttagctttccagtagagttaaaactctggaatgcaattataaacctccaaatgaaaaataccggccgggcacagtggctcacacctataatcccagcactttgggaggctgaggtgggaggatcacttgggcctaggagtttaaggtcagcctaggcaacatagtgagaccctgtctctacaaaatatagaaaaaagtagccagttatggcagaatgcatctgtaattccagggactcaggaggctgaggtgagaggattccttgagctggggaggtcaagactgcagtgagccatgactgtgccactgcactccagcctgggtgacagagtgggaccctatcacgaaaaaaaaaaaagaaaaatacctaagtggccaaataccttataaagttcatgcatgctactctacaggaaatatcctcagctgtcttctctgtgctgagttcatatactcttgtgcctagttcatacatgcttggtcatctgccttccaaagcacacagcaaaccagatgatgagagcagctgacaagtggagacagttgtcattttatgttggcagctacaataaatgacactgtctgatggagaaaatgagcggggaaaacacttccaaaacacaggcagaaatataagagttgaaatcccagagttccagaacaatttcacctcagggcaagcaagcctaagtggcctgtgtatccaccactctaccacaacccagtgacataaccgacttgatggtcctcagacgccggagctgggaggatcccctagggtgctgcccaactcgccccaatttacagatgaggaaatggaggcctcaggaagcattgacagcccagttcaggatcacagctagttaagggggaagctgcaactacagtcaggatcccctcatcccaagggccaacttctatcctatacgccccactctggaaaggtgaaaaataattcagcattttggccaggcgcagtggctcatgcctgtaatcccagcactttgggaggccaaggcaggcggatcacaaggtcaggagaccaagaccttcctggcttaacacggtgaaaccccgtctctactaaaaatacaaaaaattagccgggcgtggtggcgggcacctgtggtcccagctactctggaggctgaggcgagacaatggcgtgaacccgggaggtggagcttgcagtgagccaagatcgcgccactgcactccagcctgggcgacagtgcgagactccgtgtcaaaaaaaaaaaaacgaacaaaaaaagtaaaaaataaaaataataataattcagtgtttcaaaaggtttcaaaaggccagtaaggaattaatacatgtttaaagaattttcttgacaaaatggttgaaggctcattggttacatttgagaattaaataagataaagcatagaaggttatccctcaaacacagaaagaaatcaaaatgttgtcagttattattataacttaaaaatctgatatataaaaaagtgcttttttacagaagtcagaagaaagtaggttgagcatttttaatactaatcttttaaatacctttgctctgccagaaaattaattttcataaagcaatacattgttggatctcacccttaggaaggtcttccctgggcaccctattttaacagtaccccatcacctctagctctttactttgatttcgtatgctttataacctattaccatatgaaactaaagatatgtataaaatcttttctctaaagcttctcctaaagttcacagctaaaatactatgattttcttctggtttttaaatagtcctcttgttagaaaagatttagcccttatcctcaatctcacagccactaaatagtcaattcacacaagccaagtgatttgtaaaataggagtctctgcaaactgagtccaaccagcttgaataatagcatcataacataatgggatccctttctggtggtagtgtccgggaccaaataccaaaattcctattttaagctgtattaagattttctaaatgtagctatgtttcaagagaaaatgcttggtctatggatagctgaagccatgtaaaacaagcattcttatcacatgggtccaatatcgctgattttacatggcagatagaccttaaaacgcattcctacttttcccactccctcccacattctttaaaagggtagggtttattatctctctgaatactcaaatgaaaacttaagtgtataaacaaaactagaaaaatccttagattaagatgggaggaagatggtcttttgacctcttaatattagtttgatctaacatctttttttttttctattttttgagactgagtctcattttgttgcccaggctggagtgcagtggcgtgatctcagctcactgcagcctccacctcccaggttcaagcgattctcccacctcagcctcctgagtagctgggactacaggcctgcgccaccatacctggctaattttttttttgtattttttgtagagacaaggtttcaccatgttggccaggctggtctcgaactccgacctcaggtgatccacctacctcccaaagtcctgggattacaggcatgagccaccgcactcagcctgatctaagttctttaaatgatcattccatattgttaaacaatgtttctaagtgagaggtagagaattatattagttggtaggaggcctaaatgcttgaagacaatttagagaaaactagttatttccttggcacaaagtaaatcctactactcctgaagtataagaaaaaataaaaataaaaacaataaaaataaacaattctttgatcaaataatttttttaattgacttgttctgatcattagggcctacttgttcagcccactatccttacatgcattagtggattccttctcttttttatctctgaagatttcagaagtagatcagtggattccttaaatgttaaagaaaccctgtcttctgtaatcccagctactctagaggccgagacagcagaatcgcttgaacccatgaggtggagattgcagtgagccgagatcgcaccactgcactccagcctgggtgacagagtgagacagaatgagactctgtctcagaaaaaaaagtaaagaaagaaacccttgcaatcagaaagaaaaagagaattacaacttaaagtgactaatgttaaatatactattatatttggactatatataaactagaaacctccagggcctggcctcaggtggagttgtcttgcagctgattgcttggctctcttctctcttcccaacctgatgtcatccacttccacaactttaaatgccatgaaagtgatggcttgccatttccagccctgccctcttcctgggctccattgtccctctatcctcagccacgtggctgtttcctgtgtcccacaaaagtgccacgaaggaaacccagctcttctctccagaccttaccccaaacacctccttctcatcttaatagcatcatcagttgctcagtcacaaaacctgggcattcttgatctctcccgacctcacccccaccatcgggagaggactcatcaagaaattccagaagcttaagtgtcagggactctcctttgctcaggaccctctatctcattttgtgttaccccattgcagggtcctctatctcattttgtgtttagtttttatttttcttatggaaggccctcaaactgtatgatttaggcctcacaaaccttggatcggcctctgcaccctctgtccagctcatttccaaaagaaaactatctcaaaaaaaaaaaagaaagaaagagaaaagaaaaccatctaaaaccgaccacacaacagtgaacactgttgattgctaccacctcagtccaagccccatcccaccccaccccacactgcagccaagatgatctttgaaagttgaaagcttctcaggtcagatctctttcttaaccctccactagattcccctttcccctaggacaagtcacactacaagaggcaggacacggtggctcacacctgtaaccccagcactttgggaggctgaggcaggtagatcacctgaggtcaggagttcaagaccagcctggccaacatggtgaaacctcgtctctactaaaaatacaaaaattagccagacgtggtggcgggcacctgtaatcccagctactcgggaggctgaggcaagagaattgcttgaacctaggaggcagaggttgaagtgaactaagatcacgccactgcactccagcctgggtgacacagcaagactgtgtctcaaaaaaaaaaaaagagagagaacaagtcacactacagaaccatcacaatgccctagtagcagaacatgctgctgaactatcagggtgccctgggtgatctggcctctgctggcctctcaaccctctcagctttagctatccccttctttcctttctggaataccccaacttgtttttgcctctgtccttcgtattgtcacctctgcttgagagagcctcctccatttctttatttgcctcatctttcattgtcacctcctctcaaaagactgtcccggcagggcacggtggctcacgcctataatcccagcactttgggaggccgaggcgggtgggtcacaaagtcagaagttcaagaccagcctggccaacatggtgaaaccccgtctctactaaaatacaaaaaacaaaaattaaccgggtgtggtggcgggcgcctatagtcccagctacttaggaggctgagccaggagaattgcttgaacccgggaggcgtaggttgcagtgagcctagatagcgccactgcactccagccggggtgacggactgggactctgtctcaaagaaaagaaagactgtgtccctagggtatgaccccactccaaatccagtcattcgtgatcccattatcttcttttttcacctataactgtatgcaagtatcttatcagtttacttgtttattatctgaattctttcaaaagagctaagctccctgaaggtgggaaccctgtccgcatgctcaccgtggaatccccacagcctagcagcacctcccacagaggggtgcctaatatttttctaaacaaatgaatgaagaaaatgttcattaaacaaatactactgcagttaaatgtggcatcaagcagtactacacataggatgcatggaattgaagcctatgaaccattataaggtccctttcatttgttcctcattaactgtggatgactaaaaatccatgctgccaatagctccaactatgagatgcagatcgatgtcacaattcagactccattatgtatgtcctcacaatgcaggaggtgaaatgtgtatgtcatgtgtccaaattgtaagatacttgctgtaagtagcaaaaagatgggaaggaaagtctacagaccaaatcatatctgaatctccccattctccctctccacaaatattggtttaggaattctccgaagtttgaaggttatgaatggttatcactcaaggattcagaactaaggtaaaaatactgtgaatgatagggggaaaaaatcactaattgaggtctaaatcaatatccttcagctctctaaggaaatgtatttttaatataatagctttattgagacattcatacaccataaagtccaaattttactttttattttatttatttggttttttttttttttgagatggagtttcacccttgtcacccaggctggagtgcaatggcatgatctcggctcactgcaacctccacctcctgggttcaagcaattctcctgcctcagcctcttgagtagctgggattacagtcgcgcaccactacgcccagctaacttttgtactttcagtagagacagcgtttcaccatgttggtcaagctggtctcgaactcctgacctcaggtgatccactcgcctgagcctcccaaagtgctgggattacaggcatgagccacctcacccagcctaaagttcaaccttctaaagtgtacaatggagtgtttagtatattcagtgggctgcacattcatcactatcaccctttcctcaccctaaaagaaaactccatacctgctagcactcactgattcccctacccaccccatgcccaggcacatggcaagcaccaatctactgtctatggatgtgctgattctggacatttcccataagtgggaccaaaaaaatgtgtggtctttttgtctgatttccttcaggcagtctaatgagtttaaggttcactcatgttgttacatgtatcattactttattcttttattgcgaagtaatatttccttgtatagttagaagacattttgtttatccattcaccagtggatggacagttgaattgtttccactttttggctgtggtgaataatgttgccatgaacattcatgtacaagtttttgtgtcaacatatgttgtcttttctcttgcacatatacctaggagtgaaattactgagtcaaatggtaactcaggctggagtgcaatggcacgatctcggctcaacgcaacctctgcctcccaggttcaagtgattctcatgcctcagcctctcgagtaactggaattacaggcatgcgtcaccacacccagcttattcagactgttttccaaattggctgtaacattttatgttcctattagcaaagtatgagcgtttgaatttctccacattcttgtcaacacttgctgttgccttttttattaaagccattttattgggtatgaagtggtaacttacattgtggttttgatttgcatttctctaatgatgaatgatgttgcacatcttttcatgtgcttattggccatttgtatattttctctggagaaatgtctattcaaatgttttacccatttttttaattgggttgtctttttttaattgagagtagggctttttaaatattctggatataagtcccttataagacatatgatttgtggccaggcgcagtggctcacacctgtaatcccagcactttgggagaccaaagtgagtggatcacttgaggtcaggagttcaagaccagcctggccaacacggcaaaaccccatctctactaaaaatacaaaaattagctgggcgtgggggcgcacacctgtaatcccagctaatctggaggctgaggcaggagaatcacttgaacctgggaggcagagcctgcagtgagctgagatcatgccaatgcattccagcctgggtgacagagtgagactttgtctcaaaaaatatacattatttgcatatattttctcccattctatgagttgtcttttctctttcttgatggtgtccttaaaagcacaaaggttttaattttgtgaagttcaatgtatccatttttctcttctgccttttgtgattttgatgtcatagctaaaaaatgattgcctaccccaaagcgatgaagatttagtcctatattttcttgtaagaattttatagttttagctcttacatttagtctatgatccactttgaagtttttatgacgtgaagtatgggtccagcttcattctaacgcatgtggatatcaagttgtaccggcaacaatctttccacagtgaacagtcatggctcctatattagccagggtcctcaagagaaaatgaaccaataagaaatagatggatgggcacagtggctcacacctgtaatcccagcactttggggggcccaggcaggcagatcacttgaggtcaggagttcgagaccagcctggccaacatggtgaaacccctgtctctattaaaaatacaaaaaattagctgggtatggtgaggcacatccgtagtcccagctgctcaggaggctgaggcacaagaatcacttgagcctgggaggcagaggttgcagtgagccaagattgtgccactgcactccagcctgggtgacagagtgaaactgtctcaaaaaaaaaaaaaaggtagatagatagatttattttaaggaatctgctacataattatgagagatggaaagttcaaatcctgcagggcaggctagcaggctggaaattcaggtttgagttgatgttgtagtcttgagtttgaaatctgaagggcaaaccagcaggtggagattcgggcaaggtttctgtgctgtggtcttgtagcagaattgtttcttcccccagaaacctccatctttgctattaaggccttcaactgattagatgaagcccacccaccttgtggagggtaatttgctttagttaaagtcaactgattataaatgttaaattgtatccacagatactttcccagcaacatctagactgctgtttgaccaaacaacggggctccaacagcctagccaagtgaaacataaaactaaccatcacagtatccttgtcaaaaatcagtctgacaacacatgtaaggtttatttctggagtcactattcaattccattgatctatatgtctgtccttatgccggtaacacttgtgtcttaattattatagcttttttttttttttttgagacggagtctagctctgtcaccaggctagagtgcagtggtggaatctcagctcactgcaatctccgcctcctgggttcaagcaattcccttgcctcagcctcccaagtagctgggactacaggcatgcaccctcacgcccggctaattttttgtattttagtacagatggggtttcaccatgttggccaggatggtctcgatcttctgacctcatgatctgcccgcctcagcctcccaaaatgctaggattataggtgtgagccactgcacccggccattattacagctttatagtaagccttgaattcagcaactgttaatcctttgaattttgtttttttcgactgctttggttactcagagtctcttgcaactctagatgaatttttagaatcagtttgtccaatttacactcccaccaacagtgtaaaagcattcctatttctccacagcctcgccagcatctgttgtttcctgactttttaatgatcaccattctaactggcatgagatgatatctcattgtggttttgatttgcatttctctaatgaccagtgaggatgagctttttttcatatgtttgttggcaacataaatgtcttcttttgagaagtgtctgttcatatcttttgcctactttttgatggggttgtttttttcttgtaaatttgtttaagttatttgtagattctggacattagccctctgtcagatggatagattgcaaaaattttctcccattctgtaggctgcctgttcattctgatgacagtttcttttgctgtgcagaagctctttagtttaattagatcctatttgtcaattttggcttttgttgcaattgcttttggtgttttagtcatgaagtcattgcccatgcctatgtcctaaatgatattgcctaggttttcttctagggttttcatgattttaagttttacatttaagtctttaatccatcttgagttaatttttgtataaggtgtaaggaatgggtccagtttgtgttttctgcatatgactagccagttttcccagcaccatttctttctttttttttttttttttttttggagaatgagtctcgctctgtcacccaggctggagtgcagtggcgcgatctcggctcactgcaagctccgcctcccgggttcatgccattctcctgccgagtagctgggactataggcacctgccaccacacccagctaatttttttttgtatttttacaaaaaaaagtagagacggggtttcaccgtgttagccaggatggtctcgatctcctgacctcatgacccgcccgcctcagcctcccaaagtgctgggattacaggcgtgagccaccgcgcccggcctcccagcaccatttcttatatagggacagtgtggcgattcctcaaggatctagaaccacaaataccatttgacccagcaatcccattactgagtatatacccaaaggattataaatcattctactgtaaagacacatgcacacgtatgtttattgcagcactatttacaatagcaaagacttggaaccaaccaaatgcccatcaatgatagactggataaagaaaatgtggcacacgtataccattgaatactatgcagccataaaaaagaatgagttcatgtcctttgcagggacatggatgaagctggaagccatcattctcagcaaactaacacaggaacagaaaaccaaacaccacatgttctcactcataagtgggagttggacaatgagaacacatggacacaggaaggggaacatcacacaccagggcctgtcggggggtgggggacaagggaagggagagcattaggacaaatacttaatgcatgcagggcttaaaacctagatgatgggttggtaggtgcagcaaaccaccatggcacatgtatacctatgtaacaaacctgcacgttctgcacatgtatatcgaaactgaaaaattaaaaaaaaatcagcttgtccatatctgaaaaacaaaggcaattggaattttaattgggattaccttgaatctatagattaagggagggaggtatcaccatcttaataatattaaatctcccaatccatgcgtatagactgtgtttccatttatttagatcttctttaatttcttccaacaatgttttataattttcagcatacaagttctacagttctgtgaaagttactattactttgttactgagtcttattcttttttgatgctattgtaaataaaactgtgttcttaatttcattttcagattgtttattgctagtgtatggaattacaattgatttttatatattgatcttgtctcctgcaaccttgctgaacttgttttgtttgttctaatagtttgtgtgtgtgtgtgtgtgtgtgtgtgtgtgtgcttgtgtgaattccttaggattttgtctatacgaaatcatgtcacttgtgaatagagatagaatttccaggccgggcacggtggctcacgcctgtaatcccagcactttggggcggccgaggcaggcggatcatgagatcatgacagagatcaaaaccagcctggccaacatggtgaaaccccatctctactaaaaatacaaaaattagctgggtgtggtggcttgtgccttaatcccagctactcaggaggctgaggcaggagaatcgcttgaaccagggagatggaagttgcagtaagccgagatctgcactccagcctgggtgacagagcaaggccccctctcaaaaaaaaaaaaaaaaaaaaaatagaacttccagtaaaatattgagtaaaaatggtgacaatagacattcttgtcttgatctcagggagaaaacatccaatttttctcaactaaatatgatgttaactgtgagtctgtcacagatggcttttatgaagttgaggaaattcctctttattcctagtttgttgagcgttttaataatgaaaagggattggattctgtgaaaagcttatcctgcatcaattgagatgctcatatagtttttacgctttattaatatggtatattacattgattttcatatgttatgccaacctttcattcctgggataaatttcacttaatcatggtagataatcctctctatatgttgtttaattcagtttgctagtattttgtttataatttttgtgtcgatattggtctatagttttttttgtttttggcagcagggcacaactggccttataaaatgattcattacgtgttcactctgcttctattttctgacaaagtttgagtaggaatggtgttaattgctttttaaatgtttggtaaaattcaccagtaaagtcatctggtctgggatttttctttgtgacttttaaaattactaattcagctgggcgcagtggctcacgcctgtagtcaaagcactttgagaggccgagggaggtggatcacttgaggtcaggagttcaagaccaacctgactacagtgaaaccacatctctactaaaaacacaaaaattagccgggtgtggtggtgtgtgcctatagtcccagctacttgggaggctgaggcaggagaattgcttgaaccagggaggcggaggttgcagtgagctaagatcacgccactgcactccagcctgggtgacagagcaagactctgtctcaaaaaataataaaataaaataaaataactaattcaatagttttacttgctgtagatctattcatattttctatttcttcgtgaatcacttttgatttgcgtttttctagaaatgtgtccatttcctctaggttatctaatttgttagcacacaattgggtacagtattctaattctttttatttctgaaagctgggtagtgatgtctcctctttcattcctgattttagtatttgagtctcctcttttttttcctggtcagtacagccaaaagtttgtgaattttgttgatcttctcaaagaaacaattttgggttatttttattttctcttttttaattttctatttcatttatttccttttagtcttctttctctttttcttcctttctctttctttcttgctttctttctttcagcttgttgtggatttagtttgcccttctttctttagtatctaaggaagtaggttattgatttcttcttttctaattgataaggacagctctaagtgtccctatgagcattgctatcactgctatcccataaattttggtatcttatatttttgttttcattcatctgaaagtattttctgtttgtttgtttgtttgtttgtttgagtctcgctctgtcgcccaggctggagtgcagtggctcgatctcagctcactgcaagctccgcctcccgggttcatgccattctcctgcctcagcctcccaagtagctgggactacaggtgcccaccaccacgcccggctaattttttgtatttttagcagagacggcgtttcaccatgttagccaggatggtcttgatctcctgaccttgtgatccgcccacctcggcctcccaatatgctgggattacaggcatgagccaccgcacccggctcaaagtattttctaatttctcttgtgatttttttcaatatagagaaggggtctcactctgtctgtcacccaggttggaatgcagtggtgcgatcattgctcactgtaactttgaattcctgggctcaaaggatcctcccacctcagccttccaaagcactgtgattagagacatgaggcaccgtgccaagccatcttgtgatttcttctttgacgcacttgttatttaggagtatgcagtttaatctcttgtgaatttctcaaatttccttttgttcttgatttctaattttattctgttgtggtcagagaacatactttgttggtttcaatcctttaaaattgactgaagcttgttttacagcctaacatatggtctatcctggagaatgttccatattcacttgaggaaaatgtttactctgctgcttttgggtggagtgtcttacacttgtcttgtaggtgtagttggtttatcttattctttgtcttccatttattattgatctatctagttatcctatccgttactgaaaggtgggaacagaagtctcaaactatttttgttgaattatctatttctcccttaattctgtcaggttttgctttatgtattttggtgctgttaggcacatgtgtttaaaactgttctatcttcctgattgaattttttattataaaaatgtcctctttatctctaatgacattttttgtcttaaaatctattttgtctaaaattaagagagccattccacctgcttttgtttttttgtctttttgagatggagtcttgctccgtcacccaggctggagtgcagtggcaccatctcggctcattacagcctctgcctcccaggttcaaacagttctcgtatctcagcctcccaggtaacagagtacagccgcctgccactacacccagctaacatttgtatttttagtagagacggggtttcaccatgtttgccaggctggtcttgaactcccgacctcaagtgatccacccaccctggcctcccaaagtgctgggattacaggcgcctgccactacgcctagctaaagtttgtatttttagtaaaaacgggttttctctatgttggccaggctgcgtatctgcttttgaatactgtttgcatggtgtgtctttttctatccttttactttcaacctatttgtgttctaagaaaaatcatttaacttagaaatgaaatctttctgctaagtatatatatatatatatatatattttttttttttttttttttttttgatacgtagtctcgctctgtcacccaggctggtgagcagtggcgcgatctcagctcaccgcaagctctgcctcccaggttcacaccattctcctgcttcagcctcccgagtagctgggactacaggtgcccaccaccacgcccagctaatttttttgtatttttagtagagacggggttttaccgtgttagccaggatggtctccatctcctgacctcgtgatccgcctgccttggcctcccaaagtgctgggattataggcgtgagccactgcacccggcctctgctaagtatatttttatttcaggtattaaaatgcaacaaatgatttttaaaaatccatttaccacttttaaatgaaaacaacatcaagaaaaggtatttttattttctccaactcttaaccagtctttgatttaactgataaggatttattcttcaaaatcagatgtgatttttaagaatatcatcttcaaaattaagtaccatctaatggtccaccattctgtttctgtcaaatcagcagaggaaagaaattcctaagggaacactgctcagaaagtactgcagcatgtcttcaaatgcctgaggatcaagttggaaaactagaagcaacagaaaacacaataaggtaactgatttcacctggggaaaagtcacttcctgttttgttttttttaaaagagacaaggtctcgccatgttgcccaggctggtctcgaactcctggtctcaggcaatcctcccacctcagcctcccaaagtgctgggattacaggcgtgagccatcacacccagccaaaagtcacttcctaaatgtcaatgtacaaagtatgtaggacacctatgtgtagctagttggctattttattctccagcaaagcactgcccaatcgaaatataatatgagccacaaatacaaatcacatatgcaattttaaaatttctagtagccatatttttaacaagtaaaaaaaagtgaaattaatacatttaacaatagtttatcaataaatataactattttatttaacacaatatattaacatttctacatgtgaccaatataaaattgttattcttaatttcctactaagtctttgaaatttactgtgtattttacacttaaaatatatctcaggccaggctcagtggctcacgcctgtaatcccagcactttgggaggccgaggcgggtggatcacgaggtcaggagttcgagacaagcctggccaagatggtgaaaccccgtctctactaaaaataaaaaaaaattagccgggcatggtggcgggcgcctgtaatcccagctacttggggggctgaggcaggagaatcgcttgaacccgggaggcagaggttgcagtgagctgaaatcgtgccactgcactccagcctgggcgacagagtgggactccgtcgcaaaaaaaaagaaaaaagcatacctcagttcaaacacgccatatttcaattggtcaacagtcataatggctagtggctaccataatgagcattgcaactgtagcattgaaagccagaaatagcctttaatagctctgtgataatcaaatcaaacttgatttttttcttaaccacaattatgatgcattcctgtaacatgaccacttatataatgagaatataaaaatgcaatagtctaacaggtagatgtccaatcaaaattaaagttacaaattttagaggttgcaatctgtattagcaatcacagccactatctattaagcatttactctgtgcccggcactactgccaggtattttaatcagtagtaaaaaatacttctattacacccatttcagagaagaagaaactgggcttgagacaggttaccttgggcaagatcacacagcatgtaggctgtgaagctatcatttgaacttgcacattggccggctctggagcctctgctcccagcctccctaaaatgagtccctccatctgcagatatccactgaatctcaaatataaaactaagaaagggcgcaaaagaaaacaatcaagtcaaaatttccctgcctgtgttccattccacaatttactgagggcctattgtgcacagtgtccttcaggattgttagggtcccacttgcccctggctgaggtgcactgactgtatgtaacagactgcttcagagcaggaacttgaaagttttgataaaaagcagttgaaaaaaatgtgaatatttcagcatattttcaataatttttcaaccattcaaactttttttgctggctcttatctaggcaacagaaaacatcagtattagagtcagaaatcttacttatcagccaagtgtctattgaatatctgtaatccattccatacactatttcactctgcacaattgggagactaatagaaaatacgcaagtagattttatataaacacaaatgtgatgcacatgactatgcatcagctgcagccttaagagtaattacttgtttaaggccaggcgcggtggctcaagcctgtaaccccagcactttgggaggccgaggtaggaggatcgcttgagcccaggagttcaagactgtcctgggcaatatagcaagaccccatctctaaaaaaacaaacaaaaagagtaattacttgtttaaggtcacatttaactcccaaatccatcttactaataaaagagataattattgagtatctacttatgcagacaccatactatgtgaatttacatatattatcctaactttcaaaacactcctatgaagaactatcattccaattttacagatgagaaaacaaagccagcattctttttcattgtaccaggttaattattaacaaaaataataatgccatcagcttacattggtgtagttacagattataacactttgatttataccatctaaattgaccctcataataaattgtgatatcaagagcatagcgcttacaactaccaagataaggagtcatagagacccgagacaacttaaaacaaaattagattattcacttgggagaatcttatgttatttgcattcagcactctgcaaaccagaaagggcagacaaaaccaaattctatcccagctgagaaaagctttcacagaggtcttacaagcctaacttctccaaccttctcccacttccagaacactcccatcaacatgggagcccataaaactaagagcagtagtgggagagattctgatgctctctagttaaggagcctggtctcctgcagtattacaaataggtcatgcccaggctgtgcagtacttcctaacagcaaaaatcctaaactacctagatttcaagtagcagttgagagagactttgttttctttcccccaacctcacccttttcgtaaagggttgcaaatgctccaagcaaatttgcctccagcacttaatggaagtagtgccaagtctaataaactgcaagggaaaggagctggccattcacaagataaaccactaagtacattacttcggggcagttttgtttttgtttttttattttaatgcggccaaagcaatggcagcgaatacggagtaagcaaaactcaaagttttctatccttgcatttttacttccaattataagttaatgctagaagaacttttatgattaataatatactttttattatccccattttatagatgagaaattgaggcttagcgacattaagcactcaaggttacacagctagtaagagactaaagatacaaatcccctagactcaagttcaaggctctttaccttccaccatttgatctccttgggaaataaataaatctataatcctgcaggctgtttttatggaatatcttagttattttcttttatcttcttttttttttttttttttttttgagagggagtctcactctgtcacccatgctgtagtgcagtggcatgatactggctcactgcaacctccgtctcctgggttcaagcgattctcctgcctcagcctccagagtagctgggattacaggcatgcgccaccatacccagctgattttttttttgtatttctagtagagacggggtctcgccctgttggccaggctggtctcaaactcctgacctcaggggatccacccgcctcccaaagtgctaggattacaggcgtgagccactgcacccagcccctgagttattttcttataagaaaatgatactcttataaacaataaggacactgtctatgggaaatgggcttctaagtgcagtaaacttcccagaaggctgagcattataaactcttcaaaatggcaagcctgctaccgaaaatacagtccccacttaggaggttttctggacaccagaaccagtctccattgtcaggacatctgctatctaccccaagtttactggaatttctcccattttgggtggcggggtggtctcttcattcattaaccttaaaattcttctccttcccttttgattggatatttaaaatgttaaaataaggctgggctgtgatttcgtgttctagcagttgatgtcaccactaatacaaaattgttttgtttttagcctgcctgaaataatcttaggtttacgctttgcctcgttaaaaaacaagctcctagccgggtgtggtggcggaggcctgtaatcctagcactttgggaggccaaagtgggaggatcgcccgaactcaggagtttgagaccagcctgggtaacaggaagaccccatctctaccaaaactggaaacattagccaggtgtggtggcttgtgcctgcagaccagctagttggaagggctgaggtgggaggatcgctggagcccaagaagtggcggctgcagtgagatcacaccactgctctccaccctgggcaacagagtgagactctgtctcaaaataataataataacaataataataatagtaacaaatatctgcaaacttgattggaatttctattatttagtaactattaagcaaatatatgtaacctacagactcattgccaatagaaacacatatcgcaacaggtgttaaaaagtaactggagatcgggccatgccctaagcagcctctaagcaatttatcatatttcactgttaacctagtcatttgaatgagttgtttttgtctgaaattctttttttttttttttgagacggagtcttgctctatcacccaggctggagtgcaatggcacgatctcggctcactgtaacctccacctcccaggttcaagtgattctcctgcctcagcctcccgagtagctgggattacaggcgcccaccaccaccacacctggctaatttttgtatttttagtaaagacgggctttcaccatgttggccaggctcgtctcgaactcctgacctcaggtgatccgcccacctcggccccccaaagtgctgggattacaggcgtgagccaccttgcccggcctgtaattcttaaaaccttaataaccttggctgatgatgaaacctcctcagaatccagataccccaacgacccacaaaaaaaaaaaaaaatcaaaatcaaacaaaaaaaagctgccccaaagtaatgtgcatagtggtttgtctagaagaaataacgtggcataagaatgaaaacttgtcacatctaagaaatataaattcaacaaagataggtctgcagacctcctgtagagaacccatcattgtcatggcccaaaactttctaagagaattttctctaggaaccaattagaatcctttagaaaaaaatcttggctggccatcccaattgcacgtggatcccagggctcagcccagattctaaacacagtggccaagatttaaaatcattcaccaaagagcaaatgttttgactttcaaagagcagaactgcagcagaatagccaacaggaaattaaattccctaagttaaatactatgtactgccagcggtgtagaactactcttccatctcacccagtatgaaacctcctcactagagatgtagtgtccctttggggcagaaatgaattgtttttgtagctgggcgcagtggctcatgcctgtaatcctagcactttgggaggccgaggcggggggagggcggggggggctggtatcgcctgaggtcaggagttcgagaccaactgggccaacttggtgaaaccccgtttctactaaaaatacaaaaaagttagctgggcatggtggaacatgcctgtaatcccaggtatttgggaggctgaggcatgagaattgtttgaacccgggaggcagaggttgcactaaaccgagatcgcgccactgcactccagcctaggcgacagagcaaggcttccactgacacccttagcccaatgtattggatacaacagggtctcaacaaaagtaccctctgatttgtacactgctctctgcctttggcagccccaggagttaaagaacatcgcgtgtattatctgcgcattagaatgctgaaattgaaattacgcctctaggttcctagactgagattgagataatcagccctgtaaaccagggctcctttaggaagaaaggtgtctctcttgacgttccccaatcattgcgagaacagaatccctaaacaagggattcaagggaacagtcacagatcctggggtgggggcatgtttgctacgtgtacatccgaagacgaccgcgggctggggacgggcggcctggcgggacagccccgggctgagtaacccctcttccgggcaagccccaggcgtgagtcactggagagcgcgacgggaggaaggggcgccctgagtccacagccctgggggaggtcggagggtctgaaagcgagaagtccgtgagtagaaggtacgtaggaagtgggtctaaagggactgccttcctgggggtgggtgaagggctggatcccagggagcgagggaccaaaggggtggggcctgctccagcggccacggggaggggccgggggtcgctagaaggaggccgaccagcccgcggcgccgaaatctcccgcgctcagcagctggcccctcctccccggccaggcctcaggccccttgccgcggccgggcccgccggccggctcctcccgctgtccccgcgacgcagccctggccccagcccaggcctcgacctcgacctcaaccccgaccccgaccccgatcccagccctggcccggctgcgaagccgccagcctacccaaccggcgtacagccggcggcccccgatgcgcggccactgacggcaccgcagggtgcgtggccaatcagcgcggcccccgaggaggcgtcctcggccccgcccccctgcgcccaaggccagtgaggcgccggcgccggcggccgcggcggggtgagaggccgcgaggccccgccccgtcctcccctttcccctttgccccgcccttcccgcgcggccccccgcaagccccgcgccgccgctggtgccggtccccgcgctgggcccgcccccgcccctcccgcggcccgcgagcgcgcctcacggctcctgtctcccctccctccttctctctcacgcctagcgcaatggcggcggccgcggcggagcagcaacagttctacctgctcctgggaaacctgctcagccccgacaatgtggtccggaaacaggcagaggtaaccgagttcgccgccccagtcttcgcgccctggccggcgcgccgaccctttaccgacgccagccgcaccgggcctcggccggtccgcggcggccgcgcaggctgggcccggcgggcggcggccgcgcagcccacgtgtgaggcggcccgcggctcccggtcgtgcccccgggcttttccggccattgctgccgcggcgcctggcaccagttacctccccgccgccgctcgcacccacgtgcggccgctcccgacgcgcccccgtccaggtgtggggtgccgggcgggcccggggccccaacttcgctggccaccccgcttcccagctccccgcttgcccctttcccgctttctcccagtgggagcccccactgcccttccagccgctgtctccacccagcctagcgctgtgggtctcccaaaccctggctgctacctgacccgtcacgcctgcttctacccctgctcatctcccacaccgtctgtccctctctttttaaatatgtgccctgccttgtccctactgcctttttccatttagttctttctcattctagttcctaacatcagaagccagatttccctaccccctcccacctccagttttgtgaagttgcctttagggtttctttctatgcagtttccaccttactctgggcttataatacacttactctgctcttcagacaaattttctttgctctctagagaatcgtgggataaatgggatgtagtgggacttccgttgtttaactgggccagtaccatatgtttaagtcttcaacttcattaaatctaaccgtaatctctttttttcaaaccacctcttgttcctggcctccaaaatgtggagagactttcaagtgacagtattttaaatatatctgtaagctcatttaccaagttcactagaagactgatgttacattttcagcgttgagaccacgattcttgtgggatacttccaggggagggagaaactttccagtttcttagctgaccgccaaacttggttatatatggggtttttgcaaccatgcgattgtagagtttcataagattaagtgaaggatgttcagccagatatttttaaataacaaaaattaattttacatatagccaatgaaattgactgcaagtcctcttctgaactcaggcctgaagacttttccaggtgtctttgaaacgacggtggtaatcgttgttttgaatagatggtggatatgctggttacacttaggggttttatattaagtgaagtaaacacacccaaaattcggttctatgtgaaaaagcattttctactattcacttcattaagtttttatttattatacatgtaatacatgttcagggtaaaaattcaaacagtgaatcgtttcttatcccgtttcccaaaggtgaccgcttgtgtcgtgaatcttcgctgaaaatttaacatacacattcattttttacttaatgggcttataatactatttacactattttgcaacttgaatttttcactctatatttcacattgcctcataagtgaggttttggtcagctatagattatacatcatatggatagatatttatataagcaaccctctatgaaatggatattgcggtttccagtgacctgctcttttaaaaatagtactatgcgcaggagtacatgtatacctatctttgcatactttgccaggtttgcttgtagaatactgaaaagtagcatttgttcctagaagtgatatgcatgtattgcaccagtttgccttggggatatgatgatgctttaaaaaaaaaaattaatgctttctggtaactcttgagataatttttcgccaaaataactttttaatcccagcatgaaaataatagaaattttcatgtgttacaaagcagaacagcattgtaattagtaagctagtttaattctctctgttccctccagttgcttaagtctctattgtcaagcctagtggggaatctctcttctattgaactaaataccagtgtctggtttagcttgaattccaattggtgcctgttgtaaatcttttatcacttacatcactttggggatagttatcagcattcagcacattttctcataaagaacaattggaaataagtactgttattctcttagtctctttattcctagtgaaaacattcagatactaggtttttactttctttgtatatcctgagaatgtattaatatgtaaactaagtactgtgatacagaattttctaatttgacctccaaaaaagtaaatgttaagagaagctctctggtgccatagaatgcccctttcttttttgcctaatgaaataagcgttttataagagatcaaatgaaataaaattagcattaagtctgatacagcaaatatagaaatattttctatgaactgaaaaattggccagggctcagtaaatatctttgtaatttactcattcaaaataaaaatacttagtcgacacataaataccaaactgttgactaaggtgacttttgtattcaaatatggttatatatttggttgaaatcattgaagagacgtcaaaactctaaaaagttaaaacttttttcgtcgtatatgccatttagtaggctttatagtttatttctatttttaaaaatctgtaaggatatttctctttaactttatagaaaatgtttctcatttgaagaaacgtatgtgaatgtccctgagtctcagaatacaataacgtgaataaaccattgaataaatagttgacaagtagtgcaaagtacagtattcatggtatttatcactagacatttttatatgacataagcttaagtatttattaatcatatgcatggattttattttcttactaaggttctccatacagaatttgttcctcattgactctaatagagaatttcattgagtgttttttgtagagacagggtcttgctgtgttgcccaggctggtcttgaactcctggcctcaagtgatcctcccatctcccaaagtgttggaattacaggcatgagccaccacacccagcccattgttgagatttcaatagacagaggataacattgaaaaatatacctgattgttgaggaaccagggtgttaatagataaaagtcatgtgtcccctcttttacttttcctcatacaaggtaggctcactataaatatttatggaatgagatgagtacatatgagcatttcttcttcgtgggcagggaagaggcggaggagaagtctttgcattgtgtaaattgtataaggtggaatcaaatcaaattgaaattttgtttgccacaactgataacattcactgaacctaactggactagtgctaggaatagtattagaaacagtctttataattcttatacactaatatgctacgtacttagatacaaagataaaaagttaccatccctgtctgtgtggaacttagactgtttaaccattatccttgaccattgtgatggtattgatgtaatactatatttggattaccacagtggaacatatcacatggagagaaccctctctcaacagacatcatctgtcactcgtactaaactctcccaccattggcttctaattcattatggagtagagtttaatatttggcccaatgttaagttgggtcaattgttaagtctactagagttagcatagtcacaccaacagttccgcctgggcaagagtagggagcctcaggatttatattaggttttctgacagtgatagcctagtagagaagtttatggctgggcgcggtggctcatgactgtaatcccagcactttgggaggccgaggcaggtggatcacgaggtcgggagttcaagaccagcctggccaagatggtgaaatcccatctctactaaaaataaaaaattagccgggcgcggtggcaggcgcctgtaatcccagctactgaggaggctgaggcaggagaatctcttgaacctgggcagcagaggttgcagtgagccgagatcgcaccactgcgctctagcctgggcgacagagtgagactctatctcaaaaaaaaaaaaaaaaaagtttttgcaaaaacttgatttagaccactgaaaatttaagtgttaaacattgatcacattaccagtgtttaagtggctaagctgggtgctttttattgtatagtgagatactttttaaatgaaaacatactactggtataaggagttgctttggtaaatattaagtgaaaagtctcaaaggtacataaccatttttgcattcagcttgtgaatatctttacataaattatctcttctggataaataaattcaaaccatcttctctcctcggctgtgaatactttttggcacagttttcagcattgttaagatcctatgtgctttttactagaatgggaacttgaggttatcagaagatcttgaattctcctttcccccaaaatctgttcttccccagacagatatgtttgaaaagtttgaaacctgtgtagcactgcataaatagaactggttgtttaatgaagtgaaacagagctttcagtaccagagagattttgaatatggttggccttagaggaccagagttctgtctgctattcattgtctatgatcttaggcaagtcattaacttataagcctttatttccttatctgttaatatctcatggatgccatggggcacttagtaaaaggtttaagctagatgtggattcaaaatagccttgtttttcctcccttgtcactttgttccagagaagccacgtatagaggtatggtagcaatgagagcaggtaagctctaaagaaatcaatgttacccacattagactcaactctaaattgctagataagaatggattatctatttactaagaggcttcttagagtaagcaattccaagtgtacttaaattgatttcttttccacagtgaacaaataccatcagaattcttgcatatgaatctgcacttctctggacagcatatagttggttcttgttttttaatctgttctgatcatctgtcttttaattggtgtcaactttttattgttaaccaatttgttgtgattttacattattagcagaggatagagtgtcctgagtcacaaacctcttgctaatagatctacaaaagacgataaagcctcctggccgaatttatcctgaccacattcatttatctatgtagtaaggttttagtatgatccttgcttggaagaaaatgtagcataaaggatttgaatactttgtttctctgacttacttccaggtgtgtgtctggtggttctaagcagtggtaatttgaaccagttgtacatcatccagtctaaaaatgttaacgaaacagtttctcatgatgtaaggtgattttaagtgagccctaaagtttgcagcacaatggcttaagtcacatttggcaattttttggccctcttaggccttgagttttgttaaccagggagcataagttgggaaaacatgcacacacattagaaacatttgtttaagagatatatgtagaaaggaacttgataagtaaccctttggacatctcttccctaacatatctgaagtgtatttcatgtcacagaaggtgttaacaccagacctagattaaataatttctcatgcatccttcccactgtttatttctttcactggtttactcatgaagtttcctaacattctttcctaaccatttttttttttccatgcaggaaacctatgagaatatcccaggccagtcaaagatcacattcctcttacaagccatcagaaatacaacagctgctgaagaggtactaccttaatatttgtgactattacattcttagaaaataagttattagatgatgatcatagtagaaattagagaaatgagaattgtgattaaccacatagactttactagaactttgtacttattatttgctaaaagctacttaggagttataatgtaattttttgaagtactttgtattaagaatgagagttgccttttttccgcataagataatgtgtccagggtagatgaagattaatggttttataagtaattgcataagaattattaaattaaagtgatttgatttgattgattgattttgagatggagtttcactctgcccaggcttgagtgcactggcaccatctcggcccactgcaacctctgcctcctgggttcaagcagttctcctgcctcagcttcccgagtaactgggattacaggcgtgcgccaccacacctggctaatttttgtatttttagtagagatggggttttgccatgttggccaggctggtctcgaactcctgacctcaagtgatccacccccttcagcctccgaaagtgctgggattacaggcatgagccgccacgcccagcctaatttaagtgctttttgcagctaaaagttttctttccttgaaacaatttattctaaagaagtaaattagttcagtgttttgatgtgttatcaatgttttgaaaaaatatttttttcccatctttaaaaatttatgcttataaccatctctggatgaagtgtatgtactaaagatatacttaggaacagagacattttctagaatattttattagaatcatggtttttagctaattacctagttcctataccaaattcaaatttgttttaattttaagaattacttttccctatggtaaaaacaaggctatttcctaggattttatagtttcctactactgattgaggcattttgtagctaattccaccccccccccccaccgtccccccgattataagttaatatcctcataaatattgaatgccattgaatatctgtttactttggaaaaggtataaaaatacccaagtctagaaaactattctacctacaaaacattacatttagagtttgtagtgtaagactttttttgctagcaaactgtatataaaatgcttatccttgatggaaataagtcacactaaacttttacattatgtttcacctgacttcttccagtcagtcagtttagactagcaacttcatgttctctcaaccactttaaaagccatataaaagtatcccaatttttttttttctagatgacaagaggtacttctttgcttttgtaacctgttcttttctgtaactcaaaatggatgtcaaatatgaagaaccctatatagggtaacttctttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctagggtaacttctatcactaaaaacagatgactgttttaattcttgaagattagtgcaagttagtaaacaaattttaaagccaagaatactgaatttttttaataacttgtattaagccttatttaaatcttaactagatttaagaattagatgattgttgtgaattagtgacagcatcttgattgtggctttatagtttttggtatatgtgtgagaagaattgcacatgagttttaaccacttttataagaattgtaaccattttgaattctttctagaacatgttaaatatttgtaaaggtttctacctaccataaatgtttcagtaaaaagatttctcggtgaaaagtaatggaggaaaaaaatagccaattttatttgtatagcttaacattttttttggtcaaattcccaaagtaattatagtgataatgagtaacatcagcttggggaaatcgagagcaggaaagattaggttcaatattcccaatagcttattggcttgatttgataaaattttagaatggcatttgtcttagcttttcttttgataatctcaagaaatgttatacagaaaatgccaaacttaattacacagatttgaaaatgaaaatccaagaatacacatgttgagatggattagcactttttaggtatcgggaactcgtaatgtttgtttgcatgaaagaagcattttatctaagatgctaatgaaagggcggttatgtaacaagttaggtcaggctgggagcctaaggttgggtgggaaaggcgcttgatattctagaatgagaccagacagagaggtaggaaaagagcattcattatagggtttacaatttaagatttgtttttctcccaaataatgtgttaaaaacagggattaaagacaggtttatcattgctaaaatatgtgttcctaattgaattgtaatgtgattagaagttctcctcaccttaagtacaaatggcttattttgtggcactaacaaaataagtctgtataatagactaatgtaattagaaagagttatatatttacttctttagaaaattaggcgcttttgaaatataaaaatacaacagtgaaatacatcaatggcagagtgaatctagttattaacaatgttatctgtttataggctagacaaatggccgccgttctcctaagacgtctcttgtcctctgcatttgatgaagtctatccagcacttccctctgatgttcagactgccatcaagagtgagctactcatgattattcagatggaaacacaatctagcatgaggaaaaaagtttgtgatattgcggcagaactggccaggaatttaataggtgtgtatgcaggtgcactcatgttaccaagaacatgggtatatccttccttttttttttttttaatggaatcttttagagtaagattcataagtacctgagtaccatttattctgtttaaaatgaatgtgcttatggattttgcatttagagccagaaattacagatagatgtttgtgaaatccagtcataggactcacctattggtattcaaaatacccatgtgaggctaggcacagtggctcacacctgtaatctcagcactttaggaggccgaggtgggcacatcgcttgagtctagcagttcaggacgaacctgggcaacatggcaaaaccccgtttctacaaaaaattagtgggcgtgatggtgtgcacctgtagtcccagttacttgggaggctgaaatgggagaatcacctgagccccagaagctggagactacagtaagcggtgatcacgctactgcactccagcctgggcaacaaagcaagactatgtctcaaaaaaaggaaaaaaaaaatccatgtggaaaaataattttgtaatttgcttgaaaattggcagttacattttctcctaaatctataatgttttagaagcacaggctaattaatggtatgacctactttgtacattaaacttgccagttgaactaaaaatcagagactccagtgcttttgctgttgtatatgtgtggtgacaaatatatacatatactgttacgtagctatactatgtatatatatattttttttttttgagacggagtttcgctcttattgcctaggctggagtgcagtggtgcaatcttggctcaccgcaacctccgcctcccaggttcaagtgattttcctgcctcagcctaccaagtatctggaattacaggcatgcgccaccacacccagctaattttttttgtatttttagggtttctccatgttggtcaggctggtctggaactcctggcctcaggtgatctgcccatctcggcctcccaaagtgatgggattacaggcatgagccactgcgcctggcctactatgtacatttttaatgcccaaaaaatatttttttaagtgaggtaaaaggcaaacatcataaaaaaatgcattttactaaaggtaaaaatcctttttagtcaactaaaaataatagtaatgtaattgaacatgctacttttttatcttgctgcaaaaagctttatttccatttggtctagtgcctgggagagggctccagcttggttaaaaagctacctaatggctggagggagagggtcaggcagaagctctgatacattgagggggaccctcagaggtcactgggcttttagtgttgtttgatgatgagccttttgaagagacacttgcccagctcaacataggagccaactagcctgcggaggttggtcacgtggtcacccatcttaatgagtttcacttcctcatctaggaagtggctctccaagaagtcacagagatggggatctgtgcaggcagaacccagggcatgaagatccaacagggcctggttcctggtacaagttcttctccagggccatgacagcttccatggtgtcttgggttttgtcccactcatcttcatacttcctgctcgtagaagagagtgtagccaccactttttttttttttttagacagggatttataagtgtggttgtaagcgcagcttgtttagatggcatttttaatagttgaaatgaagatcaaggttacatgggagattactattgattgagcttactacattatgacactaattttaaaatctcatcaaccagtaatacagtaagtccttgttcaattcagctagcagattgtatcctttcttatgtcaaccatttcttagaaactaatggggaatgtgtcaattctttatattttagatgagttcaaattaatttttttagacagttttgttctgttgcccaggcttgagtacagtggtgtgatcatggcttaccgcagcctccacctcccaagtttaggtgattctcctgcctcagcctcccacacgcccagctaatttttgtatttttttagtagagatggagccaactgggtttcaccctgtttgccagcctggtctcaaatgcctgacctcaaatggtctgcccaccttggcctcccaaagtgctgagattagaggcatgagccacagcgcccagccctaattttgaatatttttaaattgtttagaaaattctactttccagttttaagtatgcagataggaattgttataggtgacatcatttctcattcagaaacacttaacaatgcaaacctttccaaagtattcaaagtgctctcatagattttttttttttaagctgctattttatttcccctcaaagcatcatctttaggttgaagaaacatttaatgtcagcttagcagcacaattgtcatttcacaaaagttcaaatatcgggggacgtttaaaaagaaaacatctgtaattcatctgtaagttgtataactcttaaggtctttgtgacaatataaccagagtcttataagtggcacagtagatttttgtggtcactcatttttattataaagtattatttaaaatctcttaatcttgttaaatagtaaacatattaataacatcctctggcactatttgaaccaaactgcaaagtgtgagcaccctgtatgggtcctgagattctaaccctgatgtcttctcaagttccaaagtagttgttactttggtttcaagaccttgccaccaaatactagctttgcctactttttcaactctttaatagcaatggtatatataaaggagtcagtcaatcagatatttgtacagttaaaagtgctgccttctcttcaaattccactccttagaaataacctctgccagccaggtgcggtggctcacgcctgtaatcctagtactttggaaggccaaggcaagtggatcacccaaggtcaggagtttgagaccagcctggccatcatggccaaacctcgtctctactaaaaatacaaaaattagtcaggcatggtggcaggcgcctgtaatcccagctactcgggaggctgaggcaggagaattgcttgaaccctggaggcagaggttgcagtcaaccgagatcgcgccattgcactccagcctgggtaaaaaagtgaaactccatctaaaaaaaagaagaacctctgttaatatctgattatctaacccaaatacagagttgtttggtttgttggtttgtttggtctttttttttttttaacatgattgtgatgccatttttatggctaaaggacagaattttgtggagtttttaaaaatagcaaaagtgacatttttcactactccaggtttgaatgaggcttatgaaatgaaaggatttactcctagtatattgaagttctgacttacacaactttatgtctggatttctttactttcagatgaggatggcaataaccagtggcccgaaggtttgaagttcctttttgattcagtcagctctcaaaatgtgggactgcgggaagctgcccttcacattttctggtatatacattaatctagttttttgagacatttgatttaatgaatgccctaaacaccttttaactgattattttagcctaatttaaccttatacttaaaatgataataatgcctttacataagttttgtttgtatttgtattggaagcaattttttttaaaagggccttttatttcacattatgatcttttttgtacacaaaggttctctacagcttgcttgctttctctttgtcttttatgattctgaaagttttattgaacagtttcctctcctttatttggagattaacacaatactggatgtagcttttcaaaagccacattaataatggtgtcttgaagaggagaaggagaatgcaggtgaatccccattatgttttctgggtcttgtgtgacccaattttataatatgttaagaaacctgtatatttataaccaaatagtctaagtttagaattaagtgattattctttgccccactgtgctatatttttttactacacctaaaatgtgctcaagatcatacacattttaggctttgtatcattttgtactttagttgtcatatatatctttgtttatatcagtaattcagattagagaatgcagatggccggagagcatagttcttgtagttttcatctgaaaacctgtggttgctcttgtcccatcctgcactccaggtcagctttcgactgagacagagtaataaggataaaagcatgtagctgggaatgggctgctgagtagcctctactcccagcccagacttctccagtatgttttcattcacttaacccaaaaacaggattgcttagagaatgggtagatgatgttcaacctatggattaatgcgtactgagtcaggtaaacaaacagttcattagagattctagctcatactttaccaagatattaatataatgtagtttttaaagaatgtttggattatcttttaggaactttcctggaatttttgggaaccagcaacaacactatttagatgtcatcaaacgaatgttagttcagtgtatgcaagatcaggaacacccgtcggtaaataatttcaatcctattaatataaccatctattttaatctaatttgcgaaagaaattagtatattaggaggttgttttcacttttatactttaaaatacaaacaccagttttactgataaagaataatttgatcttgagtaagaaaacttgaatttgcgtttatcaaaaatttctcatgtttgacattttttcctcttgattttagatcaggacgttatctgctagagctacagctgcatttatacttgcaaatgagcataatgttgctctgttcaaacattttgcagacttgctaccgggattcctacaggtatgaaagcaatatagaataaatcataattatatcttatttggttctttaatgcattcaatcatttatgcaataaattcatattgcctattatgttctggcgctaggcatacagcagtgaacaaaacatgcaaatctcagtctccattaagcttatgtttactgcctttgaaagacatttttagtctcttacaatatttatagttataaaatttttctgtaatgtaaatgttgtaagcaattatatgcttattgttgaatttatggtcatgtagattatttccattaaatcaaccaaataacctgtgagatttaatgcccattttacataaggagaaactactcttaattacagggtgtgtaatagtttgtattataatgtaagtttatggttaattcacattatcgttaaggatgttaatttttaagaatactttctgctttaatcagaaagcaaaataagatgagacaagatagagcatatattcagggcaacttgaatctatgctcctggggaaaaaaattttatattaattaaaatttaaaagattggacaagttagtggttcccaaccttgtcagactccaaactccttttttatggcaatcttttagtaatttttcatgtactcttctaaaaatgaaatgcataagtaatgtaatatatatgcataattttttagaatattaatatatggccttaatacaaaaaagaaatgcaaagaaacgtataataaaatggcttgcttctccttatgtaaatggtcagacaagactacactggaagacataatagactaggtggcttccaagtgatctgtacaaatgcaatagctaaaactggactaatagcaaagatattggcaagtcaaacaccacagttcccattagaattggtgataagatttcctaaaatagtaaggttctgaacaaagcaaagtagaggttgagtgtctcttattcagaatgcttgggagtagaagtgtttcggatctcaaaatcttttcaaattttgaaacactgtatttgtgttatacttaccagttgagcatctcaagtcagaaatccgaaatactcaaatgcgcatttcctttgagtgacgtgtctgtgttcaaaaagttgaggatttcagagcattttggatttgggatgttccacctgtatgtatccattcttgattgatacagtagttacattggagggggggataacagttgttaaaaccaggcaaaaaataatttgtgagttagtttctaggttcagatcattataaagagttttctcctttttataaatgtctgggatttgtaataatgtgaaatgcataatgagaagatcatgtaagtcccttgtgcttgtgtcacaggtgcaggacatttagtatccatggcctttgcccatcctcaatcgtgtgaccatcaagaaatatctcctgggtgaaaaccattcctcttgagaaccactgagttagagaggatttagaggagctaaaattgaaggtttccacatgataagttatttaaaggatttagtgaaacttctctccccctgctatcacaatgaaaagatagtttcgtgacagaacataaattgtaacatactattgctttagtagtttattatctgaaatctctagttactgttgaaatctaatcccggttttcttcctctggatttagagtaagttaaaatgtttaccacaacttttaagagttgttattctgaaatagataatgataaacacaaaatgcatactttaataccacagtgaccagacttaacatccaagataaataaaatgggtaatattggacactttaaatgtattacaggttctagtacttactatgcgtatgagaaaaactagggcatggatataagaaaggacagaagagccaggtgtggtggccacacatgttgtcctggctactcaggagtctgaggcacaagagttggagggtactgtgagctatgattgtgccaccacactccagcctgggcgacagagcgagaccttatcactgaaaaaataaaaggacaaaggaaagggactcctggttataaaaaaaagtaattccttggtagccttaagtattgtaatggttattatagtttcactgattttcattttgacttagatgtaaatctgttttgaatgtttctagttaacatccatcagaaggaaggtatacatgtgcctgcaggtagaacatttgcataatatagattgctaaattatttagtgaaaaatagtttagtaatatttctctattgtcagcatcttaggaatcttttggctaatgaggcattataaagtgaatcttcagcaccgactttctgtttcatcttttctaggcggtaaatgactcgtgctaccagaatgatgattctgtcctaaaatccctcgttgagattgcagatactgttccaaagtatttgcgtcctcacttggaagcaactctacagctaagtctaaaggtaaattaagtacgttagtaaacgttctgtttgttattttcagggactaatctaaattattaaatgtatacaaatatgtcttctttgtagttgtgtggagacactagcctcaacaatatgcaacgccagcttgcccttgaagtgatcgtcaccctctctgagactgcagctgctatgttaagaaaacataccaatattgttgcacagactagtaagtcaatggtcttcagatagtttatgtgtattgtggccaaatttttggataaatttgctgagggttgtgtgatttctcagattgttgagaatataatgaatatccttttagaatcagatgaatttgggaaaatgcatctcaatacatgcaagcgtggacccccacattgtggttatgcctttaagactttgcagacaccctgaaatctggtgttaaaaataacatttctagagtggagtgtgacagactctatcatttatatgttaatattgggcacagttaatagagtcaaaaacaattcagcggggatatatagatgcacagtagcgaactacaaaccaaaatagcatgtcttgcttaccagtgaagccaagattagaagaacaaggtctaacactagtcatggctctgttcactatattacattgcttttgttttatagaccctcgttgcagcagaaacttaaatggctattgtgctatggaaatactactttaagtttcattgtgctgggataaggacttgagaactaacctgatcattttctggcctagccatttcttaatgagctaatgagtacttgaacacttaatttagagggtaaatacgtcaccagatttattttgtagtggtacctaccttttgtcttacactgaggtagtggttggaattttagaaacattcccatttaagtcaggaacaagaaaaatatctcctttatcactgttcatgttgtactgactgccccagctgatgcattaagagataaaaataagttataagcattagaaacaatggctgggtgcagtggctcatgcctgtaatcccaacactttgggaggccgaggcgggcagatcacctgaagtcaggagttcaagaccagcctggctaacatgctaaaaccccgtttctactaaaaatacaaaaaattagccagatgtggtggtgcacaccggtaatcccagctactcgggaggctgaggcaggagaattgcttgaacccgggaggtggaggttgcagtgagcccagaccatgccattgcactccagcctgggcaacaagagcgaaactcgtctcaaaaaaaagaattagaaaacaaaaatattgcttatttgtaggctatgtggttattgtctacaaaaagttttaaagactcaacagataaactgctaatcaaagggttaagcaagatccttagatatgagaacattttattgtaagtgttccattattcataataatcatttagaaaattttataggcatgagttatagtaactgggaataaatcaaaagatgtacaagacatatgggaaagttgaataacatattgaaagactaatagaagaacaaattatcagttctcaaattaatctagggttatgatagaacaatcctgaaattcttctgaaagaacatagggcctggagtagccaagacaattttgacgaataaagtggagatcttgtttcatcaactctgtgaatttagaatgcattgatgatgcaggtgttgacaatggatcggatggaacaaagggtagagtgtaggagaagatccgctcacatgggaacaaagccatttttaaaaagataattgatcaaaagttcttggggccaggcatactggctcaggcctgtaattccagcaatttggaaagccaaggtgggtaaattatgtgagctgctgagtttgagaccagcctgggcgacatgacgaaaccctttctctgccaaaaatacaaaaattagtcgggcatggtggcacacgcctgtggttccagctactcaggaggctgagatggaggattgcttgagcccaagaggtcaaggctgccgtgagccaagattgcaccattgcactccggcctgggtgacggagtgagaccctgtctcaaaaaaaaaaaaaaaaagtttctgggatatctttctttcattctttctttctttgttttttttttttttgtttgtttaataggtttatggggaacaggtggtgtttggtttagtggtgatttctgtgattttggtgcacccattacgggagcagtgtacactgtacccattgtgtagtcttttatccctcactcccctcccaccctttcccctgagtccccaaagtccgttgtatcattcttacacctttgcatcctcatagctcagctcccacttatgagttgagaatataactggttatttctatggggaaaaaaattccaactctagacagcttattaaaaaaacaggccgggcgcggtggctcacacctgcaatctcagcactttgggaggccgaggcaggtggatcacgaggtcaggagatcaagaccatcctggctaacactgtgaaaccccgtccctactaaaaaatgcaaaaaattagccgggcgtggtggcgggcgcctgtagtcccagcttctcgggaggccgaggcaggagaatggcgtgacccgggaggcagagcttgcagtgagccgagataccgccactgcactgcagcctgggcaacagagcaagactctgtctcaaaaataataataataataataataatttggggtctactcaagacctgaatattaccttgcacgctggaactagttaaaaaagttaagggctaaatattacagatatattttacaagtaatgcttaatagtagataattttctaagactgaatcacaaaccattgatgtaaacattgccaaattggcaaatgcgaaaacaattttttgaccaatcagatacaccataaatgaactgaaaaaataagccacaaactggaagaaaataattacagtgcacacaatcaacagttttgttatctagagaatacacaaaggctgagaagaggaaattcattgcttttttcttctttaagatggggtcttgctctgtcatccaggctagagtgcagtgacatgatctcagctcactgcagcctcccaagtagctgggactacaggcacgcactaccacacctggctaatttttgtgttttttggtagagatagggttttaccatgttgcccaggctggtcttgaactcctgggctcaagggatcctcccacctaagcctcccgaagtgctgggataacaggtgtgcaccagcaggcccagtcaggaaattcgtaaaagagggatctgaaatagctaatgaaccctgctaagtctcaataaaaacaagtgtaattgtggaatacaagttgtccagaagtttgacagtatcaattgttaataaaagatgtggaactgagaggacgcttattccacccccagggcacttcacacatttttgtgaaataacggagacctccacttaaacttcacatagtttatgcaacagctgtgcagagcgcagcttgtttggtaattttctttttttctttttttagacagagtctcgctctgtcgtccaggctggagtgcagtggtgtgatcttggctcacagcgagctccacctcccaggttcacgccattctcctgcctaagcctcctgagtagctaggactacaggtgctcgccaccacacccggctaatttttttgtttttggggtttcaccatgttagccaggatggtctcgatcttctgacctcgtgatccgcctgcctcagcctcccaaagtgctgggattacaggcataagccaccgcgcctagacttgtttgataattttttagtactatttgaagatagtaataacaatttcatgcctagactcatgcttgtcaaagaaaagatgtaataatctcatcaaagcaaattttataggaggaaaaaattggaaacaaccaaaatgtttatcagctagacagtgggtagtatgtttatataatggaatgctattaaataaactgaaatccttatgtgttgagaaaaaagcaaattgccgaggtacatatattatgaaaccatttattatataaaaaatcaaatcttgaaatagtactataattttgtatagagatatggaaatctgtagttcaagtgtgaaaaaacaattgcggaatgagaaacatttgtgatgttgcttcttacctctggtgatggggagaatgtaatcggatttgggaatttcataggagggtttgacttaatgaatgttgctttttaaagaaacgataaaagcaaatataacaaggttaaaatttaacaaaccaggttttgggggcacagacaaataattgttttgtcttgttctcttacaggcaaagtaaaatcttaaaattcttgtttataaatagtgatatggataagataaagtcacagtcttcgggtatgaaataattgtttactttagttcctcagatgttagcaatgatggttgatttggaagaagatgaggactgggcaaatgcagatgaactagaagatgatgattttgacaggtaatcaaacattgtgtccagggtggcagtgaaagccctagggctccacggtccatctcttcactattgcaccctgtaacctgaaggtaaacttttaagcctggaatatggggcactttgccttgctgttgtatttattgctgtgtcacatgttataagtagtattttctttagttttcatgtataatttatattaataaaatttatgtttcttggaagttcataaaaatattttaatagttaatacataaagttgtattttataatcaggaactgaaagatacctacaacaacaaacaaggaagtttttcttttttaaaaaaaagtatgacatgaaaacagcaaataaagtagctatgttttttgtttggttttgagacggagtctcgctgtgtcgcccaggctggagtgcagtggcgcgatctcggctcaccgcaagctccgcctccggggttcacgccattctcctgcctcagcctcccgagtagctgggactacaggcacctgccaccacgtccagctaattttttgtatttttagtagagacgggatttcaccatgttagccaggatagtctcgatctcctgacatcatgatccgcccgcctcggcctcccaaagtgctgggattacaggcgtgagccaccgcacctggccaagtatctatgtttttaactgtcgtactctaaattatttccaagttttttgttgtttttgtttttgtttttagtttgaatatcttttaaaacgtgtataaagcagcttttttgtgataaatgcttttacaggcagagacttcccttagaataattgtttcaacaaaattccctgcaatacacatcatattttcctagtaaaaagcagtttaactttaggataggcagcatccagtggtgaaaagatgagagtcaactgggtagagtattactattgtacttatttatttcagcttaggaagtcccatgaatacaggaaaagtcaaccaaaatctgtattcactgtgcagtagtaatgatggccccttacatgtatgtgaaacatagcacctctgagctctgttactttaatcaactttattagcagtcccagaggtgtattatattacagttgcagaaagggagattgaagattgagtgatttgtctgaggttatgtagccagttaatggactggggttaattaccattgttttcattcttcccagtgcattatactaccaccttttctttaaaaaagctgaaattggctgggtgcagtggctcacacctgtaatcccagcactttggtgggcagaggcaggcagatcacctgaggtcaggagttcgagaccagcctgaccaacatgttgaaaccccgtctctattaaaaatacaaaaattagccgggcctggtggcagacacctataatgccagctactcgggaagctaagcgaggagaatctcttgaacctgggaggtggaggttgcagtgagctgagatcacgtcattgcgctacagcctgggcaacagagcaagactccatctcaaaaaaaataaaaagctgaaattattctcctgaaagacttggagtcagtataaactactaggttaataaaagtaaaaattaaagatttttggctttagaatatatatgcatttttgagacttaatcccattgttaaaaatgactgatttctggctttaatactgtcttgaagtatatgaaagtaatctttcactggaaatcacctgataacggctgaagagaagaccagggctaggtcgaatttcctttttggttcagttactgtaatgtgctgctacctgtcctttcatttgccctgcaaatggcacttaaatttatacagtttaagaaactttgttttctaaactagatgaataagattttctcatttgtgaaacagcataaatatattttcagggtgagatttttttaagtctaaaaacctgttctgaagataatttatagtttcatttttatagtattgtctttacatagtaaagataatgcacatgaaatacactactgatcctccagttctaagccaggataagtccaaatgcttttatgcccacattcctttggctttcagagaagacaatagaattgagtttcacatagctatgcatagtttttggcagtgcagtttgcacccctttaagggtgaataaactcacagtggggaagattatacattctctgcacccttttcagttttctatgttctgttcattgataggtttgaagactgtatttctaggaaatgaaatacatgaggctctttcaatactgcttttactggagtgttgaaagtgtcagaagctatttctgagaacagtttttagccagtagcgggtgggggtggtcttgaaaaataagattcaggctgggcacagtggctcacgcctgtaatcttagcattttgggaggcccaggcgggcgcatcacaaagtcaggagatcaagacaatcctggctaacatggtgaaaccccgtctctactaaaactacaaaaaaattagccaggcgtggtggcgggcacctgtagtcccagctactcgggaggctgaggtaggagaatagcatgaagctgggaggcggagcttgcagtgagccgagatcgtgccactgcgctccagcctgggtgacagagcgagactctgtctcaaaaaaaaaaaagaaaaataagaatcaggcatgactttctaaactatggtggatcatgataaaaacatttactcttttttcttttctaagctgcagagtttttaacccctaatttcaattccacatttaaagacagcttgaattctttctcagtcttagtttaataataatatggttagaagtatgtctgtagagtatactatttcttttgtgtttcagatatattgagtacataattctgtttatgtgtttagcaatgcagttgcaggcgagagtgctctagatcgaatggcttgcggacttggtggaaagctcgttctgccgatgatcaaggaacacattatgcaaatgcttcaaaatcgtaagctgtgtccttcaaatgctagaagagtgaagttgtgccctttctaaagcttaaattctaagatatgtttagactgttaaaaattaatctttgtctttttatcatccatatttaacccaattcatttattttaccgataaaattgtcaatcccaaagaaaatgtacagatttacttcctagccaaaagtatttagatttgaatttgaaaatgatgttattatttgaatttttatggaatattagaatgtttgaatcatatactcttctttcacccaatatcttttatttttaaaagaagaaactctatctaatgttatcaaaagagaaaccacttctttctttctgtttttgcccctgacggaggtgatggtggaagcccacctgccctggagggcagctgttgttgttgacacaggatttcgccatgttgcccaggctggtctcaaactcctggcctcaagcagtcctcctgcttcagcctcccagagtgcttagattataggcatgagctaccacacctggccatccttcctttttatttctatgaatatttcagttacctttgtacctgtaatatatatatcaatcccaaagtttattgttgtatgtgttttattttcatttgtgttttttaattataaagttaatgtgttcttttgttaaattaaaattcagaagtattaagttagaaatttgtttgttttttggtggaatctcgctctgttgcccagggtaatgtgatctcagctcaccgcagcctccacccactggattcaagcgattctcctgccctagcctcctgagtagctgggactacaggcacatgccaccacgcccagctatttcgagacagaatcccactctgtcaaacaggctggagtgcagtggtgcaatcttggctcactacaatgttcacctcccagtttcaagcaattctcctgtctctgcctcccaagtagctgggattacaggcatacaccaccacacccagctaatttttgtacttttagtggagatggagtttctccatgttggccaggctggtctcaaactcctaacctcaagtgatccgcccaccctggcctcccaaaatgctgggattacaggcatgagccactgcacccggcctaatttttgtatttttagtagagacggggtttcgccatgttggccaggctggtcttgaactcctgactttaagtgatccacccgcctcaacctcccaaagtgctgggattacaggtgtgagccaccgcgcctggcctgatacatacttttagaatcaagtagtcacgcactttttctgttcatttttctaaaaagtaaatatacaaatgttttgttttttgttttttttgtttgtttgtttctgttttttttttgagacagagtctcgctctttcgcccagaccagagtgcagtggcgcgatctcggctcactgcaagctccgcccccccgggttcacaccattctcctgcctcagcctcccgagtagctgggaatacaggcgcctgccaccgtgcccggctaattttttgtatttttaagtagagacggggtttcaccacgttaaccaggatggtctcgatctcctgaccttgtgatccgcccgcctcagactcccaaagtgctgggattacaggcgcgagccaccgcgcccggcctatacaaatgtttttatattatatatacatatacccttttcaaaaaagttttgttactcttttccaaataagaacttttatacatctccctctaccagaatgacatgtttatagtgtgtaattgctattccatctgtaatttttttcggtagctgactggaaataccggcatgcaggattgatggccttatctgccattggtgaagggtgccaccagcaaatggaaggaattctaaatgagatcgtaaattttgttttactttttctccaggatcctgtaagtaccagtaaatatttgattcaaaatgattagtgtagcttcatgtggaaaccttcttgcttttactaatgaaagggaacattttccagcatccaagagtaaggtatgcagcctgtaatgccgtgggacagatggctacagattttgcacctggtttccaaaagaaatttcatgagaaggtaagtaacaagtcctcaaacacttaaatcagactttaggaagaagggtggacatttcaacatgtgtgcccatttggtttcatttcacaggtgattgcagctctgctgcagaccatggaagaccaaggcaatcaacgtgtgcaggcccatgcagctgctgccctcattaactttactgaagactgtcccaagtcactacttattccatacttggataatttggtgaaacatctgcattccattatggtactgaagcttcaagaggtaagttttaagatctgtaggctgctttctgtttgtagattaatttgggttgatttgatgggtaagaactggagaaagagggacttgcagcatgaccataaagaatataaagtacaaaaactgaggaggctattcggagttgtggaatgatgagtagagaaattcagattgaccaaaatgtgggctgataattggaattgggaaagatacagctaaaggtcaggtaaaatcagtgtatatggatcaccctgaaaataaggcagagaagtttttgaactctgatttatgtaaagtgtgaaaaaccattctgtgttcttaaatgctgcaggaaattatcatatggtaaaaaattagtgtggtagcattgggtgaggcatacacaaaaaagggagaagatttaaggcaagaccatcatactgtcatcgtccagggagcttagatagtaatagtggaagaggtgattctaaaagacatttcatgggaagcattaacagtttgtttctggcagtttgaattttaaaagatgaaagggcccggcacggtggctcatccccgtaatcccagcactttgggaggctgaggcaggtggatcacctgaggtcaggagttcgagaccagcctggccaacatggtgaaatcccatctctcctaaaaatacaaaattagccgggtgtggtggtgcacgcctgtaattccagctactcgggaggctaagaggagaatcacttgaacccgggaggcagaggttgcagtgagctgaggtggtgccactgcccttcaacctgggcaacaagagcaaaattctgtttcaaaaaaaaaaagatgaaagagaagaaattaaaaaacattgagtattctaaccagagtggcagaaatacagaagttgtagaagcaacatcatttttgagtatccaagtaaaaatgattatagttacagctgaaataagggatgcaacctgaaaacaattgaatgatgttagtccagcacagtgtgtgagagatgtagatgcgaaaagcaaggattttagcccagtttattgtcaaatgtttattgtcaaatgcaatgaaaatggattactactataaaaatgaaatgaatagaaggcatagaaaataaaagataaacctgctctcaaattgctataaaagtttctaatgccctcaattcctatacttaatatgaactggtagcaaatagttaacaaaccacagtttgcatagcactggcaattggtcagagagcaagataaacaagaaatgcaatgtctcagaagccaaagacagaggacttataaacaaaggcccaagtgctcagtatcagatgacagcagactaagaatatgataaaggaaacattcgtgtgcccgaaggcagaccgaggtggacccaagttgaaggcagattggttggttggttaaatcagtaatggatggatccaacatgactttacaggtttgggtggatggctgtggtatgatagtctgtgtgtacccctgcccttccttcctgcagtgaggcactatatgggtttttaaagataagtggaaggagttgttgggatgggatggtaggaggacagtgttcacgaggaagagttgtacgaagagaaggtagcctagcagaggaggaaagacatttcctctggggccagcagcacagtccacactaaacatggagcagaggttgaggtacagaagcagaaagtaagatggctttctcaagacatagttgaatgtgtaacacaagttaaagaactctgctgagagtgtgggtgtaattgacgtggggaattatgaaaatctggagtagtaactggctcaggttcatatgagttaatattttattttattttattttatttatttatttatttatttttattttgagatggagtctcgcccaggctggagtgcgataacgcactctctgctcaccgcaaccgccgtctcccgggttcaagccattctcctgcctcagcctgccgagtagctgggattacagacgtgcacccaccacacccggctaatttttgtattttgagtggagacagggtttcaccatgttggccagtctgttcttgaacacctgacctcaagtcatccgcccacctgggcctcccaaagtgctgggattacaggtgtgagtcaccgtgcctggcttctttttttttttttccccagacagagtcttgctcttgtcaacccagctgggatgtagtggcgcaatctcggctcactgcaacctctgcctccccagttcaagcaattctccttcctctgcttccggagtaatgggattacaggggtgtgccaccacacctggctaatttttatttatttatttatttatttatttatttatttatttatttagtagagacagggtttcaccatgttggccaggctggttttgaactcctgactcaggtgatccgcctgcctcagcctcccagagtcctgggattacagaagaattattttaaaatattgctggtgacaggacgggcccagcagcaaatagttagtaagcatttgttactagctgggtcagagaacaccagatctttggtgcagagaaaaaggtcatctcatctgtttcagcaagacagatgcaagagaaggcagcagggttccttcgtgcgatcttctggggagagggggttagaagataaaggaaggggccaaagagggaattttctttatgacgtagtaagacagcacaaaatataatcataagtagaggaaatcagtgaagaaaaaaatgaggatgaagtgtaggcattaaagttgatgaacacaaaaattttgattccgtatctgtactcaagaattagctgtgctttgagatgagactaacatgagttagaggtgttgtgttaatagaagagagaaaaaaaaaatctcacataaatagttcaacatagattctttttatagaaatttcctccaaaacctacagtctctgcttctggagaggtggtctcattctgctgtttcagaaaagcattcaagaacttgaagggagtagtaattgtaaatttaaatacttcttccagttttcctttgaggtaataatttgtgtcttccttctagctgattcagaaaggcaccaagttagttttggaacaagttgtgacatccattgcatcagttgccgatactgcagaagaaaaatttgtcccctactatgatttatttatgccatcactgaagcacatcgttgagaatgcggttcaaaaagaactgagacttctgagaggaaaaactattgaatgcattagcctcattggtctggctgttgggaaggaaaaagtaagtaattttttttttttttttttttttttttttttttttttgagacagagtctcgctctgtcacccaggctggagtgcagtggcacgatctcggctcactgcaaactctgcctcccaggttcatgccattctcctgcctcagcctcccgagtagctgggactacagacgcccgccaccacgcccggctaattttttgtatttttagtagagacaaggtttcactgtgttagccaggatggtctcaatctcctgacctcgtgatccgcccgcctcggcctcccagagtgctgggattacaggcgtgagccactgtgcccggcctgtaatttctattatgttaaatttactgtacctaacttggctgtggaggcattgagagtactagagggattttttccttctgaaaaatggttttctggatgcttgtttttttccttactcctttcacattgctcctgttttatatacaaattcttgccttcatcttttcattgtttgtttgtttggtttggtgtttttttttttttttttgagaccaagtctcactctatcacccaggctggagtgcagtggcatgatcctggctcactgcaacctctgcctcctgggttcaagcgattctcctgcgtcagcctcccaggtagctgagattacaggcacctgccaccactcccagctgatttttgtattttttttttttagtagagatggggtttcactgtgttggccaggctagccctgatctcctgacctcaagcagtctgctcacaggtgtgagccaccgcgcccagcccgtcttttcattgttaatattaaggtttctttttagctcagctgtgctcctgatgcctcctcctttccccaccacacacagtgcatctcgtgggaggtgtgtggaagtcagtatccatgttcgttccctttaaatatgtgcttggaaacatgtcacttgctttcctattaatctaaaatgcatcaagtgttctaagagagaaatctatgcatatagatcttcagaaaataattaccaaggaccattggccagtgtgtttctcagccaacatctcagaattgttcaagctaatgcaaaagaagtttctctgtcattgaatcctcatgttctgaccctgagaattatcaacagagaagctctgtcttgccttcttcaaaaccagcatcagtattaatttatatttggaactggtttctgtgagacgctgaccactaaaacattggtatgttttttaccaataaaatatttgtatgtcccatactctatatatctggctttcaatgtctctttaaaacgctgcctgtttatacaatggagattaccagaactgcaaagagttaagtgaaaatcatagacaaaattttatgcagtgaattctataaacaatctaaaattttctttctgaatttgaattcagttttactgcttgaaatgcgtaagccatagactaacacctgatgccattagaagtacctttatactgtagttccctgcccttcagtggaaaatatatttttctagaaagtgaactaaatctgtcacaatatagatgagaatttttcaatatgatagtttatctatgaaagttatgacctatgtgggcaatgtagtcgattttttggcaaagctttgctaattacacaagaaacaaaattcggtatcaacaagtgtgtctctacatattttcctctagttcatgcaggatgcatcagatgtgatgcagcttttgttaaagacccagacagacttcaatgatatggaagatgatgatcctcaggtaagtggtcttaatgcatttgctttgatccgctaatgagttgtggacagcacatggttcaatatatttaaaacaaaaggagtgataggtttcttgacatactatcaacccctgctagcagagacattcttcactgattttccttctgtttctcaagctactttttctcagtctgttgtaggttgctcttgctttctgtgactctcactcaagttttggtgtttgtgggttctatccaaggctctcttctcactcctgtggagcagtgtcactcacagacatggcttccggtttcctctgtgtgcttgcaactttcagatcttcagaattgaagattcatttatccaacatgtaatagacatctccatttgggtgtctcctagccctttgaaggctgcatgatctccctcccctggcagaaaatacagaacccaagaatctcaggacacactgcttgcctctccgccaacgaacagacaaaggcatttcattaggaggaacccctgcctctcgacacacacgcacatacacacataggtatacatacccagctaacgcttgctcacagttctcatcctttacaagattttcctgatctgctcagtctcaatggtgggcagttccaacactgttatagtaacatcataaatgtttgtcatatcttgatggtattcccaatgcctaacatataacaaggcactcaataaataattgttgaattaaattttgactttacattgccacactgtaatagtttaaataggaaaacataccattttgcaaagaaagcatgttttgttgttgtttgctttctttgcaaaatgatatgcaaatatacatgtatgttttgtatgtacagagataacaggcaggagggatacttagcagactgctgacagtagggagactgaggggactgtaagctgtagggaggggtggtaaggacgaggcgtgttgctcacctttgtatcagccagcatatagtttaatgcctggcatgtgagaaacacccagtacctatctgaagagcgggtggacttttacatataaaatcattaagaggtggggcatgtgtccatgcatgctcaatagataaataggtaggtggatgacagatatcaggggataagaatcactttctaggttgcaggggtggtgaatggaaccagattctctaggtaatttgcagatgataaagtctgtgtaaacacagtaataggagaagaggtgttttaaatatactcagccacttatgagaaaattataacagctaagagaaaaggatgttttgtttcttgggttttaataaatgtttaatgaatggagtggcaggcaatagggatacagagtcagataaaatacatttctgtcttcaaaaaatttgtaactgggagttgatgaagtgtttggttttgtttaggtgattagtttcatttagatgattcagatgctaagaaagaaaaccattatcacttactgaaagtagaaagaaatacccaaggttctggtctttgtgttttgcctcacctgctgtccatatcccagtgtagtgagttcacagggatttcattattgattctgaaccttttaagtacataacctttagaaatgctcttactgcttaaagtactgtgaacatatcaataaaacattgtttctatgaaataaggaaatggctttctttatcacgtttacccattgttttttaatctattttaattttaaaatttttccccagatctcttacatgatctcagcatgggccagaatgtgcaaaatccttggaaaagaatttcagcaataccttccagtggttatggggcctttaatgaagacggcttcaattaagcccgaagtagcccttttagatagtaggtgtctttagaaggagctatcggttataatagttctctctttgttattatttttcatatgcatttgttttcttctccgttaatagcccaagacatggagaatatgagtgatgatgatggttgggaatttgtgaaccttggagatcagcaaagctttggtattaaaactgcaggactagaagaaaaatcaactgcttgccagatgttggtaagagagcactgtttttactaaacttttattttacatcttatatacatttcatatgagtgcttttaatagctgctaaagaaattactttggagagccagtaatatgttccttaaaaagtaaagttttctttccattttaaagaaatcgtatggataaacctttcattatcagtgctgttttaaatagcaaaaaacaacaaatagcccaaattcctgttagtgggaagatgaattactgtgccttggagtaatatacagccattacaaaaagtttataagctacatgagggaaggatttttgttggttttgttcttagtctatagtaggtggccatggaatgttttttaaacaaatgaacagaagtgtgttcatgctatttaatgtgaaacaaaacttgtatgatttcaattgtgtaaaaaaacagatatggcaggaaaatcaaaatgttcggttattatcccttatggtgtttgtggtgtgcatatgcatgtttagttcctagttttctttttgttttctttatgagcatgcgttttaaagtgaaggataatccttttttttttttttttttgaggtggagtctctctttttcacccaggctggagtgcagtggcacgatctcgactcactgcaacctccacctctggcgttcagttgattctcctgcctcagcctcccgagtagctgggattacaggcgcctgccaccacagctggctactttttgtatttttagtagagatgaggtttcaccattttggccaggctggtttccaactcctgacctcaggtgatccgcctgccatgacctgggattacaggcatgagccactgcacctggccaatacttacttttaaagttagattttagaaattaatgtatttcttattgtcatcttcaatacttagtatctataaattataaacactttggatttttgtgggttttttctctcaactggaaagcaaatacaaataataacatctttaaacagaattaatctttagatgtagtagaagagaatgaaacaattgggtttttggggttttttttgtttgtttgtttgtttgttttgctttttgaaacagagtcttactctgtcgctcaggctggagtacagtggcttgatctcagctcactgcagcctccgtctcctgggttcaagtgattctcctgccttaacctcccgagtagctaggattacaggtgcacgccaccatgcctggctaattttttgtatctttagtagagacgggttttcaccatgttggccaggctggtcttgaactcctgacctcgtgatccgtctaactctgtcagccaggctggagtatagtggtgccatcccggctcactgccacctccacctcctgggttcaagcgattctcctgcctcagcctcccaagtacctggcattacaggtgcccgccaccatgcctggctaatttttgtatttttagtagagacggggtttcactgtgttggccaggctggtctcgaactcctgacctcgtgatctaccagcctcagcctcccaaagtgctgggattacaagcatgagccaccgtgcccagccatgattttttaaaaatacaaaataacagaagcgttttctacagatttacaaagtaaatgcttcaattaactgatggtttcagggttttttgtatcttttagaatgatttttcctcaattaagtgatacattttgtttgatgtattgctgaaacttgctgaatggaatacgaatgattccagcctttgaagggacaatatatacgacaataatttcctttttttttttctttttgtcactcaccaatactacaatcatttcatgacccttcttttaagactctttttagttggaagactaatttgacagttctacatgcaactttaaatgtagttctagtcaaaatacaacctcctgtggtccttatgattttgctgtttgttaatattaatgcttgaagactaacatgaatctttatttcctcccaatactttggttacaggtttgctatgctaaggagttaaaggaaggctttgtggagtacaccgaacaggttgtcaaactgatggtccctttactgaaattttatttccacgatgatatcctacaacttctgaatacaaaacatgtctagatttagtaaacttgtagtttcttggagtattagacagtgttgactgaagtagacttcaccatgattgtttgtatttgcactaagtgtactcttaggtgataaactcggttctctgcatgtgcctttgtttccacttgtgccaaaacatgaaaaagaaaacgtgacctatcctatgtttgtcagctttctgtggcccacttaaggatttaaggataattagcaaatgattacaattatatatagttgctactttccccaaatatcttttggtaaacgttaagaaaataagacttttattttaagagatggtgtctcactctgtcacctaggctggagtgcagtggcgtgatcaggacgcactgaaaccacaacttcccaagtagctgggacccaggtgcacaacaccaagcccagctagatttgattttttttttttttttttttttttttaagagataaggtctgcctatgttgcccaggctggtctcaaactcctgggctcaagcagtcctcctgccttggccccacaaagttatgggattacacacctgagcactgtgcctggcaagacctgtcttaatagattagagaaccactgatagatggtcagctttctgtagcagtgagaaccctacatttcaaatgtggatagcacctttgcggggaaacatcacttggcacatctgcattcttttttgacacagggtctcactctgttgcccaggctagagtgcatggcacgatcttagctcactgcaacctccacctcccaagttcaagcgattcttctgcctcagcctcctgagcagctgggatcacagacatgcgctaccatgcccagctaattttttgtattttttgtttgtttgtttttgtttttaagtagagacgggctttcaccacgttggccaggcaggtctcgaactcctgacctcaggtgatccacccacatctgcgttccaatatctttctcaacataatgatagccgtaattaatattttccagtacatttttatgcctttacacacgagagtggtagacagacacaaacccagatctgtctgactccaaagcccgtttgtcatcattccttttacggtatcctatagtggtatcctttacagaagacagcttttacccaacaaagacttaacttcccaggatgccagaggacaaagcgggattgcttttaagaggaagttatcaagaccttattttataaatgagattagatagggaaaggcaatttaatctttattaaaaactgaaaaggccagcataggaagaggtcctcggtggtctttttcagggaaatacttcagttgcttttattagaaacagatagtacctaaggttttgaggtaggtacagcttaaggcatgctaatggtcatgggtccttccatagtcatttttgtattttggtttacatttgagcaataggcagcccttcactgctgctggactcattcctgccactattacaggtgacagaggagacaggaggtatgtcttttctatttttatacatgctttatatttaacacaagctcttgggtatcttagataaacagaagttgcctagcactccttttagtgcattgaaccctttaacatttaagcaaaataataaacagtcttttgaggttccttaacaatgaaacgtgttcgagtggcagcagcggaatccatgcctcttctcctggagtgtgcaagagtccgtggtcctgagtatctcacacagatgtggcattttatgtgtgatgctctaattaaggccattggtacagaaccagattcagacgtcctctcagaaataatgcattcttttgcaaaggtgaatatttttctcttaaaaaatatgtataaggttgtatgttcatttattagtcttgctaaaagtaaaaaaaaaaaatttgagacagggtattgctctgtcacccaggctggagtgcagtggcgcaatcgcagctcactgcaacctccacctcctgggttcaagcaattctcatgcctcatccttccaagtagttgggattataggcatgcaccaccacacctggctactttttgtatttttagtagatgttcctcaggtctcaaactcctggcctcaggtgatccacctcggcctcccagagtgctgggattgcagatgtaaggcagctaaataaatttttatatgctatagtgtatgatttgttaaaaaataaaaatgttaaattttttgttttaatattttggtattattatgtttgttttaaagagggtaaatttgccttggaagggcagtataggtagagggaatgatatgggcagcagcatggaagcatgcattctttggaaaaagagaagaaattctgaatactctagtattttagtcttgcacttaataatccaactatagaagcttgggtatcatctccagtttctgttctttacactttcctcaattcttctcttttttttttttttcattgccccatctctttttcatgccattgaaatagcctcacttgggctactccagatgtctcctttcttttcctctcagttcattctcctttcctcaagcactgccttcctcttcattgagtcacttcctttctcatacagtgtcactcccattttgcacaactctagtttgctccaatcttgattgaagatttacagtttctcagcatctttatatgtccttatttacactcctgtaattcagaattgcttctgattttccaaagacagcatgcttccatacctttgcctatattttatttcttctacctctaatgcccttccttcagtgttcttgtatgttgtgtgtacggagtatggatatagcaattgtgttccttaggagctggttgtgtgtgtgtgtgtgtgtgtgtgtgtgttttccatctttgaatcctcagtaccaagcatgatgcctggcacctaggtatgctcagtagtgttcaaaagaaaatatttttttctaactccaatctctaaaatgctgtcattctaacaaatacaagctaagcatatgtaaataatcttccaggatactgaactgtgttcatttttccatatgattcttagtggagtttaactttggactccaaacaccccaaatcttatggattgctttctttcctcaacctcattagtgcattgaagtaatgggagatggatgccttaataatgaacactttgaagaactgggaggtatattgaaagcaaagcttgaagaacattttaaaaatcaagaattacgacaaggtaagttttccatgcttttatttctgaatataatccttgaccatcttggcaatcatttaaaacatttatttgggtgtgttttagttaaaagacaagatgaagactatgatgaacaggtcgaagagtcactacaagatgaggtaagttattccctttggaacttacttacgtgaccacttgcatctgaaagacttgtaaatgcctcaatttctgatttatgtgacttgtcattctgatgtaattatcagtctttagcagaggagtcagatatatttcctctcttaatttatgaataagtaatttgaaattaaactgatatgtctttcggtgctatgtgcattttgttgtaatacctcactcaacaaaacaccttgaggtttacctagttcatttacatactgctcacaacaaccatttgtattttgtggtgctttcactatattaaagatgagtaacctaaaattccagtgttaaatgattgcctagagtcacactgttgacggtctggggcctttttcaccatgttacttagttctctcatcaaaccacctaggactgtcaagcatacttcattgtgtgtttagagtccagcatctcatatgtggccacttggtgggccagtgctaccgtgtaggtagtaccagcttcctgaaggtgcccacatgcttgtaggcccaaattgccactaacagcgagaccccattctccccaccatccaccccgaaatgaggattattctgctgaaaacaaagtaaaaatagtgaaaacacctttgtttcagaatgtagaaattagagataatttttcaacccatctattttaagtatgttccaaggaaaatctttgcaataaatacagttcttgccacacacctttgtctttcgaggtaagactggcctttgattagtaagagacatgataacccacacttgagggttactccggtctctagactcttgatttacccttaaaacaggaatgagaaattgattttctgcattttttaaggtttttataaatgttactattgataatagaaaatatactttttaatccatatgagtgtttatgtgtatgttttttttaggatgataatgatgtttatattctgaccaaagtgtcagatattttacactcaatattcagtagctacaaagaaaaggtgttaccatggtttgaacagctgcttccattaattgtcaacctcattgtaagtgttacctctcttaatagttgttttgcgtagtttacctggaattcttttcactgcaacgtaaaatctaatgcttgaagttaaaatgggtctcagaaatgattgtttccattgtacatctttgattttatcaagttgactgcattaccctggatattttctcattcattatatgcttgaagattcctaacttggttttccataggccaattcagttctaacacatctgaaagatatataagtgattttttttattatttcagattatctgtgccctcctaaattaataaaaggaaacagaatggttacttcttttttagtggaccatagataattcaattatctttgttatgtactaccagcaatcatggattatggataatgggcatatatatatatatatgtattttttttttaccttctctcacccttatatttgatttttttaaaatgttttatagacttctttttgtttgtttgtttgtttgtttttctcaagatggagtcttgctctgtcgcccaggctggagtgcagtggtgcaatctcggctcactgcaacctccgccttctgggttcaagcaattcagacgcacgccaccacacccgacgaattttttgtattttagtagagatggggtttcaccatgttgaccaggctggtctccaactcctgacctagtgatccacccgcctcggcctcccaaagtgctgggattacaggcatgagccactgcgcccaggcctacgcttcctattttaaagcagttttagattcacaaccaaattgaacaggaggtacagagatttcccatgtgcctctgcccctgtgcgtgcatggcctcagcaccattaacaccccccatcacagtagtagatacatgtgtttctgttatggacctacatcaacacatcatataatggcctatgtgtattcagtttttttgtttgttttgtttttttgtatttttagttgtgtttttttgttgggtttttagtagagatggggtttcaccatatcggccagactggtctcaacctcctgaccttgtgatccgcccactttggcctcctaaagtgctgggattacaggcgtgagccacctcgcctggctgtgtattcggtttttaaaaaatatattataaattagcagctatcatcagatgtttggaatttttctttttggctttcaattttgcattttattgtattaagtagtgcagtacattttttaaaagattcgggcacacatgacttagcctgttgaataaatgctataagttaagatctttgcagcttttattattattgtatttttttaatgtagcattaccattgtcttttttacaaagtaaatttatatacaatgcttccactgtcagttcttctgtgtgatagtgtcagattgtagagttctgtaacaaatcatacaagtctttgaaacctaaattttattaaatctgtgtatttgattgaatatcgttggtcacaagaagtggttgttactatgttttcttttttcttttgcctgtatgaggaatatcaatgtaagcagatagtctatagtgaatatttctttacattctttgtgtacaccagtatttgaagcttaaaagagaatttcttttgtagtgtccacatagaccatggccagacagacaatggggattatgcatctttgatgatgtcatagaacactgtagtccagcctcatttaaatacgcagaatatttcttaagaccaatgctccaatatgtatgtgacaacagcccagaagtcaggcaagcagctgcatatggcctgggagtcatggcacagtacggtggagataattatcgccctttttgtacaggtacgtttgcttattccgttacgtgcatttcattccagacatcctgtgaatccctactttactctctttaccacactcccaaacattatttgcctatttctgctgtagtctgttttcagacatctcatctgtagcatttaggattttagatgataaaaagatgatttattctcatagaaatagaatcaaagacatcccctgcccccagccttccagggtgcatttctctttgcgttttggcaatatacaacagccttagaataggacttttttttttttctttaattgaggcccaggctggagtgcagtggcatgatctcggctcactgcaacctccgcctcccgggttcgagcaattctgcttcagcctcctgagtagctgggactacaggcgcatgccaccacgcctggctaattttttctatttttagtagagatggggtttcaccatgttagccaggatggtctcgatctcctgacctcgtgatcggcccacctcagcctcccaaagtgctgagattacaggcgtgagccaccacacctggcagaataggacttttaaaacttactggggaatatagttaggcagcttttaaagtttaaggaccctcgggtgatgtgatgagtactgtaaatctggaggccactaatctctctgggtctctaagttagtagagggctagtgctcctgtccatgctggggcagtcccccctctgttgccattctgtaatgacatagccaagaagacaacacttcccatacactttaacatttctttaccataatcaatatctgaaccaaatacaaaaatacatatattcatttgcatgaaaatgtgaggttttagctgaacttctttcaaatgcttattttagaagcacttcccctgctggtaagagttattcagtctgcggattctaagaccaaagaaaatgtcaatgctacagagaactgcatctcagcagtagggaaaatcatgaagttcaagcctgactgtgtaaacgttgaagaggtccttccacactggttgtcttggcttccactacatgaagataaagaagaagctgttcagactttcaattatctgtgtgacctgattgaaaggtaggaaagcagactgtgaccttatttccttctcctccacagtgcttcctggtttttcttgcctaacatcagtcttttaaggtttaaccacatgatctctgcacagtcctcagttgtataggtttataatagtgctgtctttataaatcatattaagaaaccatatcacagttaacattgcccttataataaggtctaattttgagttattctttatgaaattagattcaacagatgaggcactttaattatttatttctttgtttttaaatttttttggtagcgacaaggtcttaactgttttgcacaggcaggtcgcaaactcttggcctcaagagatcctcccacctcagcctcccaaagtgctgggattacaggcatgagccaccaaacccagcctaagggaatgttgtttagtgtctgttttctaagtccaagttccccccaaatatcagtcagatctaagctctgtcgctattattatttttaggttatgaataaattcaagggctacaaccactgccactattgtagcaataggccaacaggtatattctccatacttgtttaagttcaggttcacataagaaatgggtttgagtcttccactgaccatatcattaaggaatgtaacagccatcctgcagactacatactcctgacctgctcctacatctgaaatgaccaggtcttaatcatgctatttgatcatcttccttggaaacgactactctgaaattctcttagtgacaaagactagaattcttaaattcgctatcaggttttttcccattaaacttgcctgagtttatttcccagtttattcttgaaatgtttatataatttttttgaacttcagagttattttagaagctattttgtagtagcaaaataaaacttgtgttaaacttatttttaataatacaaaacattttttttaacacatcacaaattatttataaggtatttagagcattctgttgtttggcccttaaaacaatcctgagagatgagcccagtattttttttttctaatttatgtagaaagaaactaaagagttcatatataagattggctggttttcttcctactgaatttaaaaggccattgattttagtgaacacataatcatatttctccttataaatttcacttactaaggttttcttctcatttgtcagtaatcatccaattgttcttggcccaaacaataccaatctgcccaaaatatttagtataattgcggaaggagaaatgcacgaggcaattaaacatgaagatccttgtgccaaacgtctggccaatgtcgttcgccaagtacaggtaagctgatttggttgaattggggagggggagataaaacctttttttctttgtagtcctctatgagaagaaactagaaatctaatgagctaaggaattttatttttatattttcatagtctcttgtctccaagcctcaaatggattatacttaatgtaatccatccgtatgtacttattatttattagaattaaaaccttcatcttaggacattttgagcttaccagttggtgcttaacacaagcttatgtgtagtttttctgcctatcttaagaaaaaaaaacaagatttaataataacttgtcatctgccaaaaaactttatatgatttttacttcctatattcatgtggtatatgggttactttaagatgttacctgcttagtgtagctttttcagtgcaaaaatgaagaaaacttactggaaatgaaatgaactttaaaaaaatgaacagatttcttgcttttacaatgatactcatcaaaataatgtacctagggagaaggtattttgccatgattacagtttacctatgatgatgattaaaatccttccaaatgagcatttcgtcctaagtctgtgaaaatgtttctttccctagacttctggaggactgtggactgagtgcatagcacagctcagtcctgagcagcaggccgccattcaggagctcctgaactctgcgtgaagggccttaatgtcacccaccagaaaactaactccaaataaacgcttaccctttcctttaggtttctttgttttgtttttgagcaaaagagatcggtagtgttgtgtgtaggccattcttctggagagccacaagcaggaagagcagcgctgtgttgcagaatggagtttccatggatttctaccagaccactgaaggagttcctggaagccctgcggtagctagcactgaagactatttttctattggtataacccgcccacctgaaggggaaagggaaatcaaattaatttttctcgttagacataaggaaatttaaggaaaaacagctttaagaacagttactcagcgtagatgtgtgttcacacaaattgctctgcattcagtgttcattgtgaattgggagtgtgagtctttctgtagggtagaaagaagcctcctacccagcaaaccagtagacccaaaagttgaaaaaaactgatgacagacaacaagcatgaagatggcatatttgatgtcactttggttctttttcccagaaggcttatacagtgactcagtcgggaagctttccagcttccagcccttgaatgtgaagtgtcattggcatgtctggcagtagtctctcattcactcctcaataaacaacattgaatacaaaagaggcttgtgtaaaaactcagtactgtctggcttggattcatttcatgtttttaatataagaatgatctaatatttttttaaagtaatagctatcagtaatagctgagtgttttttcccctaatattttccttgtgcaattcagacttaagcatcgagtttttaccatcttccactttaagctaagttatgatacctattccattcacaattggtgttctttttaaggtttgcaaatttcagccaattttgtagctaagattgttctgatcagctcaaaaagatttggcttagtgttttcattgcaaattataattgctgtagagccacacacaacttttgaacttttaattataagtgttatggctaaagttatttactgaaaatttcagtaaaatgtgtgaatgtttctttatgtattaacctcatagcagtaaatgacttgctgttgtttaatttttctaaggcatcttaatagacttctgttgaaaacttcagtgttaacatttttatagtttgtactaaatttaaccgtgatataaaaatgaattttatgcatagatcagaattttaaattaaaggttttttctttaaatgatttgtattactttattaaaactaaatctgaaatggaatagaaaatagaatggattacatacagatggtttccttgttagcagatgcccttcaaatatattttacgtttgcagcacaacaccattgcccggaggcttccgaatctagcaaagcagcatattaaatgactccacctgcgcagtccttgtgttcagtggatgaatacctgtgggctcttgtaatgtgtggtaatatttggagctttatagcctgtattccttgggagaaaaaaatgggaattggagtaaaaagtgtgtcaagacaacccctttctgctttcttatgtagcatctgcaaagccgattcatgtactgatgccaatcagctagagcaatgtaggctttttttaatttaaattattactacactttattactacacttgcagaaaagaaacatgttaaaatcatggcacacctgcagaatttcagatgacagtgtggtcagaagatgttttttgggagaacctagtgtttgctgggcactatgctaagcactttgggagcaagaacctcctaccttccagtttaaacactagtggtattgtcagatgccgttagtatctgagatgtacttacagcagggttctaagagctctgaaagaagcgctctgttagatgcagactggcagcatcctccttgataaaagcagaaaagcaaagaggtaattggagttgaatcaagttaatagggaaggttggtagtaaatgctgttagtgtgacatgattctgaaacccagagctcagaactaactgtgagatgtaccatgaactaacaattctttgaaaggacctgcagaagcatttttaatacctcattctgtctatgcaagatgaaaatccatggagttttttcttggcttttgtaccaaatttaggggtcttgcatgtcagcaagtgatatatattgtttataaatgcaagctatttctggaggggaaaaatgtgtgtggctcttacgttttctgggaattttgtaacaagttacacgcacaagtgttagaaactttggcataactcaatttggagtattttttaaatgctgtatctttaaagaaaagtaaaattgtcttaaatctaattgacacttctgtaatgagaggcaaccttataactctggagttgtagtttgacagaaccatcagtaaagacataagcaaataaatggtcttggtgc

SEQ ID NO: 37579 - DNA, 7079 bp, Homo sapiens
gtgtgttgggggtggtgagaatgcgctctcttcggcccgccccgtcctttccaaagaaacgtgctcataatggggtgacctaattacatcgcaatggaactcaatcttagccactccgcagcaccgggtttcataacagactcggcggcctcgagtgctgggaagaaacgtgcgagggccgaggggggcggcggagcccgcgtggaaatcggaaagaagcgcagccctgcgacttccgcctgggtcatcacgccagcagtcgggccaaggcgcagggggcgggtgggggactcgttaactttttatttgggtgggcggcatccaaacctaacagtatatattttatcattttcaagggagtcatgctccattgcgggcccttcggtttcgtggctcccatgtccccctctccacctcccgccaaaacggcgcagcgtgacaagccatatgttccactccggtgggggcgagagagaagcaacaataagttaaaagtgccgcctccctccacctctttaccttcattcttaccaaagtaaccttttttcattgttctagagtcttgaggtgtgtgtggggaggatggaggaggagggagggttgtggcgccgcccagaattcggagcgcgcgtggaaagtagtgagttgctcggtgggctttttctgggaggaaggggcattcaggaaggattagggttttcttgactaaaaagtttaaagattggatgcgtgaaaagaaacggcacgcctaggcctggtaaaacaaacaatcgtcccgggttgtggtctttttttgcggcgccccccacccgcccacacccggagagcgccggctgcaaagcgagcgcgagtgtcgacgcgtgcggcgcactaaattgtgccgcgctcgcccccgccagaccatgtcctcctggggaaaaagtttccctagtccccccagcagcgcgccccaccctacgccccgctggaaaaaaaacagcaacataaaatcctaggcttgaacattctgtgcgtcccaaatttctaatgtcctcggcctgcccggtttgccgaagggagccgagtgtcgaagagaagtcgggaaaaggtaagttgtgcagacacttggggaagtttcaaggagaccgccagctcaagatggaaaccgcggcccgggcgctaaggacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctcccaagtttgaaggaatttggccccgtccttcccaccctttgagtttcaacagttgctggcggggattacatgtgaatctggaggccagggttttgaggggcgaagtttgcctggcagggcagcccgggggcttcggggggagggctgggattgggacaagttttgggcgatcctgttttacgtaacgtgctgctggatcccaggtttgctggtctgatcgggttcccagtctgcgccctaggtctgtccagcggcattacccacccgtggggttgggagtgggaggtccctcggggaagtgagtctcgggacaatgttttcctccactctttggggggagctggggatatgcgaggaagaaaggccaagttgtgattcaaaaagatgttgcagaacaagtttgcagtggggcttgagtccgccctagctccgttgggcttcttcccgcgatagccgatcgtgcagcaaactttggggtgaaagaggcattcaggttgacccgcttacctgtgttgccgaggcattgcggctcatcgattgcgggcggggttggggggggaggtggcgacaaaatgctggcttgaactcgagagtcccgcgagtaaggatttaatggggggctccttaaaacatgttgcttgtcagccagtgttgaaaaagcaagttttaaactcggaatgttccaggactgcggtttaaatgtacatagcaaaagtctatggatgttgttaaatttctttccaacctccccctcccaatttgaaagggtgaagctgctgggctactttttaattgctgaagtgttttgccttctcttaacacgtcgggtcatgttgctctgttttcccagcttgctgctcctgttggtgcagctgccaacgccccagggctgcagggttggggtgcagggacgccgaggagctgaagagtagcatttaaaaagtttgaatttttcagcttccttccctccctgcacattcccaaactccacttgccagcccggctgccagcgctccccaacatttcttccttcttttctcgactctcccgctctttgatctatttctttctttggcccccctcccccctcacgactttttaaatgaacctcattgttgggaaccagctctcgactgggttcctgtaatcctctcggtggggtggttgcagttacagattcccggtccccccctgctgatcctaagggaccaacattagaatttgcacaatgacacccacatgggctgggaactaactcctaggtccctgacctgcaccatttccaaatcttgggtacaatttgggcaggtgaccagggtcctattggaacagaaacctgccattggtggctctgcccccatccccaccacccccaatccgctattgactaggaggtgggtaggggggttggtgctttccttttcctttccatctgcagctttgcgttaaagattaaacactggagctcttatccaagcttgctcttgcagccaaaagactaattgcaaaggcatcttctcagtgaagggggcggggtgggctagggctgagtggaaatggtgagagagattattgtagaaaatatctcttccgggaacttagggcaaagagttttattttcaggaatcacatccctgtctcccccaacctcagaccaggcccccaatctcctccccacaagaaaaagcaaaggcagtctgaaaacctgttgccaaaggaagggaacacttctgaaggaggaagttgagagtcttaggccaggtcttgaaggagggggtatcaattaagcagagactgattggaaggggacctaacgtagcctatgatagactcctttctgaggtttacctgtttttgtcgcgggcggtggcgggggcggggtgcggtaatctagagaggtctgggttgtgtgagatattttgagttgaagaatctatttgactagtaaaaaagttgaactttaaagtggtagctttggggacagaggacatgggggttgcattgcaggagtcagcatggagcagggtgcttgtcacacagtttggatcttgtggtttcttacgcatggggccaaaataaacccaggtgaatggcctatgggagggagagagggaagggagcttgctagagccgaggtagagatgagttctttgagaaagagcgggcgtttgtgattgtgtagggggctgcccatagtggacatcctggtggatgtcctctgtccttaccatcctttctcttctctctccagggtaacaagatgctcaactatagtgctcccagtgcagggggttgcctgctggacagaaaggcagtgggcacccctgctggtgggggcttccctcggaggcactcagtcaccctgcccagctccaagttccaccagaaccagctcctcagcagcctcaagggtgagccagcccccgctctgagctcgcgagacagccgcttccgagaccgctccttctcggaagggggcgagcggctgctgcccacccagaagcagcccgggggcggccaggtcaactccagccgctacaagacggagctgtgccgcccctttgaggaaaacggtgcctgtaagtacggggacaagtgccagttcgcacacggcatccacgagctccgcagcctgacccgccaccccaagtacaagacggagctgtgccgcaccttccacaccatcggcttttgcccctacgggccccgctgccacttcatccacaacgctgaagagcgccgtgccctggccggggcccgggacctctccgctgaccgtccccgcctccagcatagctttagctttgctgggtttcccagtgccgctgccaccgccgctgccaccgggctgctggacagccccacgtccatcaccccaccccctattctgagcgccgatgacctcctgggctcacctaccctgcccgatggcaccaataacccttttgccttctccagccaggagctggcaagcctctttgcccctagcatggggctgcccgggggtggctccccgaccaccttcctcttccggcccatgtccgagtcccctcacatgtttgactctccccccagccctcaggattctctctcggaccaggagggctacctgagcagctccagcagcagccacagtggctcagactccccgaccttggacaactcaagacgcctgcccatcttcagcagactttccatctcagatgactaagccagggtagggagggacctcctgcctactccagcccctaccctgcacccacatcccataccctcttctccctacccatcccattccccacaggccctacattaacaaggttaagctcaacccctttcccccagcacctcagaatgtgccctccctctccccctcataaccccacctaacataaggacaagtcaatttgtcagtagcttcttctggcttgaaaccccctccctggattttatagcccacttaccatgcataacagacaagtcccatattttgtcagtagatgcctttttttttccggcttaagccttaagtgccaaatcacaagagaaaaagcagtaacagtttacagaagcaacttagtgccttgtaatctaactttgtcactgtgactacattacctcttcagcgccagagggcacccgtgggcctcccggagcctctgcccatggcggggtggagacccggaaccagcagccccctccactggcgacacaactgcaccttccctcatttcagtctcccgcacacttattcctcctcccctcttcccggtggcacctctccacctgtacccgcccccccaccccccccacccctgccccttggaagagttgttgccagaccagggttttgggggaaacctgtcttgacattcaaaacctttttcttcccgatctgaacccctgttgactaatcttgcctgggtttgtgtaggtctgcaggaaggaaggctgaaaaagcggacgaagattttgacttaagtgggactttgtgatttaattttttcttttttttaagtggggaggaaggggaagctagatggactaggagagacttgattttggtgctaaagttccccagttcatatgtgacatctttttaaaaaaaataacaacaaaaaaaaaatgagagaaaagctaaaaaaaaaaaagtaaggggtgagcagttaatggtattcattccacatacaatatctgtgtaaaacgatttcctgtagaagtagctttaatggtttttgctctagaataccgtaggtctatccttagagcactcacgccatgctttcttccctgggttttaaacttcatataactttcagaaattggagagcaaaaattttgcttgtcactgcacatcaatataaaaaagcttatttaacttatcaaaacgtatttattgccaaactatgcttttttttgttaattttgttcatatttatcgggatgacaaatccatagaatatattcttttatgttaaattatgatcttcatattaatcttaaaattttgtgacgtgtctttttcctttttttccacagttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttctaaaaggggaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaaactttttgtaacgactatttgcagtttaaaaatcaataaaccccgttttttcaagaaacatt

SEQ ID NO: 37580 - DNA, 205741 bp, Homo sapiens
gagtgtggctgcagtgcgccgggacaccagggctccgcgctccgcactcaagaggctcccgcgtcccaacccctcgcgcccgcgcgttcgcggatccaggccgaggaccgaaaggggccgcccgagcccccggggccggcgcccagagagcccagcaaggccggccgccctgccggtgtgccgccggcgggtgcttctggaagggccaatgcgttcgggcagcagcccctgaagccgagcccgaggtgagagcgacccccgagcggcgcccagaccctggcccgagagcaccgacttggagcgccttgtgcaggctagggctgcacgctctcctgcttgggagtagaaagggggagggtgggagagcgaagaccgagctcctcggccaaggagcacccacaggggcctaacgggaggctctccttctttccgggtcgtgggggggacggccctccggtcacccctgcatgcgggccgcgcaccgcgctgtccccgcgtctcgcggaccgagaccggcggtgaggatgggctgcctccctcatcctgcgctaaactcgctttgtctgtcgcctctaggctaagtgggactgaccggggcccagagtggacgaaccgccagcatggggagagaccagcgcgcggtggccggccctgccctacggcggtaagcgactttctgcctggtccccgtgggtcacgcgcgcatggacccttcggtgtaactctcggggactgacaagccgggcccgcacgttcacgtctctcttcctccctttcccatgcaggtggctgctgctggggacagtgaccgtggggttcctcgcccagagcgtcttggcggtaagtcctggctcccgcgcttggacttgcgcgcccgagagtggttgggacgtttgagtggccttggagaaggcagctcgtccgtgcgctcccgagtgtgtgtgtgcgtgtggatgttcgccaggctgcccaccaaggttctgagaaagcttgctcttccctcatcatgctttccacctttccttccccttgggttcccagcgtcaatcctgtgttttgcaagcgtcggcctttcacgggaactgggaacttaaaatgtagcctgaggcaccgttttcgttgctttgggcaaagctgcagccgtagaggccaggaaagtgtgtcagtcactaggcagtgagacgccaggcttagggcgaaaaaagttttcctggaactcgggagctggtggggagtctctgtcacggactgagggttttttgtgtttttaaatgggagtctctgggtaaaggggcggggcgaggaggcgaacgagacaaccttagtattgtttgaattgaagcattgcgagggaacaatggcagaaaaaccgcgttttctcccaagtcctgttccggccctggaagagctgctccgggcgccacactgggatcctgttcgccgagcctgcccctccacgccggccgtgcacagccctgccgataccgtgggtgcagctggcgactgcactgcgaggctttgtccattttatacgttttgtttaaagagtaggagccacttttactgagctttatgtaaccatggctaaaatgaagaggtttggtaggtgaattcggtgcaggactcaaatgtttagacaggagctgaaagcggagggagctttcgagatgtccgctgtccctcctctccttactgtggccgatggagtagccctgccctgtggcagccggggcccaggtggattcctcctgggaacgacccctccctcctcagcgcgcactgtgccagagcagtacacaggtacaaagggcaaacgtgttcatgatttcatttgaattctgttgtttttacatcgttctgccctgatgtaaaacaaaccaggattttaaaggcagtgagtgatgaggagctactcccacttggggaagagctgctaactttacttttccgctgctgttggttccggttcaaagctcggtttgggaagtaagaggaggactcggagactttgaccagagcactccaggccaaagttttcttccagttcaggtctgtctcttcgtcccagccccgacttaagatcagaacctagatatttgaactagcccagtgaccctgtgaattctaatgcacaggtctgtactgcatgtaagacttggctcagatttatgaaccagaagcaatgcatgcacgcgcacgcacgcacactcaaagaagggggcgatccctagaaaataccacatcgggctgtgtgtgctttggttgtgctgccacctgcacccctttgtcccttagagccacttttataatttccatatgttcatgcctaaggatggtgggagtcccaggtattcttttctgaactcatcctaaaattggtagaaagaccaccaagcacctaggtctaaagatctaggtattagcctgggcatggcggctcacgcctgtaatcttagcactttgggaggccgcggcctgtggattgcctgagctcaggagttcgagaccaccctgggagaaacacggtaaaaccctgtctctactaaaatacaaaaaaatcagccgggcttggtggcgcttgcctgtaattccagctactcaggaggctgaggcacaagaattgcttgaacccaggaggccgaggttgcagtaagccgaaatagcaccactgctctccagtctgggcgacggagcaagactctgtctaaaaacaaaacaaacaaacaaaaaaaacctagttactaaacatagctctgccctaatctcttaaatccagagccccagtttccgtactctgaagaattacggcttcacagaggccaagtgccctaaggcagataggacacctctatgcctccccaaaacctcatcattgctgcaagctcacccccagtctctttgactctttgatctttggatggcaccaagaacattgattgcccagcagagcttctcaaagtgcaggccccctagacccccagacctaaaccctgaaaggcttgttaagaagtcaggccccatctcagaccttcaggtcagacattccagggtggagtccgggactccgcctccccacatgataccagaatctgggaaccactgagctacagtattgggttgagaggcagttgagattacttgccaattcactttattttcctgggctttagattctaactcaaccaaaaaaaatagatatttttaatcattttactagggacctagtaatatgtgttgttaagagacatgtagtttgttacgttcaacaaggggctggtcttctacttactcacttcttggtaaccactggctttaatggctgttccttgtgaaataatgtttcaattttcaactgtattgattaaagatttttcttaattgtggcaaggactctttcctgcgtaggtcagttcaggaaaaagggctgccgctgggagccctttggcttgttttgtttcggaagcagctaggatgggcagtgaagagccttggtgattacttattgggcacttcctgtgtgccaatttgtctgtactaatgcttctaatcctcacaagcaagcacactgatgagctaggtaactattattacccccattttacaggtgagaaaagccacaaagggtttgcagccctcgcccaaggttcctgtctttgtaactgaatgagacggattagaacccaggcctcttcctccacaccgagcttcccagggcctgaaaggtggccgggagggcactcctgagtttcagtctttgagtctcctggggtgtgggtgctttcttcttggtcttgaccgtggactaacagtggagcgggcactgattcctaggaaggaggctctccccctccttcctcctctgcttctcccactgtgaggatcaggggcagcaagtgaaggagagaagcaagacccttcccaaagggaggaaaggaagccgaaatcccacggggcagcctgggctctagactcagtgtgaacccaggtgatctgtgtgggcacctcaggacacactccctgctgtccaaggtgccctttctaaaggtgcccttgtttgaatgtggtgccaagatgcacaaaatggcttcgtgtaaggcagtgtgacacaggggtcccatcccagacttgaggcaggtgacggggtgcagttctcagtctggtgggcagctgaggggctgccgcctggggcggacattcgccaagcctctgcgtcctagttctcctctcccccaaaacggaggtgttactcatcccacccacctcatagatgggggtgctgtgaggtgtgtgggtgcatgtgaagcgccttggagggtctggcacagcctgggtgccaggaggtatcccctgggcctgtttaagggacttcccctcggctgcctattctaaccttcatggaggcttgaaagcactcactgtagccgctctgagcattgtcacctatctccagaggctggcagcagcctgagggatcaaatatgcagccggctgggtggtcacctgaggacctctggccgggacctggggccacaatagacgtgggttcacgtaggcatcagtgcggggcccctgcctgccaccctgccgcttagtttccaggctgtcctcggggctccagccccaggaaattcgcctgaccttcctgttggctgccaccgccttccctgccctccaggccggcagctgcggtggcaagtcctttccgcaggctttggtacagggaggagaggtgttcatgccgcacgaggcccagagctttctgtaaggatcgggaaggacaattctttcctgcatttcctggagctgaagcgctattgctcaaaacatggccctctgagaagaagggaaaagcacggggttcctcctctgctcgtggataaacaagcatatctcagctctctggaggctgttaaagtcttcctccatgggtggcttgtaggacttggccacgataaataatagcagagatttgtcagcagcatcccagaaggagaggtgggtaggaagggtaaaccgaaaagcgcaggagaggaaacaggctctgtacgaccaggcggctatgtttacaaccagagagagagaggtgaagaggaaaaggttctagaatagaaaaaagattttgctaaaataataaaaatcaaagaactgtgtttaattgtgtttctggggagagggaaagaaaatggatgtgtagtttaaataatagagaaactcaagggaaaaactgagtgccatggagatttaacttttcaaccctgtgttgataatataatgaagagatcaccatctagaaagtggtttgagaatgtctcattctttttatctgaagaagaatgtttgtctttgattagagggttttagagaaagctctgaaactggcctcatgctttgtgtctgctggtgtctactgtgtgatcactgctgaaggtaggaggcaatgtctgcaacccccagccttggctgatagagcttgtgaatcagggaccaggaatgacacaatagtcttgagaggccataaagtctaatccagcctgttgctaaccgggttctgacttcagggcaagacactttacgtgctttggctctggagcctggaagagaatgttgtgtggaatggatctctcaggtgatcaacataccatgagtaagttagaggtcagcagtgagggctggcctgtgcaggtgtgctaagacctgtgagggtgagccggggtctccgctgtgatgctggggatgagaaagcccttccagataagctccagaatagaatctatccagcctgcaccaggatatcgcttagaaatcaatatgccacatgggactttttatcttcacggtgtcgagaagcttctggaatccagtaaatatgtgacatttctcagttgagatgaggaaaagggcagagttcctggatagtcccctcttgctgtttccctctggtgcccactcccttcagttaatgagaccctgtcaggacaggtgacggcctaagtgactcactgctcttgatttcattggtggctccggaggacggtaatttttattttggttacccctgaaaggagaaggcggcatctaattctagggagacttcacaggtgtctccagtcctgttgatgtggccagagagtgaatttcaaaggacgtgcgagcagccggcgtccacccggcaggctcccaccccggtgccccgcgtccacccggcaggctcccaccccggtgccccgcgtccacccggcaggctcccaccccggtgccccgcgtccacccggcaggctcccaccccagtgccccgtgtccacccggcaggctcccaccccagtgccccgtgtccacccggcaggctcccaccccggtgccccgcgtccacccggcaggctcccaccccagtgccccgtgtccacccggcaggctcccaccccggtgccccgcgtccacccagcaggctcccaccccagtgccccgtgtccacccggcaggctcccaccccggtgccccgcgtccacccggcaggctcccaccccagtgccccgtgtccacccggcaggctcccaccccggtgccccgcgtccacccggcaggctcctacctcggtgctgggttccagcccctcccctgtctcctgagctcctggctggctcctgagtactctgcttcactgtcttctgttgccttggatgaagctgccttttgaagcaacatgcttttttgtaaaaccggctcctttgaagtgcagcctggtatcctggggcgggtcctgggacagaaaagctgcactagtggaaaaactggtgagattctagcggaggctgcagttcaatgtgataatgttgatttctgtaccaatgttgatttcttagttttcacagaaatgtgccatagttttataaaatgtcaatatgacatcatgatgtctgggtgaagggtatacagggactctctgtactatctctgcaactcttctgcaaatctcaattgcttcagaattttaaaatgctcccaggagtcagcagccagtcacatttggtgtgcatgggtcagatggacaagtgcatggagaaggctgaaagcagccagtctcgaatgagcagatgtgggcagcaagagggaaatgttgctcccattcttttctctcatagagtaagtgaacagaagtctcttccacttagtggaaaatacagcagaggtagacccaagcgaagcctgagtaaaaggatttttgtcccctggccgtgggtggagtcatttgtgaagacggggaggtttccctgtggagtttctgcagcaccacatgggaggcccggtggagctgtcatggggcctcttcttcgctggggagggaagtggccgctccgttgtttcctgagcccaagatggaagggcaggcttgtatcacagtgtcgctgcaaggacagaaaactgacagtggaggagcccggtgctgcccatacgcgctcacccctaggaacgcatcaggcagtaccctcgtgccctcctgggctgcacagaatgggagcccccttcccgcctgcctaggaaaccccatgggccacagggacgggcaggtggcaggtggctggtggctggtggaggacttaggcctcctgcacacgtgggtcacctgatagaaagggacaggccatggcagtgggattcagagtcccagcctctcagtggcctcagcttctgtgttagttaggggccaagggaaaggggcctggagccaggatggccagtggctgttgccttgcacagttgcctgtcatcaccctgccattgataactggaaatgagaagcatgagcagagccgcctctgcccggcccctgccagttctgctctgcacaccctgtctgcactccaggccttagccccggggggataaggatggcctgtccctttctatcaggtgacccgcagcaggtatcacacacctgcacatggctggagcctctgtcctttgcaactgaggcccatttcagggtctagctaaagtgtcttctccactgataggattttaaattctttaggatcgaggattataagtcatgattgtagctctatagacttgaaacatttgtcttcacccatcatccactttttttgtttgtttgttttcgtttttgttttagaggtggagtctcactctgtcacccaggctggagtgcagtggcgtgatcttggctccctgcaacctctgcctcctgagttcaagtgattctcctgcctcagcctcccaagtagctgggattacaggcacgagtcaccattctcagctaacttacgtatttttagtagagacagggtttcaccatgttggccaggctggtttcaaactcctgatctcaggtgatccgcctacctcagcctcccaaagtgctgggattacaggcatgagccaccacgccctgccatcatccactttttctcccagtaacatgtcttctttagctgacattgctgttcccacagtccaagttcagggcatcttgcatcggccctcatggaatgattcatgggtacctttatctgcccgaggcctgaaatacagtgggccctcaacagagcttgttacataaatgattgcagttagttggcagcaatgcaagcagatcctttggatgaggagtacagtcatggaactattaataaaagaggagattaaaatgtatttattcttactgtgggtttttttttcccaaattatctgctttctcccactggataaaactagccgtatatgatgataaaggaatcatggatcagtctgaaagatttgcattttttcctagggattgtttcaaccccacccatagaattcctgttttgttgcttttacccagttcagtgatctctcatgtgggaattagagaagaatgtgtgtttttgaatttcatggactgattatctggtacctggtggtaaatattatataacaatatttttccacatgttgagtgtttttggatccctgactgtggagtaatgggaccctgtgagatccaggaaaagggcttctgttggtgcacagggtcagacacacgtgccctggactgcatcaaaagccatggtttgtccacgagagaaaggagatgccgattggcagccgtgatgcaatcattgcaaactgtgtcgggaaggagcatcgcagcgatgcaggccctggagccaccagcccggccctccttcccgctctgtcctccccgccttccagtgacactggctccagattaggtgaaaggaagaggtcccctgggagattctttgtgggatcaccagaaccaaacctaagagagcatcctgaagatgcttccagcattccagaacctctcggagcagctaaaacaccctgcgaagaaacatagcaaatcctgtttgctgagccactggtgctgcaaactgctctaagccacggatggttcacagatgggtaaactgaggcatgtgcaggaaggcacctggtaggtcaataggaacaaagtggggagtgaaacctagaacttgccgattctaaaacctctgctcttaaccactggctaggtgaataagccccagccacagaatatatatacacgtcaaaatacagaaattgtggtacatgtaaaacatagatatgtatattatatgtagaaaatatgttatcaatctacatggaatatacagacatagatgatagagataaaagagagagagaacacacacatacatatgcaccctgtactcacacacacacagacacacagatgcacacatacatgcatgcacatagacacacaggcacacgtagacacacacatgcacccagcacacacatacagacacacacatgcacatatagacacacttgcaccccacacacacatacagacacacagatgcacacacacatgcacatagacacagagatgcacacatagacacacacgtgcaccccacacacacagacacacacatgtacatatagacacacttgcaccacactcacacatacacacagatgcacacacacacgcacatacacatagatgcaaatacacagagacacacacttgcacccacacacacacagaaacacatgtacacacacataaacacacatgctcatgcgtgtacacacacacacacttagccggaggacgctcctggtttctttcttcatgggagcagccaaggcagaaaaagactatacctgcctctggggagcatcaaacagacctgtttctttagggtcccttctgcagagaggctggacagaggcgggagggtgactgagtagcctcatgaactctgaaaagtaaaggctaagatgactgcactcaggagaggcccttaaaggatgaccaagaaatacatgagaatgggcaaagggacaatttcacctgcagaaccaagagtcctgcagacacaacccccaaccggccctctccaagtctggcttgaaactccgggccactggggtaaatgctgctgcagctatgtaaaggggaaaaggaggggcaaacacggctttatgtttggctgttggaaaattctgctagtcctaatttagagaaagacttactgaaacgctatgggcaaaagagaccttcccaaaattatcttagacgtacaggaaacccagtgggcactacagagagacaggggattccattttccctggaccaatgccagcttccttacgctgggtcttctctcaccgccccgtgtttgtgctgctgtttttcatggaagtccccatgcgccaacaggaggataggtgtggtctgttaaaaagaagtggagcctgtgggcttgagcccagcgactgggaaaagtcacttttcctttctgagaatgcttgtcttcatctgtaaacgggaatactgaaaactatgtcccagggtctcatgtatgtgacattcgttcattaaatgaacatgtctgatgctgctaggaataattcactcacgagttctagaacaccatggactcgtgtctgggtcagagcaaggacaagcaaggaaccgtgaagtctgatcagtgtgtgtgtgcgcgcgggtatggtttgggttgtccaaatatctgacccaactttactttaaatatgtcatctaggattattcatggtaagaaagcaacctgcagacgttcactatttgagagccactttatttgttctatatgagacgttcagtacgattgattttgtatgcagttgtactcatcagcaagcacctataagagcccccactcaccctgctcacaggaaatgtcaggactcaggcatgggccccacagaaatagggccagctggggtcttgggttcgaaactgctgttgctgctgcccagccaggtgatgttggtgcgagtattcaactctttacactgtagttacatttctaaaactgggttaaaatagttcttaccttatgcacgtgcccagaggagcaagaagaaattggctgtagagagtttagcaatcttagcattgcggtgcttgatcaacactagttcacatctacctggctttaggttgttgttttttaggtcttcatcctcaatacctaaagaacttgaagccacagagagtgaagttcaagttaactagagttattgttaactctagttaacagtatgaaataatgaaatattccatatttcattatgggcaggttgggggttgtgtctgcaggattctcggttctgcaggtgaaattgtccctttgcccattctcacgtatttcttggtcatccttgaagggcctctcctgagtgcagtcatcttagcctagagttaccttagccatggtactgggacaggaggaagtgggtcagcaggactggtgggtgcgggggcctgtggggggaggttttagtcttcacgattctggtgcctggagtgctgagaccctggtggctctgagcagatggccgctgagtgagaactggtggagatgcgccttcctgatgccttgagacggttatttccattttccttaagtttaggaaatgtcacccaaaggaaacattttaatattaattaaatttcagtcaaggtgtaactaacttatttccagaacaaatggaaacacttataaacaaagaacaatttgttcaaataaccatgagatgcaagtataatttagcaaagcaagaaaactcaagaggctttggtttggcaacatgacataaaaatgcagaacagaatcttaggagagagtttccttcttgagagagcagaaagattccctccataccatttcctagcagcgcaactacttctcagattagcatggaaaggcctcccagactagcccgtaccctccaacagccaggtgagtcaggccaagacgtgggttccctgaggaagattcccgctggaaatttcagggaagaacctcacctccttccctttcttccttatttggtagttgtcctaattgtaacaagcatccaagttacaattcaagaccaagtagggacctgaggtgatctcctgtcctgtctgaaatccaccttcctttcctagctgttcccgccagatttcagcgccctcttcccttctcctcccaagacagtcttagctcagacaggatttccttagtcttagtcatcagctcttattgtccggcctcctccttcctgttgtaaaacaaggaatcttaacagcaagtaggccaaaattgtgtatcttcagtgatatgtcaatttcctgccggtaagtgcagacatcaggttttgtggtggttacccacatcaaggcgccagaggttggaaaagtcaacgcatttctagttaaggcacaccgcacagtgagttttcagctgtctgccttggcttttgtgaatgtgtctctgtccacccgaaggttctggttctcgcatactgggctctccttttgccaggcgcagccgcacaacccaggaacagtcctaacccattacataaggtggctaggcggggctggcgggtggcactgccaggtcacctccgggcactgggtgacccagtcattggccccctacggcgaccccctgccgcgtgggtgccactggcacctcccctggactcccagtgctgtgatttctgggcgatttctctgctctccaacaagagtgatttgttatctgcttctcacctgattggaatttaatggtctagaaacaaatgagttatttcactcaggagggggaaggaagtcagattagtcatgctggtgcttgatttttttttaatccaagaattctttacttaagaagtaaaagcaattaagaatagtactgaatcctgcctagaagttccagaacaaggaatgggatgacaccgatagatatttcaaataactggaaagtttagttccctctgaacaaagtctaactctgaggccatctgcttctttttatatcaaaacagagcagcgtctcaaagaaaataagtgtatttaaaaggaaagatcataggtagatagaattcatccgttttaaaagttgcctttttctcctttttatagcacctttcaaaaacatctcttctttcaacacttctagctcatcagtgagagagaacaaaaggctacaactgttgattcaggcaacatttttgccttcatgttgatttttcttcctcattgggtttaattaactagagtgtctaagaataaacatagaaaaaaggcctgtttcatgggcttttcttagtctttcacatttaaaaaaattaccttagatctttattctttctaaatatttcatgtgtttaaaaactaggtaactttcctgtaataaaaaataaaatcttggcacattatcaatatagcacctaccttacaaacacagtgttgataaactaaccatctgaagataatcttactaatgtcacatcaggtctcatatatgtgcgtatttatatagtgtgcatgtgtgtgtgtgtgtgtatgtgtctgtgtgtatatatatatatatatacacacacacacacacatagagagtgtacatatatatatacacataatgcaaacctgtgtccatttttaatatttttttcattgttttaaattgtggtaaaatatatgtaacataaaatttaccattgtacccatgtttaaatgacagttcagtggcattaaacatatcacatttttgtgcaactgtcaccattgtccgtctccagaacttgctcatcatcctaaacagaaattccatgtgcattaaatacctctgcatcccatccttcccccaccctctgttaatctattctactttctgtcactttgagtgtgactactctagggacctcacagaagtggaatcaggcagtgtttgtccttttgtgactggcttacttcgtttagtataatgtccttgtattagtccatgttcatgctactgataaagacataaccaagactgggcaatttacaaaagaaagaggtttaatcaacttacatttccacgtggctggagaaacctcacaatcatggcagaaggcaaggaggagcaagtcacgtcttacatggatggcagcaggcaaagagagaatgtaccagcaggggaaatgtcagatgcttataaaactagatctcaggagaactcactatcatgagaacagtatgggggaaaccatccccataattcagttagctccacctggccccacccttgacatgtggggatgattacaattcaaggtgagatttaggtggggacacagagccaaaccatatcagtcctgaagatgcatccatgttgtagtgagtggcagaatttccttcctttttaagccccagtaacagtgctatgctttttaaagttcttatttttaaactcagttttgtttctttggttgacaggtttcaaatggttaatgtcaggtattgcaaatcagagaggtttaggaaatggcgatgtgagacccagctccagatgaaggagcagggggcaaggaagcctggggctggcctgcctgcctgtctctcggaggcggcctgcccgtgcctctgttcttgatgtttgttttgctttctggtaaacgttcaccactctcccgaaggaggttggcttgggccgcactgagttggtttcctctgggacaggcatgggaagctgtccaggagggaaccgggtgtctgggtgggaagccagtgagcgaggtctgggttgcccacacaggtgcaggcaccagacctaaagcagttctcctggagcagttcctgaagccccagaactgcgtgagattcctcaggaggaggacaggggatggacgcgtcaagacaaggggagaagacatatggggaaccccgggaggggctgtgagaggaggctgtgatcgggtgcaggcctagatcttccccatggcttcaccaaactgacggtcaccagcctcccctcttcctgtggtactggggtcagaagatggagagtggagacagggagccgatgtccacctctggtcactgcccttcttccctgctagacttcaggttgctaagggctgggaacttggtttattcatcaccaggtcctcccacagcacaggaccttcacatagatgctggagtaattttattaaatcagtgtgttatttaactcttccacggggaccctaagatagttaaggtttctctgcaggcgcagctggcagcatgatcagaggctactgaggccgcccgagtcaggtcagctggagcgggagggcggatgcccagaggaggctaacaaagggcgtgttgccatctcctttttacattttgaaggctttggcatgacccccaataccagctgttacaaccaacccagcctgggcactgttgcacagtctaggaggagcaagtagacaaagatagggatccactgattctatgaaaacttgcagctgattgaggggaggtgtcagtccatgggaagtccataccacaggggttgggagctacattccccagagttcaagggcctgttgctgccccactgccttagattcctatgactggacatcagaggcccactggtgactctggaatttctgttgcaccctctgtggtcagggagctctaaccaggtgatgccccgatgcctgggaggaggagcgcatccacaggcagttccttgcctgagatgatgtcaggcatcgggatgagggccccccctgtggaagctggacagccgtcttgctgtttgcttttatattttttgagttagtcatgctaaatataatgtctctgcagctgtaaaacctggagctgaagagaatgagtgtctgggaagctgggggccagcccacaggctcctctcctagacagacagagcatgcaggatgcccagtgccagcttcccctacctgctacctgcagtattgcatacaataagggcaggtggagttgaagtcagaaaattccaaaggaaaggggcttcctcctccacaccaaatctaagcacaggccccaggtggctccctgaggacagggaccaagccatgggcacgctgcccccagcgcccagctgggcatctgctgtagcagctggagtctaagccacacaatagacagagctggtgggaggaaagagagagggaaagtcgagattcctggccaggaccgaagctaagtagtttggggactttttgttcagaatcacaacacaaatcattatgctgagtgcgaaaggcatggccctcaaaaatgtgcaccttgggtcaactgaaggttcctctctcattggtttcacttgatttgaattacagtcgaaaaaattattgggtagacagacattggcttatctgcaaagtcaaactaatgcaaaatatgcttcaactgcaagacagagtgccaaactatttcaatttaatagcatggtttttttttttcttgagcttcaatgcaaagggaagccaggcatctggccagtgagcagtctatgagctgagctgtgcttttcttcagggcaggcagaggttggccagtggccttcttggcactcccagaaactcagcttcatgggcgtcaagggtaagaatgtggaaggtggtctggtggccaaaatcacacagtccctggatgtggtggtcaccatccaccaatgtccactggtgggcgataactggactcgctccttcttgacacctgtcctgctgggctcttgatattgaggctactggaggaaggagcttgcctgagaaggcacttccacaaggagagggatctgagtccacaggggaggggaggtctcttcgcctgaatgcatgagaaagcatactggacatgaagccccagtcctggctgggggtcagaagagatgggccggagcagcactgcccgaacggatgcacgtttgactcagccgatttggatcaggcaggtctggggctcctgggactctgcattcctaatgctcccaggtgatggtggtgctgctgcccagggtgccacagtgagcagcaggtcctagaagacagcctctggagggctcttctggcctcgggattgtttctgccttgagtggttgctttctagcaatagaaaaatgtgtaggtggggcctcccggcccctggaatctcccgccaatctttaaaacgtggtgaggaccaccctacgcttgcctgctgattgatacagctttaggaattgggtgagggaaagataattttcatctgttggttctttggaagggttaaggaatttctcatttacaaagctctttatcttttgacgtgtgggactgagccttccaggatcatgtcatgcctgagagcacgttcgacccttagcatggcaaaagcagccttcacatgcacaaggaggatggggagaagaggcatcgtaactgactgtatgaaaacgtctgcgtccccacaaagatggactttcttacaccatccaccttagctcagccttttaccaaagtttaagccacatgtgtccataataataatcggaaatcaacgcatttttaataagcatttagaaccaatgatcagaaacagaaagtgacactaatgctttgtggagagtttacccgaagatttttttctctttgaaatgaagtcaaaagcacattcctccccacctgttacctccctaagttgttaaaggcagccctgtttctcctggagtgatacttgattctccctggtgatggtctgccatgcattgatgggctctagttaaaacatctctcagacagagtcctttggaaaattccatgaaagaaaccgcctattagagataaaagcaaaggttaagtaaccagatagatcatagaagtgtctcccagggaaatcgtattggaagatcagtggctgaggtaaaggacgctgggcttgaacacttaactaaggctgcctgatcactggaggcttcctcctggaggcttctaatccccgtgtcgcttcagcctttctgtcttctcagattgcttaccccggtaggtgctgcccttcccttcgggacacggaagctacactttgctttgtgcattgtcaaggaggagaaacaggcacttcctgccttatgaatgtgtcctgttcctgaatttcttttttttttttttagacggagtctcactctgtcgcccaggctggagtgcagtgttgagatctcagctcactgaaacctccacctcctgggttcaagcgattctcctgcctcagcctcccaagtagctgggactacaggcgtgcgtcaccaggccgggctaattttttggtatttttagtagatacagggtttcgccacgttggccaggctggtcttgaactcctgacctcaagtgatcctccctccttggcctcccaaagtagtgggattacgggcatgagccaccaagcccagccccgaatttcattttaagtcatttgctcagaacccagatggcacctgcccttcgcccaggggtgaggagcttccacctcggagttcaaattcatctccatcagtccctgtggaacctgggaggagatctgaatttttttattggaaaatgcatcccctgtgagatgaatttataatcctccctcagcaagttgctggtagaattaaattctacagtgtacataaggtacttaaccacagtgtctggcatagaataaacacccaaaaggtgcaattcctgcactttcctctctatcctcgtgcacctaaacctcagcctcctctgtctgtctccctagtggcagctgccagccttctgctcccctgagtcacggcgtcttggcaagtactgcccaaagtgtttcaatacagagatagctcttcagcctctctttcccttagcacattgcaggccccaggaattgtggaaacaggctgtttgaggacatctgtcatttgagctttcactcaccccagcatgctggggcccttcttgggccctgcagccttcagggcgaggtcacacagaggggacacgctgggcccttcctgctgccccgcgcctgtctggctgcctcatcagtgactcctggtctgctgggaggtgcccagtggaaccccctacatcccatccgattcctaatctatttcctggtggtcaacctggccctctgctcggccacctgtggacagcactgccttcccttgagtgtgggttggttcccaacatcagagcagttcacacagtctcagatggcagtcacccgcccgctcaagagcgtgaccactttgtgacctgatcaaagatagacaataagcttggcttcgtgataagcctgtttaatgtatcccctcctcttattcccagaagttttaagaaatattcaattagcgactcagagtcacaacccagatacctctgcctgtctccagcagacaccgctcccaccccagccctgtggttgctaacctgggctagcctgtccccagcacacacacacccctcctgctccaactctaaggtgctaacccaggctggcctgtccccagcacacacactcttacatctgctccctccctggtttatgattcccagggggcccccacccatggaatttgggcgtccccagttactctggttgggttgtttacccctccactggcttgcttcctgcccttcccggggggtcctcaccaacccccaagagctcagcacacacaatcacccactccgggtatttcagacaaacttctcctcgcgtcacagaccacatttgattccatccaaaacacaatctgtgatatcacctccaccacccaaccagccgtcccagcaggtcagtctcagaaatataactctgcattttacatttgactcttgtcatcaaaagacaagcaattgaatgtgctttagagtgattctcttaaatagtcccagatggtttttaagtgtgtgtctttctatagtgaagagattgggggtggggtgttgggttggaaaacaaagaaattcagcttgaagtagtcagcttgtgttgttttaggagaggaattcattctgtgggtgtcagtgaagcattaaaatccccccaacagctccagagaaatagttccctgctgtggcccacaccccagctaattctgttttcgtcattagttaaggcagttgtcctgggtgaagtcttagcacttgtccatcatcttttaaaacttaacgcttgaagcaaagttgtgactgtaaacagctttgcaactcttcggtcacacacacaaaatgattcatttctcatagtcttagtaaagtctaaataagtttttatcatattttcctaaaatcttttttatgaaaggttttttaaatgatgaagtgatgtatagaactgttaactcaaaatcatacaccacaaacctcatcaacctagactaatcactctgactttgcagtaaactgtaggcaagaaggagtcttcagttaaattaatagtctggaaaagttgatcaggaatataatctgtttaagaaaaaaatcttcttaaggaacttctgggacacttacttgtgggcaaaaatcaaacgttcttgataaatattacgaatttgtttaattcgtcctgaagagcctctgtcggaggaccatgagttccttgctcagttgttggattgtttaaaaatcagttaaacattgtttctgttttcaaaattttccaattcagatattttttctgttccaccattaaataaaattaggaatattttccactctggcttggcatgggagaagagacaacccctggcaggcaagttcactgctatctgaagcaaatgcggtgcaagctgagatttgtgtccatcgagcattttactgtctttctctgtctcatcccttggtttcatgaaatatgaaaatagaacagcgcacttttcagaagaaatcgatggctcagacacatttaccttaatgggctgctgggcacgtttaattcaacgactgtgcggtggtaaggatggtagataaggacattgttctctgaagggctcgttctagaccagcttgcccagactgctgtgaaggtgatccaggggcccagagcagacagagagatgacgcccagagagacgggcgggctccgtcacccagcagcgtctcctagcagatctgagatcctagcggatccaaagctaccatggagccctagtccactgcagtcttgataaactcatgctgtcatctaattcactagctaaatcacttcatatattagatcactttttgagaaaattacatgactcactgtttttaaaagcctgctttggaaatgatgaacagaaccttctagtagtccaaaacccattgagctttgtagaacaacattatggaacaaattttatacttctttgaggtcctgtattctggcgaaaaataaattcttcttctattttagcacaatgtgtttaaagcccataatcagatacagaaatagaaaacatgctaatctgaataaaatgaagaagtaaatggagaagtttagacctttaagcaagttgcttgttacttcaatacttggggtattcgattttttaatgcaaatgttttcaaagatacactaattttgaaataatgtaagacaccactgcaatcactcttacattcccggtagacctctgagagcagcaaccaccctccaccaccccactaacatcatcttgaatcaacgctttaagaaaaaacatacttgctgcagtggttctggagctggagaaggaagatagagccagccacaggtgggcgtgccctgcaggggaaggcgtctagtggtccctccgtaccacagagcattcccaccctcttccctcactgcgggtgccacatatttgttgtggtttctttgtggttgtcaaagccaagtttcataggtgttatctcactttatcctcatggcatccttggaaatagagggcacaggtgcagtcataccaaatacagacaaaggaaaaatgccagtggaagtcaataacatgcctgaggcctctggtttgtgaagagctggtgctggaaccctgactttcttttactcaaagggtttgtcccaagcgaattattccaggtccacacggctctgtttgaagtacttcggtggatgcatccatctggtattctcaaccaccccatgaaagagacagaggaaggttatgaccaccacggcactggcaggaggagagaaaaacgcccagtgatggctcagcacacccagcaaagtgcataattccagagggtgaagggtgagttggtgcgtgcagtgaaatacgatatgacgaggccaacttttcatctgtttaaaggacaagaccaagtgtgacagattcaagtatatgtctttaagttgccaaatgaacactgtgtgtattttgctttttggtaaatacaaattactcttctgaaaatttggaagcactgtgacagttttctaatgaaattagacggagaatgagttttaccattaaggactcaaggctttccacggcccctttaactgagaatggaccttgattttgttttgcgagtcactcttacagctgcatgacttcatctcaagcaagctaaataaaggaattttcggtattataacggtcactaagcagacaactgacgtgtcagcgattagaaggggtaaggtttcggggcgagtgtggaaagatactgctgtaacacgatgttttactcggtggcttcattgtgtaggtgggtggcgagtcggaatgaagctgggaggcgcggggtggaggcgggggggcagccccaactccagagctcttcccagccagaatgtcagtctgattggggcaaatcccctgaagtctattgaaactccccatctgcctgttcacaattcatctaagcaactctgaaaagaggataaacctcctcaggccagtatttctgggattctgttatggttcaaagcagagtgcatatctttgtttttccaagtgtccgatgtctgtctacctctcctcttggaaacgcttctccgatccgcagggcacgatggggtccccgcggcctgcggtgccttcccaggctgtatctacatgcagcagggctgacttgggccttctcctttaaatgaaagacctcctactagatactttttgctgagagcaattagtttccaaaacagcaattaagaagagtttgctagcagtaactgccagcagagttgcctgttttgacctattttggctgagtggttcctctctaaatggtttggtaatcagactattaggctgctggggagccttccccaccacattcctctatggtgtgtcttccatctacccgatctcgccgtgccatcactactcatgaaattgctgtttaaataaaccctgggtgttcagattctcttaggatcagtaatatttttttctttccatgcagctttttttttaaaggaaatttactgatataattttcttctagaaagatcacaatggtcttaccatcctccaaaaatcagcttgaacattttatactggtcttaaaatatgccaataaaatcgtgtgatagtgccaggccattgcaaaggacagagaaagtcatatattacagttcccaattatttgagaatcatcctaaaagaggaggtaagaacagggttatttgagagatagaaaacctaccccaaatctccataataatttttctgcagtagttttccttttactcatctcagatgtccaggctgttggaaagaggggacgaatcctaatttttctggcttattaacgtcaacagtgatgaagtcctggagccaggagagcagccggccgtggctgccttggcccatgcagactcacgcctgaccctcgttactgggccgctgacttccacggtgctgagaggtgggaaaggaggtgcacccacagcccatgggaggtggggagggtgatgtgttcacagaccgccggcagctcttgattcaaatcattcacaaccacaaagccaagtttctaagaccaagggcagtaggaggaatggaggcaatattccaaacaccgactcaaaaccaccaacaaaagaatgtgctatctagtatttactctcacaatgtttgcctttctctgattcctaatgagttcaagcacttttgtatagatctactggccatttggttattctctctgtgatctgccacttccagccttgtgcccattttcctgttgggtgtcattttccatacccacttgggaactctttgtatcctaaatacagtcgcccatttggttacctgtgttgcaaagaccttttttcactctgtcttttctgtcttaatgatgtccaataagctgatgcctacgttttattgtcatccaatttatcaattttttatggttagtgttttcccaagctcattcattaattctaaattttacaatagattctgttgtgttttctgtatgtaaaatcatgtgatctgcaaataatgatggttttacatccttttagtcattatacttttttcttttttcaaccttattatactgtctagaatatattagcaatgttaagtcaagaaaggcttattagccaagtatacattaagtagacttcaccaaaaagctttgaaatgcatattgaaacctacataagggctatttgcagaacccaagctcacatttaaaaccgcgggatctccaaaatagctttctggactacctttgaatggaaagggccatggcaaacaattttccaagtcctcctcatctttagttaggtttcggtcagagattcaaatgcaagagggatgtaaaccagggatgaagtgatagtggcagcaacacaagttcgttctcctgtcgcaatgatagacaggacggctcccacacacagcaccttcttctagagcacttttcctcctcttctctccttttgtcctcttgagtttgaacattgatggtggtacatgatgttcctaaaaagacaagcacaggcagatagagagaaacgttgggcccacggaaatatgaattcatccagatttctactgtgttaacttttaatagaggaatccccttctatgtttgtaccatgtgttgccatccttaaaaactctgtgttgaaaggtgaccaatgagtccttccagtagtacctggtttccttagtaattgacttgtcacatatttctgcatcaacagtattctcaaatgcacgcttactttcagcaatggtgaagctcactgctgagctcaaagtccttcacaatctgaacacacggtgctatttccagaagcccaaattcccatggtagctatgtaagttgtatctctgagtcagcaagaagtgggtgcatgaggcttcccaacccaccaggtccttgcaggcagccaggcttgcttctggagagggcagagggtgaagggctgcagctgtgcatgtggtcagccccatcatcctaaggagatattcctgagtgtccaagaaaagcactgctccaccctactttctgaccttgacttatgacccctccaggggtgtagtgaccacctgaaggccactggcccggttactcagaaatgtacctctttgaatgctgcctgcctcgaggtgtacctctcatcatcacagaaggaccaccgcttactctttgttaatgaaatctgagatgcttccaccttcctattcttggaaaacattaggagtcccacacctcttgcagccctgatgtcctgggacccagtgtccatcccacatccagcctacttcgtccaagccaggtcctctgagctgtttgctgtgacattcagaggcagctttgctatctgtgaggtgtgttctggtacctacaggctccgtgagcactgtctttcctcactgatctcttctttaattctcttcatgggggcgatttcttgtagcactttttcttctccaaacattttctaacttacctaagatgggttatgattgaggtgtcccctggctacgacctactgcacctgagatgggaagaggaccgctcacgaaccgtggtcctgctcccacaccccaataatgtacaacttttcatatcgggacacagccactgcctctgcgagtctgaactcgttgccatatttctgtgtgcttttattctgggccttgggcagtcccatctgttttgttgtatagttatgattataaataataagagctcttaccttgtgtgataagttcttatcacgatctaggtcctgggcaaggtgctttacacgaatgacctcaagtgacctttagattaaccctctgagataggaactaatgtcatcctcatctcacagacaaagaaaccgagtctagaaagtcaggtcatggtggggccggcaccgcccatggagctggacttgggtgctggccccatgctcctgctgagttcggctggatggcagtgaccatgcttgctttgagggcgagggtcacacccaggtgtggcctgtgtccccaggtgcctagacacggcctgaacacagaggcgtttgataaaaaatgtacaatatgacgcacagtcagtgcctctctttggggctgaatagcgcatgcccttaggttggacagtaaaatcggccttcttgacattcagaaaggctgacccagctttggaactctgcttggtttgtttgttcgttcctttgtttatcaagcacagcagatgtggcccgcatctaacctgttgtgagcaccaccaccatctgcatgttggaagtgcctgcacgatgccctaaggattctgttccagaggcttcccttagatgagaccacagagcagccgtctgcctggggagcagacccatggccgcattccagaaagagtgttcatgctcatttctactaaaatccaggtttcgcacttggaagcggcttcccttcccaagtagaaacacattccatttccttcatacctgtcgtggtcatggcacactcattcaagatgtttatgagctgaacatatttgctccttacagtgtggatttatagtctaagaaacttggaaaagcctccatgcaggatattgtgagacaggtcaagaaaattccattccccaagaacaaatgttatgcagccagtatataacaatgctttgtttatgcagagcatttaggaatatggagaaatgcttaatgtgaagacaaagtaaagatgcaaaattgtatagaaagtataatccgagttatgtagaaagaagtgcaagagaaaagaccagggaaaatgctgaacgttctcccggagcaggcctgcttcagccctcggtctgattcagcacagtcagatccacgcagcccgtcttcagtccagggaggaggaagataaagagctgggggcccagctccaggtgacctcaactatctctctgtccctcacctgtgctgctgccctgatccctgggcatcttccctctgcagaggccgagcccccagcctgtgtcacacttctcatccctgggcttctccttggccctctgggctcaggtgcagacattcatggatcctgttcattgatcctgtggttgggagtctgctgacctcctccactgcctgcaaccgtgtctccaacacaggcgactcctgagttctctttgtaatgcttcagccatggctcctgctgtggtttggctctgtccccactcaaatctcatcttgaattgtagctcccataattcccacatgttttgaaagggacccagtgggaggtaactgaatcatgagggcggtttcccccatactattcttgcggtagagtaagtctcatgagatctgatggtttaataaggggaaaccccttttgcttggttatcactctctcttgtctgccaccatgtaagacgtgccttttgccttctgccatgattgtgaggcctccccagccacatggaactgtgagtcctttaaacccctttttctttataaattatccagtctcacttatgtctttatcagcagcatgaaaatggactaatacagctcccttggtgcccaaagtggtgactgagctccagtttcttgtccctgatgtccactctggctgatccaaacccatcacatgacaaggcttggccacccatctccaaggtggtgacattttactctcaaactgaagaagataaaattctgggatccaaaattactagatgcctttcttctatggagtttaaactacttcacatatactatttcactatcctcacaccacgtttttgaaacaagggtgggaaacagatagttgtggcacacactgttcaaagtttccacaagatcctggaagtctgctcccctgtagtgtgctttgcaaaaagaagactctcgtgggcttctgttggcaatgtagactcatccagtctcctgtggatggccacttcattacttctaacccacctttccccccagagctgacatatgtgaaaatgaagactgcaaaaatttgcctctatgtatcttcttggagttttttgatttttaacttttttagtctcggctattttgaactattttctccactgctctaatacattgaagtagagaattgagagtaggccatttcctcttttcctggaaaatattctgatggctctctttgataatttgtctgattgtctcaagcataactgatctttcatgaacacgcagggaatcataatggcgctgcactcggaaagttgagtataatggtgctattcatgaaaatagatgaattcaaaaaaatgggaagcgaatatcaaaatgaagttggacaagtaggtttttataggctccataaaacaaaatgcatcttagaagaggcctgggaggtgggataacaatagcggccgctggaggagggctcctgcgcgctgcccagggctgggctttctttctgatccttacgacgacctggcctagtaggcctcatttcatctgtaaaggactatgttgtggaggaaagagttaaacatactgttgttccctttcctggggaaagggggtccctttttatctgcatcaggggttttgcttggggaatataggaggcaggacatggacctcagggggtggcatctcatctgcaagcagctcatctgggagcttccttcccgaggatgtttgaacatattatatacagagccttgaccccagggccttattcctgaagctttcgttgatcagcttctgggaagcctccagcaaaggcagttcttcctctgctccctctgaagcagttcatgggaagagtcaccacattcagcctggggctggcatcctctggacaacatccattcccacgtggcctgggttgcctctgtgctccttcacgggacactcacaccagttcctatacaggttacatcagaagttcccaaatgttgctctgggtactgcactggttagcaatgcagttttcaaagttccaaggagaaatgaggggaaatgaggaaaacagactgcgtttatctatggatgctgatgctgttttgtacacgtaggacgtataatatatgctcactgcattcaatccgtaagcctgtaggccagtgacagttgcagtcctggcgctctgattccgcggttctggaatggggcatgggcgccggaagttttagaagcacccggcatgatgctgatcacagccaagtttggaaaccactgggctcgtgtgaaggacactgtaccctgctgtttggaatcataaacgtaagatttaaaatgggctttcctaactaataagtgccagtgagggctcaacagctgatgggcagtggagtccagagtgatggtcccagcaagcgttccagcggcatctgccaaggctggaagctgttgccaggctcgagccagagcagcatgggcaggaagctcctgatgggcagtggaagtgagattggaccagcgtcagagggcggatgtactggtggcaggctcagagagggttgccttgggattcacaaagcatggcccatggtgtccagactgggggcttttgaaggcttaggctgatgttcccccttagccacacccttgctatccaaaaggtcctgctccacatctgaccgcaagcagccctctgacacagtgctggaggctctaagaatctgaagtctgcctgtcccagggaagtccctgcagcaggttctgctgtgtgtgtctgtgtccccaagacatttttcaggacagctttgggaaaagcactttttaactgttaaaaatagagagagcattgatacttgtgaagatatatgtactcactaaaatatatgcagtgagcatatattcactaaatgaacatgcattgaaagtaaacagcatgatgccaagggcttgaagttccttttcttgttgctttgtaggttaatgaggccaggggtgtggattaacagtattctggaatcacacaaaactctccaaaggaaccatttatgccaccgtgataggaactgcgtattgctcacttggatcctaagctgatttttaaattagatctttccgtgatcccttgttgagtctgtttcatgtgcattttattatattctataaatatttcactagttgtttctaataattagagaaaaagtgtctttcatcaatttaagagagaagggaatagtctgttaaggctgagcagttactgcatatgaaggctccaatggtgagcttctaccattagctggcaaaaaagagcaaaaatgcaatggaaaacagtgagggagagagagagagaaagagagagagaggagagaggcacagttactgagccatgtggccaactattaaaactaggagaaaagacacagaaaatgttgtgtgtgggggggggtgggggtaaaatgctccccctgaagagcactgaggctctagggagcccgttaaacccagataattctactagagcaggagggagctggcctgggccttcccagttagcactcactgaaaacaacgggcctctgccgagaagctaaacctgggaccccagggatggtttatctggaagattaggggagaaacgtgcaaggcagccaaggcaatccagccatctctgcagctgggaaaaggagtgattgttttcctgagctgctagcctggatttgcagaaggaaagaatgccttgtttctgtcccctgaagacgcaagctgaaaaaatgtctggctgctcttcgccgccctcccaggttctctcccacagccaagaacgactggctgctgccctgagccgggaggtcacaacgcttgtggagtaaggagctcgggtttttgtttggggctttgttttgttttcttaagtatctgcaggacaatgtttggaagagtcgtatgccccataaaaggaagaaaatggtgctcttggattgtaatcagtgacttgtggttggcagttatgcctctgccttcagtactgcaggcctgtgccttccacggaccttccctaacatcatttctggagatgatggggccagctctttaagaaactattttttcacgttatcatgtggtaagaacagagatgaacctcagagatgaagagtgtgattgagctcagagaaacttcagtgacttgattttaaatgggccaaacagttggatttcttttaccttttgtgcagaaagccttcgtttagagaaaagaggactgaattctgatggacagtaggtgtgggaggggcagcatgttatcacaatagcatcgtgatgagattcctggatggagggaatcactggtgcttgcatatttggggcttcatcttagggaagttccctaaaatctctgtagcacccagttttcgtgggaagaatgtcgtgggagcaggggcttccctgaccttggaagcctggccggtcagtctcaaacgagtttactgcctccgacccaattgtgaggactgagccagagggagtgcatgtcagcctcagcctccagcagcacagcccctttctctacaagcctcagatataggggaaaaaaaacaaaaacagagtcaaaagtaggtcttcattaataaaagactgggatctcccagaattaatcatcttgctcatcttttccagttctggaaatctgatctttgaacctggtatcctcagtcttagcacaatacctgggaccataatagatgctcagtaaacttggtgggaggaaaaaatcaaagaaggagtcaaaatagaggtgctcggtgccgaggagttgctaacctggaccatccaaataatgacagtctgtggcacttcagaagcattccagaaatggaacaatggcactccatgaagctgtataaactcataatgtatcctgtaactaacccagtatagaacagtaacactgtttacactgattggaaggaagaaggttcatcctggcggtttatgacattgccagaatggcttgaatccttgagggtgggtgacaggtagagtggataataaatgggcctcctggttcacagagcctgagaacctctcacccaatgggcacctggtgcccctgcagagtccagtctaagaggacaattttttttttcagatgtagtcttgttctgttgcccaggttggagtgcctgatctcagctcactgcagcctccgcctcctgggttcaagcagttccctgcctcagcctccctggtagctgagattataggtgcacgccaccacacccggctaatttttgtatttttagtagagatgcggtttcaccatcttggccaggctggtgttgacgtcctgacctcgtgagccaccgcgcccagccaaggacaatttactctagccacagatatggccatggtcctcatgtaagctgactacaaatacagcaaatccacctttccaaagacttcattctaaagatgtaaaagaacaaaaagagataaaggaagaggatgagaagacttgagaagagtggaagtgtagaaagaaaatgtttaaggttcatcccctccccaccttggggagttcctttggcagcatcttctgaagggtacttctcctagcccaggggcagaaagatccagtcttttggggcagctgcggaagaaaggagagcagtcctgtagctcatgaagacattacgaagcacaaagaactgcacagggacagagagtctttagggtctcgagctcactctatgtccttggctgttaagttccccgagagcaaaccccagcttctcgcttgcttcaggctctgcatgtgtgagtgtgacccttgggtactctcggggcgttttcagccatgcgattctggggacttcagaggactctgttcctttctgactcgtgttccggcgtctgtggattgctcccaacaggaggaggagtattgtctattaagggaaaagatttcagtgacctggcagcagggagcgtcgtcagtgtttgactgtttatggtatgtcagggagctggttcctggcagtggcttccccaggggtggggaggggtgtgctgggggtgacaggaagcactgaatcacgacagagaagggaaagaagcccgcccgccacttccggtgttcactgagcaggtcggtggccagcgctgccttcgcatcagaaccccattttaaaacacatccaagcgcgtggcgtcatcgggacgacgggcttctccccagtagagtgtcagaccaacaccgccctgcacaaagctctgtgttccctgctttctgtcatgttcccacccatagccagaaatcccagctgctggccgtccagcccctatggagcagtgactaagggtggctgtgggactcactcacgagccttaggttgggtgtacatagtttgtggctgattaggtgttgttaaggatttactgttcagggctgttgatttctgccactggcttgtcttctcccaaggacaaggggcctgcctattggcttttagatcttagcacttagcagactctcagaagtgtttgctagaggacgttttctggggaatgtccacctgcactgatgaaaacaactcagtaacaactccactttgagaggagcagagcaggagccttccttaggtgtgcgtaaggggataccggctttaaagacgccaggctgagttgctgtgtcaggattgattctttacttctccatctggaggtgtttctgctttatcagtttctccttgtttccagctctgtctcgctgccagagggccgacgtttcctggcttttgttgtactgtggcacacagtctgttttgaaaggacaggagcataataaaagcggatatgaaagaagggccagatgacatcacatagaatactggaggaagtccgcgtttgtggatgtttataatctcagcatgttagttgtttgtaatatgataagagcacttttgatacataggaggactacaagccttgttgcttagacaggactcacgaatttttatcttaggctcatagtgacgaacagagaatggggatcttggcctggatcccaagtgaccctggctcattggttgacctcgggtacaagattcggcatagatgagccatttaaattgtgcctaagccagctactcattgaattttttaaaagaaagagagagatagaataaagaaagctaagaatttgacttattagagatgaattagcttactaaattttttccttttgaaatcttacttcagagaaattgatggtacctagaacttaacattaaatcaagtaagacccttttaaggtgaattctggaagccatatagagtcagcattatatgcatgcttactcagtgaaaatcctaaagcatgcaagtgtctccataaagagcaatctccttgaacaataacagtgttgacacctgctgttccccaggtctgtatcgtgagatggaaatacaccagcatcttcccccactaggggaagatgataaaatgcaggttaagaacatggaccatggatgctgggtacttcctgccgggagccgggcactatcctcacctcttcccgtgggttaatctcctttcatcctaacggcaaccccaggaggcaggaacagtaggttctacccattttttaaatgaggaccctgcagggcatgtgggatgagcattcctcacaagaccgcccccacgaaacatggcctggagcccgggcacccttggtccaaagcaaatcaagtttctcccaaacacagtgccattcagagcaaaccaaatctgcagcactggagacccgcacacccgactggaagcttagggcagggcaaaggcacaagacagcatcatagcactctggagcccaggaagaacccatcttcttgcaaacactccagattaagcgtaaaaagactagaaaaatcaactgtcttcatgcactggtataggagagcagggtagagctggctcctaaaatttcacactcaggagactctaaaaatcgtgctcaaacctaaaaatgtgtgcatgctaattccaaattagccttatcgacagaggttagcgtccaaaacttggtctaacctagtccagggaacatgcaatctttgcaacttcatactgcagtgactgtgtgtgtggtctctgattgtccatcgaacacaagaattaaaatcccaacaacctagtgaggggcagagaggagtgggattgaaaatccactgttgaaatatccaggtagataatccactcccaaataacggagtgctgcctgcgcctgtccgtacccagtgggtgctctcctctgctggccccaggagtaggcgtctgctgtgacttagagcagattttatgcacagaccttcttccaggcagagaaaaaactaccgagtgtgagttcacagcaaaggcatcctcgatccctgctgatgtgggaaggcataggtacacgccgtctgaaagctgccaggcgtgattcacttggcagcgtacctccaggagaaagggcggggcagaaattcagaaattctaacccagaagccaggccagcaggtaggtaaagtggctgtcgcatgggtgtggtgttgtccatggccccaaagcccctgggactttgatggtcaagtttgcaaagataaagctgcaggcacctgaggctgagcctgcccgggcagcgcagcgctgctgtgtgccaatgcaaacggggaccttccttgcctagaccagtcttcaccaaccagaacagaaatcttattgtattctgaaaaaggattcctggatctctttcattccatgcttttcagatttttttctcccaaatttagcacagagggcaggttttgaacagaactcttaaactgaaggtacttctctggaataaatagcttcaagagatggacccactttgtttattaccaacagggctaaatatttaccttagacctatatgccaatactaaccacatacacattttcattcattgccaaagaataccaagaactggcatgccgtataaataattaaaatttagtgtagataatgtgtgaggtaatgcttatattagatgatgtctcggtgaactctctccctaacgaaacagaagaaaaacaacatagctcataaatatgtaagggtatttattctaaatgtaacatgtgaaactcttcactgcatgtgtacctatgagtctgaaaactcacttctaactatgattacattgatggcctcttgaacaagagttaaaagctccttgtaacttgttcttctcaacacggagacagaacaaaatccctcaggctattaaaaggatgacatgacaaatagccttcataaaagatggtcttttatgcagccaattttcttattagttatttgacgacaacattgaggtttaaatgagtagccaatgagagaatattgaagtaggctgtttgttacagcacatctcctctaactcatacttgctgataggtaattggaacagaagagaatgatgtcagtatgagatggaagtcatgttagttcatgcgtgacatttttcccagcatggtgtttgtaccactgagtaacaggatagctgagggtaagtagaagaatacacatcagcacagcaaactgtcaaggaatggaactctatacgagaccccagggccgcagtattctctctcttgcctcgctcaggccacatactctccttagaaatgctttctccacagctcttcccaatctttggtcatcctgtccttgctctctgcagtgtagcagtctcagcacttccttacacccccttctatgaaactatgccatcacttttcttcaagataaactgttttatttactgcaatatttctttacttgagaagttaacatgtccattaaactgtgctattatttgtattaggattgctaccaattttattaaggccctagttacaaagttgcatcggtattgagtggtctgccccagctctgtttttcccatggacctcggtggtttgctgtgtggttttgcagagtgtgagaatttttcagaaacagtcatatactgtgttacagcagaaaagcctgttcttaaaaagaatgagtggggactagatgtgaatcaatgtgatttgactttcttcttcccaaggtgagtggctggtgtgtttgagttggtcttgactacactgacaaggaaggtgagggtatggaggacattccaagctgaaggaacagtgtgtacaaacgcaagttctttgcgaggatggaacttcagaggtgttcatactcaatgcattgaaaatcctcacattccctcagcatgtaaaataagtgattaagcattccgctgtagttgaaagaaaaagagactttgaaagtggagggaacagtggatgcaggggagcagaaccccagtcggcgggtctcaggagaagcgaagcctgctgttcctgggaagcagtggggtgcaggaatcagaggacagcagatgctggcttcacaccctcaccttccctatgggtacagtcgaggcctcctcaaacacaccagccactcacctgggaaagaagaaagtcagactcacattgatgcacatctcgtcctcacccgttctttttaacctgatatgggctctcaactaaagggttaataccagaagcacccacctagctaagtaccgacctagacagccattagtgatttacaaaaacatgaagggtggccatctatattaggggtggagaaggacagggggcaagggaaggtggtttctggcaattggtccactgacacacccccagctgctgtgtgggacagaagtcacgtgagtcagatagcaacacccaggctctcatcttgttccatctcatctgtgcctgggcatgtgtacctgtgcacagggggaccaccttctgcaaggtagctggggtgcgtgttagttctcagaatagtgccagctgtgtgtccacttcatgatgacatcaagaagatgggctttgggatcctgcccacacccagctccggggcgctgctgatgtatctgggcaaccccagccaggatcctgggctgcctctatcaccctcacaacctgggggccaggagccagcaatgaaggccagtgagaggtgaatttggaaatgaggagctttcctggggtactgaaggaacagtatcaaaatacttgaaaagaaagagaactctttcttgtttgaggcttttggggcgttgtttcctgcgtaactcaaagccttgggaatcccagacagaaagtcatttaagattaacttttgaaatcaagtgagtaagacctgattcaaaggagaatttagccatgggttaataaatatatctaaattgcaatgaaaatcttcagcggtcttagccgttgatcccgtggtcaccatagacaatataaggagcagtgtctatggcaggagtgatggaacagatttcaggaagtaactttgagtgagagaagcaggggccccagaactctagtgaccaagacattcgaagacaggcaaggaaaccttcaaatgcaggcaactcatatttcgacggggcaccctccagtgctccgagatggaaattgcctgcatttcagtgccctgttctgtggctccagtgctctgctgtatgcccactgtgaaggctgcttgtcacctgtgctgcccagctcaacccggcccctttggtcgctgtcctgcctgcctgacggctgacgacggccccacacccatgtctacaccctgggtgtttgctgtgtaggttccaggcttctagaccagatgactcaagatgaggcacatgtgagtctccacccagcacctaataaaaccacccaacaaatgagggctcagctcctcccggggtgaaggccagggtgctctgttgactaaggggaggccatgaaagaacggggaagactggctctggacagagcctcatcccctgcgcttatcgtggctcactgccaagtgcgaacacctgggtccacgcctccgcatgccgggcccgtgtgcacacctgccttcctcgctggtgagagggcgcatctcagcctgcttttcgcctctagaaaggcactgagtgtgaactgtgaagaagtggccagggcagaggatgtgtgtcaggaaatgccaagccccctttcctcactcagccagatggcctacctgtcctcacctgaaaccaggcccacccatgctctgagatcatctctagcccaggacaaggcatttccaaggcagcgttggcttagactatgttggctgggcttcacctctcattcatgtgtcaggagctctaggccggggagccaggcattggagaccctttagctgggaaggctcggggggctgagttacatcaccaaaccctcacagcagccctgtgcaagggtgccatcatcctccctttgtgcagaagatgctgtggcttcaaaggaccagtcacttctctgcctgaactcttgccctttgctacatcattcatgttcccagttggcccctcacacctgctcttcagcatcctgggttctcagcagttcctacctggggccctgcctgccatccctccactgtcattcagcctgctttaaatgtctcaggatgactaatgtcactgggatgtgttctggccctggcctttggcccaccacacactgcatgccctggcagtcaaattcctgaattttttctggagccagtcctgcccgtcaggacccaagctccagcactaaagtacggctgtcagaggtggccctgccaatagcacactgtgtgtggaaaacacccagacattgagctgcctgaggagaaatggaaggtggcccacttggccggtcattgctcgttaaaatgtaaaggtgtgcagatatgaaaacacggggcttgttgccgatgactcaggggagggcaccgaacgtcatgcctcctggttatgtcttgccgccgtgttgaaccaggatggggaatgatcccattcctcaggtattcgtctgggagaccgtaaaggattgcttccagacaggaaggacgtctgtcttcctaaagagtgtctagcccaactcgttgaactactgtcatttctttctggttctcctgttccaaatacacagcctgagctcctccctccttctctgagtctctcagttccatgaggacaggcatcgacgcagtcataactgctggcactcactggcattccagaaaagcccatggggcttattcattgtacgtgggggagcgcccctgtccttcaggcatttcaccatcttgagctggtgactagttcaagaccattctgtagagtgaacacatttatttaggatgcccttgaagtactgttaaacaaaggaagctgaattggctggctttgctgcccggcatatagaagaaggatttgtgctgggtggtacaactgtgacctgcacttcctcttccatataccttgccctgctaataccatgttggaattatttccttaatttctaaagctgcatgtgcggaaatggcttatatttcctgttttgataaactaatagaactttactgagaaccttgttcccgagttggctttcttctcttttggcctcttttttgattaaaatagtaattctaaaagtccagcttgactggacttgtgtcaaagacaaagaattgtatagattttttttttttgccttgaaaagataactttttagctttcaaaaggatgataactttttaacaataggtaatgttgatcttgtttgtcacttggcgtaggtttttcagtattcctctgtggagggaatttgggttagatgctaggcacaatccaatcgtcagctatctgtaaattcccttcagaggatggctcttgttggctggaggtaaattggcttaaaaagacttccttggacaagaagtttcttggaacatgtagaggacaaaatattctttgttttgggacagatgagttttgttcttgcgattcatataactcgattactgctcattttctatgtgcaagttgagaacaatgaccagcattttttttcattcgtctacatggcatccactttaaatgatactcatgtctgaagagggctgggtgcatttccatggtttgttcccttgctatatgttgacaatttgcagtggtagtagagaaatagtagtctcaaagagtttaaattgtttatgtgttttgtttcctggcattcaggttgtcatttaaacctatttttttagtgtcctaaatataaggaccaatctgccatggagagaagtgacattgggcagttttctccacgttttgagatgggcgattcctcagacatctaccaaggaggacacccttttccccggtggcaaaggagggactctccctctgcctggtggcacaggatcctagtgaaggcaacacgatactctcttctcactgtcattgggtcactcacagaagagccagggcagcaaccaggaggaccggatgtcctcttaatcctgcagctgccactcttgatctctgctccaactccactgtatcccattgataaatgacagagtctctgctggcagccaggcagctagtgactccaagcaagaaattctgcatttgatcctgataggagcctggttcaagaaactagaacctggttttccttaaagggttccatgacttttattcttccagaggtaaaagactcaccaaggaatctagattgtgcatctggagtgatttgatgtctatggtaaatctatccatgcaaacagatggattttcatatcttcttttttttttttattgagacacagtctcactccgtcacccaggctggagtgcagtagcacagtcgtggctcactaaaacctccacttctcgggttgaagtgattcttgtgtctcaacctcgtgagtagttggtattacaagcgtgagccaccatgtccagctaatttttacattcttagtagagacagggtttcaccatgttggccaggctggtcttgaactcctaacttcaagtgatccaccgcctaggcctcccaaagtgctaggcttacaggcgtgagccaccacacccagcccaatttccacatctttctaaatgtaatgatgccaagatttaaataagactccaaggaaaagaatttccatatatgaagtcaaccaagaaatccctcactcaaagattcccgttctgcacctggaaaaaatgtctgttgcattccaattgagtagaatgtaatctaaggtttctggaaaacacatcttatgcctttacatacactgccaactggctcctaaacatttccaattcctacagttttgaattggcacagcaatgctggctaccagtttcagaacaggaaaaagaagagctctagaaggatattttgaattttaaaaaaattaaaagagagaactacaattttttttagcacttggagggattagaggctcagccactgagtccttagggctcagagccgccccagatgcagcacaggtcacagaggtcaaagcaaggtccaagggccatcacttttctaggacagacatgccaggcacccactgagtcatggaacatgctgaacctgtaataactcctaccttctgttgcacccagggtgatggttcagtggtttccagctttctcactatctctaaacaaagcctgttttcacaatgcccatccgaccacctagtgtagggctttgcaaacctcggtgtgctaacctggaagtcatgctagaaagcaggttctgctccaagaaaggtggggtggggcctgcattcctcactagctccagggtgatgctgatgggccctgtccacacagcacacttgccatggcgggggccagctgggagagcagctgcccttcagacaagcactcatgacctctttgactttgtgtctaagtccctgcctctgatcagttttcctctctgtttccctcttattccctcccattttatttgtggtacaacttccaggtaaatcttcctcaaactctctgtccagtgtcttctttgctacctgctctctctcttgtttctttctttctttatttttattttttctttttgagatagggtcttgctctgttgcccaggctggagtacagtggcgtaatctcggctcactgcaacctccacctcccgggctcaagccatcttcccaccccagccctccaagcagctgggaccacaggcgtgcaccaccacacccagctattctttttgtttgtttgtttgtttgtttgttcgtttgttttgtacagacagggttttgctttgttacccaggctggtcttgaacccctgagctcaagcgatctgcctgcctgggtctcccaaagtgctgggattacaggcatgagcccccgcacccagccttctctcctgcttctttgctgcctgtggctttctctaccctgctcctcccttgccggcgtgggttttgtccctaagaactggtgcaagaatgaccggtccttcatctcttccttgcagctcagagactttcaagtctaccttgcttcttaggtttatgctgctttggacacttatttcctaaaatgtataattcacatttatttttcagaactattccttttggttccacaacactaaagatgtcaagagcttacaataatcagacttagcaccccttccctttgtccacagtgcctctgccagcttctttaattcctctgcctttcttgaaggagcagataagtccaatggggtctggcctccaggttggtgtgtgatgagatagttggcaaggtaggactgcctgcaggtcctcagtaaatgttcattcatttgctgagggaagtaatgattcatccccctaggcaaactccttccatgatttggaatttaggtctgaagtttcctggccaatgcgcctgggaagccactgagctggctgtcagctgagtagggactaaggatgttcaactgtgggtactgaaaagcggcactagattgaaatggagtcctgagctgcaagttggggagcacagcagtgttggagcatcctgaaagtcataggaagaatgggcttcgagtcactccaactcaggatgttcctgattccctgataatgatcatgatgatgatgatgatgacgatgatgatggcatgaaggtggtgccctcctaggcctggaggttaggggtagccagtctgtctctgctttctagcagtgagagcctcaggctgtcaggcagggaggttggccttgggaggtaggcatagaaggaatagtggagcatagcagagccctagggcgcaggcctgaacacagccagtcctctctgtgaacaggataatgcaatacttaaggacccactgttcctaatttgctctctaaccatcctcttcttcgcagctcttaccagaatttaaattatgtgggtttagttgtttgtttacttatttcaccttcttgtctacttggtcacctgccacagggcaggagcaatgtctaatctgccccctactctatacccagagcccagcacagtgcatggctcagaggaaattcacatcagtgatcatgagtgaatgaatttgtaaagtgaaagcgtggatgaaggacctcccagccccttgccctttgtcatgttagtttggaattggggatgtgaggtgtcctctcactggtgcagttgaaggaaggtgccggatacggttcagattcctcggtggtcccgagttccctgggtggggaggttctgtgtgcctatgaggaggtgagagtcaggcattctccagggagtagggtgcccccaccagctttcacaggccttctgtaaaactggtcccgccaggccttgagtcctttcctgccttggggtgaaggacacccagacaaccacaggagtttggccagccgggctgaacggctacagcacgccccacgagcctggatcacgttccacacctgcagtaggagctgcaggaacctcctggccctgcgagcttcagtggggtcagcagccaggcacacctgcagggggcgtcagtgagagctgggcattggaattgccctacacagttgctgccttggaaattcagacttgaaatgagaaattaatggaggattgaattgatgtttctttcatgagcctgtgattgttgtaaaaagaggtgtgtcaaatgcttggtgagacccatgcaggattctttaaagaacactgaggcaaaccagaccttatagggaaaaacaggcctcacggagactgaagttaaaatatggaccagggccagtgtttcttcatgaagggggtgagcagagatttgaggaggctgcagggtgggaggaaactcatcatttttattaaggagttgacaagaataggatcgcggcttgtctttgatttgcgttaagcagtaaaatgaagggataggctggagggctgagagcagggtggcagcaggtgcgtgcagtcggtatgcctctgctggagggagtggccaggccacagacatgggacaccacatagcagtcctcacactcctcctctgaggtcctcagggaggcatttgtgtctcgagactgtttcagagacccatgtcttctcaggagatgccaaggctcaggtcagagacttgttgagtttttaagagactgtctgaagcacacaccctgccctaataagtcaatatttctgttcctcctggagacctcacattccaaagtgtggtacttcgggctcttgtaaatgttggaattcctaagactctctctggaggacaggtaagatgtcagtgggaacacacatacacacatgcacgtgcgtgtgtgcacgcacggctggcatgtccatggaaactgccttggcgtggaatgagcagggctgcctctcaatgaggtattccttccctcacaatatagcactggagccatcggtacatgtagaaaagtgttactgggaggtatcttaatcagcctacaagtcctagttccaaaagtaagaatgcatcattcatttttgagtgggttatgaataactcactacaactaaatacagtgaatatcgtaaacctagaataaggagtctgttagatcaatttgaaaccattcaaatcatttcaacctttgatttatatggagggatttggcaagtggctttaaaatcaaaattaaaaatagcttgggaaacagcagatggaggatatgagttgatgctttaccctatagacccaggaggcccgcctgcccttcccagacaactggccaatgaattattgggtcaactgaggacctctgccaagcgcctgttcatgcctccctcacgtgtagtaaaaggcatgaatgcgccagcccatctagtcttgagctttggtgctaaactttctggcttagtatggagttggatttctagaaatcacatattcaaatcatgggatttatgagccccattgcagataaacattggagccattgaaaaattggcaaatacctaggatcgtgttttcagggcgtgagaggattttatatatgtttacttttacaccataaactccagctgcctcattacctcactcaagacaaaaagatcactggaaagaaatgtaaaagctttcaaggtactgttttctctgaagggtttgggactttccactttttggagttttttttttttatagtagtaactgatgcatcagatactatattaggtaaagaattataagaagaacataaaaaacgtgaaactctcagatgagagttctctagtagaaaattgttagctgaaagaaaaaaaaaatcacccatacaaaaggaacatggagtcattgctggaacccaaggccaactcttgccaggaggttttgggtcagaagcctgcgtgtcctgcccttctgccctggactatctggaagaccctgctgggcggcagtggcagagtgggcctggccatgccacttgcacctccacgtggacatgcagctggtgacaggaaaggggaaggttccagcagacccgctatcacaaaacaacttacagagggagtccccaagtgatagtcctgtttagtcattgacacgtaactcagaagagagtgaaaaggctgtggtaaaatacaatttgcttaacattggaaagggttctgtcatctggtaagttttacttgcatgataaggtttcaatcagtgaacaccagaagccagccttgtccagggtcccttaggtgtaactgtgtgataatagggaggctccaggcaggctggcagaggctggctgagggtgaaaagctagattaagattcacctgtgagccactgctcacctgtttgtgtggggagggctgcagtagctcaactgtgtgtgggagagggctgcactagctcacctgtgtgtgtgggggagggctgcactagctcacctgtgtggggggagggctgcactagctcacctgtgtgtgtgggggagggctgtactagctcacctgtgtgtgtgggggagggctgcactagctcacctgtgtgtgtgggggagggctgcactagctcacctgtgtgtgtgggggagggctgcactagctcacctgtgtgtgtgggggagggctgtactagctcacctgtgtggggggagggcagtaccagctcacctgtgtgtgtgggggagggctgcactagctcacctgtgtgtgtgggggagggctgcagtagctcacctgtgtgtgggggtggagggctgtacagctcacctgtgtgagtggggagggctgcactagctcacctgtgtgtgtgggggagggctgcactagctcacctgtgtgtgggggtggagggctgtacagctcacctgtgtgagtggggagggctgcactagctcacctgtgtgtgggggggagggctgtactagctcacctgtgtgggggctgagggctgcactaggtcacctgtatagggcggagggcagcactggctcacctgtggaatgaaggttgtactagcttacctgtcaggggagaggaggcctgcgctgagactcggctgatcagaaaggggagaaaagagggtcactctgattgccatcatctcaaaacgtttaatactgtcacgatttgaaaggaagagctaaggtacttgtccagtagcccaatctccaagtccatctttgatctgaatgttgagatcaaggatgagaaacacctttttgccccatcgggattgcccatccagggaactccctccatttcccactgactcacttaaggttgtatctccttctctgatgaaacactcaatggggtcacccacttgcctgaataggtcctgaggaaagcctcttcccggcattcctcctccttactgagcataagtgtgtcccgtagggcgaaggggaaagaaagtggacttcctctgccgacacccctcaaatgaagtcgcaagtgatatcggtggtgcagatgagggtttggcatcccgccagatgcacctgccagtccctcctcctcacatggccctccctttgatcaccatgatgggtgtcccatgagggagccaccgtttgcaccgacacctcctcctcccctccgtggtggcccactcctgcccacctctctgggttccccgccagcattttctccaggcacatgctccacatgtccaggcagaaggcagggctgctgcccatgccccggagtttctcatgcatgccacaggcctgctccttcctgattcctcacttcacatggaatccagattctcggaatgttctcctgacgctgaaggtccaggactttgcttggcatcgggcagtttataggcacttttttttttttttttgagacagtcttactctgtggcccaggctggagtgcagtggtgtgatctcagctcactgcaacctccacctcccggttcaagcgattttcctgcctcagcctcctaagtagctgggaataccggtgcctgccaccacgcctggctaatttttgtatttttagtagagacggggtttcaccatgttggccaggatggtcttgatctcctgaccttgtgatccacccgcctcggcctcccaaagtgctgggattccaggcgtgagcgaccgcgcccagcctagtgagaactatttaaagactccttgaccatagaacatacagcaccaagggtgaaccctggtctcaactgtggactctggtgatggtgatgcgggcagactcagcgattgtaaccagcatacaggttggttccaacctgtacatcctggtgcaggatgtcgatggtgggggatttcaggggtgggagagacaggggtatattggaaatctctggaccttacactcgattttgctgtgcaccaaaaactgctctaaaaattagtctatttttttaaaaaagccttattgaatgttttgaatgaatcgtttctagagttggaaggattctcaacagatgatattttaatacatgttgtagttggcaatgtttaggtaacttttctttgccttgtgttttattgttgcagggtgtgaagaagtttgatgtgccgtgtggaggaagagattgcagtgggggctgccagtgctaccctgagaaaggtggacgtgtaagtcacagcattgcaataaataatattatcttcctcatacagtcatgcctcgcttaacaacggggtaccttctgggacacgtgtggctgggcagtttcatcattgcttgaacatactggagagtactcacacaaacctagatggccgggcctactacacacccggctgtgtgataaagcctgttgctactaggctacaaacctgtacgtaggcagttgcgacacagtactatttgtatatctaaatacagaaaaggtacagtaaaaagaaagtaaaaagatgtaaaatgggactcctgtgtagggcatttaccatgaacggagcttgcgggacttggaagttgctctgtctgcgttggggagtgcggggtgcgtggatgtgaaggcctggggcgtgaccgcgcaccactgtagatccatcaacactgggtcttaggcggccctaaacttacgttttcaatatttttctttcttcagtaataaattaaccttagtttactataacttttttactttataaactgttaaactttttaaactttttgactgtttttgcaataacacttagcttaaaacacacattgtacagctgtacaaacatattttctttttctacgtttttattcgatgtttttttctattaaaaaaatttttttttactttttaaacttttttgttaaaaacaaagaaacaaacagacatgggagcctgggcctacacgggctcaggataatcaatatcactgtctttcacctccacatcttgtcccaccagaaggtcttcggggcaataacacgcatggagccgtcatcccctctgggaacaatgcctgcttctggattcttcctgaagcacctgcctgaggctattttacagttaacatatgtacacatataaataggagtacactccaaaataacaataaaaagtagagtatagtaaatgcagaaaacagtgacgcagttgcttgtcaccaagtgtcatacactgcatgtaactgcatgtccacactttgatgcaaccagcaacacagcaggtttgtccccaccagcaccaccacaaacatgtgggttatgcgctgggcagatccggtgtcatcttagggcaccactatcttcagtgcagtctgttgttgaccaaaaagtcatgatgcggtgcctgattgtacttccatttgaaatgagagtgtcttaaattttctgagtaagtcattgcatactttgctaagaaatttaatcaattgtattctgttccactagaacaaacaataatataatgcaaaattgggtcaatgtataccactttcctacaaaattgagagcaattttaattttcataagcatcttttctttcattcattgttcattataagtacgtacgtgtgtttgcatgtgtgtatatatgtgcatatataaagcaatgatgttttatagttataataagcagaaatgtcataaaaatattctgtaaagaaaaaagtagttgcatttatactgcaatatagttatacaaactagggagcactggcagttgtatcattgctaacaattctcactttgaaaatatttactccctgaatgtctttgatgtggtccgtctgatagataagtaagaggaaaaaagggtaccccaaatcatcaccattacatctggcagaatttgaaatattgccctgatattggatttaatatgttcaatcaaagtgattgatctctgattctgttgcctttaaaactgatatctttaaaactgagtcttggtgttacttggtttaaaagtattatttatatgtgcacctttaagtccatcttgcatgtgtgaaggtgtggggagtagtattttgttttatgacacagcctccttgcctttattccctggactcatgtatctaccctaggacacatgcttgtctacaccttcgtttggcaaatgccaggttgtcaaggcaactggaaactcttccctgaattgccctgatgttgttggaatcagaaattataacagcccttgggtgtccaaatgagtttccccaagttgaatcctgaagtcagtttctaccgtagccatttcccatccctacctgccaggaagaacgaccctctgctggagcttggcctccagggctgaggtgcgatgccgctgcctcctctcctgtgtcccctccacaaaatcaaatgggcacagttcgtgatagggaacctctttataaatactgtcttcctatttcctgacctgtgactgatcattatttcactgtcaaaaatcacaactgaggaggcttcctgcccctttgatcaaagctcccatctctccacctgctgcattcatcattagttgcacttctcaaaacagttatttttgtttcggttaagcattcctctgcctgctgtggggactttatggtttagaaattgctggttgaagatcatttatcagcacttaacaaggctaaataatttttaagtttatggaagccatttcacaagatgtaaaattcccctgggtctcatgctatggattttcccaacgacacttctgtggcagtgatgagaatgcctgactgcagactctccaccccgcagcccttgactggctcagccttatatgggcatggatagaattggtggtatacacatatctgtgagactagctgtgtgggacggagttcgtgtctagagcgactctgcattcttctccatgtcatcagataaacagaacccaaacaaactgagtagaggtgaccggatctgttcttttcactttctatgattatttaatgcagaatcaacatagtaacattttccataatgcctttaggagaatttgattcttcagtaaacatagctagttcagattatttcagtatataatggcatctgcatagcagtgtactgttacacgatgccagaggtcttttcagtgaggttattaggaggggatttctaaggatccccaagactctgtgatttcacgaattcacagcacaggcattgagacctttttatttcccagcgtccctagtgaaggaaacaccttgagtctctttctatactttgccaagtaaaatgaaaaatcgacaccttctggttaatctgattaacttgagtaatccaaaactccgtgtgggcttggctgtcctctagttatccagacgggttatcaacactgatccaattaagctgtgattggcagctgtctgaagggttgtacaaaagacagaggcaaacgatacccgccccccaccccggggcctggactgtgggatccactgtgcacgcgcagcactcatgtggcctgaaatctggctgtacctgtacctctgggtgctgcgtgatgcttgacactgtcatttcacctgggccgaggcccgtgctgccaagggaccacacagccagtcactggagtgtgttaacaatcagcacacagggctgctctgttaattcaggtgagaccctgaacattcactgataaagtgatagaaatagctgatgataaaaggtaagaaagagatcagtgatgccatttaccattttcttattcctggagatattcttctgtgtgttacaggagacaattactctcaggactgctgcatctactgtattaaaacatttttaagatagagcatctgtttcaatactacaaatccggtgcatgtggcttaactatttattaattaacagattttcccaaatgtgctcttgcagaagcattgctctgtctgccctacttttggactgatagtatttttttaaagtaagataatacataaaaatagcagctggacagagcttgctgtcgaaagggctgtgtgcatagtttgttctttcccacagcttcccctggggtggctcccgtctctcttccctgtggtgctactgtaacagccctggaaatgcctggctgcagactcgccacaccccagcacttggctagctcagccttttatgggcatggtaccccagttcatctgtgcgtcaccatggtgacagccaacatcggaagttgtacgtcactggataacttttggacacgaagcagaaatcacaagcatactatggattccagttccaaatggattctcatgtgaccagtgaatgagctttgggtcaatttgcagagctttgttcatccttgggcggtgagtggtagactctcccagcagggagagaattgcttcacccagacagaaccacccagtcccatagataattccagcaagccacagagttgaggcctgaagaggcaaggcaggagctgtgtaccggctgcttggcactgcccacttcccctccctgggcagagctgggaggagctgagccaggagccagcccatgtcctgtagttcacgtacgagcacactgacttcaggagggaaatggcctctgcaaatctcacacccagattgtggcagagtccaaaacaaaactcaagtctggggacttagacaaattctttttccagcataatcatcttctgtgtccgtactcctcttcccatatgtcagcctagaagagtgaggctctccgggatgcagggaagaacataggcagcgtgagaagagagtttcccctcgttatgcaagagttatggttccctagttaactctctaaccacttcttcagttgttttgtggattaaaaaataactttaacaaatgattcagggctctgttgttatttgagggtctgtatttcaaataatctctagtaagcatattggaataattataaatgataagttcgattcattgatactgcatgttctcagatttacccctccactgaataccaggcaatcatcagcaccaaacaaggtgcccgcccctagcacctttcactgcagccctcccaggctcaagcagttctcctgccttaggccctcaagtagctggaactataggcatgcaccaccacacctggctgatttttgtatttttttttttttgtggagatgggattttgccatattgcccagtctggtcttgaactcctaagctcaggcagtctgcccacctcagcctcccaaacttctgggattacaggtgtgagccaccacacccagccttctttttctattctcttttcagttttctttctttatacaccatggagatggaaggcagttgaatgggaagcatcaaagtgagtttcagttacagaatttctgtcagagttatcagcaccacgcaatgtaaaggttaataatatagaaagcagtagaggggcagataggaaatcggagtcaacaaataagacagctttgctttgcttgttaactcacctagcagatggtgaaagtcttggatttttccaagtaaggtcaattttagttcattatttcagtaacttagccaggttcctgttctcccccaaacatctgatttttgaccataaactctgatcagataggttgtttcaaattttttaatgacatcaaccttcacagggcacctcctatgtcctaaggcacttgggtattccagaaactggtaaatatgaagactggttggataactccgtgttgggaattagtgagatggtcaaatggccctgtcacacgacaacagggaaaagagaacccacgtcatcagcccctgaacgagtgagtggaggcctctgcatcactcagcatgcatccaggcggtacccacagtgccccctgtggcctggcagctgcagctgagagcctggagactatgcttctggaaggttgcgattgacaagctcgctcaagtaagcagtggctgagtgcttagggcaacaagttgtgtttagcgactgcattttttcatgtagctaagagtttcccacagtctatgggtccctggacttgggtcaaatagtccttagcctcaccagatttcttaaattcaacactataaatcaaagtaaaagaaaccagagagaaactgagcaaaaatagctgccaagagaagagggaacgagtgctcggggcgggttggaggcagataacgagaaggcaagaaaattctttgtctttggctcctgctgtcagctcagaggggtcatcttgagatgaaaaagaaaagtccccagccttggggaaggaaaggagagggtgccccacgcagatatgaagcaaagccattggcaagatattctctctaaggagagcagcggtcttgccaaaggcatcttctattgtgtattgccgtcataaaccctacccttccatgtagatagccaggattttaaaataaaactaaatcttccccaaggagagaattgcgatgccctggcagcatgggcacttttgtgtgggtgtttccgtggctagaggggttctgaaatttttgtatttgtagtagagatggggtttcaccatgttggccaggctggtctcgaacttctgacctcaggtgagccgcccgcctcggcctcccaaagtgctgagattataggcgtgagccactgcacccggcctctgtcttagttctttgaagatgtgggcatgtgtggaataaaaacatcagtgctgctggtcggacctctttgcaaaccaactgcaatttttccagacagatacttttaaacggtgtgcccagcatacttagaaaaagaaatctccagctttttacatgctgcacagaaagggcaaggaattagtcagaaatagcaaaaacaccacctggcttccaggcttttatagccctgtctacacatagctctcactcactttcaaaaccatgcagttatttttagtgtggctttggagcaaaggtggtctggctcatccagcgctgcaggggctgtggcaactgggtcccgtgattattttctgtgggtgagctccaaactggcccattatctatcaaatcctcaatggtgttatagtggttcttttgacataaaatatttatcatatgggtgggatggcgagtggaggaggggccagaaattcgtaattgcttctctctttgtcagctgcataattaactcaattctaccacaatttattaaaagtcccacttcaagagaatggttaaatctcgctggaaagaaagagccacattatgctctgaagctccaagtttcagaaaatattctttttgtgaatatataagcccaataggtcacccatcttggtcttactttcatgaaaccctgactttatattgtgctttcttttcatctaggatttactatctagaatagtcttacacatttgctatgagtttcctgtctctccactctccccagatcctccctctacccctggctccaaactcaacggagattggatgttcagtatggtaactgctaggcacatgcagctatttcaatttcagttttaattaattaaaatgaaataaaatttaaaattcagttatcctgttcactagccacacctgaagtactcgcatagccacaactccagaagatgactgctctgtttacttctgtattcctggggcctatgcagggcctgacacatggtggatatatactaagtatttgttgaatgaatacatattgtttttaaattttagtagccaactgtggctatgcataatccactgcctgtgttaggggccaagtttcctgtttttcaaggcattttctctcttgcttttttttttcgaggcggagtttcgctcttgttgcctgggctggaccgcagtggcgccacctcgggtcactgcaacctccacctcctgggttcaagtcattctcctgcctcagcctcccgagtagctgggattacaggcatgcgccaccacaccctgctaattttgtatttttagtagagatggggtttctccatgttggccaggatggtctcgaactcctgacctcaggtgattcacctgcctcggcctcccaaagtgctgggattacaggtgtgagccactgttcccggcctggcattttctttaattagaactagatgtctcattgaatggcgcaccaaagtatgaacctcgagactttgtcacaaagggctctgtgaccttgggtagggcacatgacttctttaaaggagtctcctgagggcttcacaccttgctcaaatgggccttccagagctttgcacacccctccccctacccttctctctgaacctgccctttctccacgcaatggccttggctctccaagagtcaccctggccccattgcagcccctgctgctggggcatcctccccggttcattgactccttccttctcttacaccagtgccttacatgcagttgctgatagaaaatacatatttgagcgttgaaggaatgtaaaactccattgctaaaacgaagctagggcctttcttaggatggaggacatgaaagaaaatgccacttccaaagctccacactccatcagattgacaagttagctgggatcagataataatagccatttcatgtcttgattaaaaacctcacacagactccacagaactgttgataaactagagcaaaaggaattcacagttccattcttcttataaaccaaactaaaatgctgactttcgaaatccttttttccgacctcctgatggaaagttttgacaagtgtagcactgaagcatttccccctctctgctagaggagaaatggcaatcttcaaagaccattgttttgttttattcgcttccaattcattcttagtaaacaattgcaggatttctaaaaagaccagaccatagtagttaccagacatgagatgctttctaaaagctactttgaatagaaatgttttctctgaatctgtcttccctcatgcagcaggaagaatgtctgaagctatgctaccttcatatagaaacagcgtccacagtcagtcttcccagttgggtttatctcagcggtcctttagaggtggtctacacaagactctaaatgttcctgcctgtgagcggtcttctactagactacttcaataataaagagaaaactactagattgttttgcaaagttttgaaattactgttgttgttttcttctggagacagtaaaataatagccaaggggagaaaatggcacaaatgatcaaaccaagcaaccgtatgcacattttcctccctgaggggcctttgaatttgccacctaaatgctgcatgcagtgggtaccccaggaaggaggaaatggggtcccttcatctctgctttattttgtccatcattaaatcagaaggacatggttagtgtccttcatcttcgaagggtgaagatggctgcatacattgtctgttactatcattgacattagggtaaacatataataaatgtatttttaaatgaaacagtcatttcaaaatgtccttaggaagctggtcaacctgaggccctgagctgcctgcacttctgagccctctggcatctcacccaaatgagttcattgtggtgtagaccactgaagcgctcaaggtgtcagaggtctgactcacctgggaagcacaaagcaggccttccaaaggccatatgtccccactgattagaaagatcaaaacacccctgtccctttcctctctgtgtccagcctagaggtttgcattctaggagaatggcagcagccagacacctcccaggaacccaatgtaagccctgtatcgatggcagcttcctgcgaagccactgtgagcgtgtgaaaaatccccaccgtaggaacaaaagtttttgtatctaaaacactgttggggtgaataactcttagaggtttggaaccagaaataaagaaaaagaacaaaataaaatggaagtaattaatgttgggtaaataatatctttggcctaacaagttcttggctccattgtcagcatccgtgttttctattaaattgttgtctttgtgaggcattattacagttcttccctcttaaagtctgttttgaataaagaaaccgaaggttggatgaattctatagttaggttggtctctctctaatgaagattaaagttctggcatgtcttagctctgcatggcaataattacttttaaaaaaatgcacttagggtggtgattatggcattgtaaaagtcttatgaaaatgagatgtatgtcaagagaaccttactatcaaaatcagttttgtgcattgcacccatgcttcgcatctgtcagcaaaagcaggctttctcaggtttggtgaaaggaatattgccgtggcctttgaggactgatgagtttccactaatttagagcaaaattaacagaatcctatgagcctggaggaagcagttcacttttgtttgtgttgcttttagcatactgctcatttcaaccctgcttagagaagtggcagatcttataccctcaggcagctgggatatgccagccacagagggcaagatccataatctttaacagattttactgtacacgttcacagccccaaccggccataccattgcaacctaaaagaaagagaggattgaataagcagtccagaaaattcaagcaaaactctgaaacaggaagccaggcttcctgcacttgaaggccttggggtaaattcctcatcatttaacacctgaaattttgcaaatatttggacttctcttcgaagaatgatagaattattggtctagaacatcgactagtcttctcccagccccgtattcaggaaggacagaagaatgcattggagactgatgaatatccactctgttctaaggactccagggagagaaattggatagactttactggtaacttaaggaaagacaaaaaggcgtaggtttatatatatccagagtaaaattcacaaaggcctcaagtcattaaaggtattacatactattgcaaaagaaaataatccaactcccaaaagttgaactaagaaagttcctcttcttccaaataaggttttacttagagactttcagtcccacttaaaacttcaaagcaataagcttcatttcacagcttcactaaatgaaacctaatggtagacatgcctttgactagacataaagtaagcattctttctagagaaaataaatagaaagagaggtttctttctatttccttatcagcttcacctctttcttagaaatgattgctcgtctggacagcatttgtcatgagtttgttttcactttaaagcatgaaggggagagatgaccagggagtgatacccatctgctcatcttcaaggattgcgtaggagttgagctgtagaggtttcactgcagaaagccagtattgtcaagaagcatcctgagaacatgtaattaatctctacaaatggtagaatagttacattagtgccataatttgttatatttaagctatttttctaattcacaatcaactaaggccaaagaaaagggggggggggggttgagctcaataatagcattaggatgtttaatgtgaaatccaagaagactaaaataatacaattaggccaggcgcggtggctcgcacctgtaatcccagcactttgggaggccgaggagggcggatcacgaggtcaagagatggagaccatcctggccaacatggtgaaaccaggtctctactaaaaatacaaaacaatttagctgggcgtggtggcacgccacctgtagtcccagctacttgagaggttgaggcaggagaatcacttgaactcgggagttggaggttgcagtgagccgagatcacaccactgcactccagcctggtaatagagcgagactctgtctcagtaaataaataaataaataaataaagcaattagagttacagtatggctattcaggttgaccattcctaatccaaaaatccaaaatctgaagggctccaaaatcagaacccttttgagcaccgacctggcactcaaaggtcatctcgttggagcattttggatttcagatttttcagtttagggttgctcaaccagtaagtatgtgcagatatttgaaaattcaaaaaactcccaaatccaaaacacttctggtcccaagcatgtcagataaggagcactcaccctctgatgagcttcaatcattgtgagacctttaaaatctaacaccattaatagagagcactattaacactatggacaagtggttcttccagccagaatgcccatcggtagcactcaacaggtggcactatggcataggctatggttaataaaactgcaacaaaggaaaattttagctttaacacgtgccgacttctctgcagcaatcccacccttcccgcctcagcttacaaatacgcactaactcagatacctcaatgatactcaggtgactccagccagcctcaccccaaagctccccattgcacagatgagccttctctcccatcatccacccaccagccccctgtccagccccactttcttcaattcattgatcgcagcacagcatagggaagaacatgatttattgaatcttttccatcctaaagtattaattatcaatagctgcaatataccctgacttcataggaaaacctgcacctcattctaatcaccttgttctgagcgtctcactttccttcttaggtcttgaccttaagatttcaactttactttctagccgctgcctgatcaacgtggagtgaagtgaaatgatttccccctgtatttggaagctgtacttctaaaactctgtcctagaatcacatcactctcttttaccaaccagattattgcattgcattggctcactagtaatgtatttctaccaaaaaaaagaaaaaaaaaacaagggttttttttacttttgacaagttttttgttttgttttgttttgttttgttttttgagacaaagtctcactctgtctcccaggctggagtgcaatgtagcaatctcgactcaatgcaacctccgtctcccgggttcaagcaattctcctgcctcagcctcccgagtagctgggagcccgccaccatgtccagctaattttttgtatttttagtagaaacggggtttcactgtgttggccaggctggtcttgaactcctgacctcgtggtccgcccaccttggcctcccaaagtgctgggattacaggtgtgagccaccgtgcacagctttgtattttgttgttgttgttgtgttgttgttgtttttctgcttcttcactcttggatttccacttgtgcagttaatttttgaacttgattcaggattttgttttgattcctgttaaattgtggaaaggtgcagctacagttgctgatgtggagatggagaaattgaaggtgttcttctgcccttgattttcctctctccctctctcctacttgtctaatactgatctaattcagacatagacagtccatgaagatggctattgaccaaagaggagatttctaaatgctaattcctactagtatttttgggactttattttgaggatagcatggatgaaaagggatagctatgcagccatctgcataccctcaagttgaataatcagactgaggaagttaacaaaaagaactttgtgggtggaaatgaactccttaattccagaagattaaaaagacttctttagtagaaggaaataaagtttaacaaaaagggtgcccttcaaaaatgtcagttatcttggaaggaaagatgagtaatggaaatcccggttgatcacaaagatgaataagatgcgtcctttaaaactggcatttatggaggacaagggttcttcaccagcactctgcatcctttcctagcagccgctgacatagtaagagaagcctctggaattatcttattgcatagaattagttattaattattcctacaattaagatacttatgatacaacaaagaagctcaggatcttaaagtgtacatgatgtgcgttgtatgtgtgtgtgcatgtacctagacctatttacatttatgttctgaaattgtatacatcttatatttaccaagtatttatatattttctgtatgcgtgtatttccaggggaataacaatgtactatcctagaaaatcttttcaacctccagtgctcaacataggattttagttatttttagcacttaatcttatctgagaacttaaaatgaaacccagtgtgtgtttttttaatgtcctgcaactttattagaagacactgttgctttttaaaatttatcatgtttttatatcaagcctgtgccagatgttcctaagtgttttgaacaatagctggttttgaaaccatcaggcgctctccacgtagctctgctgtgagcatcgatactccctgctctctgagcatagtgtagggcgggcggcgggccgtctgggatatgggaaagcctggggcctgggcgctgcaaagactgttctgcctggggtctgacgttggccgtgccgggagctcattgtctttccgtctcccccagttcttatcctactgatctctatatgctgttggctttgagacaataggaactccagaaatgaacagacagggaattggctcatggaggggaaaggaggcaggagtgggtggacaaggccggaaccacatttgcaccctgaggagctgggagattccgctcacctctctctctctctgtaagaatgctacatcccactcagggggtttccaattgtccttactctagttggcaggaacttaaaacataactgaagcatgaacaactgggtattttgatgaatgattgacaacatcccattgtcttcagagcccagcacaccgggccggtcattccactgttgaggtggttccttgagagagggggcagaggaccctgtgcgggggtgggatcaagcacaaagagaaaactttcccaaaacccttcaacagacttttttgtttaagaaaataataatgtttccgtctctgaacaccaagtcaggtgacccgtttttccttcatgtgatttgtgagctatttcagaacctcgtaagtctctctgacaggtcaggaatggggaaatgagaagtgtcatcctgtagagtttctcttctctggaatttgtcttgtgttattttttaataaaaataatcagtgttatgctattgtttcaaatctggagacattttactctttgtgtatcattgcctttcttttttaatgtgtgttatttctggaaggcaggcaagcttttttcttgtttgtaaagatctcttctcctgttgccaagagagataacctgaaaagacagaaaattgccaacttaaactgtagatatcattccattgatttatttacagagctttaaatcttattttgtggccactacagtgaagcaaatattattttaaaagcttcatatgaaataatcattagtagcttgttccattttaaaaattgcaggtgtttcctatgcctttgggcaggttttgttgtttgtcttttgtttgtgtgtctaaatttcccattgtctgggatgtgcacactgcatgtcatggaaggtcattgttctggttcacatgattttatttccaaactgtggtataggttctaatgtatgttggctgctgtgtagctgtgtacccatttcttactagccatgtggtttagtgactaaacagtttatttctttatacataatatttctctgagttgggatgtctgttacctgttttcacagtttaaaaggaagcataatgatttagttgtaagttttttctgccagcactatgaatcatttggggtgtctgatccacttgaatagcacatgtgggctgcagaatattcatattgatggaacaacccaaactttaggatttccattctacctgccacccaaccagtaccaactgtgttgtgaacgcattttttaggtagggaaatgatttacaaatgttagccttctttaccttcacagagttgatatttaattggaccattagtagcaagtacaaatcttaagaacgttttaaatcttgccttcagagggcatctatggtagagggctttgggtagtgaaatatttgactacttttcttaaaaaagcaaaaatcagaacaacttatagaacagtcctcctgatgtgatcagctaaaaagaaatttgaagcagccattagacttaggtaaaacttaggatttaagcaaaaagctgctctctcctgtcctcatgtgtggcttattcacactcaggggtgtctcctgtgttgaataaagtggcctccagctacagccactgcttacacatgcttggttgtgcacatgagagataaatacccaagccgcagggtgtgaggacgtagaaatccagggcatccctaaaattatatcaaactctgccaaactgcctgagaatctatgacatcctaatgcctccgtcctccagcatctgtggagttggctcctttccgcctctgtgttttccttatcccttgttgagtgtaagttaatcgggcacatgccaaggggcagcatccgttttctttttacccccttttggatgctaaggctcttcaaggatataatgcagccctgtgcagccgtggccagtttttgcacggccgcagtagagacttggcaccctggaatatctccagcaattatccagcttgagagttttcaactgaactgaagttttattaatgttcatcataatcgtgtcacgtccaattttagtacttggtatgaattagaggaaaaaggagaaaacgatggcccgttgggtcagcatgcattgtcatgatacccagcattgattgacagcttacggtggtcccggggcgatgggagcactttacatccattcacacttcctccttagggcagctccgtgatgtaacccacttttacaaggaggaaattaattgaagaacaatgatgtgagctgcccaaaatcacatcattagagagttaaggaaccaaactctgacccgagatctggagccaacacttaactttccctgaggggcatcctttaaaatctgggtatgatgttgcaccttgaaactcagttgttcaaaattattctttctttctcaacctttaacttccacatcaactctttctctccctaaacaaaatcactaaaccaaagaagcaaaagtctataaggccacagttttgtgaattaaatatccatccttttccccatctgtttgcgtttatcctactctctttcctcttttggaagcagctctgttccaggaactggcaaatcgatttggctctttttgctttcctctttgctcacagggaatctcctctttgaaaaccagaaaggttctccaaatatagcaaatgctttcctcatctccatccatcctagttacccctctcctcctctcctcccactctcctgctctgtcccactgctccacccctgactctgctaacctcatgccgattatacttctgtagtttcattaagtggatagttttcccctcttcagaagcattcctgagtcaagaacaccctgaatgcactggaagttgttcaagtcttaccctctaagtcaaggtgagatactgtgtagatctgccaattaatctccttagaggattatttaatcctaaaagaaattcttatagctcctggttttaagccctttctttactggggcccttttactttagtccttatctactccaataaggcacatagaagacattcctcactataagatgtgtggggttagagctgttgcccaattggactctgagatgcgatacttctcgccattcaggtgtgaggatggctcaccgggtaagcatcttgactttggcatcacattccagcccttacacctctgtcccagcccctgggtgagccatgttcccctttgccgtcgaattctgcctctgaaaatggaatcatagttactgcctccagcagctccaatgtggcgatggtattgagagatcagcgcagtgcctgtcacagtgcagaggctcaacagatggtggatactaccacgttttctctttctgtggaacttccgcaacagtcatccgcaaaatgacagaaaatgccagtcagttgggcattgcagggactgttgggtttgtgggcgagcatccctgcaaatagggctcccattaaagtctcataaaggaggtattttggaccttgagtctttttaaatttttgacagagccggtgcagtgtctcatacctgtaatcccggcactttgggagaccaaggtgggcagatcacttgtggtcaggagttcgagaccagcctagccaacatggcgaaacctcttctcgactgaaaatacaaaaattagcttagtgttgtgacgcacacctgtaatcccaactatttgggagctgaaggcaggagaatcacttgaacccgggagtcggaggctgcagtgagccaagatcacgccgctgcactccagcctggatgacagagtgagactctgtctcaaaaaaaaaaaaattgacagagaaaatcatcgtgattatgctacatctttatacaggagtggtccgtacaagtttttattcatttaatttttcttctgtgctgcagaagcatttcctgggcttttgacattccctgagtaaattaaggctttgtcagcctctgttctgatttgggtgatttatacatcattatgcagagtaagcaccagtagaatcacagtgtctatttcagctgaacaaaatttttgctaaggaaagaactatctgacattcactggcttagggatatttggggagacacgatagcttgcagtgcagagtggcctcctgcttgttcatgacagtacgaaatgcattcctaaatctcttatgtatcacttctgatctgactgagaagaactaggtaaggtataagtaaggaaatagtctcttatctccacccgcttcactgttcctggcagagcaacagtctggaactgtgagcgtcagaaggtcggagcctgtttttattgcagtgactcttctggttgctgcttgatatcacatgagcctctgacctgcttaactacattttaatcatcctgccttgatttgtattcttggtagatgaattgtgattcattattccataatcattagcccccccacccaaaaaaaaatcactatttttctgatagttttgatggttttagcaaatttttatattagttttggaaactttacttttttataaaaatcatcgtttttacattacatatttgtttcatgttgcaaattatcggaaggaatgcctctcacgctgtaatgtgcctgcaagcagcctgggccccttggtaaagcacagatgctagttctgcaggcccaggagggcctgaagttctgcagttgcctcaagctccccagtgacatggtagctgctggcccaggggccctacttgtaattcaaggcccccgaggaccttcctgaaacccccttggagagtcgaggccaggccgagtgcagcctcaggtgttctcctgagactgacgcatcctgcttgccttggtgaggccaggttattaagcagatagataattcattgtgtgcctagaagacatatcctaaaagttatctttcttgctgagatatggaactagacctgtcttcactcagtgatcgttgatctttagaatggccagtgtggttcatcttattaaggggaaaactttaattttacttattacgttgaatgtcactatgttcagttattgattatcccaccagcttagacttgggtggtgagtgtcttatacacctgaaagctagggtgggggtggggagacttgcttataccaccatgccagctgtagcattctgctcatggtcaccagagtgcattgtcagatgtttcttggttaggacatctgcattctacatgcaacaggtgccatctctgcccttgcttggggtcagagtgctttaatccagatgcagtattggttgcatctgtcattatcggctcatctgcagctgtccttcctgtgtggtgagcctacccctcactcctgcctggtcactctcctgaccctccagtttactttctggctctggaggtgcactgagcaagggcacacactctccctgtatccatctccatcccaggaccccgcacatccctgcagctgctcctgggtgtgcccaccccacccccactgggatttgagctcccctcaactaatgggctttccatggggaatcaggagggtgggaattgtgattccgttaaaatcatttgactcaggaaaagcttttcgaaataatccccaaggaccaactctttacagaaactcctcccccgccttcatatttttggctttgactatggggaaattcattatgttgagctaaccttggtgaaacaatactaaaaatagagataatagaaaaacatgttaaagaaggtaaaatcatctgaatacgtactttataaaattcagcctaatacttaatggctttattcagacctaatttgaacatatcacaagtatatttcaacagaactttcttcttcacagaacttttctggaaaaaaaagtatactgtcaaaatgtttctcttattagcaatcaaaacccagtttggaaaagtgagtggtttgctctgaaaaacaacaaacagggcttgtgggaattcaacagaagaataacccacggcttgtaagaatattaaaaccacggtcacattttacacagttttggcaaaaggaatagcccaggcgtctcgaatcgagatgtaatgtgaaatgaagaatttcaacagggctcattaggcttttgttctatctgagcagagttttctgctttcttggctaaaataagatgcatgcagctttaattgtatctccctttattcaaggtcttcactggcaaccttaagtatcaaggatttgctgctcaaatcatttgtaaataaaactcagatgtaaggaaatacagacaagggaggacaaaagttttgtccaaaaaaatagatatggaacaaattcagagaattgtagatataggaaggacctgatacactagcaagtctcctttcccagttgaggaaactgaggccctccatggtccagaggtgcgcctgcggcctcatgagacagaaccaggccctttcctccgggtccctcgcctcaggagattctctgagatggagaaagattctggaattacagccaaatcaggaggccttttaagattgatttaggaagagctaagagaaaatactaaatggagttgtttccaagaaacagaaataatcagtgaaatttcttttacaaggaaataattgaagcaaatgccctctgcatgaaaagtcgcattaaaacccaccccagtgggcacttcctgaatgcagtattccctgcagacagcatttgaacgatacttaggaagcaaacccttcgaaccactgggaagaatgttcccagtctgacctagacagtccttagacaaggaattcggtcccgcggtgtatttccttctccacaatgtgatcatggtggagagctccacattggtgtcggtggacacagtcatgaatggaagctgcttcatatgaggcagagcctccgtgtcccacctcacgcactctccggctcctgtaaaggggagatcatggagccgggggcatttgggccccgtttgtagtcttgcctggccctgacccatcagcacctgcctagttccgcaggcacggagaagactgcaccttctgctcttaggtggctgcaccagggcttcttgaaaaggggcagcttcctctcagggacatcagacaaaatctgaaggcacttttggttgtcatactgtggagagggtgtttctggcatctggtggggcacagggacgctgctacacatcctatatgcacaggacagccccgtgaagaagaattatctggtgcagattatctgaagtgctgaaggtgggagaccctgggctagagcagtgctcagcaccctaagctaagaggcgagtacgcgtgcaggtgcacccgagggaaagccttgccctcagaaagcccctgcaaaattccttggcatgaccttccatcttgcagctcatttctttcatgtactcagcaaatacctgagttcctactgtgtgtcaggctctgtgtatacctcaaattgaggagccaggggcgccgggcagcagtggggctcacagacttttggctgcagcagaagctgcaaggctcctcccttctcatgcacccccaaatccaactctggaggtgccgtgtcaggcgggtgcacagaccatggagctggggtgctggggtcggagtactccccatggacccccattcggaagtgcgggctgctgggcacattagttaatctcttggcaccaccgtgttttatctctaaaatggcagtgttgatgagccccccactccctaggtggctatgcctgtgcacccctaacacatgagagccacgttaggatggtgtctgggtcccttgtcattatttgggaggtgcagctgagcttcctggtagaaggacttacttagcaacccgctccgccttggaaagctgaccctcctccacctgcctcctctcctccaccttctccagcccctctgtgtcaccaggcagctctctcccgtgtcccagtgagccctccgcaggccagccttcccttgcaatggcctgtgttgccagctagtcctgttctgagaggatctgctccactcaaaccgtccccacaccttccatgtttgagcaaagcatctgtggattgcagatgaaaagaaacttcaccaaagagcacattagtcatggcctcaacccagctgggagtgatttgcatttgataacagctttttaacccccaggagcctcttaagaggtgggtcttgaaggaagtcttctgagaggcttttcttctgaggggagggtcgaacagagaattttatttagacttttctcccaccagcatggacatgagttatcagtattgtttatgattttatagaggagattttcacaagaggaacttttcctgtgcctttgcctaatgcatagtaactataagtcacttgtttatacagctttaatgtgttaactgttaaaatttaaatattaatattttaaataagtctctatttgtatacgtgctgactcatcggattctcacactcacttagagataagatggttttctatgcacacactcacattagaagaatgtagggattttttccatcaatattcgggcaagagggcactaggaggctcatcgaacacccacagggctctacgtcacacccacaagctctatctcacacccacgggctctatttcacacccatgagctctatgtcacacccacaagctctatctcacacccacgtgctctatctcatacccacgtgctctgtctcacacccatgggctctgtgtcacacccacgggctctatgtcacacccatgggctctaactcacacccacgtgctctatctcacaaccacagagctctatctcacacccacgggctctgtctcacacccacgagctctatgtcacacccacatgctctatctcacaaccacaggctctatctcacacccatgggctctatctcacacccacgggctctatgtcacacccacaggctctatgtcacaaccacaggctctatctcacacccacgggctctgtctcacacctacgggctctgtctcacacccacgggctctatctcacacccatgggtctctatctcacacccacgggctctatgtcacaaccagaggctctatctcacacccatgggctctatctcacatccacgggctctatctcacatcctcggtctctatctcatacccacaggttctatctcacacccatggactctgtctcacacccatgggctctatctcacacccacggactctatctcacgcccaccggctctatgtcacacccaccggctctatctcacacccacggggctctcacgcccagcactctggcgtcccctttccttgacatccgcctgctcctctaccgtagccagatttctttaggaaaaaaatgattctttaaaaatctaaaatactgtaaatcctattgggaaataacagttattaaacctcttcatcaggagccaccagatatcaacttaggctgtgcatctttctgccaggtgggtccttatgaccctattagtgactgtctcgcacaactggagataccagtgaacacgtgattgaactctcagcctcaaggacaggtcagaaaaggagcctcaggtcaacaatgtgttctcgacctgcttgaatttgcatctgggaatcctcctgttagtagaaaggttgaccctggacgcagtctgggattgaatctgcctcactcctttttcactccctttcagaaacaaatgaaaggaagtgtgtaaaccacacagccaagcacccaacgcatcatcatcttcatatcatcgttattattagtctaaaatggtggtggtgatgataaccccactccctaggtctcagtacccatactgagattttatgctctccctttttctgctggatttcattttttctctagaagcttgatgctatgccttgattattacttatttcaatgggacaaatttgcactagaactacagtatttgttatcactgaatttttcacggttgccatatatatatccagcatcatttgtgtcctactgctgttgaacaactactttaagatcagaaaatagaagtagtttagccagtctaaaaggatttccattcatcgaatcataaatagagaaaaaaacaatcccttctatccattactaaacctctccattccaaatgtcttcaaacaaagcaattatggtggacaagtatttgaggacagttttttctcataaacagctgcatagtgctatagcatccttgttgattagccaattagaataaattctttccacagcacattttaaaagacttaggggaaaaaacaagacttgcaagacttgaagttttcatagaacaatgtgcacccgtcttccgcccacttccccagagagaaatatatgaatcacatagcagtaaatgagtaaagtatcaaaacaggtgctggagactagggagcatgaatcatcttcttccttagatactttgtaaataaaacaggatgtatttatggtaactctgtgcgtaaacttctatttacaatgaattatataaaataaatacaatgtcacacaaagtaaataaaattgaagaatctattaaatatcactttaacaattatattaaattgtttccttaaattgatccaattttgaaagaggaatttgaataggagagatcaacaacaacaaaaattcctcctgtattcaaactttaaggaacgctagctatctattttaatgagtgaataacttatttcccaaaccacattttaagaaagtcaaaaatagttgcatcacatttttcctattgaaaatatacactttgaataacagaaaaataatccgcagataattttttaaagatttttactcagcttagtggtaatagatttctgtttatattaaccttaagaaagagtgttcagaatggagtttggccatttcattatgagttatggatattattgtataaaacatgtacacaaaattccactgatgattttatctaatttcaaccataagattctgacagagaatcaactcaactagctcttttaagcatcacttttaatgtaccacattttttaagtgactcttgtttatttttttaatgtttgctcaaacttatggggatagtgccatgttctgcgtatccacgctaggatgtggcctttttgagccatggaagatgctgtcagaacagggtccggaaaaaacaaataggacactcgttattttcttgttgatttgattagccatatgtaccatttacaatactcttgggggacaaaaggaagagagggaaaaaacaattgtatctgaatattgcaagctaatcttttataaattttaccctttaagggttgatggattcagaaattaatcaactgtatttttatctgataaatgctaatactgtactgcagtgcagttgtggttttgagagttacattcataggtttatgtcagatcaagaatagattttgttggggggtgatttttagattgtaggaggttttatacacataataaaccaagatgctaacaggaggatgcaatcagtggttattttgtgtcagcccttttctttttttttttttttttttttttttttctgagacagtctcgctctgtcacccaggtttgagtgcagtggcacgatctcagctcactgcaacctctacctcccgggttcaagcgattctcgtgcctcagcctcctgagtagctgggattacaggcgcatgccaccacaccaaactaattatatttttagtagagatgagtttcagcctgttggctaggctggtctcgaacgcctggtctcaagctatctgaccacctcggcctcccgaagtgttgacattacaggcatgagccactgcgcctggctgtgtcagcccttttcaagctgcagcaacactcacactgatgcacttggccactgagaggtgagccattggcagatgatgtacagaggatggaagaaggactgctgtgcaggcggtaaatggcatctgccagactgcacagatgaaggttcctaccctgttcactgccgcatacaggaaatatgatcaaaagagtggtagtgtgtttagacttgtggctcactctgtgtgagaaggaaaattaaataccaaagccatctataaagtagcaaaattgccctaaaagctgcaaattaggtcgtaatcatacatcaatgacagagaagtacatggaagacctggaaggatattctagaaatagctaccatcttgatggttcatctcttcttaattacttaagggaatttcgacaccttattaaaacagaggaagtccaaggtgaactctaaaaccctccttaagtatccaattctatgattcggtgtgaagcattatcacacttgtcccaagggaacttaaccagtaatttcaacgcttcagtggggagtcacacgtcagatggactcttgcgggccatgctctcaggtagtggcttgagtccccctgctcctccaacaaggccaccgtccagctattaatattactcccaattccctggacttgctatgtcctctggcgtgtggagtgcctggctgccgccttcattctctatctgactgtctcctgctcatgctcaaagcccacacccaatgtcaccttctgggggacgctggtcccaaacacctgccttcccaagccaagtcacagctgagccctgtgtccttagcaccctccaaagccactgtcttccctctccatcccccagtggactgcgagcttctggaggatgctccttccctggcatagagcagacatgtagcagcacttagtgaggaaggctgaggcaagctctgtggtccagtttccctgcaaataggggtttagaaggagctgagaaaagaggagatgagggtacactgtagggaagaagtgatattcacaactgacagcaaggaacaaaaaagttaaacagaggccgggcgcggtggctcacgcctgtaatcctagcactttgggaggctgaggcaggcggatcacgaggtcaggagatcgagaccgtcttggctaacacggtaaaacactgtctactaaaaatagaaaaaattagccaggcgcagtggcgggtgcctgtagtcccagccacttgggaggctgaggcagaagaatggcgtgaatccgggaggtggagcttgcagtgagccaagatcacaccactgcactccagcctgggcaacagagtgagactccgtctgaaaaaaaaaaaaagttaaacacaaaaaccacagtatgaactaaaagggcttagaaatctgaggctgttcccatgaagaaaatcctcatcctggacttctgtgtctgctaagggaggcacagtgattatgatagttggaggttacagtgtgtggatagactgtggttacagtgcctggatagaccgtggctgcagtgtgtggataggccgtggttacagtgtgtggataggccgtggttacagtgtgtggataggccgtggttacagtgcgtggataggccgtggttgcagtgtgtggatagaccgtggctgcagtgtgtggataggccgtggttacagtgtgtggataggccgtggctacagtgtgtggataggccgtggctacagtgtgtggatagaccgtggctgcagtgtgtggataggccgtggttacagtgtgtggataggccgtggttacagtgtgtggataggccgtggttgcagtgcgtggataggccgtggttgcagtgcgtggataggccgtggttgcagtgtgtggataggccgtggttacagtgtgtggataggccgtggttacagtgtgtggataggccgtggttgcagcgtgtggatgggccgtggttacagcgtgtggataggccgtggttacagcgtgtggatgggccgtggttacagcgtgtggatgggccgtggtcacagcgtgtggatgggccgtggtcacagcgtgtggatgggccgtggtcacagcgtgtggatgggccgtggttacagtgtgtggatagaccgtggttacgttttgtggataaagcatggttacagtgtttagataaaccatggttacagcatgtggataggccatggctacagcatatggatagactgtggttgcagttatgggtagaccgtggttacattgtgtgactagattgtcgttgcagttgcggatacactggttaaagtgtgtagagtgttgagaaacgctaagtagctttcagcctccctgactgcaccgagcaacctttggtgtaaaaaatcctccaaggttttcggacacatgctcaagttacagaacaaaacaactgcaggattcactttgtaagaagagagactcaggtgtgtttcttgtgtaagccacagtgctggaaaagtaggatggctcctggggatcaccaaccccactccaatctcagccatcatttctagccatgcaattgggtgtatcccttagtatctttgatccctccttgtctgtaaaaaatggaaatgaaaatactcataggttttatgtggagtttataaggcaactagtgcaccatatggagtggagaagtgctattgctattataattgtgtaatagtatgtaatacattgatatgtaatatattaatatgcaattataataataatagcattgttattatttctccactttggcccacaaacctgaattcagccacttctatgtagagagtactcagataaaaaagaaaagtgagatgcttacgctctagaagaccatgatgtgggacagagacggaagcatgggatcttctactgattgtgaaaggacgtgcgaaacccaggctgctggccatccccatgaagggctgctagaagggtctactgaaaatggcccacagttgggtgctaaatgaggaaacattatccagaaaactcacttaaatggagcgactgaggccgggcacggtggctcatacctgtaatcccattactttgggaggccgaggcgggtgaattacgaggtcaggagttcaagaccagcctggccaacatggtgaaaccccgtctctactaaaaatacaaaaagttagctggccgtggtggcgggcgcctgttatcccagctactcaggaggctaaggcaagagaatcatttgaacccgggaggtggaggttgcagtgagccgaaatcgcaccactgcactccagcccaggagacagagttagactccatctcaaataagtaataataataaaaaaaaggagcgactgatacccacatataccaggtgcattagcacaatcactatttccaaaggctggaaggaaatagccttgccgagggccagaccctgagctgctggaggccttgagaatggcatctcacgtccccacggagagaattgtgatgcccggacatcacgggcgcttccatgtgggtgtttccgtggccagagggattctgaaatgtgtagggacaaggacccattccagggaagccaagtgtcggccgcattcaccacccgtcccctgcagtctcacacctgcccgaggaggcagcccagcagtcgggggccccgagctggggaggaacgcaggcggctgcagccccgagggagccctgcgcttgtttctaagaataggtggcttccgggatctggagttcggtttttctaaatacacctcagcccggagactcggaggcaggcaatggggccaagtaggcagccttgggagtgacatcacggtttcctcttttaaggcgattctgaggcttccttctccccaggcccctcccgcccagctgctgcagctgctcagagccacctcggcctccacctctgcggagctctgacctgccctggcttggctgtgcctgggtttgggacagttcggtgtgtgttaaagaagcagagctttaactgcgttgagggtgtgttttccctcctgcctgctcttcttacctgcagtccaaacacgtgtgcctcggttgtttctaaagcttccccgtggactgcatgactgaaaatggactaaatgatgattatgttaagaagacttgacagtgccacctttagagggaaacgccaaaagtggcccagaaggctgagggacaggggcctatgtaagcttcacgggaacagaattcctaagctgtaaggtaacatttctatgcaatatgaaacctgagaacaaggcttaataacagcccctccaggacggcggcaagcgagccctcaagcgcagtctgcatttccccagccgcagccaggcagctgccggcaccttgggaggcactgggagcacgctggtgacttctcttggccagtaggtgtgggcgtggctcggtgctccagacactacttgaaaagggaaggtttctgggactcctggcaccgcggcctctcctctgcccaaatttcaagatttatttttactcgttgaacgaaaaagagaatgagccctgtactctgtcatgctccaaactgctgccccatttttagaccacagagcaagatgaatgctgttggaaggaatgtgtttatgagagagacagtttttaatccatcagagagcaatacttgcgactttaaatatggcatatggtgaaaaagtgtccctgtgatgagtcagcaaaaaaaattatttcacccctcacatatacgagggtttgattagctcactgattgcagttttactagtgtgcagcacagactcaaatttaaatatagcttgagggaaaactctgacatcagaatttgtgcatgataaactgtgttgctcaaacttcaaaggtctggtctccactgcttccgggacctccccctgcctcccaggggacagattcctcgtgtgatcccacaggccagctgcttcaaagctgtgtctttccttgggccccttctgacccattggctcccctgtctccactcctcacggtctgccctcaccctctgtgatcatggctgtggccctgcgatctccatcctgtctccttgtgacagattttccacctcaccctttctttaagcagctgacactcagacccatccttcctttgtgtctgatgtctttggttgggtttataaaggcaagacacttctcccaacccatgcaggacgtcctcacagatcagcttcttcaaggagacctagcccagcccgtgaatgagtggtggcagcgctggcagcatgagaacaggagttgaaacctgctctcaccccggccaaagatcacatcgcttccctttcctataaagtagtgcatcatgtggaggacatttcgtgtctgtaaagtaccatcacccttttctataaagtagtgcatcatgtggaggacatttcgtatctgtaaagcaccatcacccttctccctaatctgtgcatgtgtgtatctgtagaagtgtgcgtgtgcgagaatccacccttcatgatttaattgaaatcacagagcagtgatcagcagcagcgaagatgaccctcacagctggggagcccatgcttgatgtggtcagcattgcctccctgcaggagggcccggctcagggagtccttctcagacccctctgtcttccctatggtctattaatctccccatgcaagggaagatgatggacatcaaatcgactgtaggctgtgctcctctgtgcactctcacgagcactaacacctcccagcatgattctccaggactgcggctccaagaggaaagctggccccagaagcaggctgctgttcagggcctccttgcctggtccagtccttgcttaggtgaactccagctgaccaagataagcattcactgcatttggtttaagcagcctttcgtgtttattgtgttagtgggtgcttttctttctaaagcaaaaaaaaaaaaagtttaaaaatttttaaaactaccctacttcttttatgacttttactcccttctcaaaaatatcagtgtttcctaagttcgataatagcatttgaccaagtatagtacacacttgatgaaattaactcagttttattaaatgcctattttattggcatgggatgatttaagatgaagactctcagtgttaacggcctcaattcatttattcaaaaagcatgtattgagcctgctctgggtgccagctactatgctaggtgcaaggatgtaaatattcgtaagacacaatcaccccactcaggattttttgctgtctacttttattgtcctgtgaagaggaaagtttggagagacccactcccctccaaagtgggtttctaggtcatgtcccatcacaggaggaccagggctcttgagctcgttgggaattccaggaagacttccatggaaggtggctggagtctctgtctccacagattcccaaaggtcacgcagtgaccctgcacagggagccttgaaacctttgcagttggagccagagggactccacacaccttctagcccagcgctgggagtctgtgggtgggaccccgagtggtgatgtgttgcactcaacgccatgccatgggtgaggagcagaacctggtccacactcactctggtaaactgacaccccattaaaccatgttttaaaacttgtgtattgggaacttcactgaactcagcagtagttattccatagggcagctggaaaccattctttagggactggaaagtccattctcatgccctttgacttccttgatgttaattctaaatgacacattctcaggatgttttccccagaggaatcctatatggcagggctgtgtacaggcctgagaagcgacagggcagcctgcggttacacttgactgagtaatccgcttgtttagggctgtggccgatgagtccctgttcccatggtatcctaaacgtttgcagttattaccaaatctgaattcaaccctcatcttttatattgaaattccttttttaaaaagacatatgtcaagtggaagctatttcatttgtatctgacactatcttttcaaactgtttatccaatcatttgggtcccaagtgaattacgaattcatcaacttaaggaagaaacttggaggttaagacttctttttacgatactccctcattcatgaaaaaatgcgtttatttttagtagtgctttggattctgtgttttgtttgttctttggttttgtttctagaagagtcttgttggaagctctgtttccagaatgctggattggctgtggtggggtccataacccactgcctgtatcaaactcatacttcaagaaaatattaaatagttgcagtatctacagggcctctacagagccccttctgctattagcagggatgtgactttaggtcacaaaagaactagaagcaaaatggtgactatcagaaaaccttacccaataggagtagccagacttggtcatttgtgaggagtccggcagccggggttccagcatctctgttgcttccctgctgttgccagtgtaaatgttttatcatagtcaggatctgttgagttaaaagaatatccagagatataacaatgcattctttgtctgagtcattaagaatgtttatgaagaagaaattgagtagtgaaaagcacagattcagagcccggcagatcttcctctgaaaattggctctaccgcttactagcgcgatgcccttgagtaattctctaatctctgtaagcctcagtgtttagttctgcaaaacagaagagcaacacctttctttcagggtcgtcattgggattcgaggtagacaaagtaatctttagtatctagtcacatgatcattggtccccaggtgctcgctaaaaggcagcctccacccgtcctgagagtgaaccactgcattcttcagtgttcccggctggcaggtgtggactgctggttctcttcagtttgctctgaaaatctcactttgctttgcccttgctggatatttacccaggtttcttgggctctttctgcccccacgtgtcttgcacatcccagcaggtgtctcctctggggccttctctcctcttggccccacacattctgtttgctcccagggtggatttggaggggagtggtaacaaagacccaagttttcaacaacaaatggcaggaggtgaagaacttcaaatttgagattctaggaaaaaagaggagtttgaaagaaatactgaaatactgaaagtcacggttgaatatggtgagaacttaagagtaaaataaagaatcatcaagaaaacaagtcagtcagtcaacaacttgactgatttaaaagaaccaatatgaagagtctaaagaactgatttattcttgcattcacgttccaaagcaatttaagtaaactcaaagaatgatgctatagttgaaacgtaaatggaggaggactgggtatttatctccaagatgcagggagaaaggtgggttttgaagaggaggaagccaggacagaatacccgaagtctgcaggaaccaggagctgggaccctcgagggcagtgggaggagagacggtcacagcagtgctgtgagtccgcggggctcttccggcccctctgcctgtgtgtccactcagtatgtgaaaaatgcctgtgaattgttcacccaaaaatgtattgtgcagcagcagatgtcccctaccccatgcagaaaaaaagaccatattagtacaacgcctgtctcattcctgtttcctcaggggatgcctgagaatcccttgctttaaaatcctctcccgacccttatctaactgtggtcaagaataattgttggccatttcctgctctggaaaccatctggtctgctgtggtgccctctatcctccctcctctttaactataaattaagtcctaaaagaaagaagtagaagaactgagacaatttaggaccaagaaagtaaagttaagaaataattgtattaagtctgtaagtttagaaagggctgatagccatggggcaggtggttgattttcatcctcaccatgtagagaataagaagggaaaaacttacatggaggattctgactagcctggagcgagaactcacagtgattcagcaaatatccacacgaacagctgcgaagtattgttgatctccccctggtgtcgcccacctgggaggattggcccacggtggtgctgaaggcaacagtatggaggttggcttcaaatcccttctggcagtgtaaattcatgagaaatgctgaatacagttcatctcatgtgcttttcttttgtaaggtaaaattgagctctttcttttctctaacaagctcattttaaaggctatttaagggaaacataaaattaaaatataaaactgaacctttcgctggctcaatttcttaatgctaaattgctctcccatccaagaataatttcaaaagtttggaatttataaatggcaatacttggatgtggaaattatgttaggactcctatttttatgaatacaatccagtataatgtaaggctatataaaatgaaatatttctgttgaaatgtatttcaattctttgtctgagtagtgaggattttattattggattttagttactcaagtttcagctatatttagtgctgaaattctaggccattttaagagaatcccactataaagagggaaaaaaaaaaaaggccaggcccggtggctcacacctgtaatcccaccatttttggaggccaaggtggatggatcacttgaggtcaggagttcgagaccaacctggccaacatggtgaaaccccaactctactaaaaatataaaaaatagacgggcgtggtggcacacacctataatcccggctactcaggaggcggaagcaagagaatcacttgaatctgggaggcagaggttacagggagccgagatcgcaccactgcactccagcctgggcaagggagtgagatgctgtcaaaaaaaaaattcttttttacatgactcagatacaatgagggtcaaagtatctttgcccaaaacattactgtaggactcatagtaaaaaccttccagcagaatgaggtgttggccataccccctgccactatatgatgactttctccaccatatctgtgtgctgaagagtcagatgggacagtagaagcatgagagaaaatccatgctggaaccacctgtgcttgactttgtaaaaaatttttctcacaggtctttaggttaaggatcttttaactcccttgataatttggcaaataggtattttataatcgtaaaacaagagaaaacattgatgtagtgcttactttctgccagacactgttttgctctgtgtgtgcgtgtgtgtgtctgtgtgtaattaactcacttattactattttccccctttaacatgaggagcagagaggctcagtagtttgccacttgtccactgtttctaacctggttaggctggtcagcatttgaacatggaggataggacagtcacatgacattcgcacaagtagagagaggaacgttgacttctgagtcacaggtcttctcctggtagcgccatcataccttggggatgtttcacagccacaaatccaaacatgcgtcccagactgcatgacccgtaccccagttgtgttgacctatgttcatttcctaactcgtgcaattacacaaggatggtcttggtgcacacgacctctcggtccattttctggccaatattcagttccttgttctcgccttgccatttgccacgcttcagtcagtcttgtttcccacactgctgctggagaggtgggctcctccgcgggtgggccgatgaattacttgcctttgcctttgctagagtgagatgcattccatcatgtaatacatcaaaacatacaccagagttctggcccatctggtgctctttgctcagatcccctggccactccctaattttctccactcccacaacttgctgacatagatttgattttcaattcagaacaaattcaaaacaagtaaaaaagatctgatggaattagcagacacatgtcaaattatccacagcttcttgctggagacacatggaaagatagggtgcagcacgtctccggggacccagagctggagaactcctagcagcctccattttctacaaagccacgggtcctccacagggttggccctagtgcccagaggtcaacagtggagacctgtctcctcctgggaggactggatctcatatcaatgcgtaagatgataattaggtattgccagcattccccttacaaatccttcaggcagggcaactttggagcacagtggttgtgtcttaggaggtccagcaaagccagttcccttcaacattagaacaagtcactcttccttctacggagcactgcctgggaagtgactgccactgccatgttgtgtgacagaggacagtctttaaaggggtttcattcattgtggacagatactatatgaaggcacataagggatttcctgatggggaggatggcaggggaggtgtcccacgatctcagtgcttgttcatcctgtctgtgtctctctctccactccctgccccactcctcatgttgcaaagttaaatgagaacgtgacacatttttcctgtgattttcattttacatttttagatgtggtcattatattcaactggatataacattttgtttctaattgaaaactttttccccaaaagtttttgtgcttttgaagcaaatgcgaaagtccatttctggcagggcgcagtggctcatgcctgtaatcccaacactttaggaggccgaggagggcgggtaacttgaggtcaggagttcgagaccagcctggccaatatgacgaaactccgtctctgctaaaaatataaaaattagccaggtttggtggcgcatgcctgtaatcccagctactcggaagtttgaggcacaagaattgcttgaactcaggaggcggaggttgcagtgagccaagatcgcgccacagcactttagtctgggcaacggagcaagattctgtctcaaaataaaagtccatttctaattccatttgagggatatggaataaagtacataaaaagtaacgagtcaaaagaaagaaaaggttttagtgaaaatgaatgtactcttctcccccttctattgtttgtaatagacttaatctttaaagcagttctggatttacaaaaacaaaaaaattattcagagtgtacccatatcccctcccgctacctctcacccctagttcctccgattattaacatcttgtattagcgtgctgcatttgttacaactgataccagtgttggccttccattattcttttaaatgtgaatctgactctggggatttgtgtgactgaatctcgcagattgagaacgatttttaacaaccagccatgcttgtaaaaacatgtggaagtttctctgactctgaaataagagggacaagatggttcccatgcaggcttgcgttggaaatgggggagcgtgcacagtctaactccatgccccgtgtttttcttgagtagccctctgggttgaatcaccctggacttcagctgaggcagggggattgttttatgctcaagaaagctccaggagtggtagaatctggccatcaagatgttctgtgaaatggggctcttgtcttttctggagaacatgccttcttggccctttgatcatgagacatctcaccacgccctcctttaacattgctaatgatggggactgaccaccccgtcattaaaccccatggcagtctaagattaagccattcagaatcttactagaaatgactaagcggaccgttttttcttgtgaggagagaattaaaggcgtttccaatccctaatgataaaaccagcatcaaattgtagagaattgcaatttctttcttacaaacagcaaatttttgtctcctttcattttttaaactgttgaacgtgtcagatggtatgcatagagagatttcagaggtctagtcaatgtgcaaatgttttgtggttttattttgagtttgaagtcagagcactgaattccacaaggcttgagcctcactctccctcctgagcacccaggcttcacggacatgactaataggagtttattcacagcctgctaccatccttggtcataacgttgctcaaggcccgagcaggcctgccaagaccacagtgtagccctgttaatatcacatgaccgtcggagagtttttggaaaacctcctctggccgactgtttatccgcccccattgatatttgtctgaagataagttatacagtctgtttacttacaaatgcgtcagaacagtcttggacttctgcacggaggttctgccaaatacaagtctaacagggaagtggtttgggcagccccggaaccgaagaacccctcagagcatcacaagccatcactctgggtccctgtcatttaaatagggattcaggcttcaggttgtcagtatttataggcttgattggagggaagtaagccgtatgagcactttttaaatgaatttttatttctcatttccacttagtgatggatgcacatttttccactaataaacatttgaacttttttcagtttttaagaacatcgtaggtggcatatttcacaatcttggcaaggcagacgtttttggagtaaatcgaaactggaggccagaagtactggctctgaactgaactaccacttgcaaatcgatgtagcagaaggaataatggatcatgtggaccacgcagaaagcgatctgagacgggcgtgtcagccgcatgtggatgaatagtcctttgtgggcaggaaggagagggagtgggtgggtatgagggcaggagaaagaatcagctctgtgtttgggggctgtgagaggacactcagaagaaggcttttacaccatattttatattcacaagtttatttatgttattttgagtccaacagaaagagtcacaaacgttaaactttagcaaccccctaatgattggaaaagatgggcaaatccttgctttaagagcagctgtatcgtatggagaagaagtcatctctgctgggaaaactcgcgaacagatgcaggctaaagcgaaagatcaactctccacaccattacattttgaagggctttgaagttatttttagaaaaactcaaaaatctaaatcaaaaatcagattttttctttttttttttcctactgcttccttttcctttttcttcttctcttgtcccttctcctttttggttgtttctattgctatttttacatgttcctttaggtggggggaagataaggtgtgaaatgtattcaagtgcaactttttcaaaataataaaatacatgtttattatgaggaaaactcaactgcctatagaaatgacaacggtaaatgtaaataagcaaaagatcagagatataagtgtatagccatcacttcctttagcaatcaaataatgagctgggcgcagtggctcacacttgtaattccaacactttgggaggccaaggtgggtggatcagttgaggtcgggagttcaagaccagcccggtcaacatggtgaaaccccgactctactaaaaacacaaatggtgtttttagtgttttgtttttagtttagtggttttagattttagtggtggcaaatgcctataatcacagctacttgggaggctgaagcaggagaatcgcttgaacccaggaggtggaggttgcagtgagccgagaccgtgtcactgccctccagtctaggtgacagagtgagactctgtcaaaaaagaaagaaagaaaaagaaagaaagaaagggaaagaaaggaagaaagaatcaaataacaaaaagcacagtcagcattataagatatcagacatacccagcccagaggcagggtggagttggagatcatctagtccatcaaccaaatcaatttaggttgatttttttttaacaatttttttttttagccaagtcaaaaaaagtatttttagccttacttatatataactgtatcttttttggctcacttagaccattttatcaaaggagatcaaccacaaattcctgccggtttttagttgtaagaagctttttttattggcaggaaaactgggagaatgtgtaagttgttaagcagccaggccactctgtgcccagtattctggtaactattgtgaaggatgtttaagaagcaggtcaaaggaatgaaagggcattggggagaaaggtgaagaaaatttattgaacacctatcacatttttccctcactagctacttaactcacacatccgcacaggagcccaaggttaaaccacttgtctagatcaccaaggagagcaaagataaaatcttgttcctcccgtaagccctcagagcctgtgatgtcagacaccttgttgagagataacattcacaaaacaaccagagaaccttgatggccatcatatattagtgacatattcatgctggcatgtggggcataagtgagctcccgtattgacttggtctgagaatgaagaagtctagctttacccataatgggctttaaagcagctctttgagtttggttggccccagacctaaagtcttgcatctctgaaccactttacctattttctttcccacagaggacaaaaataaatgtgtggaactgagcctaggtcctgtgaaaccttttattctccagatgcatagcattcccttggtgacacaatccagttttgtgaaatatatgaaaatattggaacttttcaaaaattgtctaaatttggggggatgtgccatgagaatgtttaaaatgcaaattcccacacagttcatctaattgattttaatctgattatgcctgccctgcaggatcttcctggcaggaatatgataggccacctgcttcttttaggggaaaacattctgttttgagggtaagagaagatttgagtgaggtttgctttggtcatggcttctgaagcttgataattgcagaagttccatctgtaagatgctcgattaaaattctagatgaattgagtaatctccacaaggccaagagaatctaatgttcttgaatttgttccatattcacgatagatctagtaaccatgtgtagtaatcagacaaattctccaaaacatacagccagctggattcctgaactttaacaaagtttttatgctgactgcttctgcaacctcactaactagccagcctagataggaaactcccttcttaattcattcataaagtaccttttgatatatagacccaatctctaataaaccttttggagatcaatttgcatatgtgataaaagtgaaaaagttggtcttcagatacctactacagaaaaaaaagtgaaaaagttcttaagcagatgagaaatttaaataagattttaagtattttctgaacattaattcacctcttgacttttgaaactttggtcagacggaaatgttcattccttctccctgaaagagttgatggttagatttcataacacagaagctagtaaagcaaatgcagtaagaaaagtagcctcccataggtattcaaacacgtattcaaaattaagacagcagaaagtctaaatgtttaaaatatgcttcattaacttctgattccttgaatctatccccatttattaatgtttatatagagaaccaaaaaaacagaaaaattactatgatgactattaattacatcattttccaaaagggggaaaaatattgtaatcaatgaaacctgaatatacttttataattgataagattaaaaaagttgtaattccacttcagtaactaaaagagttattcagaagataaagcatttataatgatggacctagatttctgcttcctatagagatttcctgcccacgtacacatattctggttacacaggaaggctcatgagttgactactttggccagccttctattttgtaagtattggcagagagatacttaagaaaaaaaatgatttcataagtaaacttataattaagagaatgaagaagaagatgtagctcttggggcttccattgcctcctaacagaaaacatctgctggacttccggaattttcctaagaccttgagaacacacccacgcatttccaacttttttcctaaccagtgagttggcttcagcagttttcagttttatagctgactgtcccatccaaacagttgttcagctttgccctttatcataaattcattcccatttgtttattgcatagtattggttaccttctgttaattgggaggtggggaggaggaccagagaacaagctcataggtacaaaccttgtcaaaactaaaacctgttttgtagatgaggattggttccttgtattgttagcattgcctttgctcaagagaatcaatccaactcattttagtaccatctgtatctttcaaaatgaagaagagtagttaaaacaatatgaagtatggcatgtgtcaaactccacaaaggtgttttccatataaacttgagaaaacctaattaagtgggttttgaagagacaatggagctctgtttatatgtttgcctacccaggggaactaaaacaaacaaaacttacttttaaaaagcttcttcaaagttctcattttgttttagaagaactttcagcttcattgctttctaagtagcttgatatcattagaaactgataatgctcagcacagtcagcgcaagataagttaaccagcttacatccacctatatgtttaggggttctcttggtctaaaacgtcttgaaaaccaaatttctgtgaatcagttactgtcttagtccacttgggctattataacaaaaataccttaggctggataatttataaatgacagaaatttatttctcactgttctagaggctggtaagtccaagatcaaagtactagtagatttggtgtctgatgagatccaggattcatagatggtgccctgctgctgtgtcctcacgcagcagaaaggacagatgctccctcctttataagggcactaatcccactcatgaggacatcactctaatgacctaatcacttcccaaaggcaccacctctcaataccagcagattggggattagatttcagcttatgaattttggagggacacattcagtccgtaacatttcacccctaacctcccaaaatttatatccttctcacatgcaaaatacattcattccattctaatagcccccaaaagtcttaactctttccaaaatcaacctaaaaagtctaaagtccacagtctcatctaaatatcatctaaatcaagtgagagtccaggtatgattgatcctgaggcacatttctctcccagtatgagcctatgaaatcaaataaattgtgtgcttccaaaatacaatggtgggacaggcataagacagacatttctattctaaaagggagaaacaggaaagactaaaggagtaagtgatgccaggtgagtccaaaacccaacagggcaaagaacattcgattttaagtcttgagagtcatctctgactccatatccgccttctggacacactggggtggggattggttccttgagtctcggggcagccccgcctcccatggcttcactgggcacagccttcattgcagctctccaggctgggcaaactggtcactccactgttctgggtgctgggggcagccccactcccacacctccccacctagaagaaacctacactgccatgaacagaatattattcatggtgttctgacagactgaggctttttctgcaactctcttcttcttatgagccctcaccttacggagtgaggagcccctctcccacaacactgcccttgtggggcctctgttgttggccctgctcctgtgtcaggtctgtgcctggtcacagaagttctccagggcatcccttggaagctgggtggaggtggccacattctcacagctcttgcactctgtgtgcctgcagagttggcaccacgtggaggtcacgaaggcttcctgcttgtgtcctccagagagaccatctgagctacacctggacccactggagccacagctggggcagccgaggagcactgcatccgattgcagggagcagagacttgaaattgttctggccccagggtcctggcattctgggcctaagatgggtggggcagccccaaagattgcctccggaggtccttcctcagttgtcttgattagcagcatctggcttccctctaccatactcatctctttatcaaatgtttgcttggctacaatctcgatgttctctgctgaacatgttttctactcttctactacctggacagtctaagaattttctaaatctttcagttctgctctctgtttcttgataaattccatctttaatttgtttctctctgtttacactttactataggcagtcaagaaaagtcatgccacaccttcactttgcttagatatttcttctgccaaatatcctattttatggctcagaagtctaccttccacaaaacacaagtagatgagcatgattcagccaaattctttgctgctttgtgacaaggatggccttccctttagtttcaataacatgcttctcatttctgtctgagacctcatcagaatggcctttcctgtacacatttctaccaacattctgatcatgaccacttagggaatctctaagatggttgaggctttctctacagcccccctcttcttatgagccctcgtcagaatcacccttaaggttctgttcatggccatgtaggtttttttctagcatgcacctccagattctttcagaccctacccattacccagttctaaagctaattttacatttttaagtatttgttaccccagcatcccacttttaataccagtttctgtctcagtccattcgtagtccatgctataacaaaaataccttaagagtaggtgatttatgtacaacagaatgttattgctcatagttctgcaggctgggaagttgaagagcaagtgaccagcagatgtggtgtctggtaagagctctctgcttcatagacagtgccttgctgctatgtcttcacatgacggaagggacaacaggctcccctgggcctctttgagagatgcactaattccactcaccagggctgtacccccaggacctactcaccttccagagtccccacctcttaatgccaacacactggggatcagatttctactcatgaattttggagggacacagacattcagaccataacagttactgctcaaaacaaagaagtaaaagctagcaaataatataagtatgatgtatttagatttattttagtattgctcattgcctttttaaggtaaactttctgggtcaattgagctgtttagatgccgactcatatttgaaggttctgctactcctctacaataccagacttataaaaatcaatatattgcaatcattcatatactcagcgaacatgctgacacctactgcgtgaagggttctgtgatatgggcagggggtgcagacttgtatcaggcagctactctctcagaattcactgcctggcagggggaggccaggaggctgtccccagctaagacacaaggcatggcttgtgctaggccaacagggaggtgccgggagtgtaatacaacaaggaggagccgccaaggctcacaggagggtccccatatggacccaccattgctgagtgtgtgtaagaagaagagcaggaccagggaggtgggtctgagaaacagtactgattaagaaggagtccaggaaggaatccctgaaaagaaaatgaagaccaagtggatagagagacaggaaaggagccacagacagttctcccagagaaagaggaggttaggaggagggagtggtccacaggacctagcgcctctgggagacaagggtagaaaccacaccatttctaaaatgagttggggctgggcacggtggctcatgcctgtaatgccagcactttgggaggctgaagcaggtggatcacttgagctcaggagctcaagaccagcctaagtaagcaacataatccaaaaaaattagccaggcatgatggtgcatgcctgtagtctcagctactcagaaagttgagaagtgaggattgctttagcctaggaggttgaggctgcagtgagttgtgatcatgccactgcgttccagcctgggtgacagagtcagacactgtctcaaaattaaacaaagaaataaataaaatttaaaaacgttaggaagagaggaagaagagggtggtacctggagggagatctgggctacagagaaacgttttagaaaatccatgtaaaatccaaatgcagcagattatttcagaggtcaccagggtgaattatggctgggaaatggactaacacaaaaaagatgctggtgtatattgtggaggttcgggaagggtgggactcatgatgtgttcaacaaggctgtatggaagcctgggttgagtctgtgtcccaggaaaggcccactagtgggtcccggtgtgggacccacccccggcccccaccccttcctgccccttctggctttctgctccactcccagacccgtcttctccatcacccgacgttttcctagaagggcataaaacttacaccatgaggggacctccacgttagacagggggagaagctggaggacatgaatggccccgcagtcagggcccagtcacctgatctcagctctgtggaggtgaatgtgtttgagttgccctttttgtgaagacgtggtagctgcaggcatggacaacttacacattgagcaatttatatactatttgaagccacctcactttttcccttggtttttggtttctggggttttctaagaggggagagtgactcatgtctttcccactagtaggtggccttggttttaatgctgctcaatggattctaagagagcatcccaggaacctgctggtatcagcccagcacatttttggggtctctgggaatgagcttgggaaggtgagtgaagaacaactgaaaacaatgaagcgcatttgtggctggaggtcatgttctgatgaatcccgatcgggggaagccatggctgctcttgcagtgatcaagtgtctgccgcctggattctttcctggcatgtcagatttgcagcttccgagaaagtgctactgtcttgcatgacaaagtaatatttggctcaaagaaaacactgccaaactgagcagccagtaaattctatgacagcattcaccataattcccaaatgtaaaccagatagtaaagtgtcgttcataaccagcggactgtcagaaatcagagaaatgtgggagtggcctgcagaagctgatctgctgcccctacggacactgatggcttccttcatcgatgcagactggggagaagtgggcgaggtgtaggccccaagcagtcccaggctgagagcccggcacaggactggaaatactcatcagggttcacaggctgtctggtcttaaggaagtgacagcataagcaggagcatgtcagtaaattcacagcaagaccctgcatgcaattctatttgcaaatggaccctctcactcttgcatgactggctccaatagaagcaaaactcaggtccatcctagagcacatcccaggagaagtttctctatgggggatgagcttcaaaagtaattgtaatttaattagaaatttagatgtgagtacctggtttttttagtgggactcttttttttttcttggtaatttatacattagccgagacgcttttcctactacactgccagaagttaacttctaatagagttcatacattttgttctctctcatgttttttctccgtcacctattcttcacaccttttaaatttaagaagcatgtatgtatacatctgtgcgtgtgtgtatatgtatccttggcagcagtcctcattcctttggtgattactaaacatttgaggactggtaaactgtgaggaattgaaccttgctggctgaaaggtagaggaccagagtctgccttgttccccttatgccttcaggggcccggcagggtctcctgctcctggggctcatcctgcaagaggcggctggtatccaagcagcccaccccgatcgcctcctcagggaagagggcagggcagttaggaggcaatgcttctccatggtgctgggaatctctgtgatataaacccggtgggatggaggagattatttcaaataattgatatttacttgcattgaccatgaaaccaacccttcacgagcaccctctctggcccagggcagcactgcgcccctcgggtgggaaagccggtgtgggagagtccaaccctgcaggaaacggcttggagaagctcccgcctgggacactgaagaagtgagcgaggaggaatgatgcgtcagttcagttcaccaggagaaacgtggaaaggccagtgtagcgaggagagcgtcacacagttgtggagatgtcagcagacacagtgagggaccatggatgcggggctccagccaccagagtgcagggtagagaggagctgcacctagaaagccgtggcacacgcagcaccaggaggcctgggcatcacatccaccgacccgagtttcactctgcagggagcagaggggccttcacgtttttacattagaaaggagtcggagaacacgttggatttcagaatttgaatgaaggcagctaagagaggagatgcatgagggtgcagtgggatggggtgcacagaggcagttccagagttaatgcaagcaagcaaggaggaagtccgatccaggaaggaggtgctgggaatgcagaggaaacggcagactccggagatgcttggcggaaagcccagtggaatcagtgccctcccagtgcagtgtgaggacgggggacagcagtgtctcccccatttcaggttctgaagcctggcttgtgggccttgcaattcaccgagttaaggagcagagaaggaaaggggggttgtttctgttttttggagttttgctgggagcaaggttggaggaaatgaggtaagaagttcaacttgaagcctgctgagtttaaagtatctctagaccctctagacagaggcgtccaggagggaggtaggagccatccacctctgagcgttcactgaagccgtttggtgtgaatgaagtatcccacctcatgagtttggaggggaagagagcagcaaaactccaatgttgagcagaacaggaatcaggaaggggccagaggagtgaggggaaacgcaggcgggtccgtggccaccagaagagcccattccaggagggagggggcagctgtgctggggccacaagggtccccagggcggggaggggccctcacagctggggatagtggcattgcaggcccttgaagaagagtgtcaggccagaaaccagctcaccatggttcaaggtgtgaatgggggacaggaagtggctttggaatgtgtccaggttctttttgaatagagaaaaatttcctccatgaccatgcttcctgaaaagagaatgaacccacactctgggatgtgaggccaggagagttggcttcaccgtcggctggccgtccccaagtcctgccccttctcccgctcctgtctgatgtgagaggtgttgccactgcagtgtatccaaagttccagacatgcagagccgccctctggccatcgtcggggtcatggatcctttaggagtgaggaagcgggatgcgctggtgtggaaggcctttcatatggtcgggcgtggacacagagagaaagcgccaaacatccttgcggcattgctcctgcctggtggaacagcacattcacagtgagacaaacacaggtcataatgagagcagaagaccacaacagccacatgacacgcgtacacacacacgcacacatatatatacacacacacatgcacacacacatacacgcacacatatacacacatacacgcacatatacacatggacacgcgcacacgtttacacacatgcagatatacacatgcacacacacgtacacacgcacacatatatacacggacacatacacataacgcacatatacacacacatgcacacacgcacacatacacacacacatacacatggacacgcgcacacgtttacacacatgcagatatacacatgcacacacacgtacacacatgcacatatatacacacggacacatacacataacacacatatacacatgcacatgcacacacgcacacatgtacacacatgcacatatacacatgtacacacatacacgcacatatacacatgcacacatatacacacattcttgcacaaaaatctcacaagaacatcacgggtgaagctttctaggaataatcttactaatattacgaagctgaccacccaggctgtgacgggtaaatcgcaatatggatattccaaccgcaaagaaagcaagaatgtaccgtgatcagcgcagacccaccccgggtctctagtttccctctcccagtaatgctccttgttcctaatgaaccgcgtgcatctttggtgtctgcgctgctgccgctacacctttgtgaacaccaaatgcgcaggaagcgtatcgggagcagcacggctgcactcagttgttgccttctatttcgtggatgaaaactgctattgatttctcttttaacaagtgctgttgggaagaaccagtgttctggaggctgttttcgcccatgtcatgagaacagggcgccagctgagtcacttctctggaatggactttaatgtcacttggtttcctctcacccaggacccgggcttcatgtctggacaaatgagccatgcattatctttccaccagactaaagaaagatcagtttcttgtggtttgttgttctttttttaattgcggatgtgtgttcagcattcgcccaaataatcattccaaaccggggagtcttgggggagtgcaggatgtccagatagcaccagccctttgttaactggagagacgacagacaataaccccggcgtggtgaaacccggcccacacgtcccgcccgccccagagccaatgctagggccatcaggtggccctggtagccagtggttccaggaccagcatcagacactcggtgttactgtggacagtagctttgtacaagttcctagcgaggtgatttccaaaatattagatacctttaaagacagagatgaggaagactgaattgggatctggcttttactgtccgccatttaaccttcctcacaccaagcttcaaggcaacagggagcgtgagacatccgtgagcaagaagccaggctgctcagccactcgtgggccacgtcccctgtcccctcgcagggcttgcagttatcacactcaaagttagcccaggttgttctctaggcgttgttgccaagctcataattccacatgttcacggtcaaatgtatgtttagataccttaagttgctgctaacatcctgagggtagcttctggctgtaaacaaacataattctgatcactgtgagactcattctgttcttggacagccccttggggttcagtgacatggactccaagttcaccatctgatgtatgggcttctgccactggtgctgtcatctggcaccttcctaaaaccttcccattcgtacatgacccccagcacctgttctttttctcccgtagctttccttttcttcttggcgtcaaattcgaagccactttcatacccttttgttttcttcacgacaaaatatgttactgatgttactgttatatcagcttggtttgttcagaaatcaaaacagtgacatctttcttccatctggtggaaagatcatcagaacccagctaggtggtatcagtgaatatttccatttcccaaataaagaaactgaggctcagggaagggcagtgacttgcctgtggtcatagaactggcagagctgggattcaaccccggtagcacttcaaatctggtactcttccttcttgactgcacggggctccaaatcacgtgaatctgtgtttaactgatcagtgttaaatcacttcggtttgttcacaaaccaaatggccaccattctgcccttttctcctctcagctgccttcttctcgatgctcttaagccctcactcacggcctgtggggttactgcagggacttctaccaccgtctcccacgtcccatctcagctcctatctgtggtcagcacccaggcctccctacaggtcttctcagccacgacagccttctcccaaggaacctgggcctctgcgaagcggcctcctgattccccacaactcccctggaacacaaagctcgtcttctccaaggtccagctaaaccctgcttcagaatatgcttaaacagccaacctttttagcatgcagaactccacagctgtttagaaaatcttcctaatgcagcctgttttcaacaacgaatctgttcagagaaggtagagaaagcataggttatgtctaaatatttccctggagtgtgttactacttcagagtattagcctgcagctccaggggcctcctctgcataccttttgaccagcattgctaaaaagtaacagaaatggcttgtttgggtttcaccttctttttctacccatcactctttagcagggagggggattaatgagccgtgaaatggctacatttgagcagggtagggttaaagcagagaagccatgttcttaaatcacctctgcaggactgtggctggcttggttttgtacggatttccatgaaccccaggcatacattgtttatttttgtagacaatttgtccatctgcttttggcttaattatcgcttcaggaagatcagtggaaaagatgtattcagagtccaaggtcatgtctgttcctcaagggaagtctgtgtggatgacaatgccctatggaactcttttgaaaagccccatatgactcttctctttcatataccagccaaatggcccaaacctctctgtgcctcagtttcctcaccataaaatgggtacaatgacagtacctacctcgtagaggtttgtgaggactacataggctgactgttggaaagtgctccgaacagtgaacagtctagagtaaaaatgtcagctgctgttctagcttagtcccaaccaggggtcaaagctaataacctgaaacactctcttgtggaccctctgcaatgggctgggcctaacaggtccgccaatacacaaatttggaacactttcctttaagcaagtcaaagggaagggaattgtccaaccaatcagtgattgagtttgttccaccaccctgtagaaaggaaaatggaattcgatgtgctctttcgacatctttggaactctgcagtcaggactttccccatgggaggtgagctccccgtgacaaatgagggagctgccctctctcccactgagatgagtcattgtaacccaaaacaatctcaaaatctttgacatcactgccgcttgcaaatctgtgcctccagccaagggccggtggatgctactgcctgccacctcgtgttcaccaccagaactgcacgtcactccgaatctgctgacctcataccctggcatagaaacagtaaaaagaccaaacaaaaacgtgtcttttttggacccaaggttgaaatctgattttaaaacagagacattcagtaagcattaaacatcttccttttatagctttctcacagacctacattgacaaactcaccccttccctccataacctttacgcccctgagtcacagtagttgccctgaattgcttacgcaggtctggcttatcaccgacagttgtcctcaaaacacttggttcaaatgttaccagaactaaatttggaggagggagtcctggcattccagagcccttgcctcattttctagcgcgatcccagcagatggtctgatgtatctcatcagatgctgagcgcgggcctcactggcccagccctcctttccacaagtctggtggtctccttttttatgactccacttgagaggcctgggaaacattctccctgataatgcaggtgataaaaccagatcatctggtggaacgaacaatcagaaattccactgggcgggcacagggcttggagaagagttgagattgcggatgatgttttccggtagatgaaggtgactgaaggaattgaatggagggtggaggggactaaaggagagggtgaagtcctccacagcatgacccactgctgctcggcatcagaaattgggaagtcattataatggtcagaaacgtggtctaaaaatagaagattccatgtgggaagaacatgaatttcggagccaggcagagggggtaaatagcagtgccataacgcatgtgtttaacagacagcacatggagtgtgttctgtgtgtcaaatcctgcaagagatgccggggacagagtgtgaatgaggcatggtccctacctccaagggcctcgcggtctcacgtgaaatgtgggtacagagatgtagtatggcagtgccctgcagtgtgccatggggaagaagccccggccgcctcctccagttgtgaggaggggaagatgcccccagagagcccatgcttgagtcacatcctctagtgaccctgagagcctcaggcagcgagggctgcgtgtgccatggccctgaggttccagagaaactggcccaaccgctaggcactcagttagactggagagtgcagtgcactgtgccagcgtgggaaggggtgtgccagggcagtgggggacaaaaaaacgcaaaggctatggcggggtggctcgcagagcctgcagagctgacacagtggcttgggggcaaggcagacaggtctctcagaggcccccttacctttgcttcacaaatgagacatgagccagcagtgcttggcggtggtgagcagccgggactgtgatgtgggaccctcagcatgtgggaccctcagggcttggggaacggtattgctgcatgcagagcaccactgggtccaggtgctgtgggtgagaggctcatctctctgggctgccccctcacctgtctacgtgagaattagacacactccatggctcccaaacctgcctgtgaatcttaagtgcttgggggccttgctgaaaacatcaactcctgactgggcagtggctcatgcctgtaaccccagcactttgggaggctgaggcaggaggatgacttgagcccgggagtttgaggctgcagtgagctatgactgtgccactgcagtccagccgggcaacagcaaaaccctgactcaaaagatatgtattccatatatataaattccctgtccttttgtgggtcatcagcatgatgctggggcgttcacactcgtgtgagacatgcctctctcaaaccttgttaagatgtcagcacatgacccatctcacatgaaaaaattaaaaagaaaaaaacaaggaaaaagaaaaatacatatataaattcttcccaggctccttcccttgactcccaaactgctagaccagaaaattcacaaggtctgagactccccgttgttggtactttggcggccagcccaggccagtcctgggacagggaccacttcagaacgatcacccggaaccctgttaaaatccaggacaggagagggcccaagtgccctgcctgattgctaatgagcccccaggtgactctcacgctgccgacccccccgatctctctcagatgccccagatgctctctgaggtcccttccaagtccaacatcttatgaagcctttgggaaaataatcagttaccaatggcaaaaagcagagatgtaaatgtgaaaagtgatattatattggtctaatttcaaatggctatcactgtctataatctgtaagactcttgctagggaatgaggcttgtgtttgcgtattaagcaagacaaaggttgtttttgtatcataatgtatgagaaggaaatattcttttatccaaaataaaatgaatccatactctaggtaagaactttggagccgtgtttctctttagtttctgtatggtagaattttttttgttaattatctttttcccctgtctttctgtagcagcagcactctgggggaatctcagatgcattgtgctaagtgaaaggagccaggctcaagactccacactgcgtggttctatttctgtgagtgtctagaaaaggcaaactacatggagggagaaacatgagggttggaccgaggtttggagaagggagcatttgataacaaaggggcaacacccagaatgttgggtgatatggagctttgctgtctcttgctgatagtggtggttacacaactctgttatttgttgtgtctgttaatgacacaccaaataacacaccaaaaaaagtgaattttattgtatgtaaattaaaagataaaatttttttaaaggagtaagaaaatgaagtcaaaataaaattaacagttaactaggcagtagccaaaggaggagaaggacaatggtggttatcaagcattttgtaacaacagaaaaggtggagttctatttaaagcatgtcctattcaggaacatttcaaataaagataagaggggaaaaaagctgtgcatcacagccagttcaaaccccctccccatgcccactgccccacttttggctcgtaaccttttttcttacttggccaatgtggtgtgtgtttgtattatcgtagcggaaccaactcaatataatgctaacttaaagaatttttttttctctcatatatatagaccgcttttcagtctaaatgcaaaatagatataactcttggtcctgtccctgggctgtgccacagatcctgagcagtcaccctggaagacaggcggcctgcttgctcaactcaccgggagcccgcctttggaaggccacccacacgcctttcctctctgcttccacctggggcagactctgcagggctgttagctgcttactacctgcagaggccccatggggtaatgacagtcacatggcacaatgggaacacaccatctcagccatgagtcatgccatgctcttgggtgtgaagatgacctaagaataccaggaaaatattggcacgtgccattggcacatgaaaattagtaacctgcgcctgtgagtgaggtcgtaagtatagacaattagctcttttaattgccaatcatcgtgtgatcctggtagctcagtagttgccgcctatgctaattgtcactctctaaccgtgtaagtggaggccaccagcacagcatccgtaacctcttcatgacatccaggctgcatgagggtgatgctctgagcattgacacattgcatgtcagcagtgctaaattagaaagagcgtttcatacccattcgcggcctgacagccaaagctctctgcatgctgcctgcagctccagaatctgcttcctcctggccctttcctcaggtgcagtctgggctctcagggccctgaactcatccacaatcagactccaagtcttcttagaggacaagcaggcttaggaaatcacatcagtctattacacaatgattcacatttagacaaatgaaatgcatttattgctaaaagcacagaggtaataaaaggctttcccagaaaatcaacttttccaacacatgccaggcaaaatcatatccagaatataaaaagtttgggctaaaagccattgagcacaaccacccatgtgctgcctatttttagaataaggagcaggggttttcagacactgatactatgggtggggaagaggagatcatccactttttctctgctttaaaatgtacatctaccccagtcaaatcatttcagataaaactatataatagcatcttagaattataggtggtaccttctgggatttgaaaatttgtctatagagataaagcatgacagaaaccagtggcttcccagacttcgccttcactcctgaatctaattcggtcctgacccactttcagttctgctgccctgtgggctgtgtcccagacagttttcgaaatttctgtcagtatcaccatcagacagaccagattccatacaaggaaagctaggtcttggtttcttcagattatttccctggcagacttttcttttttttttttttgagacagagtctcactctgttgccaggctggagtgcagtggcacgatcttggctcactgcaagctccgcctcctgggttcacgccattcttctgcctcaacctcccgagtagctggggctacaggagcccaccaccacgcctggctcatttttgtatttttagtagaggcaaggtttcaccatgttggccagtgatccgcctgcctcagcctcccaaagtgctgggattacaggcatgagccatcccgcccagcccctggcagacatttttaaaaagcattcggctaagtgtttttttccaaatgtcactttaaaggtgtagactctccttccttttcgaactgttctctatcacataagctcatttgcaggaaaacctggaagggacataatctcggtcgccgggcaacatgcctgtgatgtcacagcttgtcttcttcatctttgcctttactcagctcctcttttgtttgtttgtttttaggtcaaggttattgaggcataattgacatgcaagtcattgaatattgacaaatgtatacagcgatagaaccaccagaatcatgctatggagaaggtccattaccccagaaactttccttgtgccctctcagttagtccctcccctccacctccagtcctggcagccactcatctgttttctgtctttagtttcgccttttctagaatgtcataaaaatagcatcagacagtaagtagcattttgtgtctggcttccttcacatagcagaatgcctttgagattcagcctcaactgctgcacacatcgggcattttgttcatttttattgccaaatagcaatcccaggagtgagctaatttaataaaaccaggatgaacattctcatacaggtctcggtgtggatataggccttcgtttctcttaggtatatacctaggagtgggattgttgggtcctgtgaactttagaagaaattgccaaactgtcttccaaagaggctgcacccttttgcgttcctgccggcagcccatggaattcgaggtgccatccttcccagctcttggcgtggccacctttttctgtgtatgttcaccatttgagtccatcacagttatatctctctgtggatttaatttgcttttccctaatgaccactgaagtttagcatcttttcatgtgtacaacttatttggtgcagtgtctgctcaaatcttttgccaaattttgcagttggattgttcatatctttagtattgagttttgagagttctttatatgttccggaagaagttgtttatcagatatgtgttttgcaaatatgtctcccagtctgtcccctgcctttttatttttaactgtatcttttgacaatcaaactttttaaatctagctaactttttcttttataggttgtaatctttgtgtcttatctaagaaagctttgcctaatccaaagtcacaaagattttcccctgtgttttcttctagaagcgatacagctttagctcttacatttaggtccatttggagtaaatgtctgtatatcaagtgacataaaggtgaaggtgtgtttctttacatgtggatgttacttactttgtattgacattagtgctacagtctgcatcacataattttggagggcagaaattccaagggtccatatagttctacctcatataactgaaattcttaataaagaatagtacccaggggtgggacaaatgttttatatactaaataaggagacagagatagaaagtgtccaacttaacctcagctctgtgttgcatggaataggctgctgatagttatctgtgtaatatactgtacaaatactagcctttacattattgttaccttggaacatgctactaatttcatcttgccagggtagtctaaaaattgctcagaaatgctaactgaccatcctcaaaatcaacgaatatttctaaattttggccggtggaattatttttctagagcctaaaaagtagtcctttccaccttttgggacattttacgtatttgaaatgtgtggcaaagagctcacagaaattaactaggtcttaggttggaatccccggaggatcaccaggaattgcagccttggacaggccttgaaggtctggaacacactgcggaagggagggagggtccgccctggggaatggagaggatatgggcgtctgctgggcgccagtgcccataaaaggtgagacaggaagagtccgcttaggaaggagaagggatttcctactattcagatttcggctggtaagtcatgaaaagctcattcttattctaccagtaaaatactgtactgtagattaaaaatcctgatgtgtagtgaagccagttttatcctgggcaacactgtttttatccttctctgataaatgaaactctttctactcccttacccagggaatattttaaggttaatgaacaatgaatggaaaccacagggttgtgtgatgtggggccctgatgcgtcatccatctgtccacctttgtttaagtctgaagctgtagggctacactgcgtgtgcccgtatctgatcatcttttgcctcttttctcagaagtgaaattccccaattgatgaatgcgggagtgtcgggaccctgagcgcattctctccacggtcgtggtatttgagtaatgtgggttcaagtctggatttgttgccttttcagactgcagcttccaaaaccagcccggatggcccatgtgcgcaccagccatgacttcagagagggaaaacaatgggcagcccccgcgccccgtcctcacgatagtcaaaatggagtctgtcttgtagatatcactgaagtataaggccaagactgattgaattagagataatatttaacccacataaatactcttatgttcctctgcatgacccagtaagccagacctttctactgagccccaactccatgcttaagaggtttttcttattgaaagtcacctatctcttccctcaggaatgccaggatgggggttatggtggtctcgtgcattggttctcaaactgttatgtaccaaggagtatcctggggatcagttcaaatgcagattcaggagttctggggccaggcctgagactctgcatttatagcaagcccccaggtgacgccgacacagacctcccttggagcagtaagggcctggtggagtcagccagctccccagatctgagtgcaccccggccagccctgacactggtcccatctgagcccctgtcctctctcctctccactggagttcgtgtcactacatgcagttgccgtggggacaaaatgagagaaaccatatttaaaacttgtaacaacgcatcatctcaaaagatagaagcagttcaacgatactgttcattatcctgtttcttaggaaatagtacctctacatggtctggtggtgggagcagggcggggggcaggggacatgacattaccactcctgtccacagcgtctcctggcttctgagtactttgtggaaatatttttctcaaggatgttggaggaatattaggagctttagaaatttaggagcttttgagatttatgcaaagacatttaaactagactcttttcactttctgggagtaatttttatttttaatgtcacttatcacaaaaggaaagaaagagatgaaaataacttttcctgtcgggactttttgactgaggatggaagttgataaggacgatgattagcacagaggaaaacccttggcatgtacctggtcctcccagctgctctttatagatgcaccacacttccttagtgggcaggaaatcctggggagaagctccatcctgatgaccaaagcgtggcctcctcgggccatgctgtaaatgtccatttaatcccagcaaggcaggctttacattgtgcacagcggagagggatccatctgggaggactaaggtctaactcacattctgcccaggctcttcctggccctctctcagcggggaagctggatggaattctgtgaaatgttccatctcatcagaagctcaggatggactgtttagaagtgatgccatcttgacacttactagaatggctatagcccaaaaaatggaaaatcacaggtattggtgaggatacagaggaattggaacctttgtgcattgctggtgggaatgtaaaagggtgcagtcagtgtggaaaaagaaatttagcaatacctcaaatatgtgatactcgtgcacacatatttacagcagcactatttagcaattccactcctaggaacacacccaaaagaattcagaacagagactcaagtagtcactcacacacacatattcacagcagcgctatccacagtagccaaaaggtagagacaccccagatgtccacgaacaaatgaatgaacccattgtggtctatccgtacagtggaatattattcagccatcagtgaatgaggtaatgaaccccaaaaacatgatcactaaaagaagccagacacaaaaagtcacacatcgtatgactgattctatttattggtaaatccgtagagacagaaagcagagtgatggttgccaggggctgggaggaaagggaatggggagtgattgattaatgggtttggggcttccttttggggtgaggaaaatgtttgggaactagatagaggtggtggtcacacaacatggtgaatgcactgaaaggcaccgagttgtatcctttaaaatggttagctttatgctatgtgaatttcacttcagtaaaaagaaaagtttacagcatactccaggaaaggaaagactagagtttttcattccaaagtcagactccctaaccaagaaataaagatgagaaaggggtttactgacagtgaaaggaaaatgagttcatgatgtggttagccactttcccccatcaaagggaattgaggaagggttgacgaatgcagataagaatgtggttttcatcaataagacgtgcatatttccattttggttagtagcagatgttccctttgagttgactgtatgaaataatccccctggtcactgctgcttgtttggttggctaaaaaataataataatcccactggatagatatgtagtttatgggcaataaagcgacagtcctgataagaaacattttatcccccagaagacagccggcagacactaacaaaccgcaggcctcaacatagtgaggggagcgtagagcttcgtggcatggtatgtaatcttaagaaggttatagtctagcatagccacaaactaaacaaaattgagcaccactgggaaggatccacaaaagtcggaatcaaaacatagtttgttcccaaacttaacaacaaatgtcgtgtaggaaaccactaagcattggagatagaatgagtctgggatatcgtgcgtccagggccagggccacccatcttccatgagtctcctcgcctaggtagaaacacagtggcaatagcttctattgtagaatgttctccaaagacactaaagtgcacaagcttcaccacgacttaggaggcctgaaattaggctgcccgaggtgagtactgatgtggcattgacaggacccctctgggacacgtggagggcagaggagaacccactgtctctaaaactctgacttcggtccagaccaggttaccctgagggagatttcccagctccccttggtttgaggggacaggggtcccaagattcgggatacatcatcttccatccacagccttaatctgcatggatagcttccaccccaaaaaatcatcttaactacttcccgtgatgcctggggcctaacatctcaaggaattgccagttaggaacagtaatgaatttggaggtgagatcttcccacacccctccatgctactgcctcaatgacattaacactgtaccctgggctgcgtttttaaattcccatttcacttcaactgtgtggattgctgagaatggcattatgaacattctgtgaagacagacacgtctcagctgaacagtttacctaggaagttacctagaggcaacagaagaaaagcctagaaaaatggctcaagttcccccctcaatctcagggcaagacaggaatttgacatttcacagcaaatggggcttggcaagtaaaggtgccgtgtgatgaatcaacagcagactcattcgtctcaagaggaaattaggacatacgtttttttaagtttgggctagcctgtgaaatgttaaaatataactataatacaatagttagttccagccataggagagatagaacttcccctcccctcctttctcatttttaaaacatttttattgtggtaaatttatttttaatttttttaatgtaacattttaaaatttttcttgtattagaaatatgcatatgtcctcgcttatgagtgggagctgaacaatgtgaacacatggacacagggagggaaacaacacacccggggcctgtgggtgggtcggggggagggagagcatcaggacaaatagcaaatacgtgctgggcttaacacctaggtgatgggttgatactttattgtattaagttccagggtactaataaaataaaataaatgcataacatcgaaattaccttttgagtcatattggcgtgtctgattcagtggcattaagttctttcacgttgttgtgcaaccttcaccaccaatccatctccagaactttctcatcttcccaaaccgaagctctgtccccatgaaaacactgcctccccctgtccctctctgcccggcccctggcagccctcattctactgtctgtctccatggatttgagcgtgctagggactgcatataaggggcctctatacaggagttgtcgttttgtgactggctcatttcactcagcacagagtcctcaaggttcttccgtgtcacagcctaggtgactgcttccttcctctttaaaggctgagtcctattccattgtgtgggtgtctacccattgttggacacttgagtggtttccaccttttggctgttgtgaatcacgctgctgtgcgtgtaagtgtaccaaagctagcccctgctttctgtatgcccagaagtggaatcgtgggatcccgtagtgattctctttttttaatgtgttaaggagccgccagagtgttttccaaagcacctgcaccatttcacatgcccaccagcagcgcacggagattctgatttctccacatcctcaccaatacttataactttttttaataacagccatcctatttagtgtggacaaacatttttatatgtttcagaagctcttttttttccctctatgtgaacaaaaggagagattaaccacttaaacatctgagggtctttttgatatttgaatgcaatacacatttccacagttactggatgcattatattgaggaaaatagagataaaattgtagaaattcatttggaaaattttttatactgaaatgaccttaaaaagaacccaaataagttaattctttcatcccaacccagtattatcatttcacaatgacatgactttagtaatttaggataatttttttctcacattccatattttctcttcttaaactctatgacttcttttgttagctatcatggcagtagatgatagtttacatataatgttccctgtagattatagctctttaaaaacaaaaaaaaaaatgtagttttgaaagtaaccgtaactgatcatgagtatgtattgtgattaatcgtggaaattgaacctttgttgttcccacagggtcagcctgggccagtgggcccccaggggtacaatgggccaccaggattacaaggattcccgggactgcagggacgtaaaggagacaagggtgaaaggggagcccccggagtaacgggacccaagggcgacgtggtacgcaccgctggtgtattcccctggcctcatgagggtggcgggtatctcagccttggttaattgcatttgctttcttcatagggagcaagaggcgtttctggattccctggtgccgatggaattcctgtaagttttatggaagactggaattttaaaacattgcgtgcatcctaggcaatacattttgtgacttaaagaaacattttgaatgagacctccttttttgtttatgacataaaacacgtggggactatacgtgcgtattctccccgcggaattcagtcagacagtgaacaaattgtttgctttgtaaacgtccttatagacttggcttcagaattgagacgattttgctaaactgcacattgtttggtaataaaaagctagagtgctgtccagatactcgccctaaagagccagtcttgtgatctcgttcgaactatagagcaacctgcatataaagtcgttcagccaagagcatgggcagaatgaagccctgctgagcatttgtgcagcttctcaagttctttacagcaacctcacataaaacgaaaaacaaaaggcatggtttgttcatgagaaaaatctcaaaatgcaataaaatgtgtttttataacctagtttactttacttctcgtggcataaaaaaataaacaaaacagcctgactcacagccttcttcacagggacccacgagcagatttcccagggttggcttcctggccagacctgacctcagggatcaatgtgtttatcgcacgttctgacccacctcccatccggctactgctgtggttctgagacatctgcttcacaaacctcacacatatacacagatgtgtgtgcccgtgtcctgcagaggcaggttctgtatcaccacacacgcacacgcacagggagagagactccattcccaggctgcacgagtagggccatgccttgcagaagagaaggagggaatgagtgagtggagggcagtgccagagaactcatgcgtttccatgagatctttagtcccaccgtcgaggagacatccgcagagcagaaggagacagtcagggcaaaataaaggaagtcacatttgccaagacaagagctgcaagccagtgatctcggggctacctgaatggtaggctcaaacaggcacttgggtttaccacatggccctgaacaaataaggaaataatgttcacatcagtcagaatcttgagaaatggacagaaatgaagaatctgcacaacccaaagattaaacaaattaggaaagtattttcatactaatggcctgaatctaaatcacccatttttaaactactcttttgaactctttggagtgtctttcagttttgtctccagctgaaatctgagttaaaatggaatgacattatggaaagcaattgcaactcatctgtaccaagtttccttcatgtttccactttacactcacttaatatcagaggcagatgtctcacaaactagggaagaagtaatcataatttggaggaatgattgtggtgagcaggtgaagaccattttctactgaacctgctgctcaaaggatccagtctcttaaccgcagaactctgatactacaaattaagttaacataaatatcacctgccataagtaatcagttaacaaatgtagagtttgaaggacctggatcattttagctgattagaagttatatataagaagcgatatgcagtaaaatcttagaggagtggtctcatatagcagtgaatctaatttgatgctgagcagagacagacatttagctcaatataactgaaatttttctttgaagcacaatttcagactcagattagattgacatgcaatttcaaatagatcagttctaagcaagtaagaaagaccaacggcagacaaataatagagaaaaatttaaacattacagttcattttaagcaaaagcatcacagaatactaaaaatctggagcagaacatgtggagagctgttttctcaagctgaagtgcaagggccccttatgtctttatttgaaaggccactagagtgccagctctgcaaacagatcgagaagctgccaacaaacagggattcctctggctcaccagagagtttgactgagcctgttggatctctcatctgacggcaccagttcaaccaatggctgtggacatctgaagcaaagaaatgtgcaaataaaagttctacttttttattttatttcttaatatcattcaggttacggagaactatatgtaggatttgttgtgtgggggttttgaggtttgtttgttttgtgttgttttgttttgagacagagtcttgttcgcccaggctggagtgcagtggtgcgatcttagctcactgcaacctctgccacctgtgctcaagcaattctcatggcttatcctcccgagtagctgggattacaggtgcctgccaccatgtctggctaatttttgtatttttagtagagacagggtttcaccatgttggccaggctggtctcgaactcctggcctcaagtgatccacctgcctcagcctcccaaagtgctgggattacaggtatgagccactgcgcccagccaagtttgtttctttatcttgaaattttccaaatttctcaaagtaactgtaaaagacatcccaatgctctcaaaaatcactctggaatatatgtttggtttattatcaagaaaactaaagtttaaaagtaactacacaataacaaagcatatagctaaatatctattgtttaaagaaacagcaaaacaggctgtggccaggtactgcataaattatagattattaacccagcccctgtgtgtctcctggaaccagcttaatgcagtgaagatgcccacaaatttagcctgagtccctctagtcattgcagacacttggctgtgttgcctttccccacccccagacatttcagaaaacctgacttgctttatattcatgtttaaaatctaaaaggtcatgtttcctaagaaagcaaacaagaggcaatcagctcttctaaacatgacaaggccattgataaaatcacgttgcgggtgtgtcttctctgtttaggatgtggatctgtgaaactcactatctaaaatgcagttgggtacaactgataaggacctccctgttttccctgagaaggaggtagctgcttctaaaatctttcctagaatttttaaaatgtacctttacttgttttctacagggataaggaccttcctgttatccctgagaaggaggtagctgcttctaaaatctttcctagaatttttgaaatgtaattttacttgtccctgctgatagacagtcactcaactagtaagacagaagaaaccccgacagtgtacttcttacccaagcccaggtgaagcagaactttgcttcgaaatcttttccctgcttagaacgataccttatgccttcacttatttaatctttcattcattcatttgttcacttttgaggtgtcttttccttggattcatgccgggaacatggcttatgagaatataagactgttttatctcacagttacatgacaactagaagcctgctggttggctgattctctcactgctctctttcccagggacacccggggcaaggtgggcccaggggaaggccgggctacgatggctgcaacggaacccagggagactcaggtccacaggggccccccggctctgaggggttcaccgggcctcccgtgagtatccccacagcgcctgtgctccagggacgggcagacccctgctaagccctgcctttataacctgggggagcctcccgctcactgtggccagaacggaagcataactgtatgttgacgcccaagacatgacgtttctggattcaagtaacttcatttttcgtattctttaaatgttagatagaaaatcattgttgtggttgatgttgttcactctcagtctcccaagtgtcacttcattttctcccaaattctcatgcgtaatagtggaatcgtaaacgcaaattaaaaagctgaaaccttgacaaaattctgtccatcaccatctttatcagattatgaaatactttgtgacgtgggagtgcagttattctccagcagatacgatgcaggagtttgttttttaatggaggaacttttatataatcatctgttttgtggcctcatttattttttaaggtcttggtaaaacatcctgaaatgtgtcttcagtagtacgttgctaccttatttccaaggaaatcttgcaaattcaggtttagactaaaattttgtttggtgagactttttatttaaaaacaaaaactttaaagtggggagggaagaacagtcattaatcaccttcatcacgttttcacctgaagcaaatggagttctcctactcagttccacctccacctgctagttcacctttcctcggctgtttctgttttatgtggttcaatttttcaataaactacgtcatcttctactctatatatcatcaatttcattatcaagaaacatatctattactttaagtgattcttatagtagatgttgaaagatatttacacatgcacatatgtattatgtatatgcctactgtttatatttgacacaattccaattttaaagaatgacccagtatctattctgcaaatgggtgcttgtgttaatatgttcagtacactaatgccaaagaaagcacgtaatagtattatcagaaataaaaataacattggcatactagagggttggttgacagagcattcatttgggttttgaaaataatttaaatcctaaagtatttctgttttaactctaggaaagatatgattgggtcaataggaaattaaaggtcttacccttgttgctgaatatagggttggtgttcagaataacccccatcagccataagaacaattagaccttgcccacaaaagtcaatgttcagtcatccacattaccatagctgcaccgaatgttaatggactctttttgttgttttttctttttacaatatatctgctaattaggggccccaaggaccaaaagggcagaaaggtgagccttatgcactgcctaaagaggagcgcgacagatatcgggtacgtttgcaagagatgggaggggtaatgaagggacccagtgtaaattctcaactaacaaagttaattgccaagtgaactttgcatgtaagaatgaatgtactgaaggcatgcctagaatggcggcataatctaaaagtcatcttacttccgatcaggatgttttcaatcttatttttaattgtgtgtttatctctttcccatattcacaatactccaagccaaattagtacttgtagttaatattagtaaatattaatattactaaaatatattctgactaaataacaatattagtaaaaattaatattagtaaattaacattactaggtcctgatagggctgatctgtttgatatgcttatttccaactctgcaataaaaggtaagtaaatctaaagatggttaaaagctatcactcttaaaattatttcttctccattagggtgaacctggagagcctggattggtcggtttccaggtaagtttatttttattggacgatattccaaacaaaagtttaagagcttcagaactccaagtaccagtttacctctcttaaaaacattctcccgctgcctatccatagggacctcccggccgccctgggcatgtgggacagatgggtccagttggagctccagggagaccagtaagtacctggacacaggtgcccactctgggaccatcgtccggtcatcccttccagatgccacttcttcaatggttgactccagatgagagctttaagaacaactatgatgcttataggcgtagcagagaacatcaagacaaaacggaccattccttgcacactttgctgctgttaaggttgaagaataagggcttaaaattatggtcaccagctctctgccagttatgtcaaattttgacttggttccggcagggtgcccttccatccccaccccatacctacccagtgacagacagcccatcatccctgggcaaggcaaaccaaagtcccacaggttcataaggaggaaatggaggtctgcctgtgccacacccatgctagcaggcatatcacacctgggctcattacagcaggtgagatactggccactgtttaacacaatggccctagagggctcattgcaagtagggaagagcagaaaaaggcacttgctgaggcttgtgtagctctctggccactcccaccactgcacaatgagctggaaggtggattggccactgcgagagctcctgactcgctcattccccacatatgttagtaatcagataaataggccttaacttacacaaggagcgatttgggctgcaggtgagagagatcttctcacaggaagccattgctcaagactgagacaagctatcaagggacactaacaccagttccttgacagatactgagaaaaaaatgaagtcatatatgtctggggagactcagtcaaactaacagttggggggtactcataattctcttcagattataataaatgacaataataataatagattttgtttctacaaagcaaatttccccggtgctgtgaaagtcattcttgcaagtagccccgtctgtgaaagacctggtcaaggtggctgaaatcagggtcatacgaggcgctgttgctgtttcactccatagggttattggcttagtcacggcacacatgccacatggttggatttcatactttaaatgcaccactcggagaagtccggcacaacagattgtacttgctaggtcctcagctgctctgacagcttttggttcttcacatgagccatgcaatcatccacaaccccctccctatccactcctttgtatccacttatttgtacttaaacactcttcccctgcatctgaaatgctttaatcctaagcacagtgttgacactgaatgctctgcagaaagacacaccatgatactgcagatggactttccgctctgcagtgccagcttgtagattcattctgtccatgaaagttggccaagctaccaggaagaagtcctgcatggagtctcgtggggactcccagaggaagtcagggaagctgtcgctgcagtcacagggcctgggaccttgcaaagggatcagaacaaacacagagaggacatgggtgaagtcaaaagcccaaacacacaaaagcaaagcagaaacagctgtccgtagacagccggcagattctgagaactggagctgacccgagtccctctcccccagcatgtcatctctgccaagccaaatgcatcagaaacctccatgcatcctacactgtgtcctaaatatacagtcaatggctttcccagagctttccaccagatgttatctgggtcctggggtaaagaaaaccatttacacatttctttgtatttgtacagggaccacctggaccccctggaccaaaaggacagcaagtaagttggttttggggggtgaggatgagggaagggggtacttaggtgtttgtgggtttgtttgttttttaccataaaacttcttggttggcaactatttattgtttatattatgatgaaaacagttttggaggtttttaagacttaatgttaaactccaaggatagatccatggtgcctctggacattaaaaaagtaaacaggtggaatgatttgttgtttgcaaattaattaccacatgcctgttggtatatgaaaaccacactgaggaacatttgattgaaacgaagattagaacaatttagggacagttcacatttattcacatgcattgatttacgagaatggacaaaatgtaactctatctgttgtagggaggccaatgtcattcttcttatctggctagaattaggttctacaggagtctaatgtcagcctctagggatatattcagtgataatcaagttaggctagagcccaaagctgtatactgttttcatcccagaaaggttattaagttgattggaacacagcaaagtaggtggtttgttagaaactcggaggacagaactagggttccttattatctgagaaagctggataaatgtccaagacaaacgaatgcagttgacaagggaagtatttgatcaaaatgcaacataattcagaaatgctgggctgccagcgggaagcatctaggaacgtttcctttgccctgtgtcccgatggaggacgtgccaagcccacacgttgccatgcctgcccattgctgtgacccctggtgactacagctgccaccgcccatgcccccaggctcctgtcccctctgacacagcttccggttggctggagggcttgcgctggacgccccaccgcctggcagcctggagcaggatgagatgggccccaggccaagagcagcagaaataggaccaggcggccgggctgaggaggcagcagccaagccctgagcccaggcgtgagcctcagatctccccttgctgcggcaaacatcaacagccctcctcacccctgaccaagtcacttcctggtgactttgacgaccagctcaggaggcagagagggactgtgggggactcacacaaattgcattctaatccagcctggccgcgtttctgtgctttgatttcagctccccaccaggtggggaagaagcaaaaggcaaaaattcattgaaggctttgtttttattttcagaaaatatctggacattggagggggcggacggtagactgcagagaaagagagatcagatagggcttatgtgaccccgctgtcactgtgggaacacacagaaaccctgggaaagaagcaaagctgttgggagtagaagaggacagtgcccgtgatgtgcacaaatttgtcatcttgctttttctatgcacgaatcttagaggtcagcgttgtcagtcctcccacacgtggctactacgttcgtgaaattattaaatccttactatgatactgggcctagctttgcttcttaggtaaaaaaggaagacaaaaagtttggataaagcccagagaatcacgtaaaatcattacattctgattgattttaaatttccaaagattattaaaaagataggtaaagtttatatgaaatgaggattattttgccaaaatgagagaagactgagccagaagaaaagacgaatcatgatcttcaaatgcagagtccagggagtgaaatggggctgcttcttccatctgcaggggccagaacccagggacatgctcttagactacagtctgcagagaccatatactcacgatcgagggccagcaccacctggggtccaatctcagctcccactcattcactctgaggccttggtcaactgacatgacaaactgtcaattagtttctacaatgcaaagcaagaatattatgcaaatatagttgctcagtaaagttgccgataaataggccttgggtttctttttctaagaaaaataattttatttctctctgattattggctttttaaaacttacagaaattatttatcttttcagggcaacagaggacttggtttctacggagttaagggtgaaaaggtaaaggaagcctggtcaattccagcagaggcatgcagcatttctcagccaggaaataaatcattttaattactaagttctgtgctgtaaaacttttaccttgagttgatctgcagacagaccatttgcatagggaaataatcattgcaaagtgctaggttgtcacctacataccagtgataattctgcatcaacaagacggtaaacatagaccatctaggctagccgagactctgacacagagacataagctcagctcatcttcagaaggtggaggtgaggacatgtcactgagtgcatcttctcctgtgtggagcccagaggtgatggaggggactgagactacagccagaggctgacatggagccatctcagggaccaggggatctcagggaccagccctggtagggcacaaaggcagccgtaaggaccatgtggcttttctccttccttagagtgctaagatccaaagacctcatggcctttgagaggaacgtgtgagatcacgtgcatgacaggcttaacgcagcgccacaccccgcaagcaaaacctcaccaacacagtcccattgcgttcaccacaaaagccatgagcccactgtaaagtagacctgacccttggcctcatgattggaacatttctattttgttttcccttctgctttttgatggaacagcacagtaagttgaatcaagtcctgctcatgtgtgaagaagaaactcttccttctttacattaatgccatagaagaagtcaaaaaaggacaattagcaagcagtgggcttctgggaaaaaaaagaaagaaaaacattgaagatccaaacacataaaaatttatagccccatacaatgaaatataacaaaataataaaaacaagaaaaatctgggaagaaatcattggtgggagaagagaatagtcccgttagatataatggagatgaagttagagtctacagtctacaaaggacttatgcaaataatgaataaaaaacatcaggggcccaacaggtacaagggaggagaacaaacagtttgggtattttaagatattctattagtggacactcagcgtacactatggagtatcactttctgcagctgacccatcatctccatttactgctgtccgtgttatgtgatatctgggctcagacttgtatgatacagtttaatgtggaaagaaaggaaaagacaatgatgttcttttgtgtcaatcagtttctgggaggtaaacccagaatattatgcaaggataacggtccagtaatgttctagatagatcggtttcaccatctgtgcaccacatcaaaaagtgttttctgctaatgataaaaatgcaaattaaagcaatcttgggatattatagttacttaagattttttttattatataaaaacatctttagctggggaagtagtctttcatttcttcagcatttcgtttatctcggtgcccatcttggcaaccagtagagtaatacctgtcaaaaaccataaagacattcagccctcatacctaataattcccatatatagaaattcattgtaaggaaacaaccccacagaaacaaatgcagtccagaattgtaaacaacctacatggcttttatgcataaattctaaatgattgctaatgaaaggaggatataaaaaacttacattaggattactctattttgtggttattatactgtaaataggtatacatatggtaagtaatatgcaaacattaaaactgcagtattttggccaggttgtatttgtattcgagttttgtagtttcctttcgatttaaagacaactgcttttgcttaacaatatgcagggtgacgtagggcagccgggacccaacgggattccatcagacaccctccaccccatcatcgcgcccacaggagtcaccttccacccagatcagtacaaggtaaagagcaaaattgactcttttcatagttgaaataaaaaaaggagagtaaaagtacatttcttcaattgtattcaaccacattccaagtagaaaaagcctcaccaccaacttggcacattacccatgaaaacataaccgggtcctcccagaatgttttcaactcttccagacggttactagattcacagtgcgatcccgtcgtcagtccatcatctcaattctgatgaatctgaagcaacaagagaattcatttaaaaaaaaacttatatctatccttacattcagtgtaggtggaggctaatggtcataccgtaattcaaagccagaatcatggaactgtctagcaaaatgtgttcagcaaaataaaacctacttctttgctgacatgaagcacctttttggaggttcaaagtcagtttttgacagtttctgaatcattcaattaacattttgcttaattgaaatcatgctcttagtctgaaataggaattgccgcgtccactctctctacgtttggaggctgctgtgccacccacccactcggaggtcccacagcctttctagggcttcctgttccccctgtcaaatggggatggcgacactgacctcctggagctgacgaggaggttgcaggcgactgtgaaacactcagtaccatgtcgggcacgcagaatatctgggaactaaaatagaaaccccaaacggggagatcttaactttccaaatagaatctggttcccaactcttgagcagggtggggcttgggtcctgtgtcctgggtcctgcatcctggggcggatttggcaggcaggaccactgccttgtgggggaaatcaacccaggtggctgaggctcgagttatgagtgaccgttgacaaaaatgtcctgggagacggcagggagggcctctgtccagcttctggactggagcccagagcaggtttgatccacgtggaggtgctcaatcttccgagtcaagtttcccaccttttctacaacccaggccagggtgggatccggggctgggaatggccaacccgcaggggcagttgtgtcctgcaggaatccaaggtaccctcagaaatgacggggacaaaggacccgccaattgctgtttctttcaccattttagacgaagagaaatgggaaaaacgtagatcatgtttttgatctatgatattgacatggctttcaacagccacttttgcttcaagtttcaatatgttccatgtgtatctttttctcagagggcctcctagtaatgttttcttccgaagagtattttcattaaggcttttccttgggcacgttctcccaccatacggatgtaaacatctgcctggaacggtgtgggggataaaggaaaacagagagaaggaaagacagactttcacttgtaccaagaggaatacaggaattaatttatcttgtgaaaatctagaagaaatgacacctcttttctcttgaattttgaagctgcaaaatttaagagtcatgtgttgtaatcaatttatgatgattgtgtgaggattgattcagtactttcagctcatgtcatgaaccctgattgatttttacccattaccatcctcaaattaataagcgtttcttatttttcatattcttcacagggtgaaaaaggcagtgagggggaaccaggaataagagtaagtcgagtaatgagcatgccccctcccctgtggctcctgggctgtcggcgctctgccaggcatgacggggtgcaccatgcgctcggggcccgcacaccgccagtctctcatccccttgtccatagcagaacagtattagcatgcatttttacactgtattttaagaagtcagttctagaatttcttcctcttggcatcataaacactggctaatcatcttctgaggtttgggaagggagcatggagatggcggaggggcgtggcttccactcaggcgccaccgggttctgccctccgtcccctctgtcactgcctgtcctcagagctccagctctccctcgcggtcgcttaccacgtgacatgacacatgcagtcctggatgggtgacagcccgggaaggctggcgggtctcctaggaccgtgccctgcactgcgcctgagttgagcatcgccaggcggtctggacaccatcggggctgagaacacagagtcctggagcagaggatgacacgtgggccctgttggctggaggggccgcccctgggttgctccttacgccccctctgctctctcctagggcatttccttgaagggagaagaaggaatcatgggctttcctggactgagggtaaaccacgccttttataactgcagttgtcggtttggtttggtttttttcagtaggctttcctttttagagctgtttcagattcacagcaaaatttagcagaaagtatagagatttcccgttattactccccacccccccccacacacacacacagcagccccccagcacgaacatctagcactgggggctgcgctggctacaatccgtgaaccatcttgacacaccgtcttcacccagcagcaggtgtgcagacgcggccctccccgtggaggaggcgcgagtaccgcacaaaacctttctggttgtgtgtgttcagctcagttagtctgtagtaaccagaaatgtagaatatctcaaacacacattgatttccgactgtcccaagagcccaacaaaaatgtccctagtcgtaagggtcgggaaggggtcaccgtccacggtgattcagccacctgggagacagacctcaccttcagagccccagcctggactgaccccactcactccacgaccacacctagctgagggctgggacgggtggtcagagccctgggcccaggaagagaaagcagaattttggtggctatctggcagttgctaccactcaaaagaccgtattttacattctccaaaaataagaatagagagacacagtagaacattagagtacaagcctttttacatttttagtttttcattgtactatctttgtgagtttctctgtatttctttacgtggtagaaatgatgcacgttatgaaagtattgctaaaatgatgtgtctccctcaggaaatgagagtcttggggtggctctgacgtcttccacagggaagcagctttgagattaggatggattctgctttcttcgagcctttttatcatagtcattatttcccatccccacctccccacaactttgtaaaggggaaagaattgtattaatagttggtattgaatttggcaatttgttgctattcttcaaaatctggacctgagacttgttcaatctgtccatcggcattttgctgtgatcacagccaggtgccgtagtcaagccctctggaaatgtctactgcatattctgagctgtttgcttctgttttttgttcattccagggttaccctggcttgagtggtgaaaaaggatcaccaggacagaaggtaagttggatgcatgaactgcagtctgctctgggcccacgacatcccacagaggttaaataaataggccttggcatctcaggaaagaaaattgtctccagaaaaaaacattgaaaatggttcttgtatttgcagtcacaaagataatcctgcctcacaatacttgaaccgggtcattaccttggctctcatttttgcaaactatcttttgcttcctccctttcaaagtgtccgtcactcgaccccaccagccatggtttctatatcgtccaacctcacacccctcctccatgtccttgtcactcataggaagctcctggacttggtgacccagggtccacctaaatttttttatagattgacccatactgtgacacttcatttatgtttaatgacaacccaattatttttatcatgagttctgtggacagatttttggcttttttttaggagaaaaatgttatgtaagaaatgtattatgggccaggtgcagtggctcatgcctgtaatcccaggactttgggaggcctgaggagggtggatcacctgaggtcaggagtatgaggccagcctgaccaacatggtgaaaccctgtctctactaaaaatacaaaatttgccaggcatggtgtgggtacctgtaatcccagctactcaggaggctgaggcaggagaatcacttgaacctgggaggcagaggctacagtgagccgagatcgcgccattgcactccagcctgggcaacaagagtgaaactccatcataaaataataataataatgataaaatttttaaaaagaaatgtattatgaatctaggtcagatttagaaccgtctgaactctaggtcatacacaatgttatagttcagtggttgatgccttttcactgttcactgtgcctgcgggtcccaccccacagcacacagcacacgcctcctacggcaggcccggcaggctccccagacaccaccactgacagccccttgggtctcacatcacactcatgccaacatacacacaaagacgtgtagcttcacatgcatgtaacggagcaacaaaagaaatgtgtctgtgctgctctgcccagtgccccttagagaatgttccaagtcggcaggtacacatctgcctcgttctttaaagctgcagagaatggcagtcaataggtgcgccatatttccttacgccctcgaggtggttttcatatttccagcaaacatgcagtcacctcggtggtacacagggcttggctgcctgcccatgggctagtatgtccatcactcagtcctagtaggtgcacagagatagagttttatcaaaatcactagcctcagaatcacaactccgttgaatcctgctcagggctgcacagagagtagtgtggcgtctggaggcccatgggcttcagttagctggtacagaagctcggcaggcctggtgggggttccgccatgcttgttccaggaccacagatggacctgcctcccagactcgctttctgacctccactggctctagacacgggccgtcttgacccagcattctgcttttgaccattcaaacttaacaccaatcttgatgacttcctgcaacctccaatgatcatactgttcccatttctgttattttatgctaaactcagcccagggagccaatgccaggctttgccgtaatcacacccagcctttcataacatcagttactgatcggagtactcccaaaggcggcacacctagaacaagagctatccaaatgcaccccacccagaggccacattctagttcatggcttaggaaaagcaaatattgtaaagggacagaggctaaagcagacattatcgttcaaaagtaacccgtttccacctaccccatgtgattaaagtgctgctgttaatttcctaccatgtgctggtaaaattataattatctttagttttccatcttcaacacaagggacttgtagtatttaaaagtgcatttccaggtgcctgtaatcccagcagtttgggaggccaaggtgagtggatcatagaggtcaggagttcaagaccaacctggccaacatggtgaaaccctgtctctactaaaaatacaaaaaaaaaaaaaattacctgggtgtggttcatgcctataattccagctactcaggaggctgaggcacgagaattgcttgaacctgggaggcagaggttgcagtgagccaagatcgcaccactgcactccagcctgggagagacagtgagactctctgtctcaaaaaaaaaaaaaaaaaaaaaaaaaaaagggcagttccacagagctgctccctggaactccaaagttaatgaaagacaagatgctgtgtaaacagtggccacctggcagctccagggctggggcccagatgtgaggatggtgaggcgtcaggctttcatttcccagcttactttctgcagttgcaacaacttgcgaagatgcagatatttccagttaagtgggttacagggaggcagtttactcaactatagaaatgggaaataggcagacatacacaaatgacgcagccgccgtgcttgtgagcaccgatctgcaccacagctatgtccgccctctgccatcccactggccaggtggccatcactccatgactttcatttgttccccacccaacacctccccctagacaccaaaagcccctccaaggagcaactgctcggtgacataaacagtgcatcaaaatgggaggaaccagaaaagaaaagatatcctgggtaggaacttgccctcctctacataaacacagaattggttgcctgtcatccccactgagattgtcagaacttctattagttccagccttttctaaaaaggaatggagacgtagcatttatgaatttggttatattcaattttctgataaattagagatggtttcgtctcctctttctaggggaaacatatctttagtaactgagcaaatgctgtccacagtgttattttataattttgaaataactccacagagttattttataattttgaaataactccacagagttattttaaaaagtgttcgttgagacctagtctcctttgaggaatacatgccacaccaacacgcgtcgtgttgtgggaagtcccccctcaataggaccattgtcctctatgaggactgtccaggacttcagggatgttgcatttgcacaggctgcagtgtcgatgacttggactcaccagatgcagcctcagtgttccctgtggctgtgtgtaggtttcctctgcaaagcttgaagtggcagacatgacctcagattgagttcttttatggaactctcactgtctttagtcttttatactaaatcgcatctcatttgcaggctggcagggtttctttgcagaggcgcctctttcaagaggcacatgcgttctatttagcctaacaggtgctccctcggccactgcaatgaaaagggtacaacaggcaaatgaagaacagaaagataacaggccagttcacaccacgagagacagcagactgcttttaagctttagaaacatgcatctccctaaaaaagcctagccatacattcttttcatctgtttgtgtcagctagtccctgaggacttctgcccaaggactttccttactccagttatttccacccttgaaaaacataaaatcaaccttgtacttctaaaattgcataatcagaacttcctatgaatcatatatatgacctcactgaattcaaatgagtgataagttattagatttgggggagggccggggagaaaggaggttgcagtttcaaagcccttcacagttatccattctaaaatagtgatctgcatgtcagtctcctgacctcagctttccctaagggtgggctctgtggtgagcttgctagcaggagtacagaccttgcctggaagcggggtctcagggagcccggcggagcctccactgggtccttcccggggtggttgccagcctgactctgggagcgcctgggtgattcctccttggccatccctgcgcctccccgaccctgttgtgtttgccactgagaaacagagaggaaaaagttttgatcgtcattttgacttagggttcccgcctatctgggtttcactgccagtggtctcagatgaaccctgagggtgcattttctccttaagtcgtgcataaccctcagcctcccccgagtcagttgacctgttgacctgccgctgggaactcccctggaaagttttagctcattgctttggctcttggggttccagctgcctcagaggaatcctgagtgcttcttaagttgtcccccttccccaatgggttttctataatgcccagtgcatttcagatggttcaaagtgcccatgctgtcttggacccttcagcagagatggcaacacgtggtgtctggggtgcttgttttgtttgctgaggatgccacagcataggtgtgtgatgctcgtggcccagagtgaagctcagatttgacaaattccagggcaccctctgagctggccagtctgtggctgtgctcacagctcccactgagtgtccagctgccagctcctgtcatgccaggtacttgaggattcctagcttagcttatgacgtggcctctaaacaggacctcatttttaaaatcacagaagtttgtctttacttttgagtcttcagctccacctagcgtgagagaaagtccgggtccaaaccacaggaccacaacaacacacacaaagtgaagcccgtctcaattcagtctaaacaacatgactttcagcacacctgctcctgggtgtcaagataacctcgaaagtaatcagagaatggacctttcttatacctgtggcatctggcattctgaattttgagagctgaaccatgcatgttctttaaaagagggaatacattgctagatttttagagagctttactcttctgtccagatacctcatgatatgactcaatgataaactttttctttcaaaaaatgttcaagggaatgagaaaacaaaacttagtgttatagttgttttctatttttgaaacagggtcttgctgtgttgcccaggctggagtatggtggtaccatcacagctcactgcaacctcaaactcctgggttcaagcgatcctcccacctcagcctcccaagtagctgggactgcaggtgcctgccaccatgcccggttacattatgtattttttgtagaggcagggtttcactatgtttcccaagctggtctcagacttctgggctcaagtgatcctcccaccttggcttcccgaagtgctgggattacaggcatgagccaccatacccagcagagattttttttaatgaagagaaaaaactctaacttaagaaaccttaatgcgtctattttggtactaaatgaagattttcaaaacctaccctgggagagagtttcaacagttggttcaggttgtcaacacctgaccccacgatcaatcataaaagcaacccgacactcatatcttctgtaggagaagaggtgcccagcatcctccgcaaatgatccctgctgaaaaggggaacctgcacctagggcagcctccagccctaatgactcacgtggaggaaacgtggggttagaagaacagattgtacaacaccacgggggtgagactgactgcagcccaccacaaagaacatctgcagcacagatgacccagtgtcttcaacaaccacaaaatgatactaaaaacatagaaaggaagaagggactattgtgaattaagtgagaattcagaggcatagcatccaagtgttatatttggacttttttggctcctggttctagcaaagcaaccttaaaaagacatttttgagacccaagtcagggaaaattgagcacagactgggttaatacatgactttaataaactgttgttcattttgtgagatataataatgccattgcagtccctttttggagttatacatcagagacaaaaattaaaagcaaatatctttcttgcagggaagccgaggcctggatggctatcaagggcctgatggaccccggggacccaaggtgagcccgtttctcatgtctttgccacttatggtgtctcgcccaccctggctggccttactcccctcttgatggtgtcctgtggaggcatcccctgccctaaaaagtacaagatccccaaatacacggcctctgacactggacagacgaggtggatggtgacctacgagccacgtgtgctccctgccagggagaagggtgccacctgccactcagggccacgtaggggtgcgctcaggcacagaggaagccagcagccctggggaaggcaggccttgtagtaacaagagggtgcggtgcccctggtttccaagggaggatgtggcttgtgtgagtaattcctgggcttgcagggaggggagaccattaggtggaagaccaggtgggtgctgctggtctagctgagaggggaacgcacccgtggggaacctgggtgggggcacatctggagaggacttctgagccgggtgaggctcaaagaggtgaaggtggtgcgcgggatgctgccttatgacaaatgctgccttacgacacagatggcgctccacgggggtcctgcggccgcatcatctcccagcccaccctcgccaggcggctcggctatcactacccaaaatgtaatagtctgaactacagaaagcacagtctcctggcattcgacaaggatttcaaaatgagatgagcccctgcctgtcttgttctctttgggcacctgtggctggtggctgggatgccaggctctgccaccctagcatggggatgctgccccaggcactgtctgtggttccactggttgaaatagctgctctgccagcctgacggtccacgctcgggtttcttctttggaaatatgtgtactgtcaaaaactccaaaaggctattctcacatcctgtttttctcttttctttctctagggagaagccggagacccagggccccctggactacctgcctactcccctcacccttccctagcaaaaggtgtgtgaacaatttcacctgcatagttcagcatcgcatacacattctctcctgttagggacacagagctatgaactttcaagacagatattctaagcaaccctaaaacttaaagtataataataataaaaaaaataaaaaataaaccacgaaatttagaacataacttcatgtacaatttccctcatgcttaaatgtgtcacagggagaccttcatgttgcctgtgcctgagacagtcctcaccacctacacgtgagaaatcccctccgttggggaattctttcacttctgcttaacttgtagagttctagttctgccgtctggactatcgctgaagatatccagggcagcagccccagccgccttcggattttttctccaaatgcaccaaggttcttaagccctctgcttgccagcccgacacctggaattgatcataactcataaccagtgaacagtcacatgctttcaggcttcaaggcaactaaattcccagatatttacacataacaaccactccccactgtcacagttgaccttggagtgtaaacgaaggactttgcgcatgtcgtcactaatgctcatcttgttattaaggctcggcttccaaattggcgagatcatatggaaatctgatcctagtcctgcaactagagcacttggctctgaaccttgtagaatgcgcatccttctaggttaaaaaaaaaatgtttcgagaacctcctcctgataatcgtgcgtatatatctttgcggatcattggcccatgttatagtcagctctgtgaggacagacatttcagcccatcttgttcactgctgtattcccaatgcctggaacaggacaggcacagagttggagctcagcaaacgcctgactgagtgacgacgtgcagaaacatatcagacaggcattgtgaagggtagggttttttaaatacagacgctctggtgtttacctcttgaactcagcaggtcacctggtctccctgtcctctaagcctaggtgtcaagaattcacctccctgcttcgaagcgagccctctgtcagtttaataatggctttgcatgtcttcatccaatgctgatcaaaacgcaggacagaacagggccatgggcagtgcctccaggagcccctgagatgtctgtctggggaggcgtggagccgtgaatggggatattttgaaatccatgctcagcttccatgatgcccgtaactacgaagctggcatttcctgcctcatccatggcgcacacctggctaccaaacctgagacccactaaaaagagccatgagcccactttgacttgactcattattaataattttggtaaaaaggaaatatgctgtttgagattttaagaacataatttttaagttaatgctggcgatgtttcttttgcattttttaaaaatgttgctgactgagaacccaactctcaccaacccctcccttctcaccgtactatattcctggaattcacactgcaaaggcgggtgctttcaaaattcactttttcccacaagcggattcagaaatgcggaggttgcctgccgccttttctaccggacaacattcccgagttattggtgagctggaatgtgactgacttgcattccagggtttcttaaagtcaaaggttgactaaccagcagattccctcagggaaaagaggcagtaaatgtatctttttcaaggtaacattgcatgaacttgtcaaaagacaaaaaggatagaggggtttgtattaaaagaaatgattccaaggtacctagaaataaaagtaatcttgctattcttccaaacaagtgagaaggtctgtggctttcaattttgtgtctttttatggaatcaacaatggctaacaggagtgtaggtcacactgtgtgccaggcgatgctccaagttgtcctagttgtacttttcagtgtgtttacccctctgggtgaccctgtgaggtggagatggacttggctgcttttactgagggagagatggaagcgcagggcgttgagttccttgcccagggttgcctttaagtggaggagccaggttcaggcccagggcctctggctgcggagcgcagccccctgcacactcggcacgaagctgcccgagcaggagacgccatacacggaagtcaggccttctgtcccttgcacgtgggacttcagtgtgacgcccagcaaagccctctccttattttaaggaacttcgtaagacgacatgcagagtgaaagctttcctagaaattcctaatgcctacatgataaaaagtcctattttcttctcattcttctcatctttcccaattatagtctagaaaaaagtgtgttctacagtaaagcgttgctatttacacagcaaaggaacatagccatgccactttgtctttgtttgttcaggggtgaaagtttttaaaagccaaattttgttatgcatccagcagacagggatgagaagagcctaatagggttaaagctggggctgaggggcagagtggggtgcagggaagtgaggcctcctcgctcccaggccaccagcagaattggcaaccacattagttccttctttattcgagctttggactcacctacttcctcacccggttttcactaatcctgttcccctgctggagaatgagccccttaaaaagagagaccaccccatgtattaatcatcttaactcctcatcaggccgcatacagcatatggagcatttggtaaatatgtagtcaatgaaaaagtgaacgccagctgcgatccgtagaccacggtcttgttcttactgtgggacttgtttcccttccaggtgccagaggtgacccgggattcccaggggcccaaggggagccaggaagccagggtgagccaggagacccgggcctcccaggtccccctggcctctccatcggagatggaggtaatgtggcttcataatatcaacaccggagacccaaagcacctgcactcaggtcctagcacacacaagggagacttcgttgacgacgtagctatgtcgttgttacttttccccactgactagtcttagcagctctaaggagccccgcacacatgctttggacaccttcacagaaccctcgcacatatgacagtaactccccaactaggttagatggtgccacgatgggtaactggcatgcttccacctgtgggttgggaagagaacggagaatcatcaggtgttgttgcccagtgttgatcacaactatcaagccattatttgaggggcaaggagaggggtgtttttaatgttgaaaaaggataatgaactataccaatggcttctacccatcggagttattgacggggccatgaagcccgctagtgccccagtgggcccctctggacacgaacacaaaggcagcggtgtggtatgggagactcacgctgcaggtgaatgctgtttggtttcagatcagaggagaggcctgccgggtgagatgggacccaagggcttcatcggagaccccggcatccctgcgctctacgggggcccacctggacctgatggaaagcgagggcctccaggaccccccgggctccctggaccacctggacctgatggtgagtggagggaaacaaaagggagggtgtagcctaatgttcagatgaagcccggtcccagccggatgttatttgggattctctgctaaatgactctgggaacgaatccagtaggccagtgattagggtgcagtggatccaggtagattagggtgtagtgggtgctctctggggtccacgcaggagctggggatggaagctgaagccctgtaagcctgtgagtatcacagccccgtggatgccacacagtgaggtttagttgctgcagcttcggtgaaatccatccttcagcgaaacatctgagctgcgcagtctggaaacagatgtgagctgacattgctgcctctgtgtcggggtgatacattccacaaacctaatccagggtgagggctcacccttgactggcagcctctctcctgtgttactccatcacgtttaagccaccttgataatctgccttctcagcccgtgcacagccaaagctacaactgaacaggtgagagtagctggtgacaaaaagagatggctgcattatctgcaaaaataagtgacagccgtcccccaaggcccagacaaatgcccatgaaagtcaataaagccggcaggcacaggagtgtggacccacctgccacccagtagtgcatccctgagtcagcaaagatgctctttcaggttataacgttaggtgactcaacttgagttgagaatgacctgtctcaggcagcagggaaacatgcagtcccgcctggagcttgctgtcagaaaaggctgttctttcagcttcagcattcagagagttatgctttaaagaccaagcttgtccaacccacgggccacatgcggcccaggacggcttcaaatacagcccaacaaaattcataagctttttaaaaacatttttacaattttttgtagctaatcagctgtattagttcgttctcacgctgctataagaacatacccaagactgggtaacttattaaaggaaagaggtttaattgactcacagttctgcagggcttgggaggcctcgggaaatttacaatcatggcagaaggggaagcaaacatgtccttcttcgtggcatcaggaaggagaagtaaggagtgaagaggggaaaagccccttataaaactatcagatctcatgagaaactcactcactatcgtgagaacagcatggtggaaactgcctccatgattccattacctcctgtgaaccaggtccccaccatgacatctggggattatgggaactacaactcaagatgagatttcagtggggacacaaaacctaaccgtatcaccagctaacattagtgttagtgtattttatgtgtggcccaagacaattcttcttccaatgtggcccagagaaggcaaaaaattggacactcctgctttcgatgttgtgaaatgcctaataggaatatttcattctctcacaagagtgaatataggagacattgggagaaaataagaggtcatagtctctttctgtgtgacgttgaccaaaagttaacagcctcttctttccaaagtagtttactttaaattccctgacattgcccctaataatctcttacagcctcctaccttcggggaggaaaaacaccatgtttgctagtggacagtgtttggtttcagtaacaggtcaaagtctctgttttgtttgtttgtttgtttgtttgtttgttttgagacggagtctcgcctgtcacccaggctggagtgcagtggcatgacctcggctcactgcacgctccgcctcccgggttcgttccattctcctgcctcagcctcccgagtagctgggacccaggcgcccgccaccgcgcagctgggaccacaggcgcccgccctcacgcccggctaattttttgtatttttaatagagacggggtttcaccatgttatccaggatggtctcgatctcctgacctcatgatccgcccgcctcggtctcccaaagtgctgggattacaggcatgagccaacgcgcccggcccaaagtctctgttttaattgtttgtttttggaagattacttctctttgacatatctagaaggaaaatcattagagttattagaggcaatgtcttctatttaaaaggtagtagtcacttctctgtgtctgttttatattataaagtaaaattttaacttaatatgctttctactttctcaatttttcttcaattagaaaacccacatattctcacattattctgaaaatttttaggtgcagatatttccctggatcatgaacctgccaaagagtctgagcagtgtgaactttatttttttattttattttattttattttgagacagggtctcgctctgtatcccaggctggagtgcagtggtatgatctctgctcactgcaacctccacctcgtgggatcaagcgatcttcccacctcagcctcttgagcagctgggattacaggcatgcaccaccaccatgcctggctaattttgtaattttggtagagacgggggtttcactatgttgcccaggctggtcttgaactcctgagctcaggtgatctgcccacctcggcctcccagagtgctgggattacaggtatgaatcaccacacctggcctttaatttttttcattatcctggactgctgtgataagagctaggtttctatgagcattatatttcctaagcaaatggtatcttttgagttttctttttctggagcagaacatgacatgttaaaaacaaaagcatacaaatattccactttaacggccaggcatggtggctcacacctgtaatcccagcgctttgggaaagccgaggggggccgatcacctgaggtcgggagttcgagaccagcctgaccaacatggtgaaaccccatctctaccaaaaatacaaaattagccaagtgcggtggtgcatgcctgtaatcccagttactcgggaggctgaggcaggagaatcacttgaatccgggaggcggaggttgcagtgagccaagaccgcacctttgcactccagcctggggaacaagagcaaaactccatctcaatttaaaaaaaggaaaaaaaaatccactttaaagaacggtgatcaaaggctaacgttgccattattcctgtaactaaattccattttgataaagtcacagcatatgccatcttgcttttcaagtcttgcttagtaaatccgtggtttactagcataagtcaactgcgaacaatttaatttctgatctgtagtgtgggctgatgaggaaagtaataaaatgaatggcatcagatcaatgttagcagctaaaaatgttaaaagcatacaacttaagtcctctaattatatatattacccctgtgagacacatggtttccaaatcaacatttttaaagcaagttcttatgcaaaaagtagtccaccataatggcctttagaaaatgtgtgtgtggttgtagtttagtaggaatgaccttgattcccatggagttctctgacttttcccctggaatgaaattgttagattcctctcttgttaactacatttcatcctgttttataggttgctactgatgaaaaccagagtttttagtcttttgcagctccagtaaaatcaaaccacgaagacagttttctttctgggtgaaatattttgcttccccctgttctagttcagttagctgaattgagttctgggaagttctgttccacgtagaaaaagtcaaaataggcctggcttgtttggccaggggctctttgtggaaatcatgttgcaaacatctaagaggcacactgctattctataggacttatttaaaatgactaatatattagagaaaaggagagcagcagggggcagaggaaggctgtcaccctcagagagccactgtgtgcctttaggactaaatttgcaaagcatccagtgcttccattgtaaggagcgcccacaatctctttgtcctgaatgaatgacgtgtctcagattgacaatggtgacatctctgaagtgtgtgtggttaaatttctctctacctgcgacactgcacgtctcatcacacagagggagagcttggagacagagaacaaagctcacaaaagtccacaactgaccggacacgcagctgacctggtcaccggtcaccctttgtccccagcagtgcggggtgcggccgcctctcctcctgagacgctgtcttctcccctccactcccgggaaatcccactggcccccgacatctctcccctgaagtccctgcccctccctgcactccccgccggatgaactcgtcctccacatgaaagtacatgcagtgtgtgctggtcactcgctcgtttcctctctggccctgttctgtgtgctgagctactaacagaaaccgttaactcgacacagagtcaaccctatgcacgtgtctcacaaatgcctcaagctctccatgtccaaaatggagctctgggcctcctccgtccccaccccctgccaccccacagacctctcccttggtcctcaccctcctgcacaaacccgggagctccagcagagccctgggctactctgcctacctcacccattctgtactggctccctcacaatcctggcgggtcctccactccagtgctgtgtgtgcccttgctatccaccaccaccgcccgcgtagcctgctaggatggcacccgttgttccttccctctccagcctgtcgtccacacggcagactcacatggcagaccgcgtagcctccctccttgatgccctttaatggcttcctactgccctcggggtaaaagccaagtccggtttcttcccctccctttgtgcaaatctgcccttcactcaccactctgcgggcgctggccttctgcctatttcagggccttttagaaaccctgtcctcactctggagcattccctcccgctccccacttcaggggctcctttttattctttgggctttaattgaagcatcacttcctcagaaaggactcagctgactacccccaaaacatttcactgggcctctccctgctgcttttcccctgttccccagcacgggccataatttgaaaatccgcattagtgtgtttcctgcattgtgtgtttaatgtgtgtctccacgtctaagctgtaagctccatgagagtccatcggtttcatttccagttgtatacacacagcacctcgcacacagcctggcacagcataggcacgggataagtgtttgatgagcgaatgaatgaatgagctatggtaaacgtgcagtgagcaaactacatgggacggtatccatgtcctcattctcatagacatttatcctcacctggcagttctctgacttgcaaactcccgtgctcttttccaagcagatagctgggttctttaaagttggagttttctcaccttcctgtgtgtaacggcctcatcccctgctcctctcaggttccatgtagtgtgtatagcaacatgccttttaatttgctgggggagtgccatttgcccattggagctctggccctattatttaacagtgaggaggacagatagctgcagggcacacctgcagagcctgcccccagcagcagcttgtgtgtcttgcagacacacaccctcctcctgccacgagatggcactcttcttctccagtgcgatggcgcgctctttgctggtgtgaagagcaccgtgtttcttgcaccgtcatcatcagggatgcccccgccgggatcattgagccctgcaggagctagtggggagaggtttacaaggggaaggtggtgggcgaggtcatccaacatggctgaccatgctgaatccagattggccacaacatttaattagcataacagttatcctaactccgtgtgtgtgcatgtaaggcatgaaagaggaaacagtgttctggagggatgcacacgtgtgcccccattcccatatcagaaaaagatcaaaatgggaaactgagttcatcttttttttagttttttgggggggaaccagaagtgtgtagcagtcttggaatccaagttacatgatcaaaaaatcaaaacttttctttggactcaatgtttctcaaaaggaataattgttatccctatagtttaatggaaaaactaaatttgcagactcttatatttctttccaaccctgaaggctatcgccacaaaatagtctaagttttcttttgaaaaaatgtgcttttgtttatgaaattgggtttatggatcatttggggaggcttggctgaaagccaccctgggctgggtgggacaccaggcgtctctgtggtgcccatgccctgtgtctggggggaccctgggcatccttgatgctggtgcctcacaactgggtgggatgccgggcacccatggtgccgatgccctgcgtctgcgtggaaccccaggcgtccgtggggctgatgccctgcgtctgcgtgggaccccaggcgtccgtggggctgatgccgtgcgtctgcgtgggaccccaggcgtccgtggggctgatgccctgcgtctgcgtgggaccccaggcgtccgtggggctcatgccctgcgtctgcgtgggaccccaggcgtccgtggggctgatgccctgcgtctgcgtgggaccccaggcgtccgtggggctgatgccctgcgtctgcgtgggaccccaggcgtccgtggggctgatgccgtgcatctgcgtgggaccccaggcgtcgtggggctgatgccgtgcgtctgcgtgggaccccaggcgtccgtggggctgatgccctgcgtctgcgtgggaccccaggcgtccgtggggctgatgccctgcgtctgcgtgggaccccaggcgtccgtggggctgatgccctgcgtctgcgtgggaccccaggcgtccgtggggctcatgccctgcatctgtggttgtctctctaggcttcctgtttgggctgaaaggagcaaaaggaagagcaggcttccctgggcttcccggctcccctggagcccgcggaccaaaggggtggaaaggtaagaacatctgggagggacgggatgaggacagcctggcctttccaagtccctcaccttacagaaggtgaaatccatcccccactcacgtgtttggacatgaaaatgagcctgcatgtctctcccagcctcctgtccccttggcggtggcactgagagggaggcgcatggagccagtggtgctgtctgagcactcggcccccaggctcaccgtccctgctctccatctgccatcctcgtcactgaccttcctagcagcagtgagcctgatgctgagtcctgtgctgggttaaaagggaaaacagttatttcttaggctgcactcaggtagtgtctcaagggctcagctccaaggcattgtaacagaggtctgtagagagctctgtccatagcaaggtgctggtatagtcaccatccctggtcctactgagactcggtagagtgacgtggtttgcccgggtctcccttcccgttgatgaggaggcgaacttggaacaggtggtctttgcacctgaccctttccagtcacctcagggactctgcccctagctcgaggccgtcctctgtgaggctctgtgggccctggtgtggtgcaggctgtgctcctgctcacctctcccctcccagaacatggggagcacttcctgggacttaccacgtcttggccgttttggcgtatgtaggatgtgcagtgcattcagcaccccgctgtggatgggcatgacctgagagcaggcaccgcaggacctggaggaagtggggcctccccactgggcatcctctgtgccctgggggagccaacccctgccgccagcatggtgctgccttgctgcccaactccctgggttcagctgtggcaaaacagaggaagagaggtcaggcatgtcttccctgctcacctatgacctttcatgaccttggcctctgaggccagggctcttgccctccctgacggctccctggagccggctcctccccttggcccgcaggcccagtggtggcaatcttcagctctaagcactgaattccttaacctccttcacactccccgcaactcaacctatgcctctgaatgtggtcccagtttttaagtatctttagtaaacatcagagtcaaattctgaaccccatgagactatgagtgaacacttgagtcacttagtctgagcctcagttttcccatctaagaaatgggggtcatagtgcccatcagaacaggcagtgtccataaagcaccaagtgtgccacccagctctccccgctgcctgatacccctctccccgccacgctaagaggaatgcggaacaaggaggccctcctctccctcctctgcaggtgacgctggggaatgcagatgtacagaaggcgacgaagctatcaaaggtcttccgggactgccaggacccaagggcttcgcaggcatcaacggggagccggggaggaaaggggacagaggagaccccggccaacacggcctccctgggttcccagggctcaaggtgaggagcaatttcatcatgaagctggcaagacactctgaggcctccccaggtgtcccgttcttgccttttatctcctaagtttacacagcttcagaccggcaacactcatggacccaaggcatggctaaaccattctaaaaacccacataccccaaggcggactttctacatgtccactggtgagactgagaaggggcgctgctgtgggaaccgcagccgacagctcttgaaagagttcaatagggggtcaccacgtgacccagaaatgccactcctggtgtatccccaagagacttgaaagcacgtgtccacacaaacacacatacaccaatgttcacagcagcattcttcaaaataggcagaaggtgaaactatccaaatgtgcgtcacctgatgaatggatcagctaaatctatacagcatctataccacagaatagccctgaccttcacgtgggagcaaggtgctgagccataccacactgtggatgaacctggaacatgttatgccatggggattgagacccacacagaaggacacatgctatcacatggtctctcattctattcttatgaaatgtccacacaggcaacctagaaacaggaagtcgattggtggctgccacaggtggaggtgggggtgggggtggggagtacctgcttaatgggaatggggtttctttttgatataatgaagatgttctgaaattagataagagtgatggttgcacaaccttgtgaaaatactaaaaatcactgaattttatgctttaaaacagtgaactttgtgctatatgaattatatctcaaaaaaacctatcatttttaatgtaaaggacattatttatttatcgaacattcgccttctgaagtttagcaagaactgattcagcattgttggaaggcttccttcacctgataaaaagcaagaccttttgatttttaaactgtgcacgtgcttgtgtggaggtgtggaccccacacacatcagctcatggcctttattctgtgccttatgcaaaggtcacctgcagcagacctttcttccgtggcagattttagctgaccaaagagttcaaagtgaatttcagatgtagacaaagaaagtatactttttgttgattttttaacttaaaaagagaactctgggaaatttataaagcaaaaagttcattatttaacatattcagcaatagaggaaaaacagttggtcaggacacttggccaaggaaacttaaaggatctgagcccacagcatggaaggaaccgcagccccgcagagctgtgttgctgacggccatgactcccaactgcttcatggcacggagctgtgcaggtgaaaatgagacccgggcacctcgctgatccatgccctaggttttctcagaaaacagataggaaaattcaacaaaaaatagcaggtgctcattttatcccagcttaaaaaggatgcgatctctgaatcatggctgtctagcagtaaaagtggctctagtattcagaaaaagtgcgtggggtgagaactgcacatataccaatggcaaagctagtaggatcctcagttgtttaaaacgtgaccgaatatttcccagaagccaaatggaccccattctgtgcccctgaaatgtctaaaaccttccaagcacacacgtccacagaacttttgttcacacgcctctggctgtgcctggtgtcctgcactgaattctatgattgtgtgtatggaaaccacactgaagtgggaatacctgagaccatttgggagttttttggttagtttttgtttgtttgtttttattgttgtttttggtttttaatatctgtactggtagagtggcagggcgcttgaagtgtgggagtgggtcaataagcccatccctccatccatatacccaacgtgtattgatcgattgggtctggtctgtgtgtgaggaactctcctagattctaaagtaatgttgcaaagcactaaataaatcaagaatctgtggaattttctagaagggaaactcccaattactttcaacattgcatttaattaaagcaactccacacattcccatattcttggaaatagcgtcaaccaagatatgtcaaaagctagcacagctcacgtttgaaaacacaacgctgatgggtaccctgctcatcgtggaaagagctagacgcgattttccaggctgcgatttgagagtccctgcaggcagcttctctctaaagtatctttttctctcaaccttaacctcagtgcaggaaacaaatttctattaaataccatttattgttctcaatattatcacaaaattttatcctccatacctggattaacctgcttggctcctaaacgactgtgttttagaggaagccaccttgacttttaattcagtgcttctcaaaaggcaccgagcccgtggatccctggggcctctgtggacacgaaggcaatgattcagctgccccgggctggggcctgcacatctgcaccattgggcagagcccagggacactgaagatgggcctaggacctgggtttccctgtccaaccacctgtggctacttccactgcattgtatttacttatttatttatttatttatttttggagacagagtctcactttgtcacttaggctggaatgcagtggcaagatctcggctcactgcaacctccacctccctgtttcaagtgactctcctgcctcagcctcccgagtagctgggattacaggcgtgcaccaccacactccactgccacactcggctaagtttttgcatttttagtagagacaaggtttcaccatgttggccaggctggtcttgaactcctgacctcaagtgatccgcccacctcagcctcccaaagtgctgcgattacagaagtgaatcaccgcgcccggccacattgtaattatttaaaattaaagaaaaggtaccatccagttcctcagtcccaccatccgcagttccagtgctccacagccactgtggccagtggccccacactggacagctggatgggggcgtatccagcatcgcagaaagtgctccttgggtggcgctcggtttggtgacgggtgactgcctgccagctgtgtgagatgaaaaagcttgccagccatcttctcagatgccctcacagtacaaagaaggaagatatttttttgtctgttttccacagggagtgcctggcaacattggtgctcccggacccaaaggagcaaaaggagattccagaacaatcacaaccaaaggtgagttcctctctggccacgcggcccctggggcactgagccttcctgtgggcacctgcctgggcagcttcacatgcaaatccctttctaggtgagcggggacagcccggcgtcccaggtgtgcccgggatgaaaggtgacgatggcagcccaggccgcgatgggctcgatggattccccggcctcccaggccctcccgtgagtagccacaaactgcggcagctccgtcctctcttcttcatccttcaggttctccaaacaccccagaagcaaacagtattgacatgagcactaaaccaacctgtgcataggacaggctgctcattctgctcattctatttctaatgagcagaaatcagactttttaggaaacggtgaattaagttagaagccaagctccaaatgaacatttaaaagtcaacaatcaaagaaatattcctcctggtgtaacagactaagaaccctcccccgccaaaaaaagtagactattctaaaatgggtggtggaaccctatttttccaaggtaaatcatgaaatatacaatttcatttttgcaacaaacacacactggtgttgaaggaggggctacctagtagcctgcagagaccccagcatcatttcctcaggggaggctggggtcagaggcgcgggaggcagccatggagggagacaagaccccttcctgtgcaccctccagcctctgagcctctcctgccaccacgcctttcccactgccagctctggagcattctcttctcagaaggaccttgcaaccttatttctcacgtctttttttctagattccattttcctccctctagtcaccaagcctgtacctccttaagctctttgtactggtttcctggggctgaggtcacaaactgccacagactgggcagcttagacatcagaaatgtatggtctcacagctctggaggctgaaagccgacatcaaggtgtctgcagggctggttccttctgagacagtgcgggaggatctgtccctgcctctctcccaggttcccggagctctggcattccttggcttatagacggctgtcttctctctgtcttctcatcatctgtcctctctgtgtgtctgtctctgggcccaaatttcccctttttatagggagagcggtcatattggaatgggcccatcctaaagacctcatctgaccttgagcaccctcaaagaccttatttccaaataaggtcacatgtctaggtcctgggggttaagacttcagcatcattggaggacgattgaagtcataatcctctttctcctcctcagagcctcacgcctgaattctattcgcagcttatttgcctcattccataacccatgtcttctctagttttaacgtgggtcatgtctgtaataacactcttgagtgcagtggtacaatcaaagctcactgcagcctcgaacttctggactcaagccatcctcctgcctcaacctcccgagtacctgggaccacaggtgcacaccagcacacccacctaatatttttaaaattttctgtagagatgagatctctctatgttgcccatgctggtctcaaactcctgggctcaagtgattctcctgccttggcttcccaaagcactggttttatagacatcagccaccacacccggcccacatttttacaatttaagtgcagttttttggggccagagaacacagataattctatgattgggtatcttaaaaatctcatctgggaggcaacagggttaaataagaggcaaagtcataattggtcactttagccagaagaggaggatgagtgatgattcctgtggttggaacagtctttggcctgttcagtgtcatgtggggtgggggtggtgagtgtatgtgtggtgtgtggtgtgctcatgtgtgtatgtgtgtggtccgtttgagtctggatttgttacggtagtggtggccttccctggagttggtgccttgtgaagttggtgaccaggaggtgcacctgtccagccatggggttcacccacccctgcggctcccaagcctggctgccagtcccagcccagctgggggcaggtggtcggagcagggttaggggtaggggtgagggttagggtcagggagaaccttgcagcctcagcttcccattctcggggtgtagggactttcccagtgcttgtgtgccttccttgtttggtggcatctctaaaccaagaatgtcaacttctgcctttagaaaactcgtgatcctgcctgtgccaccttccagtggcatcatccccactgctgtccactaagtttggggcatctgccctgtgatctctgcaacagccttgtgtccccctcccctgtgaaaaaaagctaaaacacaggggtacaccacttaatcaaggtctcataaatagagctggaccggtgtccctgccccgctccgtcatgcctttgacaaggaaggggctgtggtgtcagtggagagcagggtttgatttcttataagcagctgcctcattgtcatgagaacacccagcctcgtcccgtggctcagcagatgagcgggagcttatgcgcatggctgttccaccagcacgtggggacagcaccgagccgtgccgtggtgtgtgcgcagatcacaccagcatcactgctgccagcctccccaccccatccctgcacctcccaccagctcccccccgcaccctgcagctggtgctttcatccacagggcagcccctctccattcccaatcctgtaatctctcctgacttctgaggcgcacacggctctttccttgtccaaattagcttcctttcctttaacaacgtagcatctcttaaaataacagccattttaccgatgctaaattataacaacaaaatcatgtgtttctttctccacccacagtagaacacaaaagcctgtgccttcgctgttctggagatgaaggcccaggctgatgcaggggagctggcgggtgggaagagagaaatgctcaagcatgtacatgtgccttccagaaccggcttccgtggcattgcttagactgctacacagtctgtcactggctcctgtgacctggctgaccatggcactaggttcctgttcatctctgttgtctttctgttctggatccatagctcagaattccgggaaatgggaaaggaaacagggaagtcgaggcgatctttaacattagtatatattttaagaaataaactgaattttcacacagggtgatggcatcaagggccctccaggggacccaggctatccaggaatacctggaacgaagggtactccaggagaaatgggccccccaggactgggccttcccggcctcaaaggccaacgtggtttccctggagacgccggcttacctggaccaccaggcttcctgggccctcctggccccgcagggaccccaggacaaataggtatgaaggaatcctcccttttacctttcacagtcctgagacattccacgctttcctttgtcagtgtagacgtttcccagtagagtcagatgaggatgctgttttgcctcatctgttctcgcacgtacaagggatgacccaactgtgaggtttctgagcccccaccagcctcccctcagcagctgaaacatgcagcctctcctgtaggactacagtgacagaggccttgcccggaagttcagagatggctttcccgttccctgcccatttcaaagccttcctgcccccaccagcaacatatacgacacaccttcacacacgtgcacgccccagacgagccagtaactcttatctgtttcaaaattgcctcactctgtccttatgtcttccccccagattgtgacacagatgtgaaaagggccgttggaggtgacagacaggaggccatccagccaggtactctgggaagtgcaggtggctttaggacactagagaactctcatttggtctgctggttaagctcttgcagtatgcgtgggataagaaatattaataatatgtgcaagccacgtttgatttccatggcacaacatagtggcctggtgagcactatacattgcatgaatgacaacctggtagagacggagagacatttaaccaaacccctcttgtcagaaatcctttttcactggaaagcaccagtgcattccaactcagctccacaggcacgtgtgctgccaggagggtccaggcagaggaggctgagcccagcccagacggtggcgaggatgtcaggccaagatgggagcctggtccagattcccaggcacacagacaaaagaaagctccaagagtgactgttcttgcaagagagcctcttagacaaagggctctcacaataccccagctggagtgtcactgctcccagccacaccaaccagaagtgcccacagccttgatttaattttgcaaggtggctgattgctgtggttcactctgaaagtaaacaaagtcacaaaggagaagtcaaataattcattttgaaatcgcaggctatctccattgctggcagatgcttccagacaaaagaaaagcatccacactgacttgcagggtagcagccagattaactcggtttgcacccaggctactgccctgcaggagggaatcaattgtttgccagcacagtgccagtttttatttgactagactggcttagtttgcattttatacgaatattttgatttcattacacaatgaaattaaacttttatttacatcagaaccaagatgaattaaatcattaagttactctgatcccagaatggtagccggtttgcacagctcgtgcttttgcccttggggatccccaaggccgtgggactcagtgtttaggattgcttgggctcatcttttctcctttctgtccccaggttgcataggagggcccaagggattgccaggcctgccaggacccccaggccccacaggtaatgcacggagggaacctggagtgcacccagccttcctcccacatcttcacactgctgtgtctcccccgcccatctttcctctggtcctgcatcccccaccccagacatggtcgtgtccagcatctcagcacaaactggtcttgcgcctacagggagcccactgtcatttgccactatagaaaaaggagtctggtagctgacacttagttggggccaggctagaagagaaaattcagccatggctgcaggggaacgcccccaggggcagagatggaagcctcgtgtttaggactggaaaggggttgcacttctatgtattttctttttatgcctttccatcccaggatctaggggaagaacctacaggagaggatgctttcatttgggttttgattaacaggaaacgggaataaacaaggctagagtgttttgtctctagcacctgggaggacctgggcttctatctgctggcccaggccatctctcagcccatgtgagaaagagtctgggtgcccttcacagagcccatgcctaaggccgcctgcgtgtccagtgttggcggtgcaggcctggctggccaccactgccgtcccgcctgcgctgcgattctgctgccctgcactccagggtctccgtgggcctgtgagcatcggggaacacagagccagggcttccactcaagcaggaggagggctggaccctgagaggtggctctatgcctgtgtccatcagcctgagaaaagcaagttctctgagcagtaggaattcccctttggatgtctcttccactcggcctgtgatggggccggggaagcatgtcacttgggtaactcagtgtcacaagcaccagacacagccagagctgttctcacttgtttcttctggaactaagtccccacctatgcaagatgaatagtgcagacaggtgttctagatgcttcctgctgcacaaatcatgccctcactgcttcccgtgataaactgtagagagcgacaccagtgtagtatgaacagcaatgagagttaggaaagtggacggacacattctatgtgccctgcaccttaagggggtcttcggagtgcaccgtgatcacagggcctggggagcacaggacaaatgcagaggtatcatttgcactgtgagcagaggtaaaggctccttgtgttgtcttctgagaactgagcttgtatcttccgcgttccattagacctgcccccggtctaattccatccatggatttcaacaccgtcactcatacagcaacccccaaaatggtgacaactctgcatgtctcaggtggtcagggagaaccagaggccagcacgctcagcacacacccagactacagccgtgtgccaaggccggtctccgggaaagctccagtgatgcgagtgtgggtttctgaggctccggggctcccccagccatacccagttatttccatttcatgcccaggcccccattactgggagccccttgctggcctcccatccgctcctccctctcactcctgctgtccgcactccactttctaagagtgagggtgggtttgatcacacacatccccttcccaagaggcgccaggaacggggataaaaaagtgtggcagatgggttttgtgacatggctgaggaacctcagcccttcaattatcagaaaacacttctggagcccacacactgggccaagcaggattcaagtgtttgaaaagagtcacctcatagtcctcgtggcgtcctcatgaggcaggcgatccttctccccactttacaggtgaggaaactgaggcacagaaagttgtccacggtcacacagatagaatggtagggccaaaatttatagccaagcatctgaccccacctccaaagccctcatttagagcactgtagaatctaaatattggatattatcattcttatggttccagtccgtaaacaggattttaaacactgaaaatcattctgtaagcctggaggtgctgtttcaggctgatattccccccagcctcatcatttcccggtttcatgagatccacattaagtcagatgccaagcatgaccatgcccatttatcctcgtggagcctgatgtggtttgtggtttatttggttatttaggtgccaaaggcctccgaggaatcccaggcttcgcaggagctgatggaggaccagggcccaggggcttgccaggagacgcaggtcgtgaagggttcccaggacccccaggtgagttgagatcagacccccattcagcccctgggttccagcgggaacctgtgtgtgattcataagcatccagctctattatcttccactttgtagaagctgttttaacaaatacttgacaacttttgcatttgtccttgggagattagaaattcttgatttttcataactgatattgtactgggtttttgcagaagctatctacagatcttgcaggaaaaaggagacaggtgtttcggaatggctgtcctccgcaacacctgtctcccaggtatgtcctcagtgttaataatgattaatattaaacattctaagggcaacacaaagttatcctctcctgaaagaacccttaaaggcataaatagccctctcacaatgtggctgcaagagcttaaggcattaatctgtatgtggaggaaaatgaggtttcccttaaccagctctggtgaggagtacccacttgcgtgtcagcatgctctggaatgcagccaggcgtctgcagacataggtgtcttgcagttgtgccacaggcgatgtgcatgagtgtgatggcactgccttgattgcaggggcatacacgtctttttttttttttttttttttttaatgaaatggaatctcgctctgtcacccaggctggagtgcagtggcacaatctcagctcactgcaacctccgccttctgggttcaagcgactctcctgcctcagcctcctgagtagctgggattacaggcatgtgccaccacacctggctgatttttgtattttcagtagagacggggatttcaccatgttggccaggctggtctcaaactcctgacattaggtgatctgcccgcctcagcctgccaaagtgctgggatgacaggcgtgagccactgtgccaggccgcacacatcttcaatagtgtttgtctaatgaaaccatggaagccattgtggacaactttccacccgagatgaaacatccttccacagggtcctgggcaggttcctgcagcctctgctggagtcccacttgtcacctagaacctgtggcacattggaaccctcttgttgctagaaagttcctccctggaatacagcctgcctcccagggagttctcaccgggctgttcctgagccacacagttgacttcctcataaccacacaccctgagagaggcggccacatctcccacagacgtctcatgaacaggcagaactgaccccgggaacacatactttcttttaatgacatcgttccatgcccttggaattctgagcaaccttctaggacccccacttatcaggattcttttccaactgggctctagaaactgaataaagcgctccccatgtctggaatatcacacagaacatcgggactgttgcgcccttaggttgaacatcttgcaaatgttcccagtgaagactaattgaaccctgcccctcccctgacctccactcagatagctgatttaagcctcaatgcagaagtgtctgtccgtccctgatagatggtatctttcggaattttgtgttgcagcccgtagggattgttccaaaccctgaccctgtttcctttcatatgatgcgtttctccatgttttgcaaaattgggaagcaggcttcctgtgtctgtatcaaggccctggtaaaaacaactctgcattcgaatgaagcaaaggaagtctccatgcctctgccccaggggttggtctctgtggttttgttgccctgctggaagtgtctaaatatttagaagtgtaacattgccactctcatgatttcatatatactaagtttaagcattcatgattttgagagaaggataataattcctgaacagcttcttgctgtgagtatgaaagttctctggtaattgtgattggagtgcccagccatgtgtgcgtgaacgccacacggggctcccctgtaggggggaatggatgggatgcacccattatcaggtgatttggacagttgcccacgtgagttgggagcctgttccaccatcaaatgtgagcccttacgtcatgaacagggaggctggggcaggctgggggtgggtggtgattgaggaactgatcagtttctgaaacgcatgtcactttttatggtgctgaaatatactgcccttctgtcgccacatgcagaagaggataaaatgcccaattcaaggattgcaaaaatcagagagtctattccagatctaagacccacacatgcaaacccaagtgcatggctccctgggtacagtttgtaacattgccagtgaaagtcatgtctcttcattgtgagtaaatcacaccgttaaaactctgagtacggtctagctgattaacgtcaggttaatccagatcctttattctgtattccagttactcccagctcccaggcagtgatggctttaccggcccaggaggtccccgggccctgctcattggatctttttggtgggatacaccccacagaacacagaaaacattcccttttccgtatccatacataggagtgccgagcctgccgtgtacttgatcttgtcccacagaatcacctgccagtctcatcgttgcaggcttctctcctgcatgcacagcgggggtggtggtgacctcagaagcctttccttctgagcactgcgtgactgtcagctgtgggagttcattctgaggccatgtcagggctgactgcaccgaaaaaggaagtgacctgatgagatcattttatccagtggcacccacaaaagacacaggacagctgccttccctccatccgcagatgggacttgatgattttcttttttctttttatttttttctcttttgagatggaatctcactctgtcgcccaggctggagtgcagtggtgcgatcttggctcactgcaagctccgcctcccgggttcacgccattctcccgcctcagcctcctgagtagctgggactacaggcatccgccaccacacctggctaattttttgtatttttagtagagacgaggtttcaccgtgttagccaggatggtctcgatctcctgacctcgtgattcacccgcctcggcctcccaaagtgctgggattgggacttgatgattttcatggtcaatacaacagaggggtgtcgttcctctttgaagcgtttcccaaccgacagtgacgggtttctaccagggagatgttacggcaggcagcgttttggctctgacggccctgttcgttcctgcctccctgggattttccatcccgaagtgctgttcctcactcagcacaacctagaaggtcccacaaaaagctattctttggggcttatttgcaaagcaggggaacccatgaattatgcaaatcgaggtccaaggaggcgttgttggcttgtccaccttcactcagttttagggctggggggccgaatggcggggcaagcagaagaaacataaccaacagaacgacatggcgaaggttgtaggttccaaaaagggcgacagggacaagggctcgagctgaggaatgccttctgaggaccccatagccaaatttttgctgtttccagcctctttttgactcttctcttagaacgtcaccatgctaacttgtggtttggggcccacccatgtttccttttagggttcataggaccccgaggatccaaaggtgcagtgggcctccctggcccagatggatccccaggtcccatcggcctgccagggccagatgggccccctggggaaaggggcctccctggagaagtcctgggagctcagcccgggccacggggagatgctggtgtgcctggacagcctgggcttaaaggccttcccggagacagaggcccccctggattcagaggtgagtgccccatcggggagccgggggccccatcccagatgcacagtggcctccaagggcgaccccaatcccttccgggggatttggtaggaagcagcggtgccctatagtgctagccatgcgtaccttctcccatggccttccagcactcctttagaatgtgtctgtcacaacactgtgactacccacggtagccagtgcgatctggccatctgagaactttgacaggtgtggattcactgatgtaatctgttgtcaagttgcatatgcctggctgtgacaggggccgtgacaggctcactgtttgtcttggcagaatctgtacaggtggtatgaagaaaagatgggccctggccatgcttagtcagaggtgaagaaggaaaatagaaataatctggaatgcaattctattggtgtaaaaattaatacattttttaaaatgtcttaatgttgtttacagtgttatcaatgtatctctatcaaagtagacagagcatccctggtttcatgagtgacaaggcacccggtggctttaagggttcaactgatgccaaatcggctttgggaacccgagccccgagctttaatgaaagatgatgccatggacagcaaatgttcacactgggtgaaccccaggctggggattgctagatcattgcaacctgccattcagtgttccaaatcaaaaatgaggctgagcacagtggcttacacctgtaatcccaacactttgggaggccaaggtaagaggattgattgagccgaggggttcaaaaccatcctgggctacatagggagaccccatttctacaaaaaaaaaataataattaactgggcatggtgctgtgcacctgtaatcccaactacatgggaagctgaggtgggaggattgcttgagcccaggaattgtagattgcagtgagctatgatcattccactgcactccagcctgcgtgacagagtgagactctgtctcaaaaagaaaagaaaagaaaagaaaatgtgggttaaaactgtgactcggtgcattcactgtttatctgttgatggcattgtcgttagtccctgctgccaaccccagcccgaagaggcttctctgtggtgtgggaagcaggtgtcgctcccctgattctgccatcagcccacatcaggcatcctaagcgagatggaggctaggcctccactggcaggcgaacccatgaagctcaggagcatgaattggttttcggatgagcctgtgagattcctagcaaggcctggaagggttgggacccaggacaggggagttttgatgatgatgagactgatcagtgcccccagctgttgatactagggagcgcccatgggtgccacagttcactgagagagcaaggaagagcctaagatggccagagtgcatgcatgcacacacacacacacacattcacggtcacactcatgcacatgcatgctcacacatgatcacatacacacatgcagatacctacacacgtgcctatgcatgctcacacatgatcacactccttacacacgtacccacacacgtgcctgtgtacactcacatgatcacacacgcacgtacccacacacgtgccgtgcacactcacacatcacacacgcacgtacccacacacgtgcctgtgtacactcacacatgatcacacatgcacgtacccacacacgtgcctgtgcatgctcaaacatgatcacacactccatacacacacgtacccacacacgtgcctatgcacactcacgatcacacacatgcacatacccacacacgtgcctgtgcacacacgatcacacacacgtacatacccacacacgtgcctgtgcacactcacacatgatcgtacactcatacacacacgtacatacccactcgtgcctatgcacgctcacacatgatcacacactcacatacacacacgtgcctatgcatgctcacacatacacatccaaccctgaaccaagccagctagagcaggttgttgggtgaaattacgaggatggggaggcctcgtgctcggccatccagatctcccctttccagtcctactgactctccaggtcatttatggaagataagatgcaaatcagcgctgtctgcagaaactgaggactcggcgctgagaggtggggctctgtgtgtcagccttcctggaaggcacttaaatgagttcacagaaggcaaagtgaaggacatacgtaggtgactcgagtgtccaccatcgacctgttctgcaacccagctgtcaaaatcctgccccaagctctttgacataagggtacttctggtagaatttttttaaaacttaattacttcctgcaggcttcagaatgtttgagcatgaaaacaaatggaagcaggcttactttcgatgtcttattaaggtctttaccatgatcaatgttacctttatgacaagcttcatatgccttgttaggcagaatgttttggatggtaaaaatcctgactcccaaagcatcaacattccaagtaactacttcagtttcagttccgctcaccagtgctacaggagcagcgtgcagcgggtcctgcttccattcgactggctgtgcaggacggccacaaacacacgcaggtgcaccctgcgcttctgagcagaactctcggaatgaagtaatgcagacgtccacaaatgagatgtgatttcactgagggaggctgatttttagcagttgttccttttttaacagatagtctataagtggaaactgacctgaaacattcagctctaaagaaataatcacaaagcacctcggtgcctgatttttgcaaggcagtccttgccggaggatcgggcattcgtgcacattcacccggagaccgtgctgtccacttccagaaggggaggaagggcagcgctcagaagcacgcccagactgtctccagccctgctgccccctgctgaggccatctcgcctgctcagcccccaagttcccccacagtccatgtccctgggttatgaatgtcacctggtgtctgtcagatccccaccccattgttcttgtcaatgagcaggagtggggtggacctgccatcgctgcgaatcctttacagcctgcagtgctgcctgccaactcttcacaaccattagcacccactaacaatccatttcccctggagctcttcactctaaagatagaagaccaaaaaatagaagtgtcctcatttctcacagtactacaggaggaggtgagaaccgatgcatccgtgcatcttagagaatctcatttcagacctcggcttcgagtgcgcctcctgctcagtcagccctcttcctcgctgcaggttgacgtggtcagacagtgcgcagtcagcagcctgactctcggttctgggttggtccaagactgaccgggtcccttttgtcactgccccctcctgtgcacccccctggcttgtctgcctccctgtcctggaccagccctgcacacctgcagggtggctgtgaggctacgtgagtgtgtggactgtaaagtggtggcaggagtgtgcacctccggtgttaataatcggagagcagctgcgacaagcgtcaggctcacgaagagagggggaaatgcctgaatataaggaggtccagggagctagtgttaaaaactagaagaaaacagatgcccttagtgtctgaccactgggcaggacaggatattccaaacttaaaatgaagagaagaaatcacacatgtgcacacacacccacacacacaccatatgaagtttgaatacaaaggttagtatcctgcatgtggaaagcaaaattaaactttgagcagcagaataaactttacaatagatatgaaggaaaattcgtcagtgtatatgaggaatactaaaatctatcaggaaaatataaaactccccagaggaaaataggagcaaagaggccgggcacagtggctcatgcctgtaatcccagcactttgggaggccaaggcgggcagatcgcatgagctcaggagtttgaaaccagcctaggcaacatggcaaaaccctgtctccatttaaaaaagaaagaaagaaagaaaagatatgagcaaagaactaaaacttcaccaaaatcaataaccaggagaaagaaacgtagatcataatgaagaacaagcaagcggatcccccgacaccacgtttcactgcatcatgactgccagggttccattttgcttcagtgctaacgctcagtgctggggaaacactggtagaataaatgggtttagactttctgaatcagtgcgatgtatcttttaaacaacattaaattagtgtttgctttgatacacgatgtcagtttctcaggcagtttcctaaagaaattacctacgacatggacatggataaacatagcaaaaaaagaaaactccccaactattcctgacagtgctgtttgcaaaagtgaaaaaaatggggaggatgcgatggaatacattcaatgtgtccagatgatagagttttattcatgtagttattttaaatgtttgcaaagactatttttaaatgtggcaaaatgttcaaaatataatgtcaagtgaagaaaactaggttaaaactatacttatagtgccatgtcaactctgcaaatgtctagttatttataggaatagacaagggcaggaaggaaattcccagtggtagtcattaccgctgggtgatggtgtgccttacctgattttatcctttatacttctttgtgttttcctgattctctagagtccagaaaagcatgaattgctctttttacagaatgagtgtgtggagggagatgctgtctgtgatgaacagtccagagttggcccccacagctcttgtctctgattcctgcaggaagccaagggatgcctgggatgccagggctgaagggccagccaggcctcccaggaccttccggccagccaggcctgtatgggcctccaggactgcatggattcccaggagctcctggccaagaggggcccttggggctgccaggaatcccaggccgtgaaggtaagaccccagccctcccataaacgagtggggtcctcactggtcctgccaagagaatgagcactgtcttcttgtggagctctcaaagtctgttccatggaaccccttaagaggtgcaggggttcccaaaccagaacatgtatttcacctaataaggagacacaaacagcctgagacatcggctcatcctctgtacctgttgtatatattaaggatctagggaaggtctcatcgggaaaaaagaaaaagaaagaaattccccctacaaaagttcagaatcactgctctgatgtggagaggagaaatggttttatgaaagtgcagggtgtgggttggaaaggcaggtggctccgtcagggaaacctggggtagatgggctggagcagaggagcggggaggggaggctcggctgcatgcccaccacacaggccaaggcaggtggcagaggtggcccagaaggcaggcagggcacagcatccatgggcattgcccaccactgcccaggccgctctcccacactcagtacagccagttcccagactcctacacttcacggtccagggaaactgtcagtgctggttggaggaatcaatgtactttcccccctttttgttttgtccagaaaaacagctttttaaggaagtgttgtatgtcaccaaaggacaccgtaactgtaaagtgggaaagacgcagttgcttaataaggagttgtctccatggaaactctcaatcttactatagttctctggtttgccacagtcaggcaacagctttgtccaggaccttagcagatcttggtagggaactgccactccacttgaagatacacactggcttcccccatgtggggcctcgcctgtgtccaagagctgggggctggactcaggtagggcccgctcccctattgccgcactagccactggcttcctggggtagcaaacctggaccggaggttcaggctcctatctcagtatcgacagggccgtgctggttctcaactactgagaatcagctgaacacagcgtcgtgtggtgcttacgagacccatgggaaagcctgtcctgaactaaagcctacactttaggtggggagagagacacacacattaaaaggctcccacttggcctgggcaagccagcagagtgacaaggccacgcggtccccggtgacccagaggaggcggggacaggcaggtcagagcaagcccaaggggagaagtacctggtgccagcggggagaaggctgggactggaatgtggggtgctctctaggaaagggggaccaccccagcagaggcagaattgcccagggaacactttggagcctgtgatccccaaaccggctggggaagagagcctgatttgagggggctgggggtttagataagaagattgagccaaaggttgggagcagtgaatgctggagctaaggagttggagccccgaggcagagggggcctttgggagtttttaacagagaaatgcattaagaagggattttagggacccagcaggcagcccttggacggcttggagtcgggggaggcgggaggacagctgtgggcgggagctgccaagctcacgacagtagcagtgatgagatgggagcacggagaccagagagggcagcagcagcaaatgggcagctggagggtcccccgggactaactccgggctggagccagtgatgttcgcgaggaacaggccagctcttgactaaccccagtgaccatgccccagccagagctggcaaggcccccactcacatcagcatccacacagctttgtcccttggcttctgaagactgcagtgggaaagccatgctggctggcaccccgccagcacagcctcaacctccagatacagacctctccagaaaggccagccccagggtcccgctccggccacactttggaaactcaccccaacatggtggttttccactttccttctaaggagcttttcttactgaacactcaatgccgtaaaagcagaagagaaatttcccctgtgtgtgtttgtccaccctgtttgatttgctcctcttcctgacaggtctgcctggtgatagaggggaccctggggacacaggcgctcctggccctgtgggcatgaaaggtctctctggtgacagaggagatgctggcttcacaggggagcaaggccatccaggaagccctggatttaaaggaattgatggaatgcctgggacccccgggctaaaaggtaattgtgtgactgtgaccagggatcccttggcggggaggttgggtctaatcaactctgacctgagacagctctgctgggcgcctctgtgggccgtggggctggcctcacacttctgcagattggaggccttgggactctcctgacctaggagacagcagcctcaggacagctggttaatgctgcttagacgcgggtgggaccaatgtgcctcacaaagccagtttatgaatttaccaagacaaactgctcctgcctgggaaacatcgtcttattgtaaatatcaccatctgcacagggaaatttgtggagaggtccactcaggggcctagattcagatccagaggttatttggtgaatttgaaaccaaagcaaagcaaagtggttggttacagggataggtttatttcagcacaagcaggccaatctagaagcagagccctccagcccatgaacgttgctggagacacactgttcttccattgctggagacacacagttctgtccttccattgctggagacacactgttctgtccctccgttgctggagacacactgttctgtccctccgttgctggagacacacagttctgtccttccattgctggagacacactgttctgtccttccgttgctggagacacacagttctgtccctccattgctggagacacactgttctgtccctccgttgctggagacacactgttctgtccttccgttgctggagacacacagttctgtccctccattgctggagacacactgttctgtccctccgttgctggagacacactgttctgtccctccgttgctggagacacacagttctgtccttccgttgctggagacacactgttctgtccttccgttgctggagacacactgttctgtccttccgttgctggagacacactgttctgtccctccattgctggagacacactgttctgtccctccgttgctggagacacactgttctgtccctccgttgctggagacacactgttctgtccctccattgctggagacacactgttctgtccctccgttgctggagacacactgctgtgtccctccgttgctggagacacacagttctgtccttccattgctggagacacactgttctgtccctccgttgctggagacacactgctctgtccttccattgctggagacacactgttctgtccctccgttgctggagacacactgttctgtccctccgttgctggagacacactgttctgtccttccgttgctggagacacacagttctgtccttccattgctggagacacactgttctgtccttccattgctggagacacactgttctgtccctccgttgctggagacacacagttctgtccctccattgctggagacacactgctctgtccctccgttgctggagacacactgctctgtccctccgttgctggagacacactgctctgtccctccgtgctggagacacactgctctgtccctccgtgctggagacacactgctctgtccctccgtgctggagacacactgctctgtccctccgtgctggagacacactgttctgtccttccgttgctggagacacattggtcggtccttccattgctggagacacatgggttggtctttccattactagagacatatgagtctgtctttctgttgctggagacaccttgacctctccttccggtgctggcgacattggtctgactttctgcggtcctgtgtcgcatctccatgccaggtgcagtgttactgctgccttcctttccagcgtgctcctctgcctttgtcttgatgggcctgtgggccagtgaacctgcatcatcttcagatttccctcctagccttcctgcctgatctttgtgtgtttccttgttgccaatgtccggtctgaagacaggctgattctggaatgctgtctgttaacagcagaggtcaacagagagaagttgcttagaagatggtgtccccggaaatccctattttaggttcagaatcttctcacttgagttacattgccgaaatgttacggagacgtgagactgaaatgtcccatgcattttattcatgtctaacccagcacttttctcttttcctctgaaggagatagaggctcacctgggatggatggtttccaaggcatgcctggactcaaagggagacccgggtttccagggagcaaaggcgaggctggatttttcggaatacccggtctgaagggtctggctggtgagccaggttttaaaggtatgtccctctcttaacatcctccttacctggtcatggtggcatcctccttaccctttcttggtggcataacattgcccagaatgaatttttgaaaacccatgcatccaggaaccctaaagctagacaaaacaaacaaaatgagctaacaaaaactcaaaggctttatccctgcctcaacacactgaccatgtgataagggaataatcctaaccaaaggaaactcttgagaaccaaaatgatggcatcgctaagaaccaaatatgtcatgaaacatattccaccatgattataccgtggtaaacatgaagagggggcggtgaaaagcaggggacaggtgagttcccagagaagggagtaccaccaggcacaggaggacacagctttccaggtggaaggacataacacggtgccagagagaacgtggtccacacatgaggtgggttcaaaccctcacgcggacaggcatctcaagaccccccacgtaaggcccctcgttcattgagtttattactaacaagtcacattttcatgacttctgttcagatgcttttgttctgaaataatcacagtggtctctaaaaacgtaatgactaagagtgtgtgttggtgaggaggtggagaaatgggaaccttcacaggctgccagcaggagtgtaaaacgctgcggccagtgtgccaaacagtttggcagttcattaagaaactaagcatagagttacccagaagttctactcctagatgaagatcattgaaaacataggtacagacaaaaatgtggacacaaatctcatggcagcatcctttatagcagccataattggaaacagcctgaaaatgcatcgactgatgaatggatgagtaaaatatggcagagctgtgcaagggcacattcagtgctgaggaaggatggggctctcagacatggcgcgtgggcgagccttgagaacactatgccacgtgtcgtctgactgcatgtatatgagatgtccccagtaagcaagtttacagaaatgaaaagtggattcgcagtttcctacacttgatcttagccaaaaggccgagaagcgatggattcgcagtttcctaaagctgaagggttaggggagaattagggcatggctgccagcggctccagggtttcattttctgggataaagtgttctcaagttagacggtgctgcttgctcacagctctgtgagtacactaaagttatgtaattgttctgtttactggagcgagttgtagggtatataaattatacatcaataagctgttttggaaaaccttaattactcttcagacttacagcttttacaaattttcagcaaaataaaaattgcaatctagggtgctcattttttttaagatttttactcacacttgtgctttcaaatagtcttcctgttagcagagatttcaggctatttcaggcaaaaaaaaaaaatgacattttaagattaagtaattttcagctccatggtaattatttcctcgagcctccttagggtgaagttaaccatgggggtgtctgtccctccactggtgggcacgctctgtggggtcaggaccaatttatgattttgatcccatcagcctctagcctagtactgaatacacagtaaatgcttagagactgaagctcaattattttcactgagccagatttcacttactcctccagtgagcatggattccggggcatccccagcctgaactagcacagtttcccgcccggcccgcagctctgggcccctcccctcctgcaatttctcagctcctcagaaccccccggagacctcccttccatgcttctcctccctgtgaaggtgcctacaggagggcacggagctggcgcctgcctcacgggccttcctgcttgtgaccgaggtccatcatggtctcatcagagcacacacaacaaaatgaccttctcacaaagcatcctatgggagtcacactggctttgaccgctccctctgcatctgctggcaggcacgtccccctactgtggtgctgtgtgctcagtgacaccagccccaggcccaggaccctggagccacccccaactccaactactccgatggacacaggagaggcttctccggcgcccttggtctctctccaaggcttccctgcttgggggagacgtgcagccctatggctcagggaccaggccttcacctgtgttctcctgcgtggtctggagcccccagaaaatgacagcactctattcccttccaggcagccgaggggaccctgggcccccaggaccacctcctgtcatcctgccaggaatgaaagacattaaaggagagaaaggagatgaagggcctatggggctgaaaggatacctgggcgcaaaaggtgaggcttctgacctgcagccaggggcccctagtccctgccgccccagcccgcaccagctcgtgcccttctccgtccccagagacgcccgtgccctccacctggctttcttcgtgcttttcatctctgggcgccctgtgtgtccatagctggcgcagggttgttctctgatgcctgagtaacctcggtttcccatcttaagatttgcagcactggccgggcgcggtggctcacgcctgtaatcccagcactttgggaggccgaggcgggtggatcacaaggtgaggagatcaagaccatcctggctaacacggtgaaaccccgtctctactaaaaatacaaaaaaattagccggcatggtggtgggcgcctgtagtcccaactacttaggaggctgaggcaggagaatggcgtgaaccggggaggcagagcttgtagtgagccgagattgcgccactgcactccagcctgggcgacagagcgagactccgtctcaaaaaaaaaaaaaaaaaaaaaaaagattcacagcacgtaggacagcaaaatgcatccaggctgcaaaattgaaaactggagggcgggtgctgcgtcctcaccagagtgttacacaccagggtcttcctgcaggtatccaaggaatgccaggcatcccagggctgtcaggaatccctgggctgcctgggaggcccggccacatcaaaggagtcaagggagacatcggagtccccggcatccccggtttgccaggattccctggggtggctggcccccctggaattacgggattcccaggattcataggaagccgggtgagtgggcgtcttttactccccttgttctgtgagctcctctcccctttgcttgtgaatggacatgctttggtctggaatttgctagggtgagagtgtcagtggcaggttcagggcagcctcaggcttggtggggtccacacagccctggaaggagctgctgcacttggacaccatgcagatgtgatgtgagtccaaccggctgccgtggcccttctgtgggcttgtgctgggtgaagcatgttgtctgcatttttcatggtggccttgagagaacaaaacttgaattttcagggatcagagctctaaaattgagcacatcagtgacaccaggcctgagagcccatggccgaatcacagcgtagacctgggcccggcagcctggcttcccatccgggccaccgttcactcagcctttgttcagcggatgtctgttgagcacttgacatgggccagacacgctgttgtgatggtaacaatggtgagccctgaccctgggcagggctctcttctccacaccttctccctcagctgcagaatgaaggtagtagctaccttgcagttttcttgagtgctgtatagacagtgtgtataacatagcacagcgtggctccccatagattccgtttcctagaattccatttctagcctcgttcatatgaagatagtgtattctcacagtccctagcacacggctggccttcccagggggatgggcacatttggagcagatcagaaggtctgggccccttgatgtgtttcagtcgcgtccgtgtgaaaagaccaccaaacaggctttgtgtgagcaatcaagctgttaatttcacctgggtgcaggcaggctgagtctgaaaagagagtcagcgaagggagataggggtggggccgttttataggatttgggtaggtaaaggaaaaaggggggttgttctctggcgggcaggagtgggggtcacaaggtgctcagtaggggagcttttgagccaggctgagccaggagaaggaatttcacaagataatgtcatcagttaaggcaggaacaggccattttcacttcttttgtggtggaatgtcatcagttaaggcagaaaccggccatctggatgtgtacgtgcaggtcacaggggatatgattgcttagcttgggctcagaggcctgacagtgtgaacccttagtagcaggccagggcctgcctgtgtgtctgtctggcccaccttggtgtacagaattcttcaggggtcttcctcccctcactcccaaaatctgcagctgagagtatcttctagccagtctgtgtgtgctattcaggtcactttaaaaaagaaagatgccagccaggtgcagtggctcttgcctataatcccagcactttgggaggccaaggcaggcagatcacttgtggtcaggagatcgagactagcctggccaacagggtgaaaccccgtctctaccaaaaatataaaaaattaaccgggtttggtgctgcgcactcataatcccagctactggggaggccgaggcggaagaatcgctggaacccaggaggcggaggttgcagtgagccgagattgcgccgttgcactccagcttgggtgacaaagcaagactccatctcaaaaaaaagacaagaaaaaagaaagatgcctgtttctgccaaagacacctacaacatccaaaggacctttattcataacagctcgaaactaggaaacagcccaaatgtccatcaacagggaaaagaataaatgaacgtggtatattctaaccagacacagcattatctgtgcattttatctccatacacagcaataaatgagaattcttggtaaaatccaacaacctaacttcatttccaaactttatgttgaacaaaataaaccagaaacagaaaagtacacgattcagtttcatcgatgtgaagttcaagaactgacaaggctgttagatggggtatcgggagcacagctgctttaggtggggttgtcatagagtgctgacagtgttctgtgtctttcagtgacacacgagttcagatgcattgagctgtgcgtttaagatgagtggacattactgtatttaagttttgcttcagaaaagtaagctttgagaaagaaaaatagagcattacctaaacaaaggtgcagcctgtggataccctcccccttcctcccacaaaggagcttttgttttgttttgttttgttttttgagacagagtctcactctgtcacccaggctggagtgcaatggcatgatcttagctcactgcaaccactgcctcctggttcaagcgattcccctgccacagcctcccaagtagctgggattacaggcgcacgccaccacgcccagctaattttgtatttttagtagagacagggtttcaccatgttggccaggctggtcttgaactcctgacctcaggcagtccacccacctcggcctcccaaagtgctgggattctaggcctgagccaccacccccggcctagctatattaatactgcagcgactcatgttaggccatgcttgtacattgatgctgtagtactaaagtcccagtggcacccaggtagaccagaactctcatgctccctctggggaggaagccactctggaggggaaaactagggcttccaggaagccaccgagcaactcaggcatcttctcaatttccttaccagccacctgtgtctttctggagaagtctccctctgtgcacagatggaggcgcacagccccatatctgtgttataatctgcagagagcaagctctgcagtctggctgcccaaactgaaatcccggttctgccacttgctggctgagtgaccttaagcaaaacctttctgtgcttcagttcctttgcctgtcattgggaagtaacggtgcctgcctggcagggttttcatgaggcgtgaatacgctcttgagacggggtccaccatgtgcacgcgggaaagcatggtggagcgaggatgtagtcagagtcaccgccgccgctgacatcaccacactgtcgtgatggagacctgggccactgatgctcttcattatgatgcagttgccaagcttgtttcattgtatcacttcacagttccataagaacagcaaggccaggtgcagtggctcacgcctgtaatcccagcactttgggaagcagaggagagagaatcacttgaacccaggagttcaagaccagcctgggcaacagagcaagagcccatctctactaaaaatttaaaaactattagcagccaggcttagtggctcacacctgtaatcccagctgcacaggaggctgagacggaaggatgacttgagcccaggaaatcaaggcaacattgagctatgattgtgcttctgcactccagccagggtgacagactgcgatcctgtctcaaagaaataaataaataaataaacaaaaagaacagctaagcaaaccgcctatgatacacactaaaaaacacgagttttccacaaaatgacaagatcacaaaccttgagtattgtcgttagcatactggatagttaaataagtgagctaacttcagagttacaactgacttcgctaacagccttctaagatggttcatgtctgtctttagggtgacaaaggtgccccagggagagcaggcctgtatggcgagattggcgcgactggtgatttcggtgagtgttgcccgtccagtgaaaacagggagtccacaattcagagctctctgagcatgtgagccaatttcagacctgcaagtgctgttaggtattttaaaacaaattattcttgttaggaatataacaaaatagaagttgcaaaactcacaaagtcccagtggaaagtcctgttcttagccgtcttttttgcatgtaacaggtgacatcggggacactataaatttaccaggaagaccaggcctgaagggggagcggggcaccactggaataccaggtacgcaagttattttccttgtcttcatcttcaacaacagccctgagcctttgtctaggagcccgacttgccaaacagatcaaattcagtaacaaccagaaagcacttgatagtgaatgaggtcttcaagtccaatgtgcaagaaagaccgtcgtttttaattaagttaaatctgaagataaaatcaggaagtctttctctctctctgtctctctctttgatactgaaaaaagccagaatggaccctcggtggatgagaatcactgcagtccataaagtgtaactgatgaaaagccagctagcaccctgactcccggaacacctgagggcgtgcagcaggtggtcgctgacccgagcttctcagaaacagcgaagggtccaggaaagggggagtgggagtcaggccatcgcttgagagagatatggaggcagctgaccagcccgagcgagttgtgggggcctggggcggcacagtgcctcccttcccttctgcacatcactgaggttccactcctaaattcctgcctgcagtgacgtctcaaggggactgtgatagttttcttctttctggggattttcttttggggggaccccacactgctcaagttgctggagccccaggggcttgcagggctggccctggtgggagggaaggagtctgtccagggttggccagtggggagactgctgggccagttctttatctagaaattgctctggaatggaaagacgtgttcagttgagcacaggatcagagaaccgccgctgggaaataggcgcctctgtttaccagccctcccgggctcctttgttatctgtgacctgggctcccggtggcttcctcctgagtgacgggagctctgtactgctgagccatccggcgctgggctggctgtgtctgccaccctaggccattagtccggccatttggtttataaacacagaaacgtggaccatcattaccacgcgtctctaatgatgccttcacttgttcaactgaaaatgtgtcagggaagagacgctacccccacccaagaattatttttgctgttacctttgaacattttggtttttgttaaactctgggcccagaaaggctttggagtggagcctcccctgcatccatcaccagaagacggtatttcggagctgtggtcccacaatggaagggtggggccagctgtacccatcatccctgggggtgtcctgttttccctaagacagtgaggggtgcatgggtacatgggtgctgccttggaagctggctagtgcaggctcagagggaggaagtaggttaaaaatcagctaaggaaggagcacggttggatgcctctctccattcctgaaggagcagcagtgtggttctgcacatcctagagccggggttccagggaacccacaggggcgcggtgtctgtttgttccaagcagcatgtctgtggttgcaggtctgaagggattctttggagagaagggaacagaaggtgacatcggcttccctgggataacaggcgtgactggagtccaaggccctcctggacttaaaggacaaacaggtaaaatctcccgcagccacacagccttcctcaggcaggccctccggagaccccagaacaaaggcggtcaacattgtcaatttcctccaatcacacccaaccctggaagctcactcgtgcctgctgccagcttaggagctttcctcagtgctgatggcatggagagaaacaaccacctgggctggggggagacctgagaattggagagaagcatgggggtgaatgagaagtgcctcttcggttgagcctctgtctctcatatagaagccgacggtttgtaagggatccctttgcttgcattgaatatgcagaaacccctatgaacatcctaggttagagaaggagagcggacagtgggctggcttcccacgctgttgctgctgctgctttctgtgtttactcagcaccggggaatgccaagaggctcatctctccaggcactgcctcagggtcctctccagacgtctatttggataatagggcgacaattaaaactacacgctattttctctctggcaaggctgagcaaatcctattgaatttgtatgtggggtctaagaccacctgcatccccagcttgagggacagttctaatctctcctccaactggcactgcggcccttccggccctcggcccctcccagagcggctgcccctcctgccaggacctcaccacacagcgcccaaggtgtcctgtgtgctcagacttaatgctgtgttcacccccaggctttccagggctgactgggcctccagggtcgcagggagagctggggcggattggactgcctggtggcaaaggagatgatggctggccgggagctccgggcttaccaggtaaggtcacgtaaaacacgtggtcacccagacccagagtcgtgggctgtgcaggaggcaccgctgagcaggccagcctctctcagggcgacttctaaggcccatacgagagcaaaggcaggtctgctgtggcttacggtggtctgcaccaacatagcagcacagggtatactggcgccccaggcaactgggaatcaagccagatgcacaaatctgcccagggcttcacctcccagaaggatgaatgaaagcctcccagagaggcttcagggtccacttgtcatcgccacacagggacgcacagcaagatcagggtgcaggagcagcctcagtgtaccactgtgctgcacgggccacccccggggcctccttacagccccgagacgggccaccctgccatgctcactgcccatgtaacagaaggaattgccacctgtttgctgtgtcctgctttagaaatatttaccctcagaaatccagagggaatggaaatgacaccgggctatttgttccaagcagcttttacaaaccaaacatacagcagtggcgaggcgtcaagaagaggcatgggacatgtcactccccaggccccttctggcctagtgagtctgttaaaaagattctatgaagacagtgttccagttcaatggtgttcctaggtaacataagagtgcttagtttacatgtcgtgtaagttgagcgtgtggcttagctgcttcctatttgtggggctttagcaggattgtatgggtgacagtatcaggtgacagtttcagagccaacaaaacacatctgagttatcttgagggtttctcccacccagaaccccctgtgctgtcccacacatgaaataacaatgagtgacacccccacaggtgaaataacgatgagtgacacccccatgggtgaaataacgatgagtgacacccccatgggtgaaataacgatgagtgacacccccgcaggtgaaataaataacgatgagtgacacccccgcaggtgaaataaataacgatgagtgacacccccgcaggttttccgggactccgtgggatccgcggcttacacggcttgccaggcaccaagggctttccaggatccccaggtactctgtgccgtcccagccccgagtcccacgcagaggtgtcgagggtggggactctgtgctgagtctgccctccagacttcagggaatggagggtctcagagagcagggtgggcttcctgaagtgctatgcgatcggccgtgaggggcgggtccgggccctgtggtcctgtacgctgctaagatgtgatccctaagaatcggtttctcaaggcagttgctgggttgaatggactcatcaggcttttagacggagagagaaatagagtccttgctttttcagcagcaccgttgggagggtgggatgcacctgcgcccctcaggtgtctggagtgttcactctgcccattgcctgtctgtgatctttcattttgttggcctaaggaagccagcggtttccacctgcccctgggcagttctgatgctggagacagtgatagcgcttgggcacccacaggctgggagccaaaaacaaccaaaatgggtttcctcccagttctggaggctgggatcagcatgccagcgtggtcgggttctggggggggccgcgtcctggctgctcgctgtgtcctcacgagggagagcacccgctctcccctgtcacttcttataagggcagtaaccccatcttggggccccaccctcatgacctggcctaaccctaatcacctcccaaaggcccctgctccaaatgccatcacactggagttagggcttccacttaggaactttggggttggggagaatgacacaatcagtccatagcaaggtgaaccaagggcttcttaccacaggaaaaagaaactaacaactttcatagcactttctggcttattttataaactactgtagcacacatttttccctgaatggggatataaagactcattatttccaaaagccaatggcagaataaggtttccatcctgagcccttccagggtataataacagcaactggatgatcctcaaaaggatcatcagactttcccacagaaggcctccctttaaccctgtcctccccaagaagctgagatagcatagtgcaggaaggcttggcagcttcttggaacttctttattttaaattcagctattttcatcctaaattttaatgtccttgtcttttcatttaattttgaaatctattataggactaataaaataacatttgaaggacatcaggcactaagtggggaatcattttattattatgtctttttttcaaaagataaccttgttttcttttcaatttatacaaattatttatgttcagtggagaaaaaaaaattaacacatttaaacacatttaactcgggaggctgaggcagaagaatggcgtgaacccgggaggcggagcttgcagtgagccgagatcgcgccactgcactccagcctgggcaacagagcgagactccgtcttaaaaaaaaaaaaaattaacacatttaagaggaaaaaaagacccataatcctaaagctgcttttagaatgtgctgtttgtagacatttcatataaccaaatattgctctgtctacaggtgaatttgtatgtgtgtatattacacgtaaattcacgcactcctgcgtcattaacactccattacagttccagtgggcgagtggcgggaaatcctcgtcaagttgtcttgctgtttcctgccatgatggcgatgagcacctgataggagaagggggaagactttagatagtgtttactttgaaaacctaattaagcatagcctgaagagaagcccccaggagcctagaggcccgggaggggtcccagctccttgacccactgtttctgtgaatttgaaccctctgatgggcctcgatcctcttatccatagagccaagggcttccactgtgatctctgtaagatcccttccaaatctcagctcctgtgacctggaggccatatattgcaatgcaagctgaaatcaccatggctgcctctgtttctttgcttttgaggcaccccaagctgttctttcacttaggaaagtcaactgtatggttggaaacaccgacatcagctgctgttataactcttccacaggttctgacatccacggagacccaggcttcccaggccctcctggggaaagaggtgacccaggagaggccaacacccttccaggccctgtgggagtcccaggacagaaaggagaccaaggagctccaggtgaggccacacattccaagccaacattgccgtcccagtaaccagaacccacccagaggtggggccatggagtgtctatggggtgggagaggctgtgcagaagtgcaggaaagagctggtttttctggggaggactacctgttgcaggacctctcagctagtcttagtttgttaggcaatttattttatcccatcagtgttagtgaggcactgaccacccatcccgtggagtaactgataagctccctggcctagagaccccatcagatcctctgtgcgcctggggcactggcacaggccttgccataacaagcactctgggtagtgaatgtgcgaataaatgcattaaacctcctagcagagccacgctgacccatacttgggtaggaaatgcccagaaacttgtcttcccaccccatagcctccctgctcaccagccaaggtgggctcaagtctaaatggcagtgagaaacattcctagatagaaaccaggaccttcctgggagccagtctgccaagggtgttgcggtctcattgtgcatgagcccacagccccagagtctgctcctgagatccatgggcccctcccccaccccgcccacctcaccagcctgaccaggggcatctcctggctcaggtacgggagctgggcagcacacctggatggacagcctgggcaccctgggctccatgctggcaacagaaactctggcttccatccacaaaggcctgagtttttctagtgccaattccccatgaagctagaaccagacatccacaggagaggaagtcaggaccaaggaggccagcaaccctggcttttgctggggtgcagggatgtctcgaggcttgcagatcacatctcactctccaggatctgctgcctgccctctcccctcaccagcagctggaaactccagaatcccctagcctcagagctccacagcactgatctgaagataggagaaagaggaggggctctgccaacaggagccagactatcctgggaggctgcatggtgctgccagagccctagtcagggtgaggatccaggacagtccaccagcacagcctcagccagcggtgaggatctagggtcagtccaccagcacagcctcagtcagagttgaggatctagggtcagtccacgagcacagcctcagtcaaggatgaggatctagggtcagtccaccagcacagcctcagtcagagttgaggatctagggtcagtccaccagcacagcctcagccagcggtgaggatctaaggtcagtccaccagcacagcctcagtcaaggatgaggatctagggtcagtccatcagcacagcctcagccagggatgaggatctaaggtcagtccaccagcacagcctcagtcaggggtgaggatctagggtcagtccaccagcacagcctcagtcaggggtgaggatctagggtcagtccaccagcacagcctcagtcggggtgaagatctagggttagcataccagcacagcctcagttggggtgaggatctagggtcagtccaccagcacagcctcagtcaggggtgaggatctagggtcagcacaccagcacaagctccactgaggagtgagaatctaaggtcagtcccaccagcacagcctcagtcaggggtaaggatctaggacagtctaccagcataacctcagccagggatctagggtcagcgcaccagcagaagctccacccaggagtgaggatccaaggtgactccaccagcacaacgtcactcaggggtgaagatctaggtcaatccaccagcacagcctcactcaggggtgaggatctaggtcaatccaccagcacagcctcactcaggggtgaggatctaggtcagtacaccagcacagcttcagccaggattgagggtctagggtcagtccaccagcacaacctccactcaggactgaggatttaggtcaatccaccagcacaacctccactcaggactgaggatctaggtcagtccaccagcacaacctccactcaggactgaggatttaggtcaatccaccagcacaacctccactcaggactgaggatttaggtcagtccaccagcacaacctccactcagggctgaggatttaggtcaatccaccagcacaacctccactcagggctgaggatctaggtcagtccaccagcacaacctccactcaggactgaggatttaggtcaatccactagcacaacctccactcagggctgaggatctaggtcagtccaccagcacagcctcagtcaggggtgaggatctggggtcagtccagcagcacagcctcagtcaggggtgaggatctggggtcagtccagcagcacagcctcagtcaggggtgaggatctggggtcagtccaccagcacagcctcagtcaggggtgaggatctggggtcagtccaccagcacagcctcagtcaggggtgaggatctggggtcagtccaccagcacagcctcagtcaggggtgaggatctggggtcagtccaccagcacagcctcagtcaggggtgaggatctggggtcagtccaccagcataatcctcccaggagcccagcagtagagttgaccatgcccgtgacctttaaatcagacacctgttgggttcttgttctgcgtctcacgtgcaccatattttcaccatgtgaccttggccatggtattgaatgtctctggctttgtctgtcaaatgaaaataaaaatgcacttgtgagtattgggaggatacaatgagatactacaggtaaagctcttgcacacaggaggccagcaataaatgtttgctatctttaaaggccttgaaacatagcgttgttttcagagtgtcatgatgatcagtttaccagtctgtcacctgaaaggcatctgggaatgcagcaacggggaagacttggccaggagatgtggagaggagatcccgcacagggaggggcggaggaaactgagatgggatttcgacagggtgcacacagtggcccatagaggggggtcacagaacacagctgctagcattttgtatgaccatgcattgttaacgtttgattcacacagcatgatgttcaggccctgtacttgaccacaaaaaagatttaagatttccatccccaaggacagagatttatctcatttattttccacttaatacctcagcaaaatgcttgtccctgagtaagtgctcaacaaatacttgctggagaagaatattgtgaaattgtaggataattttctgacatcagtggagagttacgtgtagctcagaacacccctaaggtaacattgatggccttattacacatttgatctgtgtgggacccatttatcaaaactctccgtgacctcctgtggccctccttgcattccatcccagggacctggacggtgtccccggcttccaagccaccgtgcggcatgctgacttttgcaagccatgcccccaccctcgacctgcatgaacgtcacagtgggcccatgagctgatgacttcagagcaggtcctggaggccagggcagacactgcccagtgccattgggccttggcatatgaggccactgcctctggctagtgatgagggaaagacgaccttccatgatgacgttcacacactgatcataatgtcattcaggacacacactcttctctcaaaatatgggaataatttgaatccgtcatcttccttcgcatgagttgcatctcatttgtattagttcgttctcatgctgctatgaagaaataccagagactgggtaatttataaaggaaagaggtttaattgattcacagttctgcatggctggggaggcctcaggaaacttacaatcatggcggaaggggaagcaaacacatccttcttcactggcggcaggagagagaagtgctgagtaaagggtggggggaggccccttataaaactatcagatctcctgggaactcactatcacgagaacagcatgaggatagccacccccgtgattcaattacttcccaccaggtccctcctacgacatgtagggactttgggaactacaagtcgagatttgggtggggacacagccaaaccgtatcacagctcactgaagctagagtctgcaacctcacctatttctgcagctgacattcgagcatcagttcctgatttggccttgagtcatgcaacatgggccttcacggaacccctgttagtgagactcttttatgtcagtacttaggacgatccatgggggctactgagaaatcatagcggtttccgtctagattccagcaaactgactcatgtttgctaagtgttctcattaacagtcctcatcactgcagttaagttaattatgttttcgtgggaatctgccagtctgcggattgcactggatcatctaactcaggagtctgccattatttactgacactcaccatctgtttcgggtactttgtgacaatagctagaagcagttcaattggtgtcattttatatcaaactacagatggtggctcactcatgccctcagggctaatgaacccacttgcatgttgtctgtgatttgtgagacaagcctcacctctctaaatatttatcctgctgtttgttttgtcctacttggaagcacgcatgaatggaatcctttcccctgggatggataatggataccaggatcttccaaagggaaaatctcttcctgctgctgatgcgtgtagattagtcataaagccagaggggaaacagaaaaccactgttgctaccttttctcatttttatagatttgcactgtttcgcccagctcactatttcctgcagagcagaagtgatgccctccttgcccacttggacattctgacattttgcagggttctaatactaatcttggtccccagcccgaggtaaaacaaaaggctgaaggtgcttaggagagaaagtagacttaatccgcccactcaagtccacactgatttctacccaccactgccctacagcacataaagctccattagtgtcttgttggctgacagcacagggaggagtggaatttccacagatttccttatgtggccatttccctcttactctcctactagtgccaaagagctccagcctttgacccaaaaactgttggttctcattattcgcagtagttatgttctgaagtcaccaagaacactgacttagtgaatactgaaccattgctcctaggggaaatacaaggctaagttcctgcaagcctctgctcacaagatgtttgtcaatgatcagtatataagctggttttctgtgtaacggcaccttgtttagtgtggattgctgattcaggaacagtcaacatgcactcactcgtgcctgaatgcagcttctcttacatatgtgtttctccataagggacttcacagccttcttgcacttaccaacagtaggatgcacttcaacacaatacatggggggcatttgaaacagcaaaatcaccagcataaagcacaaaaatgtggaaaacagggcactacagagaccaagacaaggacacgtgtgtacagtatgagctgcagcaagaaggcaggagcgtcaccttgctggatctcagctgggactcattttgcctctgtgtatatctgtgaatgccagtgttgatttgggggggattccaagtgagttttagtgagtggacaaattgggaaacacagaatctgtgaataatgaagaccaactctatccaagctgggatccgaggcactggaggacagccgcagggagggttgacaatagtgatgtcaattgtaagcctcatttgcaatttttcaaccttctgtccatcacctgtgctgaccactgtccacacatatcaggatcagagtctgaccagctgtgcctcgcctggtgctgaggctccatctaagcatgatcgggcagcgccttggggaagtcgagcacaggcagacaggatcccagtggagggctcctcacaggagaaaggctggggtgggggaggggttcacatagcccctgcccccccaaccccgccctgagggcctccccagccccaccatgagatgttccttggcctgagggcacctcccatcactgtctcgctcgctaggctctggtccaccacaggtgatggtgtggagggaaaatagtagatttgaaaagttgggtgctaacgctgaaaataatttcttctgttttcatcctaaggggaacgaggcccacctgggagcccaggacttcaggggttccctggtatcacacccccttccaacatctctggggcacctggtgacaaaggggcgccagggatatttggcctgaaaggtaagcaggacttatacatctgtgcttcgacatctctaggggcaggagctggcaatggcccgcttaatgtagggggagaacagacgttcatttccacgctgtgcccagactccggtcaaagaggcaggagccatgatggctcctcctgtgtcatttccatcacctgcacgacctggtccctgggaagctgagacacaggccatgtcatttacttgctgtaatagcagatattcaaactgcagggggctcagaaatgtgcagtatgaacggctttcttcttcctcactgtattgtgtttagacaagtattaaatttaatttgcacttcctaatcacgaacgagctgaatattggaaagagatggcgtaaagatgaagtcacccgtcaaacaagtgtttgtgcgtcaaggttcacagcagcactactcacaagcaccgagtgctgaaagcaacccgagtgtccatcaacagaggaattaagaagcaaaatgcagtcagtatccacccagtacaagaggagtccgtcttttttgttgggttgttttcttgttttttgttttttgagacagccttgctctgtcgcccaggctggagtgcagtggcacgatcttagctcgctgcaatctccgcctcccgggttcaaggaatttttgtgcctcagcctcctgagtagctgggattacaggtgtccaccaccaagcccagatgatttttgtatttttagtagagacagggtttcaccatgttggccaggctggtctcaaactcttgacctcaagcaatcctcccacctcggcttcccaaagtgctgagacgacaggtgtaagccaccttgcccagcctttattcggtcttaaaaagaaggaactcttatcacctgctaccacctagatgacccttgagggcattctgctgagtgaaagaagccagtcacaaaaggtcggattctgtgattccacacatacgaggcccctgaagtcatcaaattcatagaaacagaaagtacaatggctgttgctgagggttggggggagagggacacggggagtgcgtgtataacggggacagatttcagtttaggatgagaaagttctggagctggtcggcggtgaaggtgaatatattgaatgccactgagcagtgcacctaaaaatgattaaaatggtaacttttatgttctacgtattttacgacaattttttaaaaacatagacaaagtcattccatgccacagacttgccagagactgtcgcctgaatgggtgacggtgcacctgactgcccccaggggccttggggccctgtttaaaccctcctttcttgtccctaatgccaacaggttatcggggcccaccagggccaccaggttctgctgctcttcctggaagcaaaggtgacacagggaacccaggagctccaggaaccccagggaccaaaggatgggccggggactccgggccccagggcaggcctggtgtgtttggtctcccaggagaaaaaggtaacagtgcccatggccatgggccagcagccctggccacagtgagaggagccccctccccacagactttcgtgtccctaacgtcttgtttgtgttgcagggcccaggggtgaacaaggcttcatggggaacactggacccactggggcggtgggcgacagaggccccaagggacccaagggagacccaggattccctggtaagtgaccgtctggtatcttcagagctagtggctcagcccagcctctccaggcttggggacatcctggaggtcaaacggccaggatcctctctggcatgggtcacatgttgtaaagagcagggaggaaaccaaggctgtgcctcggatgttgtcacaggaccttggggaatggagagcttaatattcaaacggcaggcgctgagtcacggctcaggcccgttagtgtctggctcatctctagaaagcacagttgtctgggaagctccaaaagaagcctccctggtgagaaacgcagtagcactcggagcaagagagtggaacgaccttgtgtgtttactggggcctctctgtttcccttccaggtgcccccgggactgtgggagcccccgggattgcaggaatcccccagaagattgccgtccaaccagggacagtgggtccccaggggaggcgaggcccccctggggcaccgggggagatggggccccagggcccccccggagaaccaggtagagtgctgagctggggcctggagcccctcggggctgcccgggcaaggccagggcctgctggcattgcgtcctcttgtgttctctttgtggatcgccggccgtgccaggcgtggtcagtttccagccataacgcttctttggtggcttgcaggtttccgtggggctccagggaaagctgggccccaaggaagaggtggtgtgtctgctgttcccggcttccggggagatgaaggacccataggccaccaggggccgattggccaagaaggtgagtgacagtggggaaggaccttcccaggtcctagtgctctggatctgactcacagactgtggtctgcaggaaggggacacacgagagcccagaaaagccagaaatgaggcgctgccccaccctcctgctcctaatctgggcgtagcagctacactcctatgcccagcagaacacctggccccgagtcctgggacagcctccctccttttcctgggacacctgcggtgctgtggagtgggcggcagggatcagtagacttcaagggtcaggattagacaaggagccaaaagaaaccgactattaaaatgtacaagagccgcactgcgaagccctgtcttacttttttttcttttttggacagagtctcgctctgtctcacccaggctggagtgcagtggcgcaatctcagctcactgcagcttctgcctcccgggttcaagcgattctcctgtcttagcctcccaagtagttgggactacaggcatgtgcccccatacccagctaacttttttgtatttgtagtagagacggggtttcaccatgttggccaggctggtctcgaactcctgacctcgagcgatccgccagccttggcctcccaaagtgctgggattacaggtgtaagtcaccgtgcctggtcgtcttattttttaaaattatttgcacatatacagaatgaaataggccaggaataacagctattcatgaaaaaaaaaaacctcaaaatttgtcttaatcaacctgagctcagtttgagccaatggtctgagcattaaaattaaaattaaaattaaacataggggccgggcgcggtggctcacgcctgtaatcccagcactttgggaggctgaggtgggcggatcacaagggcaggagatcgagaccatcctggctaacacggtgaaaccccgtctctactaaaaatacaaaaaattagccgggcgtggtggcgggcgccagtagtcccagctactcgggaggctgaggcaggagaatggcctcaacccaggaggtggaggttgcaatgagccaagatcgcgccactgcactccagcctgggggacagagcgagactccgtctcaaaaaaaaaaaagaaaattaaacatgggtagtactattggtgtccaagtcaaaggaaatagcagtcccctgcccctggggacagatccgcagccggcaaattatgggtagtgtggggtgcacctgaaaacaaatgccagcaaatgggagcccgcccagggtaggagacaagctagggatggtggaggggaagtgtcctgggagaaagggccatgaccatgggtgtcccttggaaggggaggggacaatgggagaaagggtcactggggatagctgagaaatattcacagagctgctgtgctggaggcagatgagccacccccgtgtgctcctcgggtaggagttacaggaggctgcacgcagaaagaacattctaacccaggctgtggtcaagtgcgcagtcagcatggcctgcgatgagccatgtctcctggaagtgtccagcggagggaggccactgctgggggtgggggctggcctgcgatactcctccggacacttccaacgccaggcacgttgggcacatcctgaggggcacatgcctacctatggctgactgagtcttttatggaaaggacccctcctctgtgcccagtgccctcactgccatcatttcatgctactgagaacaaagtgtggatcaaatccttcccaagagtctcctgatctcaacagactgagccccaagatctggggaaggagagcgatggttctaggcgcacctggaaactgccctgcactcctgggtcccgaggtttctgtggggcggctgtcaagggggctgctctctctctctttctcaggctgcaggtgcactaggccgtccactctctctctctctcaggctgcaggtgcaccaggccgtccactcactctctctctcgggctgcaggtacaccaggccgtccactctctctctctctctctctctcgggctgcaggtgcaccaggccgtccactctctctctctctctcaggctgtaggtgcaccaggccgtccactctctctctttctcgggctgcaggtgcaccaggccgtccactctctctctttctcgggctgcaggtgcaccaggccgtccagggagcccgggcctgccgggtatgccaggccgcagcgtcagcatcggctacctcctggtgaagcacagccagacggaccaggagcccatgtgcccagtgggcatgaacaaactctggagtggatacagcctgctgtacttcgagggccaggagaaggcgcacaaccaggacctgggtaggtacctcccacccggcccccgttgcctgctcagggctggcccggaagtggccaagatcaaagggccacagcgagactcccaaaccctccacggctggtaagttcccctgacggaagggtccatctacattcctcgagtgcagaaagattaaaacggcctttgaagcagaagccttacaaagcccttaaacctcaggaccttaacacagggacctgccttttaacctggtattgacttccgcaggctcccatgtgacccgtctgacccccgacccctctccagtggagaccaccaattacttcacctccttcttgtttttgacccaagttctgtagacttggagtcaggcaggggccatgaggggctggggttcatgtaagactctcccatacagccccccgaggaaaatggacccatggacacgtgtgcatgctcttatttaaggaagcctttgaaaggcattaacgcgacttcgaatacagaaaatgcaatacacacaaattacaagtggaggtagcttagtctgaggtcctctttgagggggtgacgggaagggtctctgggatactggctgtgttctgcctcctcggtgcaggttacatcaggcgttctgcccccgggaagcatgttgctggctcatggtgccttcacattcctgcctgtgcgccccgcctccacaatgagtttctaaagaacaacggggcaaaggccgccaaggataagggccaaaaatagatctaggaacagggccaaggaggcagcctagcaccgggcatgtttgctaaaggtggctgcacttctgggtctgagcttttcagcaatccatgtgaagagggaaacctgcttagctgcagcattcgttgtggccaggagataaaggctatcttagtctccagaagcaataaagctacatggaagggagaagggccaggactccttctggggtggctccttggggtcaaagagcgaccccttggaggccatcagagttttcttggggccagtgctgttaagaccccactaaggtaaggctcacccaaaatgctattccatgaagacgccactccctggtgatccaacttggcccagtatgtgtgagaacttgtagaagaacagagctgttccaaaatgccagtggagtctgatcaaaaagagaaaaagaaagaaattgggaagccttagcctggccctccagtaggtggctaaactccaccaggtgccctggggcgagtccgtgacacacagcctcctgggcctggctggggctggcaggtgcgtcttctagccacactgcactgtgatctcatgacccctccttccacagggctggcgggctcctgcctggcgcggttcagcaccatgcccttcctgtactgcaaccctggtgatgtctgctactatgccagccggaacgacaagtcctactggctctctaccactgcgccgctgcccatgatgcccgtggccgaggacgagatcaagccctacatcagccgctgttctgtgtgtgaggccccggccatcgccatcgcggtccacagtcaggatgtctccatcccacactgcccagctgggtggcggagtttgtggatcggatattccttcctcatggtatgtggtatttgcccagttcccctccccaaccacaccctgctggggacacagcaagaacagctgcctttgtgagaagaatcagacacggcagtccagggtgtgcactgcacaagggtagttggcccaggaagcgagcgagagctggaacacagcttacacttggctaactgagccacatgctgggcacagggcttcctccacccagaaagggctcattaatttgccaccaggcctttgtaaggagtgtaaccaggacgaacttgcctgttatccgtcttactaggtacaacaccaacaccaaaggtgcagctgctttgggtttaccagaagtctaaatatatgggagacttttctctagaatcctgatcttatttagaatctatctggaacctagaataccctgaagaaatacctattaactggctggcttaaaatggatatatattcgtgaggaaaattctggaatacctttgggtataaaatagagagcctgtggatactttgaaagccaggagaaggtgcacaaccaggacctgggaaggcaccgcccacccttccggatcgcctttgggtataaaatagagaaccctcagctttggccagattaggtttagcttaacctccaggggagagaccacagcaccatagtgtctcttgcaatattgcctattaaagcagaggctcctcaacttggaatagggtcccgtcccgataaattcattgtaagatgaagatactataagttgaaagtgcgttttcaatttatgatgggtttatctggatgtaaccccaccaaaaatcaaatagtgaattgaatacatattgcttttgcaccatcgaaaactcaaaaatcctaagtctaaccatggtaaatcagggaccatctgtatactattgtagggagaaaagaaagtctcactgaggacagtgggtcttccagtgagtttatttatatgcattataactgtcataactccagctatatggattggatgcccagcatgttaaatatttcataaattatatatatatatatatatatatatacacacacacacacacacacacacacaacataaaatataaattacatagtgattgctaatctttcaaaacaacaggaaaaaaaatccggattctaggaaaggaaggaaaagataaacaagtattggcattttaataggtatcgttgctatgataagttggagcaacaggatgctaaatcctgggcagggacaggcacaatttctacctttccagaagcttatcatggaaggtgactttggagcaaccttcttttgtttcacagtgaccttcagggtgcccctgtgtcaggaagtaagctttggttgctcctgtttttttcactcccgttgttaaattcaaaataaatgagcctctcccttgtgaagggcatgattacacagtatccagaaaggtcaggcatcccctgttccattagcatcaggtttcaaatgactgtcacgagataagcagacattatcctctgcacacgtaactctctgcttacataaatggctgacagccccagcaagcctggaacttgacatccccaaaaggcatgggttgagacggctcctgggtcaggacagatgggccagaagtaccttgacttctgagaacagaaagtccccattgtccctgacaatggataagtgagcagacacatctgtgtactggagatgtgccccctccagatgtgccctgactgccgtctaggaggcaggacctaaaccaagacagctgtgtgcctcgtctgcactttaaatactctttgatcccttctgtgtggtgacaagcatatggtaccactagggctgctggcatctcagcataataagagctgactttggagaggagaggacagcttggctgagagcaactgccccaccgtccccagtgggtacgcagaaggcgagagcagtgctgaggctagcgcctggctcacccttcttttgtccgtgaggatgggtggccccagaggatgcattttctgcattccctacaagcgagcgccacgtgggagggaggacaagggcagagccccggatgcagactgcagcagcaaaagtcattttcctcccctcccctcggtggcctctctcaaagctgctctggcagaggctacaagtatctagccagccgttattttagttcctcttttttcaattctggctactatctggagccctcacagccccttctccaggtcagcctctcgtccaggcaattctcttaagatacatgagctgctatgagtaccaagccagaggtttgtccactgagagaagcacattggaaagggtgcgtgtgcctggactgtgtgcacttatgcacgtgtgtgcataggggtgtgtacacaagcatgcactgtgtgtgtgtgtgtgtacatgcgtgcatttgtgtgtgtgcatgagtgtacaccatgtgtgtgcatgtgtgcatgtatgcatgtgtgtgtgcgcagcaaactcagctcttacctggctggtgccagcctctaagacttctcacattgtgctcccttctgacctcgttctgggagtcccaggtgtctcctttgggcagctcccagcatggcctcagctccttcagaccaaagtgaagccggaggtgccctggaggacgtctccacttcttattacctgctcattagcagacaagagcaggcagctcagggctggacaggcttctgccttatgtgagcagaacactttttaaaggtttttgggtttttttttgtatttaaaggaaagcttaaactggggcccctgcccaaatatatcatagaacagccccttttttccctgcaaactgaactgagatatttctattctaagtaaacagattccaaagcccacttaccactcaaagcctgctcagccaagccaaatggcccttatacaccaactctgggatccaggaggcctgccgtgcgcttccataaaggctaaacatgttgatgcaacagaaagtagaactttaaaatgaaaaaaaaaaaaaggcttccttgaagacctcagccatctcccagccagcctcagaatcaactatttaacaacctctgattgaaaaaatatatatttaattacacaagtaatacatatttattgtgaaaaatcagcaagtacagatttaaaaaaaaaaataaaaccactcatctttcctccctgatcatcagcattttcagagaaggagctgggaggcctggctgggtgattatttttaacttattagcctcagatgccagcctacatcttaattttatttttttcttctaaaaagagtaaacattgtgttatctcttctgccaggtatttttctttgaatggatgattaggcagatgttttgttttgttactgaaatgcagtggattatatctaccgctcgtatctgctgtcacggctctagttcttaccgaacggccagcctggctgtgaattagtgtccatgcagctgcctctgcagcacgtcctggtgcctggggctgcctcctgcagggggcccatgtgtatttcaccagccccctcttgctgaaggcgcattcgcgaggatgcctcatgtccgtattgacactcatggtttgctgttcagtaaaaacaaatgcacagaagagggctatgccctgaccccgtgccacctgcaggctgtgattcctaaccctgtcctgcccccctctctgtgcagcacacggcggcgggagacgaaggcggtggccaatcactggtgtcaccgggcagctgtctagaggacttccgcgccacaccattcatcgaatgcaatggaggccgcggcacctgccactactacgccaacaagtacagcttctggctgaccaccattcccgagcagagcttccagggctcgccctccgccgacacgctcaaggccggcctcatccgcacacacatcagccgctgccaggtgtgcatgaagaacctgtgagccggcgcgtgccaggaagggccattttggtgcttattcttaacttattacctcaggtgccaacccaaaaattggttttatttttttcttaaaaaaaaaaaagtctaccaaaggaatttgcatccagcagcagcacttagacctgccagccactgtcaccgagcgggtgcaagcactcggggtccctggagggcaagccctgcccacagaaagccaggagcagccctggcccccatcagccctgctagacgcaccgcctgaaggcacagctaaccacttcgcacacacccatgtaaccactgcactttccaatgccacagacaactcacattgttcaactcccttctcggggtgggacagacgagacaacagcacacaggcagccagccgtggccagaggctcgaggggctcagggcctcaggcacccgtccccacacgagggccccgtgggtgggcctggccctgctttctacgccaatgttatgccagctccatgttctcccaaataccgttgatgtgaattattttaaaggcaaaaccgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgtccccactgccccacgttgtccctgagatttaacccctccactgctgggggtgagctgtactcttctgactgccccctcctgtgtaacgactacaaaataaaacttggttctgaatattttt

SEQ ID NO: 37581 - DNA, 205741 bp, Homo sapiens; identical to SEQ ID NO: 37580

SEQ ID NO: 37582 - DNA, 108261 bp, Homo sapiens
acatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccgggtgagtgcccaggccctttctccaggcaagctgcggcgccagggtcccccggggtcgtgggtgccggcagggaccgggtcctgcctgtgctcgccacccttctccccgccccaggacctagcctccccgggctccgcaccacgctccctaccaggggttttcgggtgacagggttaagcgccttcagaaggtcacggctgtgggcatggcctgcctccggcttgaatcctgcccccgccacttcagcctggaccttactgccctcggggtacccatggtcaacgaagatgaggggggctttgaagactgctttgggaagtcgggtggtggtcttttccttacacttggccagcttgggtggtgtcccacgtgcggtcaccgttggtgatcagtaaccacctagcatttagatattggaaatttagctttttgcgagggatggggcggcgaggagtgggttgggagtttgggtgagccacggatgacttaaagctggacgctggattatgatcactttgggcttttgcctgcgttctcttgaatggagttttccttcagcatttaagaaggtgttgcgcgagttgggctggagtgcagtggcgcgatctcagctcactgcaacttccgcttcccgggttcaagcgattctcctgcctcagcctcccgagtagctgggattacaggtgtgcgccaccatgccaggctaacttttgtacttttagtagagactgggtttcaccatgttggccacgctagtctcgaactcctgacttcaagcgatcctcctgcctcggcctcccaaagtgctgggattacaggtgtgagccaccgctcccgtcctgtaagtgtctttgaatgaatgagcacatgcaaggcactctgttggaatctggggatgcaaaggcaagttaaactctaagtgggtgtcagataggcgaataaatgctctcatggtttgaggtttatcagagataggtttggtatagacttttgtagtggaggggaaaagaaaagttggtgaaagtgttcatttggttattaatagtattctgaccaccagagaaggggagataggtgctgagcttttagcattggagaaaaaatgattttgaaagactgatgcttgtaaattaaggtactttgagagctcgcgtaaggactgagagccagggatctgcagtaggctgggcccagactgcagcctactccagatttatctgcattttatcctcaaattatctgcattatgccattagagaagttacttaacatctccaggcctcagcttccttagctataaggtgggagtagtagtagtgttaggaatattgcagaattatctgtattaagcacttagtatagggcctgatgcctagtaagtgctttgttggttactacaggagtcataatatctacggttatgcggaccttcatggaccagcctgaacacctaatctcgccataaaattacgtggaggaaataatttatgatttcttaacaacttagttataatctttggaatggagcgtacttgtaatttggagtctgcctatattttcttattgggcttgaacagttaactttccgaaatcatgcctctgagcacagaactatatacatctcttggctttcagagtttcttttgagaaagttgtgcccattactcttatttttctaatcctcagcatttctgtgaggccaggggaaggtccacattttcttttatcttcactgttgcatttgaggagaactgaataaagagagaacatagtttagtagaaagggtggtctcggtgttcatcagacctgggttctgtttacttactgcgtaatctcagccatcttactaacctgtctgttcctcagtttcattatctgtaaaggcctttcccccttatctttgtaaagttgctttcttatcattcagatctcaaatgtctcttcagggaagccttacctcaacactcaatccaaaacatgccggtcccactgtagatttattcgtggcacacctcacttgtctgatatcattacttatttctctggtttttttttttttctttagtagaaggtaagctatatgagagcaggactttgtcttgttcaccactgtgtgttcaggtgacagcaggcaataaagaagtgattgttccctctttttcctggactctgagcactgtatatagtctcctacccgacatcctgtaagcatgcccagatcttgcccacgtgaaacacagaacctttcctggaactctgtttactctagaagtttctcagtctcttccctgtccatacttctctgtccctttaatttcatcacttttcattcactttcctatccactgcagtcacaccgctgtcaaaggccattattatcttattgatttttttattgtatttttgaaaaattatttcaaaagtgccttgaagaacagttgcaaaaattattccttaaggtgcctcgagggacagttgcaaaacctgggtggtgggaacaataaactaaaaatcacccttaattatgtcaaccagagagccattcattgatagctgtccttctaatgacttatgtatgtgtaagatgtatgtttatttaactttttgaaaggacctcttttaattaccaaatccactttttaggccttgacctggcatattactctgtcttccattttccccttcatgagacacttttcttggtattgatgacaccatttttctaggttctcttctctttaggatttgtctcatttgcttgattcctcttgcttctgttcacctattaaatgctgatgttcttggtagttttactcgtggtccttctgtgttttctcaacattttcattctcttttgtgaccttttccatttttcagggcattacttacctatctgatgatgtttctcccagatatggaccatctactacacatccacctgcttgaactataggtacttcagagccaacacagctcaaattggacccctccttcttctttcatctgttcctcttgtgttccctattttcgtgaatgttgctgtttctacctgccttccagaaagatcctggatatctacatatttgttttcccattcatctctcactcccttcaccccccatttattgattgcacaaatgattaagccctgttagatctgcttcatttggaatgcatcccttttcctccagccccttcatcattccctagtctccctgataatttgatcatgtcattttcctgcttacacttaagcattgtggtggctcccattgggtccagaaggagatccagactctttagcacaggtgctttatgagctggagttgcctctggagcgtcaactcttctgagttccctcccatggcatcctgcgttctagccgtaccagactactactttgaagtgctctacagcagggcttctcaaactctagtgagcatgattgcctggggctctcgttaaactgcagattctgattttgtaggtctagtgcttgtctgtggatctgtaaggctttgatgggccatgttgtatatttccttgcctttgagtgtaatgttgactcttggaatgtgtctccccttcccccttagtcaggtgtcccccatctctgttgaaccttaacttgactgcctctcccatttgactggctcctttcttgtgcctcctcttagaccgtgtatcactaaagcacccattaacactatgacgtgcactcaccaacactctggagctggctgtaagttgcttgaaggcagatactgtgtcttactccttttgctttccctggtgtttaactttgtggcatatagtaggtgtcaaatgtttgttgagtgaatcaatgaaaatcttaagacattgaagaaggaatatggtaaactggaggagattgaagggatgcttaacccacccatgcagtgcagtgtgtctacacaaattcaccctgagcttgatttccaggaatgtcctatttgaggacaaatgagtattagtgagtgaaattattagacattagtaatctgttttcaaaattgtagcaccaagaagtatatccttttactttgtaatatgtggtcttgctcttcattttcccatctcagtacatctatttttcaaatagatgctttctggaaaaccagcttttactctgttctctttgaggtgataaatactcttgctttgtcacatacattttccttgcatttctggatcagagctgctttgtgtgtgtattctttgtgtgatggtttttagcataatacttgtatacttcagaggaaagataagctttgagctcaatctgtttggaagtagatctagactaatgattggcctaaaggtgaaaattacatattgttctttgatgggatggtgtgatttttatttctaaagttggaagaaaacttttagaaaactctcattttagaaaaatcttctgcaaatattaagaatctgatgggtccggctgggtactattgttcacacccataatcccagcactttgggaggccgaggcgggcagatcacttgaggtcaggagtttgagaccagcctggccaacatggtgaaattctgtctcttactaaaaatacaaaaacaaaattagcaatggtggcgggcgcctgtagtcccagctactcgggaggctgaggtgggagaatggcatgaacctgggaggcggagcttgtagtgagcagagatcaggccactgcactccagcctcagtgacagagtgagaccccatctcaaaaaaaaaaaaaaataaaagtatctatacataagttagccaggcgtggtggcccatgcctgtaatcccagctacttgggaggctgaggcaggagaattgcttgaacccgggaggtggaggttgcagtgagccgagatcacgccattgcactccagcctgggctacgaagcgagactccatctcaattaaaaaaaaaaaaaaaaagaacctgatgggtcctttggggttctgaaatctgtaacattcggcctctgctctgtgagtgtagatttatcaatcacagggctagacaggcacatgtacaactattagacgtgctgtccataagagaagaatataatattgtggtatttcagagagaggagcagtgccatttgttttatggcagggggacattgagttttagaggacacatggtagtggatattcagaatgttccaaaaatagagaagagcgtgaagagacttggaggccgtttatcccgtgtagctgtgtgggatgtggtggaagttgatttcttgaggctaccaagattgcttagaaggtaggttagttgatgattggaagccgttggaggattttaagtacagattttgacaaagtttatgtagattataggaacgtggggatggaacaacactggtattgcaaattagcagtaataggccttcaacgaggtagtaaagaactgacgaaaagatccgtttcttgagagaaagagaacagaagattggtgagagtgttagcagaattaagaaaagtagatttggggattagggtaaacaatggtacctttagaatagatgctgattactttcttttttttttgagatggagtctcgctctgccacccaggctggagtgtaacggggccatctcggctcactgcaacctctgcctcccaggttcaagcgattctcccacctcagcctcccaagtagctgggacgacaggcgcatgccaccatgcctggctaatttttgtatttttagtagagatggggttttgccattgccatgttggccaggctggtctcgaaatcctgacctcaggtgatccaccacctcagcctcccaaagtgctgggattaaaggcatgagccaccgcacctggcctgatgtttattattttcaaagtgtgtttgtaaacataacatcatacaaacatttcaacttccgtgggttattacaaattaggaaacagggttagaagtataatttattcaagacctcaagttgagattcaactccagataccgtgattcccgtttctgaaatgttttacatatgttgcaacatatgttacaagtgttttacatatgttacacatttgatcttgtcattttcctgtttacagttaactgccatggtagttatcattgggtgcagaatgaggtccagactgttgtgttttagatggtgaagggattacttatggacaaaaacattttttaaaaggcaatatatgatataaacttgggatttaaagactttcacaggtaagtaaacatagaagatctcagaatgtatctggaagggatcttcatagattctgaagagtgtccatgtcacattatcggtcccaatctggttaactgactttgcattacttcctccataggtgagacacaggagacatcccatttgactggaggatcctgggagatggaagggaaatctcgataggtggaaaggagtggattggtatttcaggccagaaggttgttataaagtgtagaagggtggctagtagcttttttagtctaaaattctgtgatttaccataaagcataaaactggggcagctaaatttgtcaaaagtttttggagaattcagttcttagagggagaaagttcattgtgacttagttttataaaagattttttaggccaggcccagtaatctccgcactttgagagtctgaggcaggaagatcacttgaagccaggagttcaagaccagcctgggcaacatagtgagactcctgtctctagaaaaaaagaaattagccagctgtggtggcatgcacctgtagtcctagctacttgggagctgaggctgaggtgggaggattgcttgaggccaggagttcaaagctgcagtgagccataattgcaccactgcactccagcctggacaacagaatgagaccctgtctcaaaaaaaagataaaggaaagatattgtaaaaactcagaggcatttggtcaggcgtggtggctcatgcctgtaatcccaacactttgggaggctcaggcgggcggatcacgaggtcaggagatcgagaccatcctggctaacatggtgaaacgccgtttctactgaaaaaaataacaaaaaaattagctgggcgtggtggcgggtgcctgtagtcccagctactccggaggtgacagagcgagactccatctcaaaaaacaaacaaacaaaaactcagaggcatttattgagcaccttctataataagacagctattgtttattgagcagtggcgtctcttttctttcttgttagacggagtttcgctcttactgcccagattgaagtgcagtggcgtgatctcggctcactgcaacctctgcctcccaggttcaagcgattctcctgcctcagcctcccaactagctgggattataggcatgcgccaccatgcctggctaagtttgtatttttagtagagatggggtttcttcatgttggttaggctggtctagaactcccgacctcaggtgatccgcccgccttggcctcccaaagtgttgggattacaggcatgagccactgtgtccagctttttttttttttttttttgagacagagtctctgtctcccaggctggagtgcagtggggcgatcttggctcacttgcaccctctgcctcctgggttcaagcagttctcctgcctcagccttctgagttgctgggattacaggcacctgccaccatgcccggcttatttttgtatttttagtagagatggggtttcacatgttggccgggctggtctcgaacggacttcaagtgatctgcctacctcggcctccaaaagtgctaggattacaggcttgagctaccgtgcctggcccgttgtttcttttcttaattacatttaccataattaatatttttaaaggtctaatttattagatttattactagataagaatattctagccagtgccttatacatagaaagcactcagtaaatatattttgaattaataaatggaagaacagaattgatgtgataagtaaagaacaatgataggatttttgaaaaaagatggttttgaggatggttgatctggcagttgtatgaagagaggctgaagcctgagaaactaaagatttgttgcagaaatccatgagttcatcaagagcctcagacatctaagcactcactagatgggatgtaaaggctgagagactttgcccaataaaataattagtctaagattttgagtttgagtttgtgggaacagggtattagtggaatggttggttgcagtggagaaatttgaagggaataccaaccttttttttttttttttttttgaggagtctggctctgtcgcccggcctggagtgcagtgacgctatctcggctcactgcaagctccgcctcctgggttaacgccattctcctgcctcagcttcctgagtagctgggactataggcgcccgccacggcccctggctaattttttgtattcttattagagacggggtttcgccttgttagccaggatggtctcaatctcctgacctcgtgatctgcccgcctcggcctcccctaagtgctgggattacaggcatgagccaccgcgtccggctcattaccaaacatttttaaaaggcattatctttttgcattttggatacatttaaaactcgggaggctccagcagtatataaaaagaatgatttaccgtgatcaagtgggatttattccaactgtgcaaggctggttcggcatttgaaaatcaatccacgtgatccagcgtatcaacaggctaaagaaaattcaagtggaatagttaaattagggattggtgaaaacgtaggagataaatttgagttccccattttctacattacagtgcaacaaaataagttgagagagcggctctatgaaaactagttttgtactttacaagtgtgtcataaaatccaaatcccttatttatctgccattagagactttgcactgtctagtctcactctcactgtctaggtttaattttttaccactttccagtgtgaacacccaattgcagccagattagtttcttcaatgcccttttgccacgttgagttcgtttcagaatgagaccgtctcagaatgagaccgtctgagtgctaaccctggccctatcattagccttaactgtgatgactttgggcaagttgcttcagttttttcatttgtaagttataattttctcatacccagcacaaattaaacacctgataaacattagctattaataatgcctcttctgtcttctacctgtatctacctttaaactcttgatagctctaaagtgacactaaactgattcataatatcagtgaagaagaaaaaaagtggagagaagagttttaagaacgtgtatggcctgggcatggtggctcatgcctgtaatcctagcactttgggaggccaaggtgggcggatcgcttgaggtcaggagtttgagaccagcctggccaacatggtaaaactccgtctgtactaaaaatataaaaattagtcgggcatggtggtgtgtgcctgtaatcccagctactcaggaggctgaggcatgagaatcgcttgaatcctgaggcagaggttgcagtgacctgaggtcgcgccattgtactccagtctgggtgacagagcaagactccatctcaaaataaaataaataaaaatgggcagaaaatacttcaccagaaaagacatatagatggcaaataagcatacgaaaagatgttcaacagcttatgtcattagagaaatataaattaaaacaacaatgagataccactatcggaatggcaacaatccagcaaaacgtcgaaaaccccaaatactggcaagcatgtaggacaacaggaactctcatttattgctagtaggaaagcaaaatggtatagctattttggaagatagtttgatagttttcttagaaagctaaacatagatttaccattaggtatttacccaaatgagttcaaaatgcatgtccataccaaaaccttcacacaaatgcttatagcagctttattcataattgtcaaaaattggaagcaacctggatgtccttcagtaggcaaatgggtaaacaaatcatgtatatctacaaaagaacattattcaacaatgaaaagaagtgcgccgtcatgctgtgaaaagacatggaggaaccttaaatgtgtattgctaggtgaaagaagccaatctgaaagggcagcatgctgtatgatgcaactatatgacattctgggaaaggcaaaactagagacaggtaaaaatcagtggttgccaggggttcggaaggagggtggaaggaatgaggagatagagcatggggcatttttagggtggtgaaattattttgtatgatactgtaaaggtggatacatgtcatatgtttgtcaaaacatgtatacacacagtgaactctaatgtaaattatggactttggttgatggataatgtatcagcattggttcatcatttgtaacaaagatactacactacagcaaaatgttactaggggaaatgggagggagaagaaagtgggaactgttctttcagtacaatttttctataaacctaaaaacactaaaaaattgtgggtttttttctagtcagtctctgcttatcaaaaaattgtgtttattttttaaaaaaatggtacatgcttaaaagtagtggggagggtcccatggaagcctgcttagtaggataatctgatcccttatatcttttttttttttaatggacattcaactataagatcgttttctattgaagagttaaaaaaaaacccaccttaatttttttaaaaaaactgagagataataactttaaatggtagattttacaagaaaacatttatgggtaatttgagtattagtggtaggagctggagtctggaaggaacctgagacatttaactaggaaatgtaaaggagccagtatgatacttggatgagatgatacaataatttccccttatgtggttatatcaattttggtccttagcatttggaggcagtgagctccagcttgtgcaagcctggtgggtgtgatcttcttgtggggccccaccgtcacccctggacttgttctgttctttcttttctgtgacgacatacccattactccaggctgtgaaactcttgtttccagaatgtattagagtgaatttaaaaataagttctggaccatataactgaagagtgaagacttctttggttaaatatgtaatccttcctctatcccaatttattttataatagattcatgtttctacttaattaaatccaagcacacttatgagaaggagactcggctgcagtaaagacatgtatatgagaaaaatttgcctagaatattcagaacaatgtgctagtttataaacatgttttctgcctgaaatttgagttggtcttctcttacatttaaaaaatatcctgtagcggaagttttatttttgctctttaacagtttatcagatttgcattgtgtaaaaaactttggcaaatagacttcacaattttgaaatttctgtattaatcagcttttgttgttgactaatattattgcatactcctccaaacttgacatgttgtcctggacagtttaaaaataatgtcactttgtgcttgcgggacattaagaaggggatagtttagtaacaactgatagagcaactagataaatgccttttggaagtaagggataaatattattttaagggtatatcttctgtggtttgtagcttaattcagctcgtttgacaaactcgagtcaattagccatctacaatgtgctgatcattggtcttacaaaaataagacattgtcttatttagtcagtatcttgattttttccattattttatacctagatggtggaatcactaatggttagagtcatgatttctcccagatcacagtggtagaatttctagtctattatcaattacagcctcgttttatataaacttgaggtgaaacctctagtatagtttcctttagtaaaacaacacatacttgatcattcaatttgtgactggttttttcagattaataacataggatagaaatgtaagttttatttttaaagtcaccattgtgatgaaaatgtgtacgtctgaaaaatgtgattatattatacttagttgttatatagtgtataatatatttagtggctgctgtaactaagatatttgcaataaatgtgtaaaccactgataattagaaatcatttgttaaaagtgatgtttaaatgcagagaaagcatttttaaattcaactcagattgataacaggtttccttcacacataagaattattttttatctgatatttttaaatcaggtacagcttatatttttacctagaatagcctagagaagaaagtatatgggaactctacttaatgcacgatttttctataaacctaaaaatattctaaaaattgtggtgttttttttcctagtctctgtaaaaaattgtgtttattttaaaaaaaggtacagcctagaagccctcagatttcatgttagagagcattcgacttgcatattagactccattactaaaatagtgaatggtttaaagattgcttgctctttgtaaacacataatgtactattctgaccatacctaatttgtaatcatttttctttccattctggcttccttaaaattaatgatgtttaacactttatttatttttggtggcagttgttttaaataattaggaaagaatacagctaacattttgacagttgcacagcagataagaattaagagccttatcactattaagtgtttcaactttatttagacagattagaaattatttgggcctaaatgatccttaaaaaaaaaaaccctgcatcgttttagcctggacattggtcttcttttaaattcatagtaagcttatacctagaaaacttaaaggtagttataaaaattttggatatattttagatctcttgtcttatttacagagatgagaagagctttgcagcataaactgcttcatcttctgtcattaccttgttttggttaaggagagatttaaaaaacacttaaaacacactgtatttccatctgattttgaaatcattccatgttcaaagttaccaagatgttgtcaattattcaggagatttactgtgcatatagtttatgtatgtgtgtatatgattttatctaaagtaaaagctaaaactttctttcccattagttcatacctctatttttggtattgtactgtgattttaggtgtttaataactaattttaaaatttgtttaagttttgttcaaaaaatgacctaaatagatagcaactgattattattaattatgtttcattttttagaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtatttcaaaatttcctgttcataaagttgacttttggctggtcacagtggctcaggcctgtaatcccagcactttgggaggcaggtagatcgcttgaggccaagtgttcgagaccagcctggccaacatggcaaaaccccatttctactaaaaatacaaaaattagccaggcatggtggcgcgtgcctgtagtcccaactacttgggaggctgaggcatgagaatcgcttgaacccaggaggcagaggttgtagtgagctaagatcgcacaactgcactccagcctgggcgacagagagagacatctgtctttaaaacaaaaaaaaaagtcttaaatttaggttggtgcaaaagtaattgcagtttttgccattaaacataatggctgcaattacttttgcatcaacctaaataaatacttgagggtaagctcattacacagtagattatttgatactttaattttctttgttatattctgttgattgtcatttatgttatgattgtgatttctatcttgtcaactcatctgggcaaagtttggagtaactaaaacatttttagattttttttttttgggatggagtatcgctctgtcgcccagcaggctggagtgcagtggtacgatctcggctcactgcaacctctgcctcccgggttcaagcaactctcctgcctcagcctcccaagtagctgggactaccgatgcatgccactgcccagctaatttttgtatttttagtagggacggggtttcaccatgttggccaggctggtctcgaactcctgacctcgtgatccacccgccttggcctcccaaagtgctgggattacagacgtgggccaccatacctggtctagatgtttattccatatcagaaaataaaaattgtctttttgcttttcctagtttatggagtcacttttagtagtaagtttcttggaagataactagtttttcttaccttccattgtagagtgtcaggtttctgtaagatgatcatataagacagctttccattattttcctttcattttcaattagctactaaaaatctgtttgagtcactaatgcctgatgcaagctataggtctttcactccctgcccccgacccccaaaagcctcatgcaaacatatgcataattttgcatgcagtttaagaggattctgtagcttcctaaagcctattcgtgggtttcagacacactcagaagtgtagatataaaatctgatggtgagagataccaaagaagtattaattattactatagttatgtacatttaaagacctgtgtcacattctctctctgacttatttattcaaccatcactacaatcagttttggaacattttcatcaccccaaaaagaaattacccaactcctcatcccttccagccgtaggcaacaactagcgtattttctgtccctgtaggtttgccctactctagatatttcatataaatggaatcatactaagtggtttatttttgctttgttttaaagtcagctttcagggatatgtagataaagcttacagatatagggagagggaagcttatattgtagctgattatgaacctaacttttctattcatagatgttaattacactgctttacagtattctttctttctctctctctctctctttctttctttcttctttttttttttttttttgaaacagagtcttgatcttgttgtctaggctggagtgcagtggtgcaatgtcggctcaccgcagcctccacctcctgggttcaagcagttctcctgcctcagcctcccgagtagctagaattacaggcatgcgccatctcgcccagctaattttatatttttagtagagacagggtttctccatgttggtcaggctggtctcaaactcccgacctcaggtgatctgcctgcctcaacctcccaaagtactgggattcgcgcctggccctttatactgttttcataagatactgggaagtttagcctttgaattgtagcaagcactgcctataaagtaggttctttgtatttttgtatttgatagagttttgcagattacatagattttataaccttagatttcttaagaaagcagactaatatttaaagtttgacttgtaacttagtaacactgtacattaggataggatttttctaatttatggttactctcagtttgagccagaagatttttgaatgcttatagatttctgtttaaattttgatatttatctatgtgatattgctgctatgttaaatgttatccattaaccttttttccacaggtggcctaggtggtagtcatgccttgcttctactacgtagttgtggttctctcttgcctgaactaaagcttgaagagagaacagaatttgctcataggatatgggacacacttcagaaattaggtatgattgtttaaatatatgatgtgtataaaaggtgtagatgttttttctttttgcaaaaaagtgtttgtttacataaatgctgtaattcagttttatggaagggctacttgattcataattttttgataatatttatttggtgaggtatagtgacatctagggtcattaacaataaataatttttcataacaagtattacttacaagtacggtaagttaaaaaagaaaaagaagaaaatagccggtttgtctgtcaaagttataaatgcacataccatttgaccgagcagttccatttgttcgaatttaggtacagatatactcacatatgcaaaaggatattcttcattgtagcttgtttgtaatagtaagaaattggaaccaattcaaatattcttctctaggggattaggtaaataaattatggagtacccgtaaaatagattactgtgtaactgttttaagaaatgaagaagctctttatatgccaatgggggtgttctccagagtataaataaaaattaaggtgtagaccagtatgtatagaatgataccattttgaagaaaagtgtttttacacgtgcatgtgtatacaatattaaaatatttctagaaggatgatgaacactggatacaggttttacttgacctttttataccttttcagttttatgtcatgtaacatagtacgtattcaaaaaataatttgaaaaaagatggtttaatacaatttaatgttcattcctgatttaaaaaaatcttaaagtatagaaagatgcttctttaatgtgttaaaaatctaaaaccgacaacaatcatgtataatgcaatgaaataagatgtgaaacaatacaagaagttattatttttagatgatgtgattgtttaatctgcaaaatcccagaaaatcagctcacagtaattagctggactcactaaatgtttaagaatccatacctcttctagttataaaagaaaatagagaaaagaatccaagaaagtatagctacagataaataaaatatttaggactatccttcaaaaagtgagtaggacctatgtgaaaaaaactacaggataaagacagattcttccttcacagttttgaatacatctagaatacattttgataagttgatttttttttaagttaaaaactatatagataaatgttgactttcagaatggaaaaggattttataagtataaaaggagcagaaaagtaaagctaaaatattgaatctctaaaaattagaaatttctgtatgtcagtaagtcattgaactgggagaaatatatgcagaaaaggttacattctaaaatagaaaaaagcattacacagcagtaataacattaattcctccatataaagattaacaatgtgttattatattaacattctttacagataggtctctcctgtataagtgtctgctttataaggatggaatccatggcttctttattttcctgtttgacagtagcatgatgctttgtgtataatggcatttgatacatacttgttgaattaatattgccagaaaccttgtagtttgccagtttgactcttgtttacagatttataaagatacaagagatcttttagcttaagtaacttgtccaaaattacagaatgagctgttgacagatctgagctatctgtaagatggggctgataatagtgtctcaaagttgttgtgaagtttgagtgagccactatatgtggaacacttagcatagtgcctgaaacatagtatgaaagaaacatatctgttaagataaaaatgtgtattaatttaatggaacagctctctgctgcctaaaatcacatactctcacccccagatactaaccataggcctgtatggtcacaggcagttgaataaagatgtgaaatttaatgcatgaaaatgtagtgagacatgttaccacaaaattgatataaagaccatgatgtcatgactcagtagagtaaggctgtgtggtaaccttatttgatgtggccctaaacagtagggatacaaagaaaacaaaggtcattagaatacagataattaacaagagcataccatagatcatgttcatcagctgaaaatggaatgcatccttaaaatgaaggctttgagtgacagaattgccagcacagtcctactgtgtgaaagaactgaagttacaatccattcttcacagtgtgtctgtaatgtgaggactgctttatatagaaaaatcttacagtcacttttaaatatagggatattgtcagcgttttctaacaggaagataattttgtgcttcataagtaagaggccttttaatatccgaataggcagttacttgtaactatacagtaactcagtaattactgtcttacatgcttagcttgctctgtgtgacagagtatctgtgtagataggtctgagcgccaagatggatgggtgaaatgctaaagtgatagttttactctttttgtttgttaaatttaggtccactttaaagcataggattttcaatgcttttctaaaaattcattttaaatttcatttgtaggtgctgtgtatgatgtgagtcactataatgctttacttaaagtctatcttcaaaatgaatataaattctcaccaactgatttcctggcaaaaatggaggaagcaaacattcaaccaaatcgagtaagtagttgctattgtgaatatattttcacatccaccattttttttctttactcagaaaaaaaagtatatttaaaattaactggcccatttcattgacaggtgacataccagagattgattgcttcttattgtaatgtaggagatattgaaggtgccaggtatggatctgtatgaacatgtttaagcgaacaaatttgtacattttgtaaatctaatgtctgttcactctttgttttaaagcttcttcctaatggaggaaattgtttcagaactgttttaatctagaaaatctggtaatctgacttacataaaatataaaattatcgtgtaagagagaaaagataagtaaaagttgctattttaattaaaaatttgatttactggagagaggtataaagttgttgagctataaagctgactttgcttttttttttttttttttaaatatttcctaagggaaatgttcttaaccatttaagctgtattcatttataaaactggaagtagtgtagaaaatcagttgcaccatttctctgcttatgtaaaatttattactacttatgaatggaaggtttggaaaataagggataaattggaatacataatttcatttttatctaaaagaatcttatgaaactatgcttttaaaagggtaattagtagtgtaagacaaatcagataatcagatttttaaaaatctagtatttgtatcgatagtacttcaagactgttgatacattagagagtggggttttgtgggaaggggatcaaagggattagttctttctttgtggtttctaaaacaaatgtatattactattatattttaaaaacaaaagtaactcaaggcctaattctgtacatgttgtaaagagtgttcttataaatactttcaatgagtatcttcgtttttcctttgcagcaagattcttggatttatgaaaactaaggatctcccagttacagaggcagtattcagtgcccttgtgacagggcatgccagagctgggtaatgttcaacctaaggttttggttcttaagtgatagatggctgagatgctaaagtggtcattttactccttttttgtttgttaagtggggtttaaattagagaaaattattgtagacagttcttaaaatacatttgtctatcccttcaaaaaaaaatctgtagtatatgaggtagagcatactaatatttttataatgagcttttacatttgttccacaaatctttcttttatttgaatttttagaaattgggcttgaagccgggcgtggtggctcatgcctgtaatcccagcactttgggaggctgaggtgggcagatcacctgaggtcaggagttcaagaccagcttggccaacatggtgaaacccggtctctacaaaaatataaaaatttagccgggcatgatggcaggtgcctgtaatcccagctacttgggagtctgaggcaggagcgttgcttgaacccgggaggcagaggttgcagtgagccgagattacaccattgcactccagcctgggagacagagcaagactccatctcaaaaaaaaaaaagaaaaaagaaactgggcttgatctgatctgaagtaactgctctggaaaatatttttatttttgaagagtaatttactaaatgttattcttacctcgaaagttaagtctgagtcataacctacataatattaagagggtatgttatttaatgtctatgtaattattattattttttaatgggggatcagatgtttatgatctttattatttcagaaacatatatccagtttaatatacattagttcttttctgacatcataattccaaatggtacttagcattttttattttaataagcatatgttttagtttgaataactatattaaatttggcaaaagcataataatctgttttttgaattaacttgtagtgatatggagaatgcagaaaacattctcacagtgatgagagatgccggaattgagcctggtccagacacatacctcgcattattgaatgcatatgctgagaagggcgacattgaccatgttaagcaggtatgacttatgtctaaataaacatactttaaaatcatttgtaaaaatttgtgttatgttttacatgaggcaggaaagtgaagtttatacctgttttcaaagatgtttccttgcagaaagtagtatttatggagaattattatagtttagtatctcggtgctggtatgtaacagttactgttgaagtagagtatttcctgttttttaaaagaagtcgtaaacctttaggtggtatttttccctagttttttgaatctggatattttatttagctttaatacttaaataaaaacactctaactttgtcttctaatttctggaactctctatagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccaggtagttttaaaaaaatctatttacatgatttttataaaaatctgaattgctattcttacatgatggaaaggacattttctaacaatgggcattgtgggagttgaacatagaactcttaaagtcagttaaataagcccaaaaacatgagttaatgaacacatggggatgatttgatttgcaggtgttttattgttatttaggcagttatatgcttttgatgtttgcaattcttattttgtcttcagtattggaacattggttgcagtgtaaaaatattgttcagtttattaacaaaagatgtctttgttttcttcccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacggtattctgtccacttttactttgtagacaatgtaattggcagtgaaataagattctttaaagtataggaacatttataagattagaccagttgtaaacatcataacaatgttcttgtgttgcaagatttttgggtagaaagaggatgcggggtttaaaatgctcatctcagaagtggtagaatatttgcagcaggtcaaacggtggggtgtttgccaatccagctaatgtggtgacttttttcccacagcctgtggagaagctaacagactactgtaagaagttaaaggaagtccagatgcactcctttcctctgcagttcaccctccattgtgctttactcgccaataaaactggtactacattcttaaagttaaagccaagtaaggaagttttgctgaggtagctttgtgatcttttatgatatctctttcagatttggcaaaagccttaatgaaggctgtgaaggaggaaggttttcctatcagacctcactatttctggccattgctagttggacgtcggaaggaaaaaaatgttcaaggttagattttgccttttaccgatttgtaatggttcccagagccagtatgacagtttgcacgcacatctaattggattctttggaaaagcatacttattcctgagtattatgagataatggaattgttttaagtcatcatgaagtattatgtgtaagcattttaaaaaacaaaacatgatggatttctttcatctgaatttcattaatttcatttcttatttcatctctgatcttgatattcaaacttaatgaacgtagtttttttaagttcttaaaaaaactctttagttcttgattttatatatagtgtttgaaatcagattgtctacctttaataaagataaagttgtatatacaattaggttcatgaaaacaaaaagtatggtcattttctttgtgggccaatctatttctttttaactgagcttagttagaataataggaaaggcaggaaaacttttattgtgaaatgagtactcatgacctgacagcctgctgattgaaggacaaaaatgttcaatctttcaggttcttaagtacgtttaagcatttatcatacttttcccttgtacacatgggatgtctataggatatgaataagaattgaacaaatattaaattttagagtacagtatctaattcttcggtttgcattattggtaattcagaaagagtagtctcataaaaagatgcttttaacagaagtactttccccttggggaaacaaaaaatggtctttttcattttatctcgaagtataatgtgctttggaatgagatgcagaattgttagtgtgacattgggtgacaaacagaatgcacaaacaacaaaaaaagtgcttttagcagactttcatattgcaattttattttaaatgtacagccgtcttctggtttaaaggaaatagtgaaacaagtattccctaattgtttctggctataaaagtctctaaatcctttttagaaaaatctttgtgaaaacaatatgctagtttgattaactctttgtatatcctccagtctgaaagctccaaaaggtaacctataacccagtgttttggaaccacagaaagtttacatcattccatcaaactcttcaggcatgttagtattgtccacctttacacaagtatgaaaatttttttggtaccagttgaaatgtttgttcatcaggttaatctgctttccacaaccatgtcacagttgaattgattactacatttttactacttagtaaacataaaagagttaggtaatttctttctatggttgtagcagttgaaatagtagaaaatgggctttatctcaaatccatcttgtcttagaatctcagaatttagattttaaaagtgctgtactgaaagctcacattacgtgaatgaaggaactgagggccacacagacattcagtgactgaccttagcttccacgtctaggtgtgattaggctgggattagaatagagggtttctgtcctccttttaaaatatccttttttatactataacccttccatattcagcttttgtaagtactatactgtgtttattttctaaaaattcttagctgctgtttaaaaattagttgccagtttttacacgaataacattgctaaaagagagtgaattttttaatcgatgaaggttttgtctgaaaaaatataaaagtttatgcttttatattgtgtgttctgagagtgcaaaagattgtcagttttacaatttttaaaaacaatatattcttctttgcagtaggtcctgaaagatagtaaagtatatattctacagtcttcttttatataacagagaaatggctgtatgtattctttatagtttctttagtgtaaggtaagaaagtaacattcttattagtgcaatgaacttgttctttgtccagtgaaagtcacgtataaaatggtagaaatcacagaagaaagtgactgcagtgatggaggatgtgctgtgtttcatgaggaataaatacatctcttcagaaaatcaaagatatttggggatcagacaaagtggaaccaagagttttcaacaataggataatcaagtgtcttttttttttcttttaaaaaacatatatatatatttttttctttttttttttttttttttactgtgacacagcctcaggaggtcctgagggcatgtgccctgtataataatcaagtttctgttgaatttttctggctgcaaatttagccatcaccaacctccaagaaagatatttataattacttcctcatggctcatcttactagtatttatctctgtggcacaagtgaaaagttatcacttagaataatgcatctctagccagttggcctgactttcaggaaataacctgtaatgaatatggatctatatccctgggcatatttagaaaacatagaaatgagaatgtgaaagggataaaatacataaagaagggctgatcagaaagcccaaatgccagttgagtgaagtggttgaatagaaggaacttgctttttttttttttttgacacagtttcgctcttgttgtctaggctggagtgcaatggcactatctcggctccctgcaacctctgcctcccaggttcaagcaattctcttgcctcagcttcctgagtagctgggattacaggcatgcgtcactgcacccagctaatttttggtatttttagtagagacggggtttcaccatgttggccaggctggtctcaaactcctgacctcacgtgatcacccgccacagcctcccaaaatgctgggattataggcgtgagccaccactcttggcggaacttacttttcaaagaggaagcagttgcctcctaataaagtgagtgccgtggctagagtgtaaaatcctgtggaatgaaacagtcatagttggtgaaagttgttcaggcaaatcatatatcattcctgatagttggtgagctgttataattctcattaaactttttaaatggagactttcctctagattgatcaactttctcatggctatattgaaatatttttattagattatttagtcttagtttagactttctgtgttcacagaggtttggaatctatttatatctaagttaatgtaagattattttaatctttttcttgtgaaaagaaatgtgaattgtattttttattagaatttgttcagatagatcagtctttccttcttattggtaagtgcttctatccccccatctgactatagttactgaacagaatatctttctttgtctgctctctcaggctgcctgagcgagtgattgagcagaaggtgggatcccaggttttcttgagcctgctttagtttcagttagaaagataatgtaagttaaaaatgccagcaaaatagataatgtaaatgagcagaacatactcctccttctgataaatgttactggaaaaatgaagaactaagagaatgaaacatatttgaggcttagaagatggggtgaagggtttcctgtaagaataagaatcttgtagctgcagtcaatttggtggccagttttcaaacactgaaaaatctatcatctgagaaacttttcaggattatgtattattacagtattttgatacagctgaaaaaaattaagttattattgctcctattaacatttatttaggctgggtgtggtggcttacacctgtaatcccaacactttgggaggctgaagtaggggcattagttgagcccaggattttgagactagccttgggaagttggcaaaatcctgtctctacaaaaaaatagaaaaattagccgagcgaggtggcatactcctagctgcttgggaggctggggtgggaggattgctagagcttagcaattgagccttgatcgtagccactgcagtctagcctgcgtgacaaagtgagatgctgtttcaaaaaacaaaaaaatcaaaaacaaaacaccacacacccagttatttagtagttttaggattctgcacatattttttcctttaaatttagtgactaccctgagagttaagtggggagctttattatcatcattcctatattggcaacaaggagccactgaaaatcatcctttttggtggcagaacaaggacttaatcccagttctttctgattgcaggaaaaacatgtaggctttagcattttttgtagtgtaacaagcacctgccaggaattaagagacttggtttctttttttttttttttgagatggagtctcgctctgtcgcccaggctggagtgcagtggtgatgtcggctcactgcaagctctgcctcctgggttcacgccattctcctgcctcagcctcccaagtagctgggactacaggcgcccgccaccacgcccggctaatcttttgtatttttagtagagacggggtttcaccgtgttagccagaatggtctcgatctcctgaccttgtgatccacccgcctcggcctcccaaagtgctgggattacaggcgtgagcctctgcgcccggactgagacttggtttcttactcaagttatgcttgtgatcttggagaaattactttatacttttgttagaagattcattgactttctttaccccacttttaaaaattgacacaaactatatatattcaaggtgtacaatataatgattttatatacaggtacattgtgtcctgattaccatagtcaagttaattaacaaccataaaccttcaacacccatagttaaccatttgtgtgtatgcctgtgtgcatgagtgtggtgaggacacttagaatctgttcttttaccaatttcaagtcaacaatacagtattactaatagtagccaccatgctgtacattagaaccctagaacttactcatcttattaacagaaagttcgtgccctttgaccaatatctccctcaccctagtccctggcaactgctgtcctactttctgcttctgtgagttttcgactgttttttattctaatgtaagtgagacagtattgtctttctgtgtctagcttatttcacttgattagttgacttctaaaggcatttcagctttctttatgtagagaagcacacccaaaccctgattgaaaccttggagtttgacatactgatctaagccaagtggtaatattgaaaattctttttttccagaatgttatagttctgttgtctgcaatcttgccctaagaatttagaccacaagaatttcttccatgcctatgtataatatttcagttcttggaacttccatctattcaataggcatagactcttataggtcagaaaattattcattaagtgcttcgacacatattgccttgcatagtccatggatggtagttagaaagatttagcaaaggaatatgtgtaaaagcgtctggaagcacagttcctggcatatttccatttctagtgtgtaagccaccaaattatggctcagaaacatgcgacaacttgcttagatttacattgctattaagtaccagaactaagggggagagctgggtctttaaagtccaaagcctttttttttttgtcatttcaccagagtatctcaccagcaacttagccgtttactttaactaaataataattgtcctggaaacaattattactggtcagaaaggacactgaggacataagattaacacaaatctattactaggaattcagaagcaacttagctatgtcatcatgtcaggtgcttagtaatcttttcatataaagaagagcacagtgggatttgccatcttttatggtagttatcaaggttgttagtagtgatacccagtgaattattagaggaatagtttaaatttcgcttacaagtattgttaggcttctgtgtgcagtgtggaccaactctacatgcatgttctcttaaatttcagtaagcacatgctttgtttagggattttaaaaaacattattattattatttgagaccgagtctcgctctgttgtccaggctggagtgtagtggcgtgatactggctcactgtaacctttgcctcctgggttcaagcaatacccctgcctcagcctccccagtagctgggattataggcgcctgccaccatgcctggctaattaaaaacattatttttacatcttgaaaaatacatttaaacctcttagatttgaagatattaggttatttatttattcttcccagccaactttactgaggtatgaaggattaataattgtgtagctaaatctatatctgtctttctatcaatcgatcatctatctatatgataaacaacatgatgttttggagacagtgtctcactctgtcagccttgacctcccaggcttgagattttcccacctcagcctcagtgggaccacaggctcatattaccatggctggctagttcaaataattttttttggtagaaacaggggtctccttgtgttgcctaggctggtctcaaattcctgggttcaagcaatcctcccaccttggcttcccaaagtgctgggattacaagcatgagccatctcacctggctacattttgatatgtgtacacattgtgaagtcattaccacagtcaagctaacatatccatcacctcagctagttatggaggctctgtcacccaggctggagtgcagtggggtgatctcagctcactgcaacttctgccctctgggttcaagcagttctccttcttcagcctctctagtagctgggattacaggtgtgtgccaccacacccagcaaatttttatatttttagtagagatgggattgtgccatgttggccaggctggtctcaaactcctgacttcaggtgatccaccagccttggcctcccaaagtgctgggattacaggtgtgagccaccgtgctgggcttttatttatttttttatttttatttttttttagctagttacctttttaaaaattttgtattggccgggcgtggtggctcatgcctgtaatcccagcactttgggaggcagatgcaggcagatcacaaggtcaggagtttgagaccagcctggccaacatgatgaaaccccgtctctggtaaaaatacaaaaattactcggcgtggtggcgtgcgcctgtagtcccagctactcaggagcctgaggcagaagaatcgcttgaacccaggaggtggaggttgctgtgagttgagatcgcaccattgcactccagcttgcacaacaagagcgaaactccgtctcaaaaaaaaaaaaatattgtggccagaacacttgagatcaactctctcagcaaatatcaagtattctgtacattgtgtccagaacttatttaccgtataactgaaaatttatacctatggaccatcatcccttttcactcacaccccagtcccataacagagttcaactttttttttttttagtagattccatatataagtgagatgatgtagtatttatctttctgtatctggcttatttcacttagcatgtgcttcaagttcattcatgttgttgtaaatgacaggattttctttgtttttaaggctgaataatattccattctatatgtgtatatatgccacattttctttatctgttgacagcatgtttctacatcttgggtactgtgaataatgctgggatgaacaaatgtttcttcaagatagtgattttatttcctttggacatatgctcagaagtgggattgttggtaattctacttctaagtttttcaggaatctccatactctcccaccaacagtagaccagggttccctttctctccatcctcaccactgtctaatcgcttttgacttttgatagtagccattctgacaggtgtaaggtgatatctcattgtggcttaaatttgcatttccctgatgattagtaatgttgagcatcttttcataaacctgttggccatttttatgtctttggaaaaatgtgtattcagatcctttgcccatttgttaattgaattatttggggtttttttgctattgaaatttgtgagttccttattatatattttaggtattagccccttatcagatacgtggtttgcaaatattttctcgcattccataggtcgccttttcattttattgtttcctttaccgtgcagaagctttttagttagatgtggttccacttcactgtttgtttttattgtctgtgctttggtctcaagtccaaaaagtcgttgtcaaggccagtgttttcttctaggagttttatggtttcaagtttaagtctttaatctattttgagttgatttttgtgtattgtataagataagggtccaggctgggcgtggtggctcatgcctgtaatcccaacactttgggaggctgaggcgggcagatcacgaggtcaggggttcaagaccagcttgaccaacatggtgaaaccccatctctaggatcacgaggtcaggagtccaagaccagcctgaccaacatggtgaaaccccatctctactaaaaatacaaaaactagctggtcgtggtgacgtgcgcctttaatcccagctacccaggaggctgaggcaggagaattgcttgaacccgggaggtggaggttgtagtgagccaagatcacaccactgcactccagcttgggcgaccgagcaatattcagtctcaaaaaaagacaaggtcttgctatgttgcccaggctggacttgacctcctgggctcaagcagtcctcctgcatcagcctcgtgaatagctgaaactataggtgtgaaccactgcctgcagctccagcaccatttattggtacctttgtcaaaattagttgattatatgtgtgtgggtttatttttagattctttgttccgttgcattggtctatttgtctgtttttaggccagtattaggtaattttgtatatggtgaactgtttaaagttaaaatattctgattcataacctaaattttaaaaaaaattatagttttttttttacataattaaattttatctaaaagaaatgtgcaggtatttataatgtagttagacttgcttgtgtttttctgtactcagtaggaatttactgtcaattatttgtactggagttcatcatgtaacaaattcgaaagaaatgtaatttatctttaggtctctagtaggccagaaacagggacttttagggggagttttaataatgtgaaagtaatgaagctgaagataagtaagtttttagaaggagaaataagaatgttctttctttttattaaactgtagcctctgtcaaattaggtgatacttgagtaatctgacagttgtctagaattaactggatctatttgaaactcactgtagctctgaaaacatgaaatgacttaatttttaagaagttattaaaagagatttttgtgagtgggaaatgagatagaggaaacaacttatttgatttttaagttagttttaaatacaattagacaataattcattaaattgttctctattaatttttccttcttacattgtaaaatatgaaatcagaaattagtaacaattagggaactttttacataagtgcttaattgaaaacatgttttgaaatcagtcacttctctttgcagcatttattctggtcaaattttttgtgtacaagtccatcattgctctataatagcagtgttgtattataatcactgtttggggtgccagaaatgttgggcacattgcttaattgtttcaagtttctttatacttataatttcaaggatagtttcttgaaatttactgtttcacagagggggatgaagaaaggaggagttaatttttttatcattgtatctcacagtgtttcttttctgccttttagacaaacgaattgctgagtaattttcttatactgtgattcagaaaataattgaactgaacttaccgatcttttcttactttattctaagttctctatctctgtgcttctacattttatttggtaggtataattgaaatcctcaaaggaatgcaagaattgggagtacatcctgatcaggaaacatatacagattatgtgattccatgctttgatagtgtaaactcagcacgagccattttgcaggtgagtacaagtgtggttttaatttaataattgaagaggatatctttcctccttaatgtttagtgttgacacacaaaaaagtcattgaactgaggactcaaaatggtcaaatctgtatacaattttctttttttcttttttttgagatggagtttctctctcattgcccaggcaggagtgcaatggcacaatcttggctcactgcaacctttgcctcctgggttcaagcaattcttctgcctcagcctcccgagtagctgggattacaggcatgcgccaccatggctagctaattttgtatttttagtagagacagggtttctccatgttggtcgggctggactcaaactcccgacctcaggtgatccacctgcctcagcctctcatagtgttgggattacaggcatcagccaccgcgcctggccctgtatacaattttctaaagctttgtaaaaatattagttggtataacatttatagtggttaaactttcaaaactcaaaaagacaaagcagcttttttcttgtgtattaaaaagacaatatgccaatatcgggaaaaattaaaacaatattaactcctaatcccatcctgaaatgcccctgcaattttcatttataaattaggttttattttattttattaaagaaacaggagtttcagtatgttatccaggctggtcttgaactctgggcttaagcaatcctcctgtcttagcctcctgagtagctgggattataggcacatgtcactgtgccctgcttcagttttcactttttgaatattatttttcacttcccataaattttcataaatgcactaatagtatatatactagtctttctgtctctctctctttttttaaacttcaaacctttgtttttctaccagaagttttctacttctggtccttagcagagtaggcaagctgttgatgaagaggcacatgaagatgttgattgggacagtgcattggattagcaaaggttgcgttttccactttcaaaacagcatgcttagcgctgaatatatgaattacaaaaacaaaacaaaaagtgctgtgcagttaggaacaagttggcagagcacctaatacctaataaggaacatgttgtttaagagatgtttcctacacagtcattcatgtaataccttgatttttctaataatgttagagtgtttctttcattaaaataattacataattacagtcttctgaagtgttagggtttatatcttcagtgtcttcacctctttccctaagttcttagtggagtatgttgagcctgtactatacatattttactgttaaaaaaaattttttaagtaactttcccacatattcttactttttcagatgttttctttctttgcagaaatacagcccccagatcagtgtctttgtggttactgctttggctttctcactagtgacttatcttagggaacagcagatctaatttggaaacttatcccaaatttggttacattcattctcatctcaactatgttgccttcattgctggaatttcagtagtattgagtgttttgggattgaaaacaactactctgttaagtgcttaatagaactcacagtattgatctgctttttttctttgttttttgaggcagagtcttgctctgtcgcccaggctagagtgcagtggtgcgatctggtctcattgcaacctcctctgcctaccggttcaagcgattcttctgcctcagcctcccaagtagctgggattacaggtgcccaccaccacacccagctgatttttgtatttttagtagagatgggatttcaccatgttggccaggctggtctcaaactcctaatcttaggtgatcagcctgcctaggcttcgcaaaatgctggcattgcaggtgtgagccactgcgccctacctgataatgccttttgtcttcagctgggcattaaaaagtacatttttaaattagttttcagaaattacataataaatgtttgttgataaattagagaacacaagtaagtggtagggctgtacaatctgtccatagttccttgagatagtcattgcttagcatgtatgttctttcagatgtatactaggctggagaaatctcttttagcaagaaagtatactgttcatattatcgagcaactcttattatactgttcctattatccacctaacttgacagaggctatagtttaataaaaagaaagaacattcttattttccttttaaaaacttacttctttttgccttcattactttcaaactccccctaaaagtctctgtttctggcttactagagacctgaagaaaaattacacttctctcatatttgtttcatgatgaactttttttcatttgacaccttttcataacagtatttaattccacaaaatatattttatgcttgtatgctgtttcattgtatgggtatgccataatttattttttatccttgcttattgctgattaagtggttttttaatatactataataaaatgattcaataaatgtatttgagctaaattttgactcatatatttaaattgttaaacaaatgatgttgggacaagtgatgagcctctatgagttaaattacattaaattagatcctggccaaactgtatgccccaaaatattttagattaatgcattgaatctttgttttgtcttgaatgggagaattattctagtgtcctcagtagtaaactcatcctggaagtaaggccctctaaaggcatcagaccatctgtatttgaagataagcatttaacttagaatgctgaaatgtcatctttaaatttttgctaaaattcaattactgagcttatctatttttctagaaaatcagagaatatggtgattcaaataatcaggaaaacaggatctttggcttatcaaaatattgttagctgagatgtattctcattgatatatgctttatctccaggaaaatggatgtctgtctgatagtgatatgttttctcaagctggattgagaagtgaagcagcaaatgggaacttagactttgtattatcattttgtaagtatacaacattagcggtaaacttgatagatgtttatttcagttactattgagggcatgcagggtggttcacgcaatgaaagcaaggaaggtttatatgttttgttaaagccagactgataaaacggtttatgagttgaacttgtggataatttggaagtaattttaatgttataaggacattgaatattatatgtaatatggtgttagactgaaggctggacctggagaccctgaagacgtggatattctttataatttggccaccgattatgtgatttagaagaagtcttctaacctctctgcttcacttttactaaacagggatagtactacctaacttgggggagttgtgaaaatcaaatgcggtattgtttctgaagtgttttttaaactaacatctattataaagacttctagtcttcattaacaaaaacacagcaaatgtttactaaacatttttaaacactagtgtgctttataatgctcatcacatgttaatacaattatctccattgatagatgactaaaggcatagagaagttaaatgatttgcccaaggttagtgatttgaaccagaagtaagatgttcagactttagctttgttcttttcaccatactgcactttattttattttattttatttatttttgagacacagtctcactctgtcacctaggctggaatgcagtggtgcgaacttgactcactgcatcctctgcctcctgagttgaagcgattctcctgcctcagcctcccgagtagctgggattataggcacatgccactatgcccagctaattttttgtatttttagtagagacagagtttcaccactcctgaccacaagtgatccgcctgcctcagcctcccaaagtgctgggattacaggtgtgagccactgcgcctggcctgtattttatttttaattaataaataagacgttcttaagagaccttattttttaacacgtccatggtgttgcttgacagtttttcagatcttctgaaaaatatgtcatttacaaacaaaacacagacataattaatttttagctccctaaaatgttaacagttaagctctcattaatgttatattcaaactgtatgggtggaacctttataccaaccaggttattggtatgtattacttgtgcatgtcgcttaaaatatttgttgtaatattgtaagggaaaggcaaagtgtccagtatgaaaaatggtgactgttgtagttatttgagtcaaatattgagtattattgctggctgctatctgagtgtattgattttgccttccactctgtatactatatagattttccaatctgacaagaagaaaacagagaagcattagcagaggaatctgggctcacgaggtggatccatgagagctgccttttccttttatcatatcatccattccacttcgttgtcaacctcttgatttttcaggcttgtttgttgctaaggaaactagatgctttttgtcagcagccttcatagctgagatgtttctggtcatctttttaatgaataaaaacttgacaatattctgtagaatactattttgaatagtataaaaatgaattttcaagaggttgtttattagatttaaaaaagaaaaatgccaagaagtttgccaagtatttgagcttttcctgtcagtgccttcccctccagctttgatttacaagtctttgaagagcggttcgttctatgattgctggtacgtgcttcaggcagctcttaggaatgcactactggttactacatcacaggaaatgtcaggtagtagagaacagtaaatggattatcttgattaagttttggagtagtagagaacattttcccacttgtgtttgtaggcatggaaaactaatttgatcacatgaaattaaaagctgctgagaggcatgtggtggtgttccctttaaaattccttgagtgactcagtgcaggtcattttaaaagtgacttttagattttcaaacactataaaagcactgagaaacttaggctccttgttcaaggaatatagcagctgatctaaaacaattctccttatgtgtgtgggttaatttgttatttttggggagatgaacacttaaaatgggccatgacttttcccatgggatttttctttaatgaaaccaggtaccttaaccttcacttaaactgtatttattgtcttcagaatttgcttctactatgaattcctctctaatcccatcctttttgtattattcagtagccacattacatttatagtgaaaagattaactctattacttataacatggtcccattttagtacaattacagggaaaaacaaattcagggaatgcctactgtgatctcatcccttgctagtttggcaagggttatgtgaagagtcagtgtaaggtgtgattcttacacaatggcaaatcaggcttataatgtcagcattgaaacatacaaggttgtagactgttaaatgtcaaaatgagtagtagagcaaacaaatactcagaaaagtgaaagatcaatataagtcaattacataacggacgtatgacctattttattattactttaggtggttactcttgtgtgagtgcaggtcattgatcatagtggaaaatgaaatgagaaagtatgaatggttcaacagaacccaacacctctccgagaaaagaatttttcctctcatgtgctgtctttaaagaacaaaagtcttgtagggtattacagtctctctcttcatggtgccaccatgtccaacaacatacagcctcagtgtgtgtaccaggctgactctgattctgctggtatgttagtaattgccatttataggaaaggatatttataaattaattagttgtatatattcatgaaaattaaaaatacgttaaaagggtagcttatattgcagatatatattactgcattgtctaattttgtatgaaaacatttttattttttaaatacaatttccaaaatgaaaactaaaaggtattggtataaatatgttttcaatttgataatacagggtttttaaatttgtttggtctgagatttaatgatggtcattttcttttgcagtgaaatcaaatacattgcccatctcgctgcagtctataagaagtagcctactgctaggcttcaggaggtaagatgatcaacttaaatgttccttgcctgaacatggactgatttctcctgtccttttgacttattgcatgaggaaaaatacaaatattcttatctttcagtgtacattcagtttacctgaaataacctttgcttgtttaattttttcttttaagtcattgaattaaatttaggcagctttgtgtcatcttttctgagaaatgcacacaggtttggtaaagatcctgtttccaggaagaaagtcctgtttcaaaatggcaagttggagttacagaccaatttgcatatgtatgttcagcttattctttgagcatttaattgcaaggtgacttttattcagtaaagtatcattctccccttctgtgtgctcagagaatgttaatgaccttgcccttccaattttgttattttgaaaatagataaacataaaagctgaaagaatagtaaaagggaatactcccataccacccttttttatttgatttatttttttgagacggagtcttgctctgtcgcccaggctgcaatgcagtggtgtgatcctggctcactgcgacgtccgcctcctgggttcaggtgattttcctgcctcagcctgctgagtagctgggactaccggtgcccaccaccacgcctggctaagttttgtatttttagtagagatggggtttcaccatgttggccaggttggtctcgaactcctgacctcaggtgattcacctgcctcggcctcccaaagtgctgggtttacaggcatgagccactgtgcccatcctctgtaataccctttgtgtagatttgccagttgttaatattttgccgtgtctactttctctcataccctctttctctacacaagaaagtacctacacacacacacacacacacacacacacacacacacgtttttttctttttggctgaaccacttgaagttgtatgcataatgacactggatctttcagcatatttctcttaagaataaagtcatcatctctaaaatcacaacatcagtatcactctgaaaaaattaacaatactgtaccaccatctgatatatgtagtccatgttcagattttcccactttaacaagtttcctttatagatgtttcactttttgactgaggagtcaattaaattgatgcattggatttgattgctacatctctttattatcttaatgcagaacaatttccttagcttttttgtttgttttttaataacactggtttttgttttgttttgttttttaagagcccaggctggaatgtctcttctacattttgtatttttctgtttttttttttttcccatgatgagactcagattaagcatttttagcaatagtacttcatgggtgatgggcacgtcttacattgtatcacatcaacagatataaaggcaggtgtgcaataatgatgccaccaccaaagtttgatcacttggttaagatggtgattcgcacatctctcttgcagaggccccttgtccactttgtaattactaagaagactatggggtggtaatttgagactgtgtctaccctgtttttccattacttttccctccttggttttagcagccattggtaatccttgttgaatcagttattggtagttcacacaagaatgagtttctttttttgagatagggtctcgctctgtccccaaggccagagtgcagtgggttaatcagcctactgcagcctttacctcccgggctcaagcgatcctcccatcgtagcctcccgagcagctgggactatgggcgcatgccaccatggctggctgatttttaaaatttttttgtagagacgggatctcactatgttgcccaggttattctgttgagagaagcagtgtagcacagtgattcataattttcttttcttttttttttttttttttctttttgagacagagtcttgctctgtcacccaggctgcagtgcagtggtacgaacatggctcattgcagcctccaaattctgagctcaagtaatcctcctgcttcaggctcccatttagccaagactacaggtgtgcactaccacgcccagctaattttaaaatttttttgtggagatggagtctcaccgtgttgcccaggctggtcttgaactcctggcctcaggtgatcctgccacctctgcctcccaaggtgctggtattgcaggtgtgagcctctgcacctgctgccctaaccttttttgattcattgatctctttgagaatttgttggaagctatggctcatctttccctgcaaaagatgcatattataaaattatgactataatttaatggagttcatgaagtactttccctctccctataaaaacccgtatcgtggaagccaaaattaagagcctggagtgtatccttccatgcttttctctgtatagaagcagagacctgtaagaggtgtttgaagttttgctttgttttgtttaaacaaaagtaatatatcatactttacatactactcatctttctttttcacttaacaacactacatgaacatctcttggtctactgatataaatctaagcatttatatctggaggggattccatggtagggctataccataaattttcaatcactcctttattaatggactcagattccttctaatttttgccactaccaaaacaaagtggtacattacatattatgtccatatgtatatgtgtttgtgcacatgcatgcacatgtgtgtacatatatattatatatacattagtttatcccccctcagtggctagaatgtaaaaaagagacgtctgttttcaagagtgtatgtattctttaatagctactaccatactacttttccagaaaaagttgtattagctcatacttagattagcaattcacacttctaccagcaatgtatgagagtacccacttcctgcaaacttacaagtattagacattacaatgctttttaattttggccaagctgatggatgacaaatgacatcttaatgtataattttcaatttgcatcttcctaactattaagcagggttagagcatacttattggccatttggatttcttctatgaaataacctatttaaattctttgccagttttctactaggtcatacaatttttgttgtcaatttgtaaggtattgcatttgagggatatttatctatacactgtcacatgtgaaatatgtttttttttaaaccttgttgcagagatgagagagaaatgtaaggataagatcttggatagttactggaaggagtcaaaggagtttgtagtcagtgtcgcaagttacagagatgtaggggagatagccctataaaaagagggtgttcagtttggtatttggaaaagttactgagtttttttcttttcaaaatggagatgaggtctcgctgtattgcccagggtggtgttaaattcctgggctcaagtgaacccccagccttggcctcccaaagtgctgggattacaggcatgaaccaccggcctggccattattgagtatctttaagagaagagttttgatactattgtagtggaagaagcccagctagaagctctgagaatcttggtgtctttgttttgtttttagtgattggattatgtatactataactgaatttatgtgtgctttcagattatttatatttttatttgaatagataacattgaaaatattcgaaaatggattaccttatctttaaaccacaccaagctaggtgctctgcgtctcccctgacttaaatccttttttggtgctttccctgtttgttagcatctaaaatttttaattgattcctgggtttaaaactagccacagattggtcatttttttaactttccactttaaagttagataaaatgtttaaatatgtttaacaaaggggacactacccaggagcctccagtgtttgcacagttgcaaatctgtctttattcttgacatagtaaaaataagtttaagcggattccttccaggaacatatttcaacatgtaagtcctaaaactgtataccattggttaatttttcttattgtagataaagaaaaatcgtaggttgtggtaacttggcatttttcataagaatatgtgcctaattcagagcacttgtgtaactacaggtgatttctttcttctactccaaaaactagtcttcgtaactatgaatgtttatagaaggtactcagtcttctgccaaggttggggaagggatgaatcagggcaggggctgcagagaaattgctgagaggcatattgagtttgtagaggggaagggaagggtttttcaggccgaggcattgaggctgagagaacagtggttctggggaagtgtaagtagattggtagtagcttaagaaactatgaaataattacaagaaataaagccaaaatggtagcccaggggtctttatgagtagtctcattctaagttaggatatttggaccttgagtcacatggcttcgagccattgaaaggtttacatgatgaagttaagattgacagatattcaaaggggagagtacaggtaaaggcagatagggggacaggaaacattaggagatcattcacaatttatgggattcttttaggggactgtggaatttccagttgaaggtattttacatcgccttaccaaatttgtttcctcttctgggaaacaaagaacttaaatacgtacatgcaggattgtctttaagataaaaaatataatgcacttagaacctagtacaaagtctgggtcacttttaaggggcatgtagggaaggacagttcctgaaagaggttgagtagcatctagcagataatggctaacaacaacagaaattccaaaacttagtgaaagaggaccaaaaaaatgttagttgaattttgaattaaaaatcactggtaattttagcataagtagtttcagtggagtttggggccagaagtcagattgcactggtttgggcactggtaactgttccttacaacagcttggttttgaaggataccgtttatttttgttttggtttcaaacctgtggcattcaccatgaagcttcacattcaaggtagtgcttttagtcattttcagttgttttaggtatatgtgaaattttgaaagtttatctccatgccttccttaggtacttcatgccacgtttgagggcagcttaatatccagttgttttttttttttcttttgagacggaatttcgctcttgttgcccaggctggagtgcagtggcgcgatcttggctcaccgcaacctccgcctcccgggttcaagcgattctcctgcctcagcctcctgagtagctgggattactggcatgcgccaccacgcctggctaattttgtatttttagtagagatggggtttctccatgttagtcaggctggtcttgaactcccgacctcaggtgatctacccacctcagcctcccaaagcgctgtgattacaggcgtgagccaccacacccagccttaactattttttatttgacagtaagttgatactttgataaaaatatatggttaaagtaaattttaaaaataaataaataaaggaagcccagcttactaatgttgagagttaaaatagaagtacaaaatttagactggacatggtatgtgtttatttttttattttggaatttttaaaccttcacgaaagtagagctgccatgtacccatcccccagctttaacagccaagattttggcagtcctgttttaccattccccttctctttctttgctggactattaaaaataactatggatctttgtcatctacccataaatacttcagtatatatctcagaacttactttaaataaaacaacataaccaccgtaatatcatacctgacaaaattaatcctagttgataatcagaattcatcaaatgcccagatgggtccgggatacagcaaaggaaccatggcaagttttaccacttaatattatgcactttggcacattagcccctcactttcttgcaaactctgattgttctctactttccttgtcctgtttttcaaatgtggtaggctactggcaagttaagattccttggaattaaagctctttgtagcctaaccaaaaaaagatacctaatttttatcttattttactgtattttattcttcactgttacagcttcaagttatcccctgctggaagaccacatgagtgatactctgtcttctcagggaattatatttaaaggcacattagttttgatcacccggtccaggtgttgggatttctccattatgtagtaactgtttttcccattacaagtaacaagcaatctgtgggcagtcactttgagactcactgtgtctcccaggctggagtgcagtggcacgatctcggctcactgcaacctccgcttcccgggttcaggcaattctcctgcctcagcctcccgagtagcctggattacaggcatacaccaacactcccggctaatttttctacttctagtggagacgggatttcaccatgttggccaggctggtctcaaactcctgacctcaggtgatccacctgccttggcctcccaaagtgctgggattgcagatgtgagccaccaggcctggcctattttgaatatttgaggtgggtgagtgtcagcctttctaaattacctttgtcctgaaaattcatcctgatacagcaaacatttatttacttattaattttaatactttgatctgtacatattacaagtatgcatatacttgaaaataaacctgggtttattttcgatcctttgctgccctctgcaggtctatgaatataaatctttggagcgaggtaagtccctctaatattgcaaatcataaggtgcttttaacgttacaagccaataccataggttatgtaataatttttatcatgaaacctatatttggttttctactaaaattttgctggcagagttaatgttgaaaaataatagttatgtgtgtcttttagtgtttgtgaatccaattgataagaatccaatgggaggagggagaggatcaggaagaatagctaatggatgctgggcttaatacctgggtgatgggatgatctgtgcagccgaccaccatggcacacgtttaccgatgtaacaaacctgcacatcctgcacatgtacccctgaacttaaaataaaagttggaaattaaaaaaaaaagaatccatgagaatagacactttaatctttagaccccttttgttttagtctcattaagatgaatggaagttgttattaaatatctaaaaaatgtaagttatttagcagttcaggatattttactttatatttcagtaaaacttaatataaaatgaggaaaccagttcagtgtcaacaagaccaaaagcaatataatgaggaataatattggtcaataattcctataagctcttttctatttataacagttcattcagagtgatgtttatatatcaatttataaatcagtttagagtctttctgtgtgacatttcacaaaacattgcagttttccttcaacatggatttgtttttgtttttaaaagacaaacctattatttaaaaacaaaacaatctccttggcgggtgggggtggttttgaattactgtgaaatagaatagtaccttactggggagaggttttattatttcaagaattcaatttcagattgtgtttgttcttgtttgcttctcttgctgcaatgcacgaattttctgtcttaccagataacagaattgttgtacaaggatggacgttattgccaggagcctcgaggaccgacgggtagcgtttcaatttcgatgattgtaacttatccacaaatccatttttctgtgtaatgatgggttaggaggattacagcagtaaatactttattttttaaagtggaatttgaaaacatttggttataaatctttatattgattacaacattttgagatctaaagtgtttgattttgttacaattattttttctaaagacagggttgggaggctttttcttttcagatattggggaaatgtttcttctaacatctatggaaataggcttaaaaatcagtgattcttagtatttatgtgcttttaatgttttgcaggtgtagttaattttaaacataaaatgtagcgaaggttcttgtggatttccgcttaaatgtaatttattgccccaaatacattgttttgacatttaatgattttcatttttcatataatgaagctagactatatagttttctgtaagatggtacccctcttgaaagtttacatttctatcctaggtattactgtaacatggccctatacattttatgcttgaatgcaaaggaaaattactgttgttacaaaacatctttgttaatcttggtttttcattggctaataggcagctctccacaggattactgtatctgcttattaaaattgtttaactttctttactcaacatttaacaatcctttctaattttatgtgcttccctaaatattgtccacaaaaaaaaaacagtatagaaatgtgtacaagacatttatttattcttattacgtgtgatttggacaggaaaggggtaaggccttgggcaggaccacttctgtcacagagtggtggaaaaaaaatagattgaagtaagattcagtactgaaaagctgtcactcggtctgaaaataattaatattcctttcactcaccagttagatatgtgctcccaaaccacataatctctatgcctcagtgatcattgttgccatttcagagcctctcatcagggtgacatctcacaccaaaatgatttcttataaattaatcttgataacatgacagtctcggtaattttagtggaatgctttctcttgtttttttccacagaagctgttggctattttctttataacttgattgacagcatgagtgactcagaggtacaggccaaggaggagcatttgagacaatacttccatcagctggagaagatggtaccatttcgttttttgctatataatgcctgtcctgcctgacatgtatctattagatttgaaattgctgcttttaagtacaaccagaccacttctcaatgacatgcaagagttggagacttaaattatgtctgagataatttctgttagacaaatttcagtttggttgtctaaaactcaggttttttcccccctcccttcccttctcacagaatgtaaaaattcctgaaaatatctacagaggcattcgtaatctcctggaaagctaccatgttcctgaattgattaaggtgtgtgtgaaatagcaatcaactggataaaatgcttaacttacatataacagcatgttaaaattttatttaaatatgatgcttttggtcagaaaaaaaatttgtttcaatgacagccattaaaacgaagcttttcattgattgttcataaatactatttatatattcataaatatatttataacgttaattacattgattaataaagtatgaagagaatgtctaaaattttggaaagatgaaaagtagtaatatgaggtgagacttacaaatttgcttttgatgtttgctgatgtatttttacgtgtgttttctaattctgggctaatttaaatttcaattttaggatgctcacttgttggttgagagtaagaatttagactttcaaaaagtaagtaggattttgactagattctacatgctataatacccatatttaatgagtattctggattgtgtacttataaaaccagtgattcctcacatttttatcatcttgtatacctctaagaagttggtaaaacctgttccccacctcagaaaaatcaacatatctaagaaatttgcatataatctcagaaggtttgtaaatccctggagtccatccatggattccccaattaatatccctgatagcatttatgacatttaggaaggtagaaaggaaagtcagtttaaagggaagagtgacaaaaggcatactatatttcctttttcaggaaatttttcttttcttttttcttttctgtagactgtgcaacttacatcatctgaattggagtccacacttgaaacactaaaagctgaaaatcaacctataagagatgtcctaaagcaactcatattagtgctttgttcagaagaggtaacatttgttttaatatttaaatattattaaggcaaaaaattcttggtaacaataagaaaaaccaaatataatatttatgatttttacaattgatcgttatatgtcaggcttgtaaagaatgcaattaaatgaaaggttaactaatttcagctacaccttgaatggcatgttttctggttgctgtagtttgtttacgataatctgcaaagtgaatgatagtaacagctgtgataggtttatcatacatgccaaatgtcctttcaagccatggctccggtctcttatatctagattgtcaagcaactgatacacgcagtagtcatttgcaagtcaaatattactaggttgttaatgcagggattgaaattccattttcctgctggaaaaaagctctttctgagataaagggtcccttgccttttttcagcgggcatccagctgtactttgtgttcattttagtgtatgtctgcaatttgtgggatatcactagactatttttcactttctagttcaatataattgagccataaacttgtagttttagggaaaaaatatcatgactaactttatgattataatctgctactgttaaattctaaaatatttcttcatattacttggatactaaactagactgagaaacttttcaatgatacatatttctgcatcctgaaattagactgtgattaggatttgatttgggaattacttaatctggaagtcttttttaaataataccatacacaaagcctaaaacatcaaatttggcataaataatggcctattttatattacagataacacatcttttaacccctacacgtgtaagacttgcccacttcttagaggtgaataaaaatatcaaggggcagagtcaggttgttaacatgaaaccatttatttttaaagtactattaactttttctaaactctgaacagtaaagctaaaaatgtgacatttttaccttcacactgatttcttctttttcacatctatgctgtattttagaatatgcaaaaagcccttgaattgaaagcaaaatatgaatccgacatggttactggtggctatgcagctttaataaatttatgctgtcgacatgataaagtagaagatgccttgaacttgaaagaagaattgtgagtaccctggcactgaaacaagttgtcaacatttattctgctctacagaccttgatagattatctagatggaatattactctcttatataatgtcatttttaaaaattcttttgttgtcagtgtttttgaaatttcgtattatacggctctttaattaattgtggcttatgttcagcaaggtgtctttgtttaagtatgataagacattctagtccttagaaccaaaggtttttttccattgattatatatcatcacaacagtggtgatggtggtaactgttttaagaggcttgataacatttccctttcaatattgtagtgtaaataaaattctatccatttctcaggtacctttggcttcctatcctgttagatttttcaagtaaaaatgtcaagtattcgtgatgaaggttagaatcacttaaagccaaagagtttcttcataagtatcctttgcagatggagtgatgcaatatatatgtagtgttgggcttttacttcactagtcactttgaatataatttcgtgtgaacttgtatatggcttcaaaaagaaatcctaactgaagcgtagaggccaacattagttcaggtcttctgatgagcttttgaaaagtgattaaatggatgttgctgttcttttagcagttaattgacttttaaaacaatataaatgtggctttaatttttagtgaccgcttagattcatctgctgtccttgacaccggcaagtatgtaggccttgtaagagtattggcaaagcatggcaagctccaaggtaagcctcagcacataaaggaaatatgtgatgcaagtatcttgccactggaataacatgtgaattgatattaatggatatcatgtcctgcaaagtgcttgaacactttgcatagaaatttgcatgtgaatccaaccagagctacatggacagtgtaggccattagttttaatggattggcaagcttgtcatttacatttgcacagctcagtgctttttgcatttctgcagctagtttttattagcattgctgtttggattgagtttgaagatcatgacttatggcacaatttgcttatgtgcctgcactaatggctttgtttttgcttaagaaggtctgaaggctgaacgtaaaacctataaacgtaaaacctataaacataacctaatatatgcgcctgaattttgcagtagtctttgccttactttttaataacattaacaaaatatatactttaaagtttttattttaattaaggtttttatttaatggttcatggaaaaagcatagctgattacacagctgatttgcatactcaaattttctcgttgagataatgctaagcctaataaaattaattacacttgataatacattcatactattttcttgtttcttaactttctgatttggctttattttgaaatttcctttttagccttcctcttttcctttgattttcagaaaagattgttttaattttattatagggaaaaatgtatggagaaaatcatttattagaacattgaatgttttcctaggacgcctttctaactctttctaaggattagcctatttttttaaaatcactttttgtaaagtggtcaaaacattttgtctgtgtaataattaagaacaacattataaaaatgcacttattccatatcctaaaatgtttgtttctgccttcctaatgaagcttaatgaatctaatgtattaacatgcagtcttttggaaagctttcattggctctgcttggctaattagtatcgacatagcaaacaggccctatcggtatcagaccattagtctggctgtatatacagtgtaaacacatctttattatctggcctcctgacaagccatctgctgaagaaacaatggtgtgatttagcagatgttagctctgaacgataaaagcatccatttaggaggatcttacagctatagggcagaccatacagggttatgtggtacagagtgggcacatagtccctatctataatttgtagtcaaagttgcagggaaatgataaaaccatgctattgtggatttataattgtagtctcgtttagaaatgcaagtagtaattaacttgaaatcggcattatacactagaatttacattcctgctgggcttgaaatgctgttttaatagcagtttgttttccctacatgaaattacctaagggtcttttgtgttacttcattgtagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagtaagttaattgaattttgaattttaaatgttggcattaaaagaatgagtctaataattttcggattatactttataaataccctcatgatggggaagccttggaggtcatttaccacagagtaagagggctaatatgaactaggtgacctttaaaatcactagcagccctgtggtcctgtggctttacatatcaatggaatagtccctggtgctttttttgtaggagcatgtgatcacttgaatttgaatctagtttttcctagttttgagcctgataagtgttattaataaatataagaaaaaaggatcttctggggcttttgagtatgtgtcttgacagttattcaggtaataagtgttgaagcatcttcagtgctccttttcttcacagggtattttaaatacatataccattacagttattctagctttgataaatgttgtaggagatgaattttactgatagggcaagatttactgagtttgttaatttttccatttgaaatgctcttgttggtgctcaatttaaggcattatttgcaatgtaaatcataaagtcagtctattttataatgaataaaacattttagtaagatgactaagcgtaatttatcatctttttcttttgtacttgtttttgttttctgttttgctttttaaatttcctagatcttctttgtcagctttttcatagcttaacatagtttgtaatctgcattacatggagactgcactggcaaattagtttaaacaaccctaggcaaacaaaaatagaagataataattaaaataaaataaaatggaagatatacgtatctgaaagtagtaaaacaccgaaaatgaaaagatactaatttagatttctttagttcaattaacagggagagctgaatttgactgaaacgcagaaatatctcactgtggatgtagtgtggatgttgtcctgttgatgccaggagaaaaataaaatatgtattttaacggttctcatgttttccccaaatttctggtagtttttctttatttattagagagtttaattaattgaatataataaatgatttagtgttgaattttaaatgtataataaaaaccatctcttttaactaacttaaaaaaatgtgtgaatacatgcatgcacacatgaaataattcctttgccatccaatcaaaaacaattaccgggttagatgactggtcaaatcttaacctctacagtctcagcattacatccttttaaagaaatagtgattcaaataatgactgtgttattgagttatcatattcatagccaactttatatagaaatcctataattaatatgcttcctattagaatttttttcaattgcttaaaagacccatttctgcaaattgcatgtgcaactctacagaaggatttgaaagaaatgggcccagtgcccagaaaaattaggccctcctacactaccgggcaaaaataaaataattaacaatgaaaatgaggccatcgtagaaaagtatcttacaaatagaaatactttgaagacagaggagacctgaaagctttccgaaagaggtctgcagatggggctcatgaaccaaggagagcttacccatgggaaaatggaaacggtgtggaattcaaatgttaacctagagcatcctctgtgcttctgattatatcctgaagtcagatatttctgtgtctcagtcaaatttggctctccctgctaattgagctaaggaaatctaaattagtgtcttttcattattggtgttttactactttcagatatgtatatcttctatttttattttattttaattctgtttttatttgcctagtttttttttttttttttttttagactactttgctaatgcagtctccatgatgaggtctttcagtttcatctatcataataaaaagggctattgactctttcagagtcatgagactaataaaaagataaaggaaattttatatttatgaaattacagaaaacagcagaaacattcgtagtcaggggaaatgcctggagtaaaaccctgactttgaaactctttctcaattgtgttttctccaactgatggaagatagctaattaattcagaatcatgacaagtgctaggattaaccacactagcctgccaaaaagtccacgtgtattcgatttgattaaatgtgtataatcttcagtaatatcatgtaattgacctcagcaggtatgagctcatctggcaaatgagctttatttattcaaacttgtgataaaagtataaaaaacattttgaaacatcatcataaatcttcaccctttcattcaaaggcaggcatctttttggcatgtcactgtaaaaggctctaaagagaatatcactttcgtgttgtaattctgaagcagttccatgagactgagttccttagaaagataatctctttaagtttcagtggatcttaattctgaaccgacttttccagcattggacaaaacacaggagaaattaatactgtgtcagtttgtgttatttagacaatgtaaaaaagctttatgggtatagaaaaaatacactgtttttattcatttgccaagggaaatccaaaacaataacagatttagaaaattataaagaagttggtaagctaacctgcttttgtattatcaaaatgaaaatacttgcattgaatggaaaaaaatttgcagttgaacaaaatttttatgtttcatttacattacattacagtctctaagccacgtattttacatgtagtccaaatgagtattatttcaaacattttcttttgtaagtattttatcttattaaaatcatgcctgattcatggagatgacagcaatccgtcacattaaggaagaaagaaatgctttaaaataggttaaaagagttttttattagtcttcatgttatggtcaaggaaatgaaattaataaagtctgggccatcagatattaaagcataaaaatttgtatgatgcagtttcaggttcacttgttttatacctgatccattttggtttcattgcatgcattaaaaaataactgaagctgtttaactggattatgttggtgcaagtgatcaaagcagctttaatttctgctttccattaaggattttttttgtgctggtttgtgttataatctgtatatgtacatatgcatttcatttaagtgtgtcatgaacttcatatatactatcctcccagaattcttgctgaattaatcttgagttcataaaggtcacaatttctctaagatgaacttgtaacaatgtttttggaactcactgtaacactttaatatgttacataaatgggaaataggctttttaaaatgttgatgattctgttacacatgctccccttcaattttagcatcttcatttgtactggatactttcattatttatgggaatgcttgccttctagagtaaaactccttatgtgctgaaaggaaattaaggaggtttggctcttttactccattattgcaattaagaatttagcatcatcagtgccaaaggacaaaaagtggttcatttgccctagggggacaggacagtgataagatgatttttcgtcaaggatcattgggtcgtaattaagttacattcatggctattgctttttgaaggatgattggtaaatgacaggcttcatgtgcttagtacggacagtgtgcagtagggttttttctgcctctgtcagaaaatcctgttgagcctgataatgtaaatgtggcattttattctgaacaaaagagcagggaaatgagctatcttgtctaatcattcagttgtttaacaccgacttccagtttagactcaattggctggaaagcacttgacatgtgaagttagtgctgttccgaacgcatgtttgagtaaattttaaagtaagtgacagctaaattgtacctagggaaattacaaagccttcaacacagttaattttttggggaggattagttgtaattgcaacaccagtctccttgaagattcctcatttatagatgatgaacagaaaaaaaacatttagctctttcaagtgctggttctcttaacagaataatttttgtgaagatgatggtttctcttgaattggtttcttcccatattgaacatctgctgaggatttgtaagatagtttgtttttaaggagttcagtttggtttttgtttgtttgttttttcttttttaaacttttttctccccccacagcccttcttttctgtagtgattgcagatttgagcgcatttcagtaaggaagcctgttacataaattgccacttcactaacaatgtataagtttaaagtactttattccaaataaaaaaaatcaatatttgtcatctttcgttttttgttgttgttgttgtttttatttttatttttatttttatttttttgagacggagtcttgctgtctcccaggctggagtgcagtggcacgatcttggctcactgcaagctccgcctcctgggttgatgccattctcctgcctcagcctcccgagtagctgggactacaggtgctcaccgccacgccagctatttttttttttttttttgtatttttagtggagacggggtttcaccatgttagccaggatggtctcgatctcctgaccgcgtgatccacccacctcagcctcccaaagtgctgggattacaggcgtgagccaccgcgcccggccatctttcttttgttgtttaagtatactctctgggattagaaagttacttagtataaattacgagacttaagtttaaagctactaatagataaatagatagttgtcactcgtggttgttttaacaattccagattgtatgaaatacatttatgatttttacaggtatatgtattgaggaatgtatatgagttttaggagtacatgtttcttggtatctcaaagtagatagttttatgattggtggatgtcccatagaaatgtctgtccagcaaacttacatgctacatggtgtttgtttttctgtcagtgacgttatagcatacttcagtttcagaatgaggactcaaatgagtggtactatcagatttgccatcggagcttcaagcttatttatcgggatgttcttccgtgtaataatgaaaaaattgtagtttgtagtagctctttgtagtcatgttcccttaagaagtgaattctagattctagaatgaattttgatgcaggccaagtgagtctattcaagttaatgaatttaactctattttaagtttccaaatttcttgctggacccagcctatctcatatatatgttcttaaaatttaaaattacagaatcttttcctcaattttacctttatttcatagacttacagaattttggtaaagcttatatttttaatttgcaccaaacaaaatactgctttttaaaatgattgcttactttttattagtgtacgtagttttatgcatgaaaattatgtagtctattgaaattttgaggggggtgtcttgatttttttttttataaagggtaatagtatgctacagagttgattttcttttagtgtcatttgtgaaagcattgactaaatttttattaggagtgagcctttaaatatttgtatgtgaagctttaggaattatgcatatatgctgatacaagcatgggctcaaagttttgaatgcaaaattaatgtgtcaacattaatttcttcagaggattattgttatttcttagcaggatttaaatcatttctagtgctcaaagaaattcacagatcactttgggtcacagaagctagaagtagactgattggtaatgtgttgtcccacattttggttgtaaagcaatttttacctttctccttttgatattgtgcttcccttactgatttcatcctgcctaataaaagtggtattttcacctgatgattttctctgcttgtgcaaaacactttagatgaacctaataagcacagagtcatagaacctgttagaactaggagggaacccaaatgtccttgagttcagctgttgtgataatttgcttttcatcaccacttctagaaatgtatcacgttgctacagctgagtagcataagtactcttatcagttgggatggaaatccaaagtcctatgactacatagctatcttcatagcaatgcaaattttaggtgcttttaaacatatttttcatttccgtcatcacctaagttttcaagctttattatgaaagattaatagtgacataaattatgtggggaatgtaaatttttgtcttttaaaatgacatgatccaaccacaagtccgaattagataatagggactgaagaactgactagtcatttactttgtttttatctccagtacactttgtatgaggtatttcattataaatttctaattcattttgttggcatcctaagagcagtaacattggttcttaaaattactgacaaatatatgaattatttccattttgccattcttgttttttctgttgttgttctgaacatgtataatcttcagaagcatatatttggagaccaaagactattaacgtgtcgctttgattgacagaacaattattcattcatttattgatagctttgacctaatgtagggggaaatacaattgagacaatactattctagtttgggaattgatctggaaaagcaaatcatgccacttaaaaaaaaatcgtatgtgtgttagctttgctcttaaaaaatgttttagtagtttttcgttaagcagagttatagaaaggcaataaccgaacctgtgtctgaagtaagggaaaatactgattatataaagctttatatcatatgtggtagctactgtaccatttctcttctatgacagtaatccagcctgcaacatctacttgcagtttgaaattaacctgtaatttagtcttcaccccaaatgacaaaaattcaaatgactctgtggggtgccagaagatgcactgtaaacagggcttagtaaggggataaggtaagagttccatcaggataggctcgttttcactgtgtcactattattgcaataaaactaacatttcttcgttgtcttttacttttttagtacagcttaaaatcagatcttgataaaatagtaattcaacttagggcaatgtaacatttgtataataggcaaaaatgtgaaggctttaacaggaagtataaaaggactttctggttttgaaaactgttatgtgtatgagaaatttatattctctacaaagattttcactaattgtcactagttgtacttggagccatgtctctaaccatgcctctttttaaaatacctttcatactctcttttcataaatcgttaatttcttattccaaattgcaccactttattacattattcaaataccagtgcttttaataaagcataatgtgtaattagatgtactgaactgacaatgggaagtccagcgacttgcttacctagtaccttcctctgtttacctggtagccttagtcaaatcagccagtctctagatgccccagtttcattatttctttgaaagtaaaagggggtggcaagtagaattggatcatataatctctatagttcttccaagggatttcttttttttttttgaaacagagtttcacttttgttgcccaggctggagtgcaatggcacgatctcagctcactgcaacctccacctcccgggttcaagggattctccctcctcagccccccgagtagctgggattacaggcatgcgccatcacgcccggctaattttatatttttaatagagatggggtttctccacctcaggtgatccgccctccttggcctcccaaagtgctgggattacaggcatgagccaccgcacctggtcttgcaaggtcttaaatatttctcatactaacattgtccttttattttattttttttatattacctgtgaattttatttcagtatggtaagagagaaattacaaaaaaacttttaataaagacagggttaaagtaaattgaaagcaaattgtccttttatggggggaaaatacttcttaaggacccacaagaatatagtaccacactgttgtttaagaaactgatttaatgacagtgtctttttattttaatttctcacataaaagaaggcttgactttgtaattggaaataatttttaaaagcttaccctttaatgaaaaaagtatttagaattcttctagaattcactgaccaacacgaatatcctagttttcataatagtaagttcccatatatatgaaacttgaggttatttcctacttggctagtaaggtgacagtacagaaaatattatgataaagatgaaaaagttcttgaaaattccttattagctattggtggacatttaataacgtttaccaaatctgaaattattgagatacaattgttaaaggcacgtaagtgattggaaaaaagtatttgacggtagtccttgctttcagaagtaatacattcttacagcaactttctacataaagtcagaatttacagtaaaatcagagaatgccttaatctatttggacttttttataaagtaccctttaacacacgaaataataaaagatgaagcagggtaaatagtggattgctgatgatgtatgttttctgaacatttacttatatataaagattgtttctttttttcccccattttagctttgtggttttctaccttaagtaaagctcagttgtttacatattaactggtcattaaacatctctctaaagtattactaagagactaagctgaattcgatttattttattcattgctaatttttttgtttctaaggggcgacctatctactgctcttgaggtcgccattgactgctatgaaaagtataaagtattaccaaggattcatgatgtcttgtgtaaactggtagagaaaggcgagactgatctaattcagaaaggtgagtcactttctagtatcttaatgtagtttttttttcccttcttgctgatttaatcttagtgtattgttaagagaaaccagcagaaggccagcacattcagataaactttctttatacttgtgaaatctaaaagaaaaatatcaggtagatttccaatattatacatgttcttgattttagtaactgttcattttgaaaaaatgtctgttatttttgtgttctaattcttggtgatctgcctttatgaagattttttttacccttatcctcactagttctctttgtagctactctgttaggtacttaattagtcgatatagctatattctttaagttattcttaatatttgtttttaaaataaatttttcttgtatttgtctggaacttcatatgatactgtttttctgggtttttttttctcctaatatatatatttttttctctcctacctagcaatggactttgtgagccaagaacaaggtgaaatggtgatgctctatgatctcttctttgccttcctacaaacaggaaattacaaagaggccaagaagatcattgaggtgtgattttaactacagtgttctaattgtagagctatttagactcttaattagaatacatttaaaaattttaacctttaattacacttgttctgattcatgttaatagaattcaatcccagtaatgttgggggagggggatctcggccagcttctttattgtatataattacagttcagaaaaggcagtctggttgtatattaaatttgtttcctcactttgttaaattcactattatatatcaaaatgatatttgcatattaaatcttggattgtggaacaattaaattaaactggcattcctgggtgtaaagttgctaatcctctttgccaaagaattctttgttcttaaaagcagtggaatttaatttgctgcagaccatgctcaagatttatttgtaatgcttgtctacaagttaatcagccaaacaagtgctgtctgcaactgtttggcatttaatttaaattttcttcttctttttttttccactatgctaagcagcttatgggaaatggtaggtgacaaacctggcctatttaggattagtatattttatctaggctttactaaattttgcttagtggaattgataagtcaagggccaactataaagtctgtccaaattgtgattaatttcactattaaacaattctgtgtccactaagaaaacaaaacattccgcagaagatggacccattgccttaagaaaaattatttcatgtgattaaaactgttaacttataaatacatcagtaatcatgggttttctcagattatacttcgcttttggtcaatgtcgttttccaaaaatatacaggggacaggatgcaaaagtggtgtttgacctctttatttgtgtattgatgactgcttatcatgaaactgaaaatataggcacacaacccagaaaactgtatttttttcctcctgatgttttttgaagaagagaacggtgtagtatagaaaaggaggactgtgaaatcaattcagaactttcttctctttccattttatgactcaatctgcccacttgtcagcagacagtggggcatgctatcgtgctatcttggacaggtgcttctgtagcttaagtggttcatttacattttctagaaaatggtataatttttcttccacattcgcttctgaaagtacagtgaatccaaatgtgagaagagctgtctggctattgagttctgctcctctgtaggtacagtgtcagtattagcaggtcactgatcagagcggaaatgaagctcagctctgagaggttctgcaggaggaatgcatgtgcctgtctttgtgtagtaaggtgtaatagagccagaggcagaagagtgatttcttgttttgccatctacctgcttatgtgataatggacaagttattaaacctttctaagcttcctcatgtataaaagagaacataatatctgtctttaagattcaatcacataatgtatgtaaagcagcttgcatgtttcctggattatggtaagtgatcaataatattaattccctttgccccttaaaggtagggattgtgttgtcttctttacctcacataattcaaaatatgatgttcagcataaggtacatgtttgccacatgaataggcaagagaagactgcctcttaattacttagagctttgccacagtacaaccacatttaggaatggctgtctgctgatgacagaattttcgtagtaggtgtgtacaaaattttttaaagggtgaagaatagctttacagaaagaatactacaagtcatgagcaacatttttatcattcccaaaaaaagcaatagtgtcttatcattgggtagattcactatggttgaatttacagagctgctgtgtatttgaagcgttgtggaaataattagataaaccagtcataagctcattaaatgaagaaagatataggcaaggttcaatgtgtaaatatcacctgtttttttgtttgtttgtttttaagatgaattggcatacatgtatcatgtgttatatgtagtatatttgacagtctccagtcttttttttttttttttttttttttttttttgagacagggtcttgctttgttagccaggctgtagtacagtggtggcttagcttactgcagccttgatctcctgggcacaagcaatcctcagaaagacctagtctgaaaaaagtcctttctacaacacttcatcttatagcaattactacattctgtagattctctttttaaaggtctatctctttgactagaatgaagggaagggagaaagactgagaaggaaaggaaggagggaaggggaaactggtccaactgggaagccatgcaaatgctatcaatcacctttgctaaagagcttcattctggaggtttcagatgaagaaatctgccaatgccacctttaagggttcatgacaggagattctctatcagatctaagagcttcatttatcttgtacctatgttaattcaccctattttctgttaactcaggtctctctccgtcatttacatagcatttgagatgactgagtaaagtgtcataaaaatccaccaccattaccttaattttgagtgtagcagtgtttagggtgagaattaaaagatgaattgtgcgtctgcacttagagtagagacaaaagcattccaggcagaaggaactgcctgtgtgagggccctgaggcagcaaagaggttcctccctttatcgttcttctgcctctcagaactcttattagataacactaataaaatgacatctggattgtctggtacattatcagacatttaataaatgctagtttgattcccttccttctctatgccattctttactgtgtagaggtcaacccttctgtctcttctgcagatacatcctctgtaggctgtcttaagaactcttgggaatcaaacccaagggaagaggttagaatacgaaatgctaagtttaaagcagaacttttttctcatctttgtgttggttctgagaacctagcagtgcctggcacatgacaggcatttagtaagtgattgcagaactactcaaagggctaagagttaaattaaataatatatttcttgatagaaacctttaatatggtaacatttcatacatcatttaacttttttgcttgtatatataatctttccctggatttaatgtctggtcttggaaaaaaaagaatgagtaacccaaaaagtgatactttatttgtatggtctgcaacactgtcttcctgggaggtaaatgaagtacctgaaaaggtcatagactaaaagaaggaagtcatttttctgtttgtttgtttacagagaaataccttcttttaccataatttctagcaataggagtattggactagaactcacgaaccctgagttttagttctggctctgctaccaggaaccataaaggaggtcccatccttaaagacataacaacattactgtctttgtgtatcaggggctttcaaaatggtaatgacatttgacccacttttgagaaatgatcctaagtaaatcatctgaaaaccaaagtaggtaaagatgtaaattatgattattacctgtaacagtgaaagtttttctcaaaggagaaagggcgcaaatgaactccagtttgtttatgaaatggaatgatgtggccattaaaaataatgcttacaagattttggattttcgaatttgggatgttcaaccagtaaataatacagatattccaaaagtcagaaaaatctgaaatctggaacgcttctggtcccaagcgttttggataagggatactcaacgtatagtagttacggaatttgaaaccaggccctgagtttctgttttctattggttcctctgtaccatcctacgtccatgatctcatgacccctcaatatctgaactgtcgaaaataacttaccctttctccggaattcctctttcttgacttttccctctctccctatctgctgttttgcctttccatcacggtgcagccggagtacattttgatctcttctcagtgggggaaaaactctcttttgatggcttttgatttaagaccaaaagcttggattccagtgatctcccagtctttgttactcttccttttgttcttttccagatctgattcaggaatttttatcccatttgccttccttaataagccagcgtggatcgtatacacagacagtggattttagagctagggtttgtttgtttgtttgtttgtttgtttgtttgtttttgttttgtcctccaaaatttcaggatatgtcagttctcatgtaaatatatacccccttttgtgagttagtttagtatctcctataacacctggtcaagtggataattttttagttcatgatagtttgttaattggacttgctcagccatattttcctccttattatacatggtcttcaagtctatcttggaaaattttagagaaaaggacaaatgctaaaagacttaatagtaccatgagaccttttttgctcccttgttctgtgctagctatggggataaatatagttgatccttgaacaacataggtttggattgtgtaggtccacttacatgtaggtttttcttcagtaaatatactggaaaagtttttggagatttgaaaaaactcacagatgaactgcatagcctagaaatactgaaaaaaattaagaaaaaggtatgtcatgaatgcttaaaatataggcagattctagtctatcttatttgctaccataaaacgtatacaaatctattattaaaagttaacatttatcaaaacttacacacacatagactatacatgctgccattcacagctgagagaaatgtaaacagaagtaacgaagtactagtcatacgaagtaacgaagtacataaaattccctacagtacttattgtattactgtaattattttgaataacaccatgacatccatacacagtatcactagtgatgctggaagtgcttctaagaagtaaagttgtgacatttcaagaaaaggatgaattgcttgttatgtactgtagattgaggtctgcagttctggttgcctgccatttcagatagaaattcatcttgtaaaaagatgtcataaacttacggtatcaaaaaatgcagtactgtaaatgtattttctctttcttacaatttccttaacattttcttgttgtagcttactttattataatgatatagtattaaatacatgtaacatacagaatatgtgttaatcgactatttgctattgctaagacttccagtcaacagtaggctattagtagttcagtctttgggaaattaaaagttatatgtggatttttgactgcacagatggtcaaactctaacccctgtattgttcaagggtcagttgtacttggacggtacttgggttggggtggggatgttgttttcttttttttttaagagatggggtcacactgtgttgcccagactggagtgcattggctgttcacaggtgcaatcataacacaccgcagccttgaactcctggcctcaagcagttctcctatttcagtctcccgagtagctgggactacaggtgcataccaccttctccagcattcttgtctttgtctgtcccttctttaaagcccttgtgcacatgatttttcctcctactatgttaactaggggacatgaggctagggcgggcggtttttgttgttgctttcatttgacatctccagcagaagtggcaagaaaaatcagaacaggtgaaaatttctatttgagttaaattcaggataatcttccttgagacagagtttgaaatgcagtagaaaaactttcatttctttttacctaacaggtaataattattggatatctatttttactagtatacatagaagcttatgataagctttttatggtaaatttacatcagagtgttgtaatgaaattaaagtaatgacagttatttttgactttggattacttttttttcccctatacaagtaaacctagtagtgaattgcaactgcagaaagttgtggtttgaagcacagtagctcaggtggaaacaaacatgcaattgtttctataaaaatacttactgtatcctcactgttcattagatagattgtatgtggcaacacagaaagaactaaatatgagtttaattaacattaactgttttttcatgttatatttaacatcccaattagaattctattcttctccatgtttttattacattttctatttctgctttcaacttgcagtttttaaaattcaataagatgttaagagataagccagaaatcttgacattacagcagcctaggagatttagttaatctgacctagatgttcttttgatgattgagatttatatatgaaaacagttctcaatttcaaaatgaaacatgggaagatctgccatataaatcagctgtcctgccaaagacaggcagattaatcagccacaaacagaaagagtatgtcataaaagttgtgctgtttagattgttggcatttggatcagcagtaatattgaaagttgtaagtgaccgtagcccttgcattttgccgtgttctgaagaggattatttcatagtttttcaagggcttttagtatatattgacattggtttcattttcagtattatgcgtgtgaaacaaaacaaataacgtaagaaaaatccttgagaagaaattgtgcctgagtgtagatattaatagtatttgagactgtatttcaatgactaatttattcatcattgatttcttgtatcccaaaaagtggatgatataggaaatgagaacaagctatccaacttctagtctaccaatttttctgtcatcccaccaaagctgcaagatgttagtttccacttcagttcttaatttaacgttgtacaatgttattttttaaaattaaaaataatgaggacttaagagattagattcaagggatacctggtttgatcaacagaagtgagcggagaaagcagtaaagatacctcctctagactggagcagccagggctaatgagtatgtagttttcttaccataatgctgtgattgaaatgtagtatttaatggtgaagccctcttgcagatgatgaaaatactatagagtgacaaatccttggaattatgttgaaatggtttgtcttttattccagtatccaaaattgtaaactaagtgctttgaagccagacttattgaccaaacgatagtaatttctaattgaggatataacatatgtctcagttgtttaattgaactgagactataaaccaattttaaagtacttagcttgttttgttctttaaacatttagttttaggtgctaggcaaaagtcattagagtacttttatcactgtgaagttcgcaaagcattttcttttaaaaacgaaagccaatggtttattattgtgacaactgttactttgtgtaacattgataatttttgtctcctgagtctattggaataaagtgtatgtgtgtgtgttcaagagagagcgtgtaaatgagaaagagcacgtgcagtcaggtgtggtggcccatgcctgtaatcccagcactttgggacgctgaggtgggcagatcacttgaggctaggagttcgagaccagcctggccaacatggtgcaacccgtctctactaaaaatacaaaaattagccaggtgtggtggcacacacctgtaatcctaactacttgggaggctgaggcaggagaattacttgaacccatgaggcggaggttgcagtgagccaagatcatgccattgagactctgtctaaaaaaaaataaattaaaaataagagcacatgcatgtgaatgttgacacacactttttatttgacgttttctagtttatcgcttatttttgaactaaagacagtataaccattttattaattaaagatttatggaatgaactttgacgtgcagtgcagcatttggaaattatcggcgtcttctaggcagaggttaagcatagtttgtgttttatgctctcttctactcttacttaaaggtctttgataactatggggttaattatagtttgtattagttatagtataaatttagtatatagattgtatactagtatatatagtttagtatataagtttagtatatatatttggcagcaaattcataagaaaagaaactgtctttgaggaaaaaaataatattcagccgaagccttaccttgggtgctatgtgattattttattttacagactccagggattagagctcgatctgcaaggcttcagtggttttgtgacagatgtgttgcaaataatcaggtttgtatttgattcagatgtctcaatcacctaaaagtgtgagtagaaggcaagggtcctctgtatcacatgaagatttggggacttcgagagacagggcattgtggaagcagtgtttatctcgatcatttgccagataagcaatggcttatttcttattcctgaggtgcagtagaaaccctaaactgttaacctgggccctgatgatattatctttaactagttggttggagcaggctgacctaatgtccttggcacttcaagcctgcattagtccttagtggaagaaggagttgcttcccagagctctggaatttctgcttgccctcctctggtgcaggtacctgtttgcaccatgccaagtaaaagccacagggcaagaagagtgtaaagtttggagggggaagtatttttgttaacgtacgatacactcattgagttctcccacccagatacctttgaattagttattcatgttgtgttcttgactccaaatttttttaaaattgtggtaaaataagtataatgtaagatttatgatttaaccttgtataagtatacagttcagtggcattaagttcattcatattgttgtgctcagcccattaacttttgaaatgaagttcaactgcccttttggtaaagctaatttgaaagattattccactgctatttgttaactgtaaaatacatcctttacacaaggtagatctatctcttaatcttacttttaaggttgaaactctggaaaaattagtggagctgacacagaagctatttgaatgtgatagagaccagatgtactacaatctgctaaaactgtatagtaagtgatttaactattcttcacgctttcatttattctgttgaaggcagtggcaggaaaggagtatttggttttgagggagctccagggattgtcagaaggcagttttcattcaacagaggctcaggtagaggctagattgaattttatcacagaatgttatatcgtagcactagacactgtatgtcttcataatttctgacattcttactgcaataatgagaaagtacgaaaaccttcatcagaaccacagaatttaataggactttttgaggtaagaacggtctttctgttctttttatttaaaccttcaggtaaatttattggtgacttttataaataggtaaccaccaacacattcatgtaagtagagatttttttctttttgcaaaaagatgcttatcttgcatatctatatacaaactcattgttaaacagctttttaaatgtcattatatatttttgagtcagctatatattacaaacatttttctatatttaatcacctacaaataacttatatactacatagatatactaaaatttattcagcctatcatctcctattactgggtttgtgaatagatttccattttccatttctaaaacaacactacgttattcatttttgtgccttaatcttcattcacatccttaactgttttttgaggctgaaatcttagtatttgtatttgacatttctgaaactttcgatctctcttttcaaacaatgctctagtacttttatactagtgtacacatttggagctttacagtttcttttaggatatttcggtagagaggaataacacttagaacagccagtgacctttccctatttgtttcatggatgtttatctagatttattgttcttcttttctcttggcaaatttcccttcaccaaacgaataaggggatttatttgtcttttcaaacttgtatttattaccattgaaagctttattttacatctcgatgatgtaaataaaattaaacttgcttaaaattttacattccagtttttggttgtattgaaatacatacttcacagtgtaattcttaagactttggcttgaacgatgatcaaattcttgcacacaatgctgagtttggtattgaatgtatagaattaaaaacctgtattttaggcagttggtcctcaaattgcaaattataatctgtgtttgagcactaacattccactctacctactttttcttccttttaaaaacaatttcatgatgaaattctaatgtgccaagttcaaaagaagcactgactatatgtctaaatatgtcttattatttcaagtagtcctcatggaagactatataaacttggattcagaaaaaaaaaaaaaaaactatgaagcccttactgtgtgctagacattgtggtaggcactgcagatgtaaaggtagtgctctgctgaaagggtcagccccatcaccaagtcttaacactgcagcgggtaagaacaactgtaagtatgtggtagtctaaggccaggtgagaggtggccagccacacaaacttactcttcctattcagaagaacttttactattagttttgctttgtttttgagacagggtcacccaggctagagtacagtggtgcgatcagagctcactgcagcctcaacctcctgggctcaagaaatcctcccacctcagcctctcaagtagttgggagtacaggcatgtgccaccacaccttgctaataattttttttttctttttaactttttgtggagacggggtcccactatgttgcccaggatggtcttgaactcctgagctcaagcagtcttcctgccgcagccttccacagtgctgggattacaggcatgagccactgtgcctggcctttttttttttttttttttaaagaaacaaaaaaatatacaacatttagcttcatcttaaaatttccattagggatatatggtctctgagtttaatactattttcttgtccttaatttcctctatgtgtcctattggacacctgtctccaattccttcttgcgttgtatttgagtcaatagtttgaggaggttggcagagtgtggttagcttcttaggaggctggaagccagtggaatcctatagagaagtatatattctttttaaccacatttgtatacttcctaccttctgccgtgttataaatggataatctggttatgatagccctaatcctttcctttctgaagaaaaagcaagctatccccttctgcattttgccttcagacttgggccactatttaaatattgttacatggactcagttgctttgaaatggaacataagatatgaattgggtcttgctgtgttgcccaggctggagtgagtggtgctcactgcaagctccgcctcccgggttcacgccattctcttgcctcagccttcccagtagctgggactacaggcgcccgccaccacacctggctaattttttgtatttttagtagagacaggttttcactgtgttagccaggatggtctcgaactcctgaccttgtgatccacccgccttggcctcattatgctttttaaaaatccatattttgcattgtggatttctttcttaggatgtgattttagcccttgaaagagattggattagtagttatttttggatatttgttgaaaagcaactttccttcgtttattttaaaacggttcctttcacatacttaatacacacttaattttgttgtaaatcataacataatacagaaacatgcacaaaacaaagatatgtagctcagccaacacccatggaactgtgtaagtcttacatacatttaaatactagcttttattaatataaaactgctttcattttctatggactcaatataacatgatctgttacaaaattttgtcctaattcaaacttcatttctatccttcccaatatattgtgacctttcattgtgacagtgttgcaaaattagcttctagaacctataacaaacattaattacatgaatgaaatgacttcctcacttgcttaaggaattttctattatttctatatgacaaacattttcttatgttctgaacacttctttacagatagaaagtagaaattagtttctttgtatagtagtctatccaagagtcaaactgccttacatttgtaattttgcaatacaattctttgaatctatttaaaaagtatgtataacctcagcatttattccgtctcagtaatgattcatatattatttcttcaagtatgtatagccatttacatttcttttcatattgtatggctttttcctcctccattattacacaagtgaaatggacatattctgattactaaagattcaaacaatgtaatactatactagctaactatgaaaatgtcattgtgtccaccaccaccccctaaccgcttatctcagacgtaactttgtgaattggccatcctttccatgtcttctctgtacattgccctctctctacctttatatccatgtattttttatgtatgtacctattattttgattcttttatatcctgttttgattgttttatactttacttgtttcacattctacatttctacattgtggcttctttttgttttacttaacaatatgaaataaattcacaagaaaaatacttgctttttctcccttttaatacgaatcttaactgctggtatccttaaaacctctgaagttgatgaatgacttttttaaaaaatgaatttatgggttcttaacatgtatttgtgttttattttagtccttatttgttttagtgttcacatctcgcccaggctggagtgcagtggcccgatctcagctcactgtaacctccacctcccaagttcaagcgattctcctgcctcagccaccccagtagttgggattataggcatgcaccaccacacctggctaatttttgtatttttagtagagatggggtttcaccatgttgtccaggctggtctcgaactcctggcctcaactaatctgcctacctcgtcttcccaaagtgctgggattacagacacgagccactgcacctgcccacaagtcttattttaataggtgcatctctgtaatatccttgtcttcccaaagtagaagctttttgtataatttgtgctttttttaaacaaagaaaattatgttcccagaattcttgcagcctaaaggcacggagttgtagattatccacccacctttttattgtttagaataactaatccctttttaaaggtccttagcagtattgtgtctagctgttggaaaccttccctgtcttcccacagtccacaaggaccttttggcagtcaacagaagtgctccactgcagaataaagattcagaggcttggattttttttttttttttaaatcaaataagttttatactttcacatacttgaaatacttgaattttatattacacaataacattttaatgaagaaaaagcgtaattagttaatgagagtcttgttttgaaaattggttgtaaatgtaaggcttttatattagttgggctaattttatcagtatatgtataaaatcactctgcactttaggttaatttctgccatctgggcctccttgcgatgtagtctgtatgaaagtttaggctgcagctgggcaaggtggctcacacctataatcccagcactttgggaggccaaggccagtgaattgcttgaggtcaggggttcaagaccagcctggccaacatggtgaaaccctgtctctactaaaaatacaaaaattagtggggtgtgctggcgcgcacctgtaatctcagctactcgggagtctgaggcaggagaattgcttgaaccctggaggcggaggttacactgaactgagatcgggccactgcactccagcctgggcaacagagcaagactccatctcaaaaaaaatatataggctgcaatctgtgtgacccaggggaatttctctaagtttttttttttttttttttttttaaattgctgatttcccatgaagaatgagtatgctttgttttttgttctttgaattttttacttttaggagtcattagttatcaaaaaacttaactttttggttttggggagaataatctaggaaaatcctacgtgtttttagtatttttcctctaaaatgctgaggaacaaatgtattcatgttgtctggaacatttgtgctgtaaaacaaacccctccttcctagagctggatgccacacaatccagatatttcttatacatactagcaaattaaaaaaagacatctaaagcagtttttctgtgcatttaataattgtattacacttagtgtcatgtgacatttttcatatcttgccccagtttttcacaagcagaaactaatttattatattaaatgacttgatgtttcctcttccaaccatgagaatttctaaaaacaaagttttgattctggagtttttgctatttgtaaagactagattaccacatgaaaggaaatgggcttttcaatatgaagggatctgcctatttccttcccagcccttgtaatagtctgataacattatcagttgagataagaaatctaagaagattccatgtatcacacagggtcatagaaactcttcatgtcaacacaagaaacatagacaattctctattcaactaagtgaaaaggtttgtagatttgtcacttgtaaagagaattacacacttgcaatcattttagtacacaccacagctgtgtactatacggcagcagcccccaacctttttggtaccagggactggtttcatggaagacaatttttccacagaccaggttgtggtgggggatggggatggtttggggatgaaactgttccacctcacatcatcaggcattagttagattctcataaggagttcacaacgtagatccctcacatgcgcagttcacaatagagttggcactcctatgagaatctaatgctgccgctgatctgacaggaggtggagctcagcgggtaatgctcacttgcccacccaccgtacacattctgctgtgcagcccggttcctaacagaccacggaccagtacctgtagcctttgcaaagatcatagatatatgtataccgtatgcactgcatacaatcacagatatatgtatattgcatacggtacacgtatgtatgtatgtatatggtggcatatgccatatatctatctatctatatctatatatatatctctatatatagagatatctatatatagatatatatatatctatatatatatatatatctatatatatatatatttccaggatctttgcaacgctaaaggtcatagttgaattgtcacctgtttctgattttgatttcggcagtaggcactttctcagtaacattaaaaagacaaacttcttatcaacatgattggaagtgtgtaataaagtgtgatgggggcttcttgttattgctttttaataggtagggtatttttggtttgtaattcagaagtacagagaaaagttcccttctcgacttcgggtcacggtcacttttggttcctttccctaaaggcagcatttggaataatgctttcttcaacatcaaataagaaaaagttctaaatatttttgtgtattctgtttagcatatttattgattaatttctgcttaatcaaattctacagaaataaacggtgactggcaaagagctgatgcagtctggaataaaatccaagaagaaaatgttattcctcgtgaaaagacattaagattattagcagaaatccttagagagggtaaccaggaagttccgtttgacgtacctgaggtaattgtttttggcataatcgtaacagattttgttgtcagtataattaggttatagattagcctacttttatattgaaaagattaccagtttttatttaacagaataactttgttttaaagttgtggtatgaagatgaaaaacattccctgaattcttcgtcagcctcaaccacagaacctgatttccagaaagatatattgattgcctgccgattgaaccaaaaaaaaggcaagcacatacggggatgggggtgtgtgtgggggggtggtcttctttctaatagcagtgtggggtgtaagcccaaccaattagaagtgctctaggatagagataggacttaaattttacatatttcttgtccccttccatactttaacgaaaacattttggggcaattgggaaaatttaactattgactgagtggtagataatattaaggaattactctttttattattttttttgagatgaagtctcactctgtcgcccaggctggagtgtagtagcgtgatctcagctcactgcaagctccgccttctgggttcacgccattttcctgcctcagactcctgagtagctgggactacaggtgtccgcccccacgcctggctaattttttatatttgtagtagagatggggcttcactgtgttagccaggatggtttcgatctcctgacctcgtgatctgcccacctcggcctcccaaagtgctgggattataggcatcagccaccatgcctggccggaattactcttatttttattagatgtgataatggtattatgatttacttatagggaaatgttctgaaattttgagatccacatgagttattgagggatgaaaaaagtcaaaatttctataatgtatttaaaaatgcttaagctataaaaaacgaagcaggccgggcattgtggctcacacctgtaatcccagcactttgggaggcttcagcctcccaaagctggcagatcacgaagtcaagagatggagaccatcctggccaacatggtgaaactccatctctactagaaataccaaaattagccgggcatgttggtgcatgcctgtcatcgcagctactcgggaggatgaggccggagaatcaccggaaccggggagatggaggttgtagtgagccgagatcgcaccactgcactccagactagcgacagagtaagactccgtctcaaaaaaaaaaaaaaaaagcaaatctagtaagatgttaattgttagatataagtgatgggtatatggaaggtgaggttcattatactattctttttttttttttttttttccccccggagacaggtctcactctgtcacccagactggagtgcagtggcgcaatcatggttcattgcagcccccgcctcgtgggcttaagcagttatcctacctcagtttcccaagtagctgggaccataggcacacaccaccacactcagccaatttttgtagtgacaaggtctcgctatgttgcccgggctggtcttaaactcctgagctcaagtggtcctcccacctcggcctcacgaagtgttgggattgctggtatgagccaccacccccaacctgtactattcttcatactttgctgtacatatgaaatttttcgtaataaatgctattgttggcatacatttttattaaaagtattttttgaaaataactttttgtggcacatattataacttacttgaaagcaaaaaatgattaaggcattaattactatactagtatgtgttgaagtgatccagcaatatctcaaggttagaggtctgtttcttgactctttccctttctctagtattaaactttcctgaagacatcttcacctttattatgcctactttaaattttttatgaccgtctttaaccctctgttatgagcttgtaagttgaattttatgtttttacttagacttcttatactgttccagaatcatatattactcttattttctttacttttgttaatttcttttcattctagctttccatagaatgattccttcagttttggggtggatttcaaggatggttcatgatagtttaccattaaggaaataaacacaagagaatttttttattttagtattgatagttttgaggtttattggaaaggaatcaatttagaaatttatagaacttcttaatttcctaacttaactagaaggtttggccaggcttgcaggctcatgcctataatcccaacaacttgggaggccaaggtgggcagatcacttgagtccaggagtttgagacctgcctggcaacttagtggtatcccatctgttcagaaaatacacaaattagcctggcttggtggcacaggactatagtcccagctactcaggaggttgaggtgagaggatcagctgagccggaggttgaagctgcattgagccatgatcgcacctgggtgattgagtgagaccctatctcaaaaaaagaaagaaagaaattttgtggcattgatgtaaaatgtatgaagtaaaaataagttcttatgcctcctcagttacctatagtataactttttattcattctgagtcattttcttttgagaaggagtcttgctctgtcacccagggtggagagcagtggtgcattctcactgcaacctccacttcccaggttcaagtgatgctcctgtctcagcctctcaagtagctgggactacaggcgcacaccaccacgcccggctagtttttgtatttttagtagagacagggtttccccatattggccaggctgatctcaaattcctgacttcgtgatctgcccgccttggcctcccgaagttgctgggattacaggcgtgagccaccatgcccggcccattctgaggcattttcctttgctgcatattcagtctatatatctttgagtacacactatgcatctttgaaagcgaagtataaaattaagcttgattaatactatgtaaatgttctgatgaacttgtgtgtgtgtgtgtgtgtgtgtgtgtgtgtgtgtgtgtgtgtgtgagagagagagagagagagagagagagagagagagtcttgttctgttgcccaggccggagtgcagtggcgcaacctctgccttctggactcaagtgattctcctgcctcccaagtagctgggattataggcacccaccaccatgcctgactaatttttttttttttttttttttttttttgtatttttagtagagacagggtttcaccatgttggccaggctggtgtcaaactcctgacctcaagtgatcgcccacctgagcctcccaaagtgctgggattataggcatgagccaccaccacgcccgtcctctggtgaagctttgatttagctaaatgactaaaatgaatatatggttagtgtacagtttaagtgaaaacatttaagtagttaaataattaaatacaatgcagtgtgtattataaatgtggagctacctctattctggaattttcatttatctaattggtttcatcctgttaattcttttcttttctttttttttgaggcagaatgttgctctatcacccaggatggagtgcggtggcgcaaatcttagctcactgcagcctctgcctcctgggttcaagcgattctccagcctcagcctcccaagtagctgggattacaggcaccccccaccacccctagctaatttttgtatttttggtatagaccgcgtttcactacgttgtctaggctggtgtcgaactcccaacctcaagtgatcctcctactttggcctcccaaagtgctgggattacaggcatgagccactgtgcctggccataactcttcagagtttcctgtttctttttttgtatatctcaggattcgaatgtttagtaaaatatgaatgctttgaaaattgaatgcttacattaacatttttctggtagttcagtctacttaaaggtatatcgtgattgtcacattggaaacaaacgtgcggtgaatgggtttggtatattaaaatgctaattaaaaaaaaaactaacagggactaattacacagccacaccaagttaatgtgaaggccacagttttagaaaacaacaagagtttccaaacaagtgaaatactatatacgattgttaggaagttgacaataattgcattacatcttaagtttttagccccctaaaaagcattgggtattgaatggcagattttattgcagtcatcttattgtgtgtcatggtttaaatattttatttagcaagccattctgtgactttaataagtaaataaaagtcttaaatttgtgatgcattgatactggtactcaaatgaaaatatgtctttattttctcccgtttcagaaaagtgaaatacaccgaatagactaggtatctgatggaataatcagtaaatgatagtggagtttcttcttgcatattagcgtgtttttattttccgttttttgccagtgtcctggaatatacagttgttcacaaccatagaaatctagtgtaaagcacttggaaatttaatgactaacagggactgttctatggaagactgacttgaaatgtgataaatctctgccattgttactttcacttgcccaaactgttctccttaagatgcaaatataaatgttgccgtatatttttttctccaaatttagcttaaagggataaatatttctttgacagtgccacttaagtttaattaagggactaatgcacacattccctaactcatacatagaagcgtaacaattttcgcctgttcagaaacttctaaagtagcttaaaatgttcttctgaacattaaataatatcatgttctgtcttaattagaagttttatatttccttacattgagccctatattcgtagaaggccgtacgtgatagttcatttatgccccatctttattgtgatttgtttatccacagaagggagtagattgtagtttcagttggctgtttatagccaggcagttttatttcagaaaagtataagtgactgaaaagtgtagttacttctcttttggtaacatcttttcattcactgacagttattgtgaacaagtgaaataaaactgttaatcagtcaaacaaatgttgcttagtttacttgttagatatctgtatatttgaaaattgtatgtttttgtataagtcctgtcgtagccaaataatgtgatctcctaattttagaattataggctatattctctttagtgctattgtgctgaaatgttaaccattgtaaccacccacttatagattaaagattgctttaaaatgaatcttttgctcccctcaatctaaattatacctctggtttatttggactttaacacacattttgcgatttattttgaaactagtatcgtcttttcataaattcagaagagctgtttctcatttttattacaaagaaaataatgtatcaacttaagaaagctggtatgagaaatcattttaagaggaaaccccttcaggcaccatccattcagattaaggtgtagtttccaaacctgtagctttgtctttaaaatatttgaagaattatgtcagtgtgtctctctatagagtggtaacagtgggttggtattaaaaagcaaaaatatttgggtttaggtctttgtttcaggattttttccatccttttggcatttcagaataatgtcatctcattttttttgtctgttttctctcataggggcatatgatattttcctgaatgcaaaagagcaaaacattgtgtttaatgctgaaacctacagcaatctcattaaattactgatgtcagaagattattttacacaagcaatggaagtgaaagcattgtaagtgttagtccatttattaaacctcttgtttaaaaaagaatattggctgccattagccaataattataatagtaatgtgctgtgtagtaaaattgcttgattggcctcagctacccataaaaatcatatgaaatggttaactaactttatcaggttttttcaccttcaaaaaaaaacacctttactggccatatacagtgcagtacattttgcttactaagttatattccatcacaattcatttaagatatccatgcacagaaaagtaattttattatattctgttccttgttcaacatctaaatccatgtaccttttgtggtgggagcagcctgagaaaacaaagacaccatggactttgaacttagaccaagatttgaatcttacttaaaagttctgtgaccttgggaaaattacctgctatctctgatccttagttcttcttccgtatgatgagtgtatgataatattacttaatattaaagatttcttctatgtgttgaagaaggtagagtgaagtagagaaaacataggtactgaacacatcttatttgtgtttccccctcctttcgtgttgtttttggattaaaaaaaagaaatctgactgggcgcggtggctcatgcccgtaatcccacaagtttgggaggctgaggtgggtggatcacctgaggtcaggagttcaagaccagcctggccaacatggtgaaaccctgtctctactaaaaatacaaacattagctgggcgtggtggcatgtgcctgtaatcccagctactcaaaaggctgaggcaggagtatcacttgaacccaggaggtggaggttgcgttgagctgagattgcgcaactgcactccagcctgggtgacaaagcgagaccctgtctcaaaaaaaaaaaaaaaaaaaaagaagaagaagaagaagaaaagaaaaggaataatctgaaaaaaattttaagtccgcagcacttttagaatattagaatcctaagcagaaaatggatgcctgccatcctttcacatcacaagaaaacctggcagtgtcctagtgttgctaaagttatgcatcatagggccgtatttagtgtctgtgttttaatgttgaaaaacatgttctgtatgactgtacttgtctgtgtgtatatgtgtgttgtcttgaatcatcatttgtatgtcttgatacaagagtcgcactaggactgttgggtttttaatgtactctgtgtgtcatttgtgtgttttctcaattcctaatcaaattttatatatatatatatatatatctagaacactcgatatacccttaattagtgacttggaaaatttgacagtgagcagtatcctgtcatctgtaaccactaggtcaagggtgtggatcatctaaaattacttttctcagaaaattatgaaactctccatcccaaccctctctgtgataatgaaggagagccagaaaaaagagaagcattttgtgttgagaattaagtatgattaagtgatgagatagaagcaaagacagaaaacttaaaaaaaattagattttgagtttggtcacaaagacctctgaaatgcttcctgaaagtacagattttaattttatttatttatttattttttcattttcattgggtttcttctagaacagtgatacttactctggtagcataagaagattcctctcagctcaccacaaagattctgattcagccaatttggtgtggggcctgagaatgtacattttactccatagcccaagtgattgaagaatcatgtcttaagcattctgatcgcatgtgattaataacaaattgtacttgatgtatcacatgtaactatattataaaacatactcaaaatagaaaatcttcataaggtgaaatttttaaaaagagatttaagcccaggcacgttggctcatgcctgtaatcccaacactttcggaggccaaggcggaaggatcccttgaggtcaggagttcgagaccagcctggccaacatggtgaaaccccatctctactaaaaatataaaaattagccgtgtgtggtggcaggcgcctgtaatcccagccactcaggaggctgaggcaggagaatcgcttgaacctgggtggcagaggttgcagtgagcccaagatcgcgccactgcattccagcctgtgtgacagagcaagactctgtctcaaaaaaaaaaaagggagagagatgtaaaggtttccttgccttaccctggagtgttcatgcagtgtgcatgctgctcattgaagaccactggtctagagtagtttcaaaactgcaattgcagccaattagtgggtcatgacatctattaagtgggacagaaccaacattgtttcaatgaaatagtatagactatttcaaagtatttcctgtagtaaagatattatttcatgaaaagttgctttcagttatgcgtgtgtgtatgtatctgtggattgggttgtctatgtaaaacatcatttcttactataatcctcccatggatcttgatctaccaaggttgaaactgctgacctggaagatagttgtaagcatgaccgtctatttgccttaaatttacaacctgtgaaacataggtttatcttcttcccttcttctctagatctttatgaagccttcctgagataaaattgacatgtaaaaagatacatatttaatgtatctatctcagtgagtttggggataagtatacacccttggaaccattgcctacttcaaggccacaaacatatccttccccttccagagttttttcccaccctcaatattattattattattattattattattattattattaattgggtttttttgtgtgagagagaacacttatgatctatcctcttagcaattttcagtataaatacagtattgttagctgttagcactatgctgtatagagctccagaacttacttatgttccataactgaaactctgtactttaaccattatctcctcatttcccctcctcccagtctttggtgtctaccatcatactctgcttctgagtttgacatacaagtgagacttttcttttagctgtgttatccaccagggttatttgggagttgccttcctccgtgcgtctgtgtctacccaagagaacccaagatccaaagcctgaagtcaatctgggctttggatgcatgtcctctcccttgaaccaataaaatgttatatctaactatgtagaattgtttcatgggttaaattgttgagtacttttaaaaataatgctggactgaaaattcagaagtgaaagttcaagttacgaattatccaactaactatgttacttgagatatttcaagagatattttgtgggttcggttcctgtttattgccaactaggtcctctcttcccatttcccattctgtatcagtgatcagagtgaaaaacaactgctgcttttttataggcaactttattataatatggtggtcaaatgagctactgtagcaagtggcggtaccgccctagtattattctggcagtcttactctggatccataaatagctgtttttacagtttcctatataaggtcacttggtcaaccttgagagccatagttttggccgagcatggtggctcagtggttcgtggctgtaatcccagcactttgggagacagaggcaggtggatcacttgcagtcaggagttcaagaccagcctggccaacttggtgaaaccctgtctctactaaaaatacgaaaaattagtcaggcgtggtggtgcgtgcctgtatgtaattccagttactcaggaggccaaggcaggagaacggcttgaacccgggaggcggaggttgcagtgagccaagattgcgccactgcactccagcctgagtgacagagtgagaaaaaaaaaaggccatagttttcctatgaattaaaaaaaatatcatttttattttgcctttgttgtcatctaatgtgttacagatacacttgacctctaataagatttcttcaattttatttacaaagtcatttaaccttcccaataagccatggaacctctaaagtaatagtaacttttaaaaatgttcaataagccatctttctttcatttttagtttcttcatgtttcaaaataatttatctgtagtgaattctttcaagggagggaaaccactgattcaaagagcagtaagggatataaactctttttttaaatctctgctaacattaaaccatattcttagggaatttaggaatcatgtaacaacaaccctactttatcttttgagagtagcacttgattttctgtcgttcctcttggcttcctgtatcattctgttcggaaataatgctatatctgtcactgatgatttttgttgaattggcctgtttttgttatcctaaataatataatcaccaactaatgtcctttctgcatattatgtaagcacagtcattgcttacatgaaagctcacttctcatgcctatatttttacatgtattataccatatttacttaaaagtgttacctaaaatccattaatccattaaaaccataaggcaacaaaacttctcctaaatttgaaaggctgtcatttcagagcaataaattctctgaaatgtccaatgtgaaagtttccctataatactgtcttctttggttaagatagtttaatttttgcagttggtcgtaaattgaaagagggtactctttttcccctataatttttttcccttcattttgacagttctaaaaataaaatgtctagaattctctgctatccagttcagtaaccactagtcatatgtgactgcttaaatttaaattagttaaaataaaatataattaagatttctgtttcttcatcagagtagccatgtggctagtggctaaccctattggacagccaatagggttattggatgattggatgatattcccatcatcacaggaagtttgatttgagagctctggactcgattttttccagaaggaaagatcaaaattaggtgtgaaaagttaatgtcttttattatattgtataaatgattccaatataaagatctctacccgcaactttttaaaattttttccttttgccactttggaatctgttttggttgtaattggtcagtttctacatatgtaggatatattattatagaatagatctggggtttcttcttcctgatatttatctccactttcatatttgtaatgagcaggcagcttgagagaggaagagattattgaaaaagaatgttacaggctttgaggtttttgaaaggtttgtagttcatacttagtgtcaaagacaagttttgttgccttgtggttttaatgaattgtaggtgaatatttttaaattaatatggtataatacatgtaataatattagaagtgagcttttaatagtgtctcatttttatttaatcatgtgaaagattgagaaagtaaatcctttgtgcaattcttagtctcatgcatgagttgttgacttaagttgttgacagatgggacaaagggagaaaagtcaaactgagcaatgggtactttggtgggataaagaggattggtcggaggaataagaaaatcctgtgtccagggactgcaggggtggaccttagaggctgaaagtgactgagagaatgggcatgtcgtagtgtctctgggggattttcttgggattgatgaaaataatttagcagtgaccccacttttgttgcaatctgcccagcttatatgtccgtgttggcagggcatgctgttgttggcaacagggtcatcactgagctcgataaggcaaatgggagcaattgcttttgctccttttgacctgtttagattttctaatccggagatgaactctgggagcattaaggatgcagaaatttcatcacaggagatgcgcaaacagtgtagcaaacagaaatctccagctaggttttggggttttctgtttgtttttgttgtttcattttgctttttttaaatcctgtaggttttattgaaaagtcaagtgattttttgctcttgagttttaaaagttggtgttttgtttcaaacttaagctagggcaagatggttgtgtgaaatttttaattttaaagtaccaatagtttgagttctgcagtatgttcagcttcagaaactgtatgaatctagatggcagaaatttgaaaattaattgaccaaatgatagagtgttagtaatctgctttagtttttatttaaaatgtacagtgctgaaaataaatcctcattttagtttctggaagaagatttttacattttataattactgtgaatgtagaaaaaaaaaagtatccagcttaggatatggcagaacaatgcggggcacgcagttattttagtcatctaatatgtcagcattcaagaatctgaaccgattgtttaaaaaaaatcttgtactttgtttcttttgttgctcatttccaactttgtcatctgtcagaatgcaaaaaaaaattatccttctataaccattgacaggataacacaaaagctgtctccaggtcgatattttgcagcaatatttttaacatacgaacagtagtttttataatttcaccttggtgctcaaccatttattatcgtatcagaagcatgtcagtaattcctttctaaatgtctgcttcttttagcgcggagacccacatcaagggcttcacactgaacgatgctgccaacagccgcctcatcataacgcaagttaggcgggattatttgaaaggtatgtcacaatgcttgacctttacgtcacattaatgcctctgcagatttttcttgtaacgcccttcgaatacttggataaaggagtccatttagcaaattacctgcttatcaagagccttttgtggtagctgagagacataaattactgtacatgcatttataatacagcttgaatatgaatgtacttgtcatttgaccacttagtccagtttccattccatttaacacaagatgggttttcttaagatgaatcacagctcttcagacatgcaaaatttgtgttccagaacgagagaaagtacaggctttcaagtgcgttaaaattcacagcacaagtcattttgctttggaaattaacatactttagagcatctgaaacaattcccagcagttgtttcttgcatattgtgttggttgtgtgtgagataccaaatcagttaaattgagtgttaaatgtgtgggattgtgcaccaaatgattataatattgatttttaaaacttaatctaatacttttttaatagttcataataccaacagcaataaaatacagtgtttgtttgaagtttggagttttcaaattaatgttaagagaatgacacctgaaagatgtggacatgactttggggaggattgggattggggtgggggccactggtttgatagaggctgtttatgagttttgaaggggatgaattgggatgtggaggtcttatgaatgatctcccaaggggcactatgacgaatctcttaaatttagctaagtagctttccactttaagatttacatttgaatttgagtgaatacagtgatactgcagttttgccagtacaacaaaacccacttaggagatcttcaagaaaggttgaaaaagctctggaaatgtaaccttattgcttcctatctctgtaataatggtattattcctcactgcatgttctggttttgttttgggtttttttttgttttgttttttttttttgtttttgttttttttgagatagggtctcattctgttgcccaggctagagtacagtggtgggatcgcggctcactgcaacctccgcctcctgggttcaagcgattctcccacctcagcctcctgagtagctgggattacaggcgcccgccaccacgcccagctaatttttgtattttcagtagagacagggtttcaccatgttggccaggctggtctcgaactcctggcctcaaataattctcccacctcggcctcccaaagtgctgggattacaggcgtgagccaccacgcccggcctgcatgtttataacataagttcacatccttgagaggaagttgttgtttaattgtgcagctttaatgttgcttataatacctaaatgtactggtctttagctgtcttcctaattgattagtactgaatatgtaagtgaatagaaaacacttcttgtgcccagacttttgtggctaggcgcaatggctcacacctgtaatcccagcactttgggaggctgtggcaggaggattgcttgagtccaggagttcaagaccagcctgggcagtgtagcgagaccttgtctctacaaaaaatttttaaatagccaggcatggtaatgtgcacctgtagttctagctactcaggaggcagaggtgggagaattgcttaagcccaggaggttgaggctgccatgagccatgatggtgccactgcactcagcctgggcaagaacaaaacccttctcccggcccccccaaaaaagactttatgtcctattagtattttatgtaataaaatgataaacaattttaaaacaatgaaaagttaaacttgctcgccatataaataagctcattgtcataaatagcttttgtttctgtagacatggagataagaacaaaacacttttctaatttcagggggttcatttttcagctgaacctgacccagatttcttcagctggattggtaccctttatttttatgttaggtgccctgtgtaagctacaggaaaggacatggtataatttctcatctactcttctgagctgttcagctcaattggaggttgcctgagagcaggagcctcgagcgcactgttcctgcactacctcccccacccccaccccacccccctccctgagcacatcaccacaaacctgttgttagagtaaaatgatcatcagtgaggacaggagtagtgtttgcactattcccatcttcttattttgctccatggctgatgagagctcttgatttttaaaaattcccttccgttgttctgcctttcttttaggtttccttttctcaaccccatctaaagcagaaagaaaaaataaagccgattaaattttactgttggtgaatattaatagctgatacgtggcacttgtacagtgtaattagtatcactagtgagtaattgagtaaatgttggaattaggtgacagtgggaaaggacctggggggagggatgtggatgggtaacatttttggtgtccctgaagtcattaactgtacagaaggcaagccttatatgagaataggatttaggtcacaaggtcctgtgctatctttagacagatgtgaaatggtctgttctccccacccttctgctctcttgtgcacacgcgcactcatagacggaagctctgggatcattggaatcttcgagtcttgtctaaaaatatgattttaccttgggcaaactaatctctgtgcccaggggtctcatctgtaaaattggtacttgtctcggaagggtagttgtgacagtagctgtttaaactgctgtgcctggcatgtagtaaatgctcaataagtttgagttactgtcatcaccatcattaatcttatttttgttattattgttttgatgtactgtgggaagagcctccctagctgacaatattcttggttaataagactattattataattatctgtgtatgaccacccattagcaaaattttatcaagcttattataaatatttttaaatagtataaaaacattttttgtttcctatatgtgcatgtgtatttttaaatttttattgactatgctttttaacctgtttttcttttttctcatttgagaatgagtggtttaagattgtagatttcaaataatcataaattctttattcattaatgaacactaaattcatcatgtctttccactgtattttgagtacacttcaattaatacactttccccatttttctgtaaaactaagctgttcttagttggaaagctgtttggagagtcttagttttgtctaagttacattgctttagttgctataaagctattaagttttcttcgataatggtaggggtgattgttaggctactcctcagtctaccactttatttcatatcatgattttgctacagttttatgagtcagttagctagaaggctattccatagttatttataatcaagtacttgaaagtgtgatacttcaaaaaaacatacaaacaaaactccattgattatactgatgctcctcaacttaccgatggggctaagtcgggataaagttgaaaatgcattaactaccccataaacccatcgtaagtcagggactgtctgtatttgtggaaatcagtaggcattattttttaatttagtgcaggaaaataatcacaaggcatctaatcataaaataaatttgttggtgttaaagttcaatgtttcagtttggaacattgatcctagaggatcaatgtttttagtgtttttgagaaagaattgttgggatattaagttttgatgatcatttaatcttcgagttaaaatctggacaagtatgaacatggatagaagtcacacatttttggaaactctagaaaatctttcttatttgtattcatttgaacttaccaactttagtcactgaatgttatccctaaatggaactcatattgtcggtaacatttgtattttctctgtgacttaaagaagaaattcctcgggcctctaatatcttatatagtcaagtaaataatttttgggggtatctcatgaagtattaataattttctgtaatctaaaattaattattcatagctttttgtttatggccatttggtgctcatatttaaaagctggttttcaaaatgcattaaagtcagcacaggtcatataagaaaagccatctcctgctcttgtattttagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaagtgagtatttgcaagccttcttttccttcattggtcactagaatgggcattgcctcagataccaccttttaaaaacttttttagacatgtggaaaccttatcaactgcagaggaaatgttgatgctagttgctgattagggaataattatatgttgaaaaatatgttttttctttaccttaaatcttagaataaacagcatttaccaaattcataaatcttgctccacagttgataacctttctcattcctgtgtatatatgccaggcctcttgttgtcgaaacactttgttcagaagtgaaaaatgatctcatttgtttgtcagtaatatttgatagggacactagtagaatattgtgaagcagaaggccccgcaagcttattaaaaatgtgcatttccgtattcatattccttacccaccccgtgaacactctcccacccccacaaaaagggaggtatttagagctgattttcttaccactgtctctagattccttttgagaattacccctgtagaaataaataaggacttgatttttaataagctccctagcaaagtactttatggaatttgatactttcagtatgcttttagaaaaaatgttctttagtaatcttgcatacatttaatgggacatgatattaaaatataatgtttgtttttgtaggggtttttttttgtttgtttgagaaacagttgtgttttgttttgaccttttcaaactatttcgccagatagaacttccctttaataagaaaatgtgattgttttacattagaagattgaagaaattactcatctaagaactgggtgaattttaaagttttaccacataaacacagttttatatgattcggagaacatattcactattaagtaattccttaaaacttgtaagagaaatatattgtaacagtattcatttttagttagagaattatgtttaatataataatttcaacacaatattgactgattggatttagtatgccatatggtaacagtaaagtatccattatagattaccttaaccaaaaagatagtcatagagataatttttaccataacttgctaaataagaccatgtaactgatttttttcaatgtaaagtgtgaagatactttttcctgagatttttagtataaactgagtattttccaaatgtataatacctgacaaaaagaaattgaggcgaccataagttagagacatgcatatatgccttttgaaacatcatcagtatctttaagaatcctgagatgttaaatactatttttatgcagtagtgacaagttgtggatcataaagccaaaattgtagcatttatacaagttttcattttatatccaaagagtggcaaaaattaagttaaatatttaagatacagaattttaaaagttatcttcattaattctcctgtatatagttgtttgatcttgtctgtagagcattgttaaaacaagcaactatttgaactgctgtgaagcaaaataaacaaccactgcagcacgaaccagctagtgaatgtttttgctacttaaatgtgattcagggtttcagttgcctagtgtttatttggttaagtgtaaatgtatttcatttttttcctaaagtattagcatgagtggatataaaagtaagttcttagactaaactgcctgtaatattaacataaaagcaaatttttaagtaatttattttgcttttaacagtaataacatagatgccgcaatagaaaacattgaaaatatgcttacttcagagaataaagtcattgaaccccaatacttcggcttggcatacttattcagaaaagtaatagaggagcagttggaaccagcagttgaaaagagtaagttagttgtttgtgctaaagaacacacaagcacattttctctctagtgagactagaccaaatttctttggtaggtgagttataccactgttctaatgaaagatttttcttacctgtcatttttccagtaagcatcatggcggagagattggccaatcagtttgcaatttataaacctgtcactgattttttccttcaacttgtggatgcaggcaaggtggatgatgccagagctctcctacaggtaatgaccctccactcatggagcagtggggctcgaggcttgcaagaagtaaattgagaaattactagacataggcgtgtggtggaatactagaaattcagtgtggtgtgcagctagcttgtttacattcagtgtgaatcacggttgcaggacaaggactggatggtagattttaggttactggttttaaagatgccagatcaaactagaaatgtctttagaattgaggtagcggggagcggcgggtggtgcgggggtaggtatggggcagcgagtttcgctgaaatgattaaagacaaatctttctgtgcagatagataatgcaaaacaacaattcctttgattttctactttaatttctcaaatgcgctagatactgtgcgtcaccatggcaacacagtttgcaaacaaaaagtaggaaatgtttgcttttcaagtacagcttctcacttgaatactcaaacattctcagtgccttattcaaggtttattaagagttgaatatgctttctattcacttgtgtgtcacagacacattaaatgacaaatgcaggtctctgtggcccgcactctcagttaaattagcaaccttcagggaaggagacaactgcattcatgccattttaacagcactaaatataaagctatgccaagtgccgacagaacagtgggtgatcctagctgccactggcaatgtacacaaacaggcaccgccggggagccccttcccagcaggtggcagtcaaacagtcaccgtgatcccgccaacggctgtgtttgtgtagactccctgtgtcaaattgaggcgtgggaccaatttctgatcgtaaatagtattatattcccttacatttttaccagctgtgaaagatcttaagtagtagatagggaaggtaaaactacccatgtgcttgacctccagtttttattcttcaagttcatctagtttgacagtagaatccaatccatttttaaaaggaatacctgaaaaactgtatctctgttaacagttttataaagggtgaattagcactgcttctcagactcttacttttgttgctggagaagggaaattccggttcactgggaattttcttgttttgctttgcttgtttactttttttcctttgtttttttttttttttttaattttaaggaaaaggcagtttatgatagggatttcaggacttttaaaattgttttatcttgctatcttacgtggtgaaaaaaaaaagaaggaagatactcatgctttatcttcatatgtacatgtctaagtacctactaggggtataataagcatatacatatctaattatacacatgatggtatgcaatcagttttaacacatccttttgatagttctttagaaagtggcacttggtacttcatctactagcttgttctctgccataatcaaggtttttctggaagagcacaattgacagccgcctgggtgggtggcagcagggatggcgcctgctccctcagaaagaactgcgttatctgcagtgacctcactgaagggctcttggtggtagctgagtgttgatgcaacagcagagtcttttcatttaccatctcatcactagactggggtttcagatgataaacccttcacccatcctttacctgcttgtcaaacagtaaaagattattcttgccgtagcgaagaatactttattcacagatgtcaaaaacatcagtgcgtaatgtaaatgttctgtgtggccccaaaaagttctttttataccattcgttttagtattgacagtgttttaaagctttgaaagagcagtgttcttttagaaacttaaaagaatgacatctgtgatgagtgtaaactaaaatattgtcttgccatatttgattttactatagcatctaagattggatagacatttgatttatctggtctgtcatgtaaacttttttttttagtttaactttggtctctttctcaagcgctggctgtctgttgcagtgaaagccttttataaaatagagagattgaaatcagtccttttgtatgcataagtgtaggtaattatactttaaagagaacttgctttgtacattttaatttttataaagaaatgagcagttatctccctgacaccttattaaatgtataattaaccttatgatccctagctcacttgtgaatgcttggcagtataattggagaggaataatgtttctttttttcctctttctttgcagtcctaaaccttattctgtggttgttgaagcattagtttaatttttcccttttctttttaaacaaactttatacttgcaatgccaaggacagcattcaccaaagcttggcatagcttgcacttgttttcttttttcttgccttaaaaaataatagtcgactattaggccttcctattggtaataatacactactgtattattgtgaactttcttaattggaaatattcagtttgatccacttgtttatcagaaaccttcacttactgaataatgttttaatttttagagatgtggtgcaattgctgaacaaaccccgattttgttgttgttcctccttaggaattctaggaaacaaggaaaggtactgtgctttacctgcttacaaatcaatgatactgtacgtgccttgctcagaagtattgaatttaacataaaagcctgttgtttcaggaccttatttgagaatactatagagattcaagactttgcttgtctctacttagagtcagttttgtcgtctgttagctgtactggaaatgtaaaacaagttcacgcaggaattttccacttacacaggtatgcattgagagccccaagaaaaggcccttaaaaaatgcaagattaggctgggcatggtggctcacacctgtaatcccagcactttgggaggccgaggcgggtggatcacttgaggtcaggagtttcagagtttgagaccagcctggccagcatggcgaaacctggtctttacaaaaaaaaaaaaaaaaaaaaagaaagaaagaaagaaagaaagaaatggaagattaaaattatgttgcttcggtcaccttgggacatttaacaatgcagaagcactaccaaggaaaatgtacactccagagtgtctcctagcacgtggctacttttgagcatttatcaggtataaaccatcaggtaaatgagccacttggctttcaaattgatatggagccacaaattaattctaatttgtgcagttactttatttacactgtaaaaggggtgggtgggtatgtaatagaaccaagtccttttgaaaaaattttttaaaaaaaaatttctgtgggtacatagtaggtatatcacattctactttgatgtttaactgtaagtataaaattaaatttctcttagatcggattttacctcttgtatacgagaaactacattcttagtttatttgggttctttatgaagtttcaaaccacatgccaactgtgatgcttgttttatttgaaacatttaggctgtgtccagtttgggaggtctacgttttcctgaatttctacacccttcccctagatatacctacacttttaaaaaatttgcttcattgcatctgtgactcatgtatttatttactaccaacaacttttagaaaatatttaattgccccttctttcctttcagagaggctgtgtttttatacgtgtgattaaaaagtataaggaatctgaaaagcacttgtcagtccacctgtgggactgtgccaagtccctgttgccttgtccaggagatgggacgggaaatgcacggcaatatgtctgcttagaacatcccacccaggacagtttaaaatagaagaagccctgggaggatgcaggtccaggtgtggattgactgaataaacatgctatagaaaggagttaggatttttaagatgcctgttaacagtgttccattgcttgacagtagaatagttaagccagattttgctcctcttggtgagatgggaagagggcatagatgtttatatatccatcatgggtttatccagtaacgttggagtagggcgggaaatactcagcagatattcattacggcatagcagttctgtattcactcgctacaggaaataaagccatagccgagtctgcatattcctggaagaaataagtaaaaatttcagtgagattctggaaatgctcttttttgtatgtcaagtgtgtaacacttcagaatgttttaactgaattctttacaatttcatcaaccagttgtggcacctaaagatagggttgttatctctctacccttgggatctcataacttcttggtatggtcaccacttgacaaaagaagcaatgtgtttatcatattctagaaaaatattcatagaaatgtaagtggaattgcattaacctgtggaaaaatgctggtttcttttagctgtagattattgagtcaatatcaaatgctaatatacaagggacaatagtgcattaaatttaataggtagttctgttataattattgtgaaaatttttaatatagtgttgatttgtcagtgttctaattcactgttaatttgcggttttcataatattacctttatgtaatttcctaggcatcaactgtgaaatctgtgttagaattgattcctgaattaaatgaaaaggaagaagcatacaattccctcatgaaaagctatggtaatataagtttaatttgactatattatttatttaaatggctttattatttaagtgactatatcatgtaaatgacttgtagtatagtgaactaagtcttagtcttcagctcaaaggcagtaatcctaaatatcagataattatgatataaataactcagttctggaatatgtttttaaactattaagaaaaatatgaaattatgcatataactttaacattaaaaagtatcactgaacatcttccgagcagtccgggtatattgagtagaatcccaggctcctgggaagacctggaaatcctcttggacttatatatcagaaaccagttcagtctccccaagggcctgccacctgaaacaagtacacatttgagactcacttaactggccttcttgctccttcagtaccctctctgcttgcctgctactcctttgaaatgacagacccttgattaaaaagtagcccaaggtttttacgtcccagttcaaattctggtcttttaaccagtttgttccctgattgccagacaatcacatatgaaaggaaattgtctaaagtttcctcagtcatcaaaataaatgttagcatttctcaatcatgatcacctctccatctgtggcccactgatttgctcactggaggcatggggtaaataaagaattgcttcattgattttatctatgggaggacaacagactcaagaatcagaattagtaagtcagttctctttttccgtccttacagggagaacattctgtattatttcaaaatagagctaatagtcataaaatttatcaaatttccagtaactaaacacaggcatacctggaagatatggttccagaccaccacaataaagcaaatataatgaacaaagttacatgaattttttggtttcccagtgcatataaaagttatgtttacaccatagtgtagtgtattaagtgtgcaatagcattatgtttttaaaaagtacataccttaattttaagatattgctaaaaatagttaacgatcatctgtgccttcagtgagtcataatcttgctggtagaaggtcttggctcaatgttgatggctgctgaatgatcagggtgatgattgctaaaggttgagatgtcttaagacaacaataaagtttgccacatcagctgacttttcctttcacgaaagagttctctgtagtatgcgatgttgtttgttagcattttatctgcaattgaatgtcttttcaaaattggaatcaatcttctcaaaccataccactgctttattaactaaatttatgtcatattctgaatcctttgttgtcatctcaacagtgttcacagcatctttaccaagagtagattccttctcaagaaaccactttctttggtcatccataggaaacagcttctcctcatgttaagtctgatcatgagattgtagcaattcagtcacgtcttcacgctccacttctccttctagttgtcttgctatttccacatctgcagtgatttcctccacagaaatcttgagaccctcaaggggttcatccatgagggttgaaatcagcttctcccaaactcctgttaatgttgataatttgacctcctatcaattacagatgttcttaatggcatctagaaatggtgaacccttcccagaaggttttcagtttactttgcccagatccatcagaagaatcactgtctgtgtcagctatagccttatgaaacatgttttttttttttaattttatgtttaaaacatggaacgctttacacatttgcgtgtcatctttgtgcaggggccatgctaatcttctctgtatcattccaatttcagtatatgtgttgccgaagtgagcccaaaatgtgttaagacttgaaagtcaagattactccttgatctatgggctgcagaatggatgttttattagggcacctgagaacaacattaatctccctgtatatctccttcagagctcttgggtgaccaggtgcattatcactgagcagtaatattttgaaaggaatcttttttttcctgagcagtaggtctctacagcaggctttaaatactcagtgaaccatgtataaacatccatgctgtcctctaggctttgttgttccatttatagaacacaggcagaataaatttagcgtaattcttaagggccctaggatttgggaatggtaagtgagcattggcatcaacataaagtcaccagctgcattagccattgaaaatagagtcagcctgtcctttgaagctaggcattagcttttcctctctagctatgaaatctttgatgacatcttctaatataagactgttttatctacatggagtatctgttgtttagtgtagccgccttcatcagtggtcttagctagattttctggataacctgccgtagcttctgcatcagcatttgctgcttcaccttggactttcgtgtcatggagatggcttctttccttaaacctcatgaaccagcctctgctagtattagggccttgcactggattaggctttggcttttaagggaatgttgtggctggtttgatcttctatccggaccaataaaactttctccatgtcactagtaaggctgtgtcagtttcttatcatttgtgtgttcagtgaagtagcacctttttaatttccttcaaggacttttcctttgcattcacaactggctgttccacgcaagaagcctagctttcagcgtatctcggcttttgacatgccttcctcactaagctaagcttaatcatttcatttctcgcttctgatttaaatgagagatgtatgactctttcacttgaacacttagaggctataatagggtttttaattggcctaatttcaatattgttgtgtctcagaatagggaggcctgagtagaggaagacaggagaattactagtcagcatcgcagtcagaacacgtttctcaagtttgccatcttccatgtgtatggttcatagcatcccccaattacaatagtaacatcaaagatcactggtcacagatcaccgtaacagatataacaataatgaaaaaggttgaaatattccaggaattaccaaaatgtgacacagagacacaaagtaagcacatattgttggaaaaatggcattgatagacttgcccaaggcagggttaccataaaccttcaatttgtaaataacgcaacatctgtaaagtgcattaaagccaaggtatgcctgtaatgtgaaatagtgtcaagcgcataaatctgtgtgtgttactactaaattaggtaatccattttgggaggaaggtagaaaatcaagaagtaaagaaaggcaagatgccagaattttcggagcagcttcctagaagatagagcttgagcccttaaagggttcagctcctcaggaagggaaataaaggatttacacaagaagttgacttcatggaaacagcaaagatgtgttccaactccactaagagctgatgagtcaccctcattccactttgggagactctttgattgctgaacgtctcacctctgtcttaggggttcccctggtgctgccggagttgcggttgacaatatcagagtcagtgtagggcaggggtttatgtgatgcttagatgctaacaatctaatgcaaaattaaggagttgaattaccagcagtaattgttagcagagcccttaccatctccatggtaaactaaaaaatttccacaaatcagccacaagtagagagccagccaaatttggctcctaacatatttcatcattcacttaagtgaaactagtgtaacttgttaatgtctccttataggttttgcttttgtttgttttttgagatggtgtctcgctcttgttgcccaggctggagtgcagtggcaccatctcggctcactgcaagctccacctcccgggttcacaccattgtcctgcctccgcctcccaagtagctgggactacagacacccgccaccacgcccggctaattttttgtatttttagtagagacagggtttcaccatgttagccaggatggtctcgatctcctaacctcgtgatccgcctacctcggcctcccaaagtgctgggattacaggcgtgagccactgcgcccggcctataggttttttgtgtgtgtgtatcattgtagctaactatactttccatatttgtttattttacaatagaaaaatgaaaagcttttttgatgttgagctgatgatcttgatgttgatgtagatttctacataattgacatgtccctctccacaacagttcctggattatcttgatttcacagtggttttaagccaaaggggattgaatggtgtgtattattttataactgaggacttcagtttgtggtcacttgaactatcataggtcttaaataatgtaataacctaagtgaatggtatcaatattattctaaagtcctttaaatgtagccatatttgtcattttcttctccttcaaagtgagtgatgccgaatgagggatgtagagaagtgagggagatggtagattctgaatgtggcttcttactgaaagtagttaagtgttcatttgccgtgggataaagggatccagccgtccctgagtggctgttttggtgaaaagagtaagataggttgtctttatctctgattaatatatttttttctttatgtcagtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgtgagtatttcttaattaaggggaaaaaatacctctgcagatttatgtgcacttcataacaatgtgtaagaaaataagttgaagacttaattacatgaggattagatctctgtgaagagccctcaggggatggcttgagggactgagcagcatgccttggctgcggcagtcggagaacatagctctctggggccacagtttaaaatacaaggtctgtctcagaccttcagctataggcatggatttaccaaatgtccttggggcagttctctcatttcaacttgaaataggatttaatggcctgtagttcaacagccaagcatattatgtcagtggtaattacttgttcatttacataagttggtttttatttcttcgtctaggaaattttgcctttttttttttttttttttttttttgagatggagtctcgctgtgttgcccaggctggagtgcaatggcacggtctcggctcactgcaacctccgcctcccaggtccaagcgattctcctgcctcagcctcccaagtagctgggattacaggggcctgccaccatgcctggcacattttcgtatttttagtacagatggggtttcaccatgttggccacgctggtcttgaactgctgacctcgtgatccgcccacctcggcctcccaaagtgccgggattacaggcgtgagccactgtgcccggcatgttttctttaataagagaaatcacatatgcacaattcctttttgttatgtcattgaactgagtcaatacaccgtgtttatttcaaacacctcagccttccatacccatacctccatatgtgcacacacacatgcttgcacatacacacgtatacacacacgcaccctacctcctgctgctagctttaactctgaacccgaggcccttgaacttgtgatttcatgaaacaaggaaggagtactgaagcttgaggggcagcatcttccatgggcctggcagtcttagctaccagttggtagtgttttatgattttttaagttatgtaccatcacctcttgctggtatctctaacttccctctttttttctccttaacaggaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattg

SEQ ID NO: 37583 - DNA, 4512 bp, Homo sapiens; identical to SEQ ID NO: 35751

SEQ ID NO: 37584 - DNA, 111947 bp, Homo sapiens
attgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcaggtaggaggagggggcgggattcgggcccttcaccctgctgttccatgcccggtggggccaggtttgcccgggggcttccgggatcaggccgcctgaagcgcgattcgggcagccggcagcgtcctcggctgtgccaggccctcgggtggcccggttccctgtgcagtagtggtctcaacacacacctgggctcacacacggtggtggctgcgatggggtcttagagaggccatgcagcacgcgagcggcaagagctttgatcgggtcctctgggcagactcggaggtgggagaatgtggctctcaattccaaggcagttttcccttctggagagaactactccgcgctctggcgtgtgtctgcgaggtggccattaggggtgtctttgctagaggccttggcttgacctcatttcacacccaaggagaacgctaaggcgagagagctcaactgcaaaagttttccgcttgaggagctctggaagggcctcctcattagcatgggggggtgtaatgaatgaagacagtccccgacgtgtcacttgcccgaaccccagacatctctggcgctcctgcaccaaacgccgagattagcataaaggaggcgcccagggaacgtttgaatgaatgaaaatagctgggaacccagagtgagcgggaagccgcttggaaaacacccattgaggaggtgtttcatctaggcctgtgaaacgcagcccattttcccaggacccctcctcccttctcctcggccccgcctcctgacccctccattcctcgtccccgtagtaatcccctccggttttcctcagtctccacgtacgtccctcaaagcgcgtcctaaaacccggataaccggagcgctccccatggaccacacggagggctcgcccgcggaggagccgcctgcgcatgctccatcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggtaagtctgagggaatcggagcgccgggaaccgggaaagttgcgggcgtctggcagctcacggcgggcagcgggttcgggggccgcggcgcgcttggcgttcgggggcccgcgggggcggcgtcgcgtgcgccgagcgcggcggcggcggcgtgtggccgtgcgctgccgctctgcgctgccgtggctcaggctccagcgcgtgagggcgggcggcggcggcggcggcgaggccggcgggtgcgggcgtgagtgcggcagggcgcgcggggccctcgggcgccgtgcctcccgcgcgcctccagcgggctctgcctgggggccccgtgcatctttgttcctcgcggccgttgtcgccgcttcgccccgctagtgcccccggccccgggcgctttgtctttcaccgctacccgctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgtgggtcccctctcacctttctgtatggtcctggatcaccccccgaggctttgtctcccccatccacgggcttattctctcggcacccccttcctctcccgtcatcggttgatttatccacaacccacggtgtacgtctgctgaactgtctcagccccggggactccatctgctgcttctaagtgcacacaagactctacggtttgttgttttgtgggtctgaaagatgcatgggatacttagttttctcctccgcacctctttttctcgggatttcttgtaccctcccgcccccctatcgccacccctttctctcgggattaaagcgtctccaattttcatcgccgtctttttagtgccgtgggttgttttgcttggaaacagtagccttggaaaaagatctggtctcttggtggttcttgcgccccccggcccccgcccccctcctggttcctgacggcgtaggccaagggcagctgtctgtcgaagctttgcaatctaggctgcctgaggatgattggagggtatcgtaggacggttagaaggaggctcaagatgtatatatgtgtttttctgttagtgtttgagaatagtttcagatagccacaatggatattcatttggcgtgtgagtaggagttgagtgaatttccatgttaaaaacttgtgagtgttggggcggagaatttcagcattttctagaaatctggatttagaatttatcagtaacttctgcctcataaggaaaaggagaggcattccgcttgggaattttatataaatgttttattttttcttaatcattagatagtttacagttatgtgctttttgctgccctgtagatgcgtgacaacccttctgtcccatcattggggttgaaatgaggacagcaccgaagagtgcagtttctggtcgatgaatactgcttctaagatctttgtggaagatattaatcaaatgcagttaaaaagtatacgtataatatgtatattatatatatatatacacacacacacgtaatagcctgtagtgagattattttaaagacacttcctagtgttaaagaacccttgaagtgtttcgagttcttattgttttggtaatgctaaaagcttggggttgtgtgaatgggggtggggggtgtggtgtgatgtattctaatgacttgagttattctgggtgctaggaataagagttattatatttaccaggattactatgctgaaggtattcttcaagagtttgttttttttctactggttgatctctacttttagaaggtatgttacccataaaatcatttggagtgtcatttcatttacaaactgaagttctacaatagtgaagtgttgttgataggggacatacgagatctactctaacgagtattggagcattggaaaatacttttttttctggctgtgattagaattagtagtttgagttttaattaatggaaaaccatgttttcatgattgatacataagtttttttgtgaaaatctgcagtctgggtcgcttgagtgggttttaccaataatcttatgtctcccttacttgttcttgtacataatcattgttttgaaggtaaaatcttgagctcactggttctctgactgggagcaaagtgtaaatactgtgtagtaatggaaggtattttgctctgacttgtacctgtaagaatgattacacagacatgataaaagcgcttttaccatttgagttgcgtttttctttctaaatcgtgtaatacttttacttacatgattggtgaaataaaactgcttttaattaaattataacagcagcatatttcgaaatctggatgcgttgtggctggagaactttcattctgagtattaactgttaaagctttaaattttattatccatgcatattgctgatggatctgtgagtatattttcagaaaacaggagacttgcaatattttcaaatctgtactaatacacacttgtaggcattagattttaagcagttaggtttgttaaaaagttatctgttgtcctataccaacagatttctatcaatgttttttttaagtgggtaagatcaaaattggtttggttgacaggccattcttgccagatgtaattcattaaataacctttggcacccttgatgggtaaggcattaggaaaaaattgtttcgtttgaaagttattatacatctcattcttctgttcatttttagaaataagacccaggacttggctttaaagcattattttgcattttgcttcctcctaatactaaatttcatgttatctcaactaggggcagtattttctcatggattgactaaaagttgttatttttggcatctggctttgtgattatttccaagttactctacttcccctgggccagtttcctaactatgtagtaaaatgggaattataataacttgccacatctgcacaggattgctgtgccttaagattcgcagagagcatccttggatgaaaactgtggggaaggtctaggaattgttactgaaataagctaatgtgaagtaggtcatattttataggaagtcaaataggaggtttttaagttcttggcaagacacagtagcgatagtgggattttttaaaatcccaaatatgtattataatatgggtaataaaacagatacctttattcctgccccccataaacttatagggaaagggacaaataaaacaaattacagggtgatgtgtcgtgtgtgagtgtgtgtgtgtgtgtgtgtgtgtggtgtaagagattgaagttctgtcaaactcaaatgtaataacattataaaattatgggatgcctttcctcttttgttttctgcatgtagcaatattctatttatttattttattttattttttgagacagggtctcactctgtggccaggctggagttcagtggcacaatcttagctcactgcaacctccacctcctgggttcaagcgatcctcgtgccttagcctcctgagtagctgggattaccagcgtacaccatcatacctggctaattttgtatttttagtagacatggggtttcgccatgttggccaggctgatctcaaactcctgacctcaagggatctgcccaccttggcctcccaaagtactgggattacaggggtgagccaccatgcctggcctgcatgtagtaatatttaacaaatggtagtacaacatgctttcactggactctaagccaagtctgttaatagcagtgattaattttaaatatgccttatattttttagtgctttgttatttgctcttaagaataaattctaataaccatgactataatttcagatttgactcttggccttagaaaagtgttttgcatttgaggagcactctgtagatacgtattgactgaatgaaacctgttgcttctctgttcttggtagatgataccatattccgtttggttcccaaagccacgattcctaattcctctctcaccagcctttacatttaattactgagaactgatcatttttccttctaaaaaatctcttgaatttgtttcccttatcctcactgccgaagttcatgctgtcatttctcacctggtttactatgacgtactgacagcctctttctgcttctagagtcaccacctttatccagcttctacatgtagcagagcagtctttctaaagagcaaatctgatcactgcttaatctaaaaacctttcaatggctccccctagcagcgttcattaagagaggcaacagagtggagggttatgagctcacatttagtgtttaatctgaactgggttccaattctgtctctggcacttaaaacccctgccagttaaaacccctgtaacattgacaagttaatctctttatcaattgcaagataattattcctaactcagaaagttgttgtgaagattaaatgagataatgtatgaaagcatttagcagaattcctggcatgtagcaagtgctcaaaagatgttagctactgtggcgcataggatcctccataactatttcatctgtctcttctccagctgagttgtttgccattttctctccataatcagtgcttcagtcatattaaagtattttgacatctctgcatgagcccagcagtttaatgcgttcttgtgtatgaaaagtaatgatccttagtaggttatttctcaagactaagggaatattctaaccagatctaccagactacagttggtgcctggctgtataaatactgtatatttaatacagtattaaatgctgtatataattctcttggaagcatgatactaagttgtaattatcacacccaaatattgtcacttggtggcaggtatcatttatattcttatacttagaagattgtctatcacatgatagagactcagcaaaaagaatttttgaacataggactcagtgctttgaaatcttggtgcaacatggttcatgtggcacaattttaaaattgtgtgtgtgcttgtgtgtatacagtatatgtgtgtctaattcatatatatgtataatttatatataggtatttgactttggttctgtaaggagtaattgctgaagtacccagaggaattgatattttcagccacaagcaatctcatagcccctgagaacattatagtaaggctcttaggcaaaagtttttttttttgattattagaaaatactacattatatttgtataaaactgacaagtttaaatttcacttttgttttttatatgattggctgtcagtgtttatcaaaagattccattatttttaactgttttcagtactagatggctagggatgtatgttagattaaaccgtagaacactgtagactgctttttggggaatccatgccatagaaccaaataataagttgataatttacatggagactcaggtctcatggacatattactgacagataatttctttaagcttcaggttctacctctataaaataggggatgataattatattttatctgtcaggcacattgtgactgtcaaataaggtaaattttgtgaaataaggtcaaatgaaacagtgtatgtgtaagtgacttgtaaacagtaaagcgttctatacaaatattttaattactataagaatcagtttcctctggtaacctttcatcttgagcagggctcaagatggactttttatactgcaagctgtggttttgtgggtcatgttttaggaaggcagcaatgtatttggtgcagaggaccgcaacccttgaaatatgtgctttggcattttaagcagacatatttgttaaattactgcttgaccacgaatgttgtcattgagtcacccccagctttttggggtctatttcttactgctctcttctctgcttgggcagctgtaacaatgtaggaatgttgaatgtctagctgctactatctctcagactcttatcctgcccacagttctgtatgcctcttaggcctggcacaacatcatggtgttgcttatgcctcattagacctgctgcttaagggaattaaatgataccctaatggtctaaaaagggtaatgtatttccgaacatgtcatatttactgtaggaggttggggaaggcgtcacaggcactgtaagtggtagtaattacctatccgtatagatatttgtgtaattttgttgtgttgagacaatgcataatggtaagtttgagagcttttcagtcatattggtgaagtttacggcaatcttgggaatatttatactattttaagtttacaaaaaataaaatatagaaaacacatttttttaatgcattctgagttgcaaaagccttgcaatgaaaactgcatctatttgatgtgaagcagaatacactagagaatcaagttgaccctggaggttttttttttttttttttttttttgtattcagtagtcttagcctaagagctaatgattatctgtgcattgttaatgagatgataatcagagttgtaagtgataagagtagtttctcataaaaagtttacataacaggagaaaaaatatttaatgttgggcgcagtagtagctcaggcctgtaatcccagcactttgggaggctgaggtaggaggatggcctgagcccaggagtttgaggctgcaacgaatggtgatcatgccactgtactccagcctgggtgacagagaaagaccctgtctcaaaaaaaaagtttttcactctataaaacttttttataagtatgatattgtgttatagaagtacagtattgctttatgaaatataaatgtaatattgtagtttttttaaaataatgtgaacagtctattatggacatagcttaatttcctccagtacaaactagctttagactggtttgcataaatagaacaaaggtatatgttcccttttggaaaactgcagatctgcaaagattgtgcctgattttgccagcatgttttttcacatctttttttttttttaatttgataacatttttcatgcaaaaaattacctagatctgtacaaagctcctaatccatacaccatttggagtaagcagaaacactggggtcctaagacatgtaggaggggtgttaaggaaaatgttaatagtataaccatgctttagtggctctccttttagtattgttttaataacaatatatttattaaataagcagttgaacacttattaggtataagacactctttgtgctggtcctataaagatggctaagaaatggtttggtgaagctcatgacttggtagagtgtacacaggtaattattgtgtaagggagattatggtaagtgctgtaaccgatatttagtgttggtgggaacacagatgtaaatgattatcttcatttggagttcatagaaaaggtgagagttgatagggagtgatgggaaattaagctggaaaagtaattgggagcctcttggaagaccttgagtgctaacctgattatttggttttttggctggttggtgttttttagagacagtctcattgctctgttgctcagcctggaatacagtggcaaagtcgtacttcactgcagcctcaacctcctgggctcaagggatcctcctgcctcaccctccccagttgctaggactataggtgtgtgccaccaaacccaggtgtgcgccagcaaccccagctaatttaaaacattttttttgtacagacagccttgctatgttttccaggctggtccagagctcccgggctcaagtgatccttctgccttggtctcccaatgtggtgtgattatggatggcctaaggtgattatttgaatattaatcagggatacagaggacaagggtaaggtattgaggtttttgtttgtttgtttgttttgacggagttttgctctgttgcccaggctggagtgcaatggtgcgatcttggctcaccgcaacatatgcctcccgggttcaaatgattctcctgcttcagcctcccgagtagttggggttacaggcatgcgccaccactttcagctaattttgtattttcagtagagacggggtttctccatgttggtgagactggtctcgaactcctgacctcaggtgatccacccgcctcagactcccaaagtgctaggattacaggcatgagccaccgttcctggcggcattgagggttttaagatgaggtagggctggatgtaaacagtgtaaaatagattggaattggtggacaccataagagaaatataatcaaaatctgattttggtggtgggcctaggaatgaataggccaagaagctctttttgaggcagggtgatgtagggaacttgggaataattgtactgtaagtcactaaaataagtttgtggctatgagcatttcacttaagctaggtcttttcctttgtctaaaaaatggaagaaaataatacctcatggtattgatgtgaggattaataagagatagaaaatgcctactgggccggctgggcgcggtggctcacgcttgtaatcccagcactttgggaggccgaggcgggcggatcacgaggtcaggaaatcgagaccatcctggctaacacggtgaaaccctgtctctactaaaaatacaaaaaattagctgggcgtgttggcaggcgcctgtagtcacagctacttgggaggctgaggcaggagaatggcatgaacccgggaggcggagcgtgcagtgagccgagatcacgccactgcactccagcctgggcgacagagtgagactctgtctccaaaaaaaaaaaaagaaaatgcctagcttggttctggtaatagtaggtgctcaataaataggttctccttaccccttttctgaagtgtggaatttaaagggtaagatgggagtggggtacacccccttcagaagggagggtaggaaaaaacctgaaattaaaacctggtgataaaataatcagaaaagggaaagttctgagtaaggtgaacagatacaagagaacctttttaacaaagtgttgtgcttattgtaggtctttaataaatgctggatgcttatttttgcatacttctgttacacttaacattgttctgcaattatataaatttatctgtaattgattgtttaatctgtcagtgagcttcataagaaaaggagcaattattttacttaccttgcacaattgtggagcacctaccatctgccagaatgttatttgctggatgaatatggcttgagcagatttggtaatatataacacttgccactaggtggctcttggtcttgataaagctgacattcagcatagataggtttttctacctagaaacccacgtagaaactgacccccggattatattcacttttttgccttttctgtacctatattttttgaagtggaatatgaaacacatatcatatagaaaactcatttagactgttgaaaattagaaaagtgtaatgcctttagaatatgtcctgtagaaagaagcagaatggaagctcaatgaaattcacaagtgaacaaagcacatttccccatctctcaatgtgcttaaagtgaggcatgatggtttgattttaggcattgttttttgttgttatgactgcgtaaattgctttaaaggaagatattgtgaggatttgtttctcagaggatttgatgaacgatgatgaagcgtggtgtgtactgatgctaggctatgattctgtgtgctcttatttgtattgtactcttcctattgagaagtaacataccatctaatggtaacttacataacatagaaaggtaactacatcctgtgtgacacgtgtgatatatattattaaatccattagattcaggaaattttagagccagagaagaccttactaatcatatattctaaaagtacccattcatttacacagacaggttagataatggctgagacacattcagtgactgagctagttcctggtttgttttagggggaggggaaggcctgtgttagtcttttgtttttgaaacagggtttgctgtcacgtaggctagaatgcagtggtgctgtcatggctcactgcagcctcaatctcccgagctcgtaatcatcccacttgagcttcctgagtagttgggactaggtgcacgccaccatgcctagctgggttttgtagagacggagttttccatgttgcccaggctgatcttaaacttctgggcttaagggatctgccggcctcagccttccaaagtgctgggattacaagtgtgaacccctgtacccaacgttatgtttttttttttcccatacctttctatttatctcactcagctgccttttaatgttacatgcatttttaaaaaatagccctttttctcatatgtgcagacttagagcaagactgtaaatccctcagcacccaagccttgatgggtagagtgcggcggccagtgttgcttcattaaatggtcagctcggagcctgcctgctctttcctcgtttgctgtgttcctgtttttggtgctgcttatgatctttgtcttgtatttctaactgaccaggtggcctcttcaggaacatagttgtcctcctcactgcacacctccttatccactctgcttcagttgctcctactcgagaactggctggacgcagttacctctggcttactccagtctctgcctcttttctctctagcttcttggttatgccacctgcaataaattgcagctggctgtttccacagcctctggaagggaagatggaaggacagaggagagtgaaaagaaagaaggctgtcatacagagaagagaggctacaacttgaaattttatactgaaagatgatctggtttatgaacatgatgatgatgtgtgtagtgaattttttctagtgtatatgccaaggcaatattattctcttgactatgggattcattaagtctgttgtatctgtcatccatgcttatccacatgtcaaggaagtgaattaatttcagcattcccaagatagaagtgatagtatatggtaatttacttacagcttataataatgagtgtcattatttgattaaatggatattactaattaatgggagttgccatgtcactattgtaatgttaaaaaaaaaaagacctttcagaggttatttcataattattggtaagtaagccattctttgtcctggccttcctcccatgtattcaatgtgatatgtacactttgcacacaggatttactgacatgtcatttacttaaacagcagtttcttaggtaccctaagtcctggaaattgtcagttgcttaaataattaaatacaaataaatcagctgtccacctaagctaccatatacatttttgtttaaattctaatgtaatttaaaaggcatttatttaatttttagcttgttttcatagttatttcagggaaatgaccatcttgatatggaaatttttcttagaaattaattgatttcacatctgtataaaataatcatcttgattatttttcttgttggaaaagtaatgtttgttataagaaattcagaagttatttatttacttcttgagacagggtctcgctttgctacccagactggagtgcagtggtgccatcatatcccactgaagcctgaaactcctggactcaatccttccatgtcagcctcccaggtagctagggctacagacactcgccaccagtcttggctaatttttgtattttttgtagagacggagtctctcactgtgatgcccaggctggtttcaaactgctggtctctggtgatcctcccactttggcctcccaaagcactgggattaccagcatgagccaccatgcctggcctcaaaagttacttaagtatattgtgtaaagtgagccactatagtcttataccaggaaataatcactgttaacaattgggagtacctttgacccttgaacaacacagatttgaactgagtgggtccacttatatgtggatttttttcctccaaacttggatggaaaatacagtattcatgggatgcaagaatagtgtatatggagagctgactgccggtcttgagtatgtgtggattttgatgtatgggaggatcctgcaagcaatcccctgcggataccaaggaacaacgatatatttcttaatttaaagaaatggaaacgctgacattcgattctattttaaaaatttcagtagttttgcaaacataatattaaaggtgccagggagctaacactttgttgaatatctactcagtcctcaactacaatgtgagggaagtggtatctctatctattagattactttaaatgaatttccaggaaataaacttatttttaaagttacacttgattagactagtctttgggctcaaagtttctctgaagtagcgtaatgtatctttaggtaaaaattttgtatttcatttttaaaaagttttttaaattaaaaaaaattttttttttgagatggacgtctcactctgttacccaggcagacttggaaattttgggctcaagcattcttcctgcctcatcctcctgagtacctgagattacaggcatgcatcattgtgcctggcttaattttatttatttcttgggataggatcttactgtgtcacccaggctggaatacagtggcaaaatcacagctcactgtagcctcgacctcccaggctcaagtgatcctcctgcctcagcctgccaagtagctgggactacaggcttgcactaccatgcctgcctaatttttatttttattgtagagacagggtctccaacacctgggctcaagcgatccttctgccttggcctcccaaagtgctggaattatagttgtgagccactgtacatggctcggacataatttttaaaataattttgtcagggcatccctgggatgttgttctatcagttaatccaacttttctgccttttctttttttttttttgatggagtctcgctccgtcgcccaggctggagcgcagtgatgctatcctggctcactgcaacctctgcctcccaggttcaagcagttcttctgcctcagcctcccgagtagctgggattataggcgcccaccacaatgcccagctaatttttgtatttttagtagaggtggagtttcaccacgttggccaggttggtttcgaactcctgacctcaagttgatctgcctgccttggccttccaaggtgctgggattacaggaatgagtcaccatgcctggcccaacttttctgctttgtattttctttttttttttctaatattccttttttgcctacagaccaatttttaggtttttaaattctgtatacatcctgtgtggccttgggcaagttacttaattgcattgcaacttaagttttcccttttgtacaaaggagagcatacatgagaattcttctgaggatcaaacgtgtgtatgcaaaggggctgcaagactaggcctggtctataaggattgcttaacgtccgtttcctttcttaactcaagctactgccatgccttttattcatctcttgacttggtcttgtttttattttcccttatgcttacatattaaaacctgattttcaccccaggccatcagtaaataacctccttttaccagacccccaaacctcatttcagtcatcagcctatttcatttttctgcatcttgtgttttgttttgttatgttatgtctttattcttgactaacaagctactatctccacttcttgattattccatcttctctttgctacttctcttccaatcttaagtattgtgatttgcagtttttgtcttcctcttgctgtattctttgactttatgtctgtgtcattagtgtggatgtttagattcgcattttaaaaattcctactggttgttctgcaggctcattaaacttgccttttccaaaacaacttgttctttttaccacctgtatctgtgataccatcctataaaatagacttgatatctgttatagtgctgttgtccatctggctgccacaggtaaacgttaacttcagtaacttccttatttcctcccactatcagtttttcttattttcttattattattattattgttttcgagatgaagttttgctctgtcacccaggctggagtgcagtggcgtgatctcggctcactggaacctccgcctcctgggttcaagtgattctcctgcctcagcctcctgagtagctgggactacaggcgtgtaccaccacgcccggctgattttttgtattttagtagagacagggtttcaccatgttggccaggatggtctcgatctcctgacctcgtgatccacccgccttggcctcccaaagtgctgggattacaggcatgagccaccgtgcccggcctgcatccattatttcttatcagatattctgcgttctcttctttttgctcgctgccattgccttactctccaggctgcttcatctcatagactattgtcacagccatgtcaacttccccagcccacatatgcttacttcttttttttttttttttttttgagccggagtctggctctgtctcccatgctggagtgcagtgctacgatctcggctcactgcagcctccacctcctgggttttacgccattctcctgcctcagcctcctgagtagctgggactacaggcatgcaccacctacgcccggctaattttttttgtattttcagtagagatggggtttcactgtgttagccaggatggtctcgaacttctgaccttgtgatccacccgcctcggcctcccaaagtgctgggattacaggcatgagccaccacgcccggcaatgcttacttctttagtctgtagttttggtgtttgttctgcatgtgagtatttgggggtttgtagggggatctggtcacctaattttgttgtaaatggtgcccacagattttgattttgctatcttagttatggctcttttatgtgggaagagattggaaagctatgctgctgccagtgttaccctaaaatcctgtctaaatatcatcagacaaatacatattaattgtaggctaaatcgatgcaaagtgagtaagacagttcgctagatcccagctcccagagatatgcatgcatgtttacaatggggtaaatttccttccaaactctagttcttttcttgacatgctcatgtctgtttcttgcattgagaaaggaagagttatggttactatttctatgaaagattatttagagatctaggtactgtggcttgtaatcccagccatcccagaggctgaggtggaaggattgctggatggcagatttggaggctgaggaaggatagctggagattaagagttggagaccagtctgggcaacataggaagaccccatctcttaaaacaaaacaaaacaaaacaaaacaagtgttgcgtgtgtctgtagtcctacctacttgggaggctgaggctggaggatcacttaagcccaggagtttgagattgcagtgagctgtgattaaaccactgcactctagcatgggtggtagagcaagaccttgtttctttaccaaaaaaaaaaaaaaaatttctttagaaatttaagtaagcttttgatgttttcacatacattaaaggatatgggtaggtttttctctttaaaacactgtatatgtagtttttttctcctgataacaaaaataacaaaatataaaaaggaaaaaacgtaattctaccaaaacacattaacattttaaggtatatttatcctttcaaagttaaaaataacttttaccacctccctaaattataaatatattgtaaaaaagcctaaatggtagcgtagtgcttccttgcttctgcccctgatggtctttgtttagcgttttttgtttgtttgtttgttttttgagactgagtgtcgctctgtcgcccatgggcgatctctgctcactgcatcctccgtctcccgggttcaagcgattctcccgcctcagcctcctgggtagctgggattacaggcgacagccaccatgcccagctaatttttttttttttttttttttaaataaagacagggtttcaccctgttggccaggatggtcttgaactcctgacttcaggtcgtcctcctgccttggcctcccaaagtgctgggattacagacgtgagccaccgcacccagcctgtttagtgtttgatgcatagtattttttagatggctattgaatgcatgtaaatgcgtacataatcttttttaatcttgttcttccatctgtccttctgttggtcctcctttcctctacataaattgaattataccaattcagcagcatattgttcttcttgttgcttgggtggttaaacagtatctcttctgtagctctggctatccacaggtgtggctccccatgcttactggctgctttgaggttgtttccaacttttttttttttttatactgctgccacaaacatatctgtgcatgtgtgaaggtaaccaatatcttgatacctttaagtggaatcactgttttttccatgaggttattggccatttgtattttccttgtgaaatatatacttataattctttatccttttttttttttttttttttgaaggacagggtctcactctgtcacccaggctggagtgcagtgctacagtcatagctcactgcagcctcaacttcatcggctcaggcaatcctcctccctcaccctccccagtagctgagaccacaagcatgtgccaccaggcttggctaatttttaagtttttgatagagagagcaactcaccacgttgcccaggctgtctattcatttatgtcttttctcattttgtatataagcacttttattttccacatattacttttgtcaattctatggttttttccctagtttttcatttgtcattcatttttatttattttttgtcatacaggagttaaaatttttaggtaggcaggtttgtagtttttcttttggctttgtgtttttttgttgtttttttttcatcttcctcaccctaacattatggaaacattcttatgtgtatttttctttcttttttttttttttttttgagatggagtgttgctctattggtaggctggagtgcagtggcgcaatctcggctcactgcaacctctgcctcccggattcaagcaattctcctgcctcagcctcccgagtagctgggactacaggtgtgcgccaccatgcccagctaatttttgtatttttagtagagacagggcttcaccatgttggccaggatggtctcaatctcttgacctcgtgatctgtccaccatggcctcccaaagtgctgggattacgggtgtgagccactgcgcccggcctcttacatgtatttttcttccatgtgctcttttatagtttaaaaatcggtgtatctctttaacccttctggaagtttggcttttttgtttgttttggtgtgtgttacataatgtaggctctaacttttttttttttttttgagatagagtctcactctgcctcccaagctggagtgcagtggcacgatcttggctccctgaaacctctgcctcccaggtttaaacagttctctgcctcagcctcttgagtagctgggattacaggtgcctgccaccctgcccggctaatttttgtatttttagtagagatggggtttcaccatctttcccaggctggtcttgaactcctgacctcgtgatccacctgcctcggcctcccaaagtgctgggattacaggtgtgaggcctggcaaagttgggtgtgtgtgtgtgtgtttggagacagaatctcactctgtctcgatctcagctcactgcagtctcaacctcctgagtagttggaactacagctgtgcgccaccatgcctggctaattttttgtattttttttagagacggggttttgccatgttgcccaggctggtctggacctcctggtctcaagccgtctgcccaccttggcctcccaaaatgctgggattacaggtgtgagccactgtgccagccttatatttttatattgtgtgtttcaaatataattatattgtgtgtttcaaatataatctgttacttgaacgtggtgtttagtacccaggaggtctctagttgcgttcagaccttgccatagtttggtgagggaggtagtattaccttgttttacagaaacttaaccaagtttacctgcgagttggtaggagaattggaattcaaacccgtatctccagatttcaatttcgttgttaacagtccggggttcatgcctgtaatcccagcactttgggaggccaaggcgagctgatcacttgcggtcaggagttcgagactagcctggccgacatggtgaaaccccatctctactaaaaatacaaaaattagctgggtgtggtggtggccgcctgtaatcccagttactcgggatgctgaggcaggagaatcacttgaatctgggaggcggagtttgcagtgagctgagatcgtgccactgccctccagcctgggtgacaaagttagactctgtttcaaaaaacaaacgaacaaaaaaaacctctgtaacatacagtgtgtaaaagtaacactccaaatcagtgagaaaaagagcattcaaaaagttacattagaacacttctggtcaggcagtggctcatgcctgtaatcccagtactttgggagaccaaggtgggcggatcacctgaggtcaggagtttaagaccagcctggccaacatggtgaaaccctgtgtctacaaaaatacaaaaattagccgggcatgatggcggttgcctgtaataccagctacttgggaggctcaggcaggagaattgcttgaacccgggatgcggaggttgcagtgaggtgagaccacgccattgcgctccagcctgggtgacagagcaagactccatctaaaaaaaaaaaagaacatttcattcattcattcagcaaatacctattgagtacatactacttaccagtactatatgctagtagtaaagacaaaattttaaaagtaattaacattatgttagaaggtgatgcatgcaactgagaaaaataaaacagggaaagggtataaaaggtggaataaaaagcaggcaagatggtcaaggaaggcctcacagaggtgatatctgagaaagacgtggagggaggaagagattcctgtgggtatgtgggagaacagcattccacacaaaaggaataacacctgccaggttggagcagagtagtaagaggaagaacagtaagagctgaagtcaaggataaaacggtggtccaaaatgtgcaaggttttagacaaagaggaacttagtttttattttgagatgagtagctactgcacgatcttgagaaggatctctcaagcaactttactaagaacaagagcagagctaaagaaaagttaagaggattctgcaacaattcaaggtagagatgatgctgatagtaagaaatgcagcatattggggccgggcggggtagctcatgcctgtaatcccagcactttgggaggccgaggtgggtggataatgaggtcagaggactgagaccatcttggccaacatggtgaaaccccgtctctactaaaaatataataaattagctgggcgtggtggcgggcacctgtaatcccagctgcttgggaggctgaggcaggagaatcgcttgaacccgggaggcggaggttgcagtgagctgagatcacgccactgcactccagcctggcaacagagtgagactccgtctcaaaaaaaaacaaaagaaaaaaaaaaaagaaagaaaggtagcatgtgaaagccttgaaataagtgtcataaaggaaaaaaatcattttagatgtgctagtttgaaatgctttttagacgcccaagaggaaatgtcttttgagacagctggatataaagtttggagtttagaaaagaggtcaaggctgggaataaaaatttgggagtcatcaacatattaatagtagttaaagccataatcatcaagatctgtgttggtggcaacgtaatgctaaaacccaggggctacattctggacactccaaagtttaaatgtggtgaaatgagaaaacactacaaaggagactgagaaagaggtgccagtggggtaggaaggaaaacaggagtgtagtatcctagaagtcaaataaagaagatggctcaacaagaagggagtgatccagtcagataacatgtggtaaaagacagctgaccactggctggctgcggtggctcatgcctgtactcccagcactttgggaggctgaggcaggcagatcacttgaggtcaggagttcgagaccagcctgtcaacatagtgaaaccctgtctctactaaaaatacaaaaattagctgggcatggtgctatgctcctgtaatctgagctacacgagaggctgagacagaagaatcacttgttacctggaggtggaggttgcagtgagccgagattgcaccactgcactccaccctgggtgacagagtgagactccatctcaaaacaaaacaaaacaaaacaaaaaaaaaccaaacgaaaacaaaaccaaacaaaactgaccactacatttagctgcgtggagggaactgttaagttttgttgaagtgacggagacaaaaacctaaatggagtgggagagaaattggagacagaaagaacccttcagaggtctgttgtaaaaggatgcaaagaaacagggaactagaagggattgtggggtccaaaggagaaataccagcacgtttgtatgttgtcaataatgtttcagtagaaaggtaaaaattgagacaagagagaagaaagtgtagctggctagtccaacatcctagaatagccaagaagggatgggacatagtgcaaaactaggctgcccaaagcagagttctcacagtggcttgcaaaattcagcaggcatcagagtcacctggagggcttgctgaagcacagatggttggaccccatctccagagtttctgacacaaaaggtctgcagtggaactccaagaatttgcgtttctagcaagttcccggatgattctattgctgctggtccagaaacctcattttgagaaccactgctctgtatcaaaaggagggaagacagaaaagatgagtatatacattagtacaaatgctgaacacctgggttatcaaaaaaaaaaaaaaaaaagggaatgtggtgtttagtagccaggaggtctctagttgcattagaccttgccatcgtttggtgagggaggtagtattatcttgttttacagaaacttaaccaagtttacctgctagttggtgggagaaatggaattcaaacctgtatctccagatttcagttccattgctgctttgtagtatgaacatctgctagcgatagtgtaatttagtatgtggtgatcctactagcatttcccctcctcattcctttctcccatgcgtggttaacttagtcatctgacaacacatgattgagtgtgctcactaaccagacaagcctctcagtccaggcagattatagatctgaggcaggagagtaaagttgaacagggaataggtttatgtggaattttttttgtctccctgtttcactatacaattttggaagaagggtttgtgcaaaaaacacaggttgctagtcatgaaacacattctgttcaccactaattaatttgggtagtatctctgcttcacttttcttcagtgtaatggtatctctgacatgctagggagcttaggaaaatggttctagcattatataaatgacaggtattgctattagcaatgactcaagattctcatgttttttggtattctacatgtcatccattctttctattatactggagtacttttgttttatgtaaaactgttgtataaatgtcattttaaagtctctgctgtcaaattttgttgttattctaagacagcagctgtggatgtggcttaaaaactgatgagtttctacaatgatgagcctttatggagcaatgaaaggctgcttgtaaattgtagccacacttgcaatgaattctgtgtttgttattgtgaatccctaagggtgactgttttttcagcagggcgagttaggacggcacaaactgagagtttctgttctggtaatctttacttcttatgactttaaggaatttggaatatttttgcttgactgttgtaatgaatctctaaacatattatttggatatgtgggcagataaattgtaagatatgttatagacgtggtttctgtcatcaaatatttttgctcacagtagctactgtgtgtaatagcatttatagatgatgctttacctctagttactgcctaaagatataaatattgggttatttgaagctacatatttccagcttatacatatgaatagtttaaggcatagtgtatgtacccacttttatttcagaaaaatacaggttgtttgtttgtttattgttttttttttgagatagaatctcgcgctgttgcctaggctggagtgcagtggtgtgatctcagctcactgcaactgccacctcctgggttcaaacgattcttgtgcctcagcctcctgagtacctgggattacaggtgtgtgtcaccatgcctggctaatttttttgtacttctttctttcttcttttttttttttttttttttttttttttgtgacggaggtttgctcttcttgcccagactggagtgcaatagtgtggtctcggctcactgcaacctccacctcctgggctcaagtgattctgctgcctcagcctcccagctaggtgggattacaggcgcccgccaccacactcggctaatttttgtatttttagtagggagagggtttcaccatgttggccaggctggtcttgaattcctggcctcaagtgatccacctgccttggcctcccaaagtgctgggattacaggcctgagccactgcccccagcctgtacttctttttagtagagatggcattttgccatgttggccaggctgatcttgaactcctggcatcaagtgatccgccaacctcagctcccaaagtgctgggattacaggtgtgaaccaccacacctagctaggaatatggttttaatatgttattgagacatatagctaactataattattttttattttttatttttttgagacagagtctggctctgtcacccaggctggagtgcagtggcgtgatttcggctcactgcaagctctgcctcccgggttcacgccattctcctgcgtcagcctccggagtagctgggactacaggcgcctgccatcacgcccggctaatttttttgtatttttagtagagacggggtttcaccatgttggccaggatggtctggatctcctgacctcgtgatccccccgcctcagcctcccaaagtgctgggattacaggcgtgagccaccgcgcccggctgctaactataattattaaaagtagttttactcagaaagacatcacctggagctgacctacaaataataagggagatgtggtaattttttaatcaaaatatacctagaagataaatttctcaaaataatcctagaaatgacttttaaagcagaagagaaaaaaggaagggtggaatagcaacaatggaaacaaatgaggaatcctgctccccaccccacctcaaagcccactgtatatgtggggttatggtcagtatttctggtgttagagtgtatatttgcaaatctctgaactgtttatatgtatgaatctcatcataatagattcacattcttcttaaaggcaatgcttaacatgtttcctgatcataagatgttcatattgaagattttaaaaaaatacaggttgaatgtgctgcttaaaatgagctgctgctttatttttaaacatttaaaaaattttgttaaatttagtctcgttcttcctacaaaagagcttaaactttgacagtaacagctgttcttttgtgtgggacatgttttcatgaggatttttgtgcacattaaaaataaccatttttgtgaatcgtagttattattcatagtcactttataagagatataaaggttttccagtgagttacttctgattcataaccaaattatagcagagcagatgtagactaccagtggaataattagccaaaaaatattagggggctagagatctctttgtgtaacatttaactttaatttcttggacagcttatatgaataattaaagtgttgaggcagttaaaatttattttcctctcttgggatttcccagttgtcatagatagctgtagtcactagggaagtagaaatattatttccagcaaacagatggctttcctcgtattggtccccaaaagcgcctactgaggtttgtgtttctgttggatgatttcctaatcacaccaactcagtatacttttgaaagatcacacctggtaacagaatatgatgtaaatattaatatgacttagtgaacttgagagcatccaaaattgtaagtttatatagttcctacatccctggggagagtagtctgtccaatgagaggaatcgcctggtagctagtactttacttttcttatcacaagtcccctttctgcctcagttgtactctcagggattcccaagctgctacttctgctttttaactctcattaactctgtcatctacgtgctattttcatttctgcttagtcagatgactaccccatcccgtactttgaggcattggtaggtttttgttagaattaaggataggattctattatgtatggggaagattttcagagaatacagtgatgctggggcttaaaatgacaaaatcacatcttttctaagctctataatgaagcttttttggagatttcacttgttactaatctttctctttttaaaatgtctgtttttcttctcccattggaaattaaaacacacacacacacacaaacacaaattgggaatctacatgtatatttatgctagtgaaatttcaaaaatagtcaagtattagtgaagtggccacattgttggagtaaatacttgggggttcatcatctcactcccaaaaaatttaggacatggacatgcacgaggagttcaggagtggaggtttaataggcaaaagaaagagaaagagaaaggaaaacagctttctctctagtgagagagaggggacttccagagaggaaaagactggcgactgcggatgtactggattttatagtcagattggaggaggggatatctgatttacatagggctcacagattggttgggtcaggtatgacgtttacagcggggaaggctggctgcctaatcttattatgcaagtaaactttccccttggcaggtgccatcttatctactccttactgtacacatggctgacaaagagaagggaagatggagccgctatcttgaacatgattggcacaactgctgacatctatgtctgtagctcgattttacagtctgctctttgtgagaaaggaaaatgatttggggctgcttttcattaaaaggaaaaccttactgaggacttccataccctcactatctgcctaagtaatatcttcttaactcctttatcattaggattctaaaaacaggctgtattggccgggcgctgcggctcaggactcctgtaatcccagcactttggaaggccgaggcgggtggatcacctgaggtcaggagtttgagaccagcctggccaatgtggtgaaaccctgtctctactaaaaatacaaaaattagctgggcatggtggcatgcatctgtagtcccagctacttgggaggctgaagcaggagaatcacttgaacccgggaggcggaggttgcagtgagccgagattgcgccactgcactccagtctgggtgacagagcgagactccatctcaaaaaaaaaataaaaaataaaaataaaaatttgtcaagaaggaaaaaaattctgatgctttacacgtgttgccaggggaacagtggcaccatttgttgaaatgagatggccttgaggtaaaaggcacagtagaagagttgagttagtttggggagaagatttcgcttctgaacatgtcgactttgaggttcttgtgagaaagctagatgaagatatccagtggccagttatacgtggcgatcctggagctcaagagagagaggtcagggtcggaaatgtgtacttgaagactggtagatgctaattagaaccttgggagtgggcaatatctcttggatagagttaggcagagacagacttggcaagcaccaaaatttaaggaatgggtagaggtatagaagcaattagaagaaaactgttagcaaacaaggtagaataaaagcctcaatagtagagcattacaacaatgaagacagagttctagaaggaggtacactggtcagtggtgtcaaatgctgcagtgagggtgaggtaagtttaaatgttcattggatttaggatttcagagaccctggcaagaactggtgagatcttactgtggttcaggagttgaaggtgagggagtatgcaactcttttaagagcagttcttttaagaacatggagagtgggagtggagccataggtgttaaggtagagctttgaagatggaataggctcgataggtttagatgcttattggaaggaacacacgaagagggaagagatgaaacttttattgttaactcctgttgctgccttttctgtaaccttgtgctgcttctcatgtgttaatgaaaagcctgaattaaaagggggtaactgaaagtggcacacattcagtaattctgtgaccaagaggacatttaccaatttgattctcttttagagtctttctacatctgctgtttcctttttttttttctttttctttttcttttttttttttaagatggagtttggctcttgttgcccaggctggagtacaatggcaccatctcagctcactgcaacccctgcctcccaggttcaagtgattctcctgcctcagcctcctgagtagctgggattacaggcacacgctaccacgcctggctaattttgtatttttagtagagatggggtttcaccacggtggccaggctggtctcgaactcctgacctcagatgattgacctgcctcagtctcccaaagtgttgggattacaggcctgagccatcatcgtgcccggcctgctgtttcattttaatcagaaaaaatattctgtgtttgtctcctggaggggtgacgtttgtgttttgattgtttcatgtttttgctcagtccttctaatactaaatgaggtgatggacttggtttattactgtgaagccaaagatattacttgtctttgggatctttatccatatactgtaagagctatgtggcacatacatcaatttctttttcttttcttttaactgattgcctctagacttttgattgcttgctcttatcagtaagtagaaagttagcatgtaccccaatatatgtgattatcatattgtactgtaccaatatactgaaatatgtacataaatttgaaatgttaaaaagtattttgataaagttgaggtaagcaaagcttttcacctcaacaacaaaaagtttggttgttttttgatttttgttttttgtttttttttgtttttgagacaaggtctcactttatcactcagagtggagcgcagtggcgtgatcatagctcactgcagccttgaactcctgagttcaagccatccttctgccctagtctcccaagtagataggagttacaggcatgtgacatcatggcccacgaatttttaaaattttttgtagacacaagagtctcactatgttgctcaggctggtcttaaactcctggcttctagttatcctcctacctaggcctcccaaagtgttgaggttacaggcgtgagctaccatgcctggtctgtaaacaaagttttaaagatgtttttaaaagttaatggcaggaactcattttatcatcacaagtttgtgtgtgtgtgtgtgcgcgcgcgcacgcacttgccaggctctagagtgcagtggcgttctcacagctcactgcagccttgaccccgggggctcaagccatcctcccacctcaccctcctgagtagctggcactacaggtatgagccaccatgcctggataatgtttttaaaatttttttgtagagatggtgtctcgctatgttgcccaggctggcctcaaacttctggacgcaagtgatcctcccacctcagcgtcccaaagtgctgggattacaagcatgagccacagtgcctggccaatcttcacatgtagcttttagtgagaacaatgtgtttaaatatcacttctttttatcttttttatttgaatatcacttctttaatactttgcgatagagtcattcaaaggactgggtccaagttcgttttattttgatataagtaagtgattttcttagctgaaaagctattgtttaaatgccatgcttaagtgttttgatttacagacatgtctactaggtagcatactacaggcagctatttgtcttcacaggaaaagtaattgatttggggacctttttgcatagagaaaatgagtaactcatcaagtttcacaacacttttacttctaagtgctttaccaggagataaacagcagacctccatgtggtataagagattttcatggttactctctgtctcatgatgatgtattgttttataaaagtaactgtctattacatcggcagtactttgtgccattctgcctttaatttcttctgttgctaatgtaagatggaatgaatgaatgtcttgtgtgatggaatttcagtacactttctacagaaatttgttttatttcggttaaagcagctacttgcatagcagataatgctctcactgttatttcataaaatgcttttattaaagaagtcaagaagctccctccatgaagacagagaccttgtctttttgttcagtgctctagctctgaacctacaagagtgcctgtcgtgtaagacataataaattttaactgtgaaatgaatttgtagttgagaatgttttcctgtagatactttcttacaaattttcatatttcattaagaagccagcaaagactataagctaaggtatattagaaaaatggtttgtactaccaactttatggcaaatttctcacactagataatttttctaatactagtttccccactctgccctatgatcctcaacagctttttgtgtgcttatttatacagtaatttgcacacagaaaaatacattttggtttatgtccatatgattccccaagtcatatttcagtctttctgccatgacaggaaggacaagtctttcctcatggtatttggctacttatcttacactattatataaaataaaccttaaaagagacatctgaacatacgtagttaaatttagtgaagttttccaaagtactgaattgaaaattatgactttaaaccttgctcgggacaaaaaacctacaacctatagacatatgataggtgaacagttcattaaaggacattaagaggtgaggatggagggcatataagggagataacattctagcaagaagaaacagcaaatgtaaagacctgtaggcagagtatgcctggattagatgtggcatgtgaagtaaatacagaattcaaagatgattccctggtttttggcctgagcaatggtaattacagggttgccatcatttaatatgggaaacaagttttaggtatgaggttgtgagatgaggctacatataaatgaatgatttgcttttatggcttctggattttgcatggtgacaggttaaaacaaatctcaggttagccaattcttggtaggaaacatgattttaacccatttatgccataggttgcaaaattttttttgtgtgatagccttgagcagttggatataaataactcacaagcttagcattccaataatggaacactatattatatacgttatatattatatattatatacattaagtttgggttacctgaaaaaattacttgagactattttgctctaccttaatatgcttaattactatgctaactcccaggcccatcctgtggatttcaaaagtatatgtggaaacattgtgtacattagtgcgtgatctctgacacttgaggaacatagatacctagaatattgagatagtaaaagggaattagggagtcctgaaggcaaatattcatactaacaggaagaagacacagaagtttttgatcacatacttaggtctccaggcatcacttgagagaatttttctgagaatgctttgtttattttttggtggggggtgggtgactgggtcttgccctgtcgcccaggctcagctcacggcaacctctgccttgcaggctcaggcaatcctcccacctcagcttcccaagtagatgggactacaggtgtgtgccaccacacctggctaatttttgtattttttgtagagagagggtctcaccatgttgcccaggctggtcttgaactcaggaactcaagtcttccgcctgccttggcctcccagagtgttgggattacaggcctgagccactgtccctggccttgagaatggtttttatgttatgaacaatacaggacaatggtatctgtcaaaatagctgctatatattacttgttttctctacaactatgtatatcttcctgtatgagctttctgttttgatagtacgtttatgtacttggaaatatgtgcatgccaaataggccccactgctagtttcatacaggttatgcagtagggtcactttccatggctattaacttctagatgttctattaagaaacagtgtgtgctaagagctgctttgggtcggggggaggtgtgtggttatggtggggagttccctttcatacctactttgggatcacagtgaactgacattgatctttgtgtatttaaattgttttcaattcagagtagcattaatgtatactcctgcagccttgtcctaatggtagcagttttagcattattttctctatatagtgggagtttaccttactgtctttgtctttttgggctactgtaacagaataccgtaaactaggtagcttatgaacaatagaatttatttctcacagtccaagactaaggtgccagaagattcagtgtctggtgaaggtccctgctgtggttcatagatggtgtcttctagctgtatctacacatggtggaatagggggtgaaggatctctctcaagcctcttttataaggacactaatcccattcatgagagctgtgcctttatgacctaatcacctcccaaagggcttccctcctgatattgtgacgttaggggtcaggatttcaatatatctcttgtagggggacacaaacattcaaaccatagcactcacatcattaaaaattcaatcaaggctgggcgtggtggctcacacctgtactcccagcactttgggaggccgaggtgggtgcatcacctgaggtcaggagcttgagacctaggaaggagaatcacttgaacctgggaggcggaggttgcagtgagcccagatcgcaccattgcacttcggcctgggccacagagtgaaactctgtctcaaacaacaacaacaaaaacctcaaacaaaatcaaacaaaatctatccgtggcgttctggtaggaccatgggtactgaaggttcatagggcttgttttgtctaatgcctgcagaagtctcttatactgccatgtaagttctgggaggacattgcttcttagagaccattttcattaaaattaaaatctaatccagcatgtagccttcatcattaatccattgttttagtaagctttgtttttgttttccagcttcttatgtaccggtagctttgttaaatagtggaaagtgtaacaattcctaaaaaatccagtggaaaggaaagtatagcaaaacccggtggaaagtgtagcaatttctgaagctactacatcagctactacttgcaacaaagaaaggcacttgtatattttcagccttttttcttaaaatattcacctgttgctaaggtttttttctttaatcatgaaaggtttatttccagttgcttcaaaacattaatatgctaggaaaaattgtctatgaagtaacatgattttcatttatgtcaacctcattcccctatgctgcctatgcagcagatcacagcaaggaaacatacattgtatcagaacaaactttttgttttgatttgatttgttaaatgcatgcagaggcaggtatttgtttttgggatcagagagaccaggctttgaattctggttctgccacttaaatgtctcttcctgcaagttacttcacaactttaacctcagtttgtgtgtctataaaatgtaattattatgcctatctcataggtttggtagtaaataagtgagataatacatttaaaatattagacaacctttttatacttcaaatatactaataaatcttatttgcaattgttcttataattcacagtattctttttttttttttttttgacagagtcttgctctgtcacacccaagctggtgtgtagtggtgcgatcttggctcactgcaacctctgcctcctgggttcaagcaattctcctgcctcagcctcccgagtagctgggattacaggcacccaccaccacgcctggctaatttttttgtatttttagtagagatggggtttcaccatgttggtcaggctggtcttgaattcctggacctcaggtgatctgcctgccttggcctcccaaagtgctgggattacagttgtaagctactgtgccctgccacagtattcttttgtttttttgtttgtttgtttttggagacagagtctcgctctgtccgcccaggctggagtgcagtggcgtgatctcggctcactgcaagctctgcctcccgggttcacgccattctcctgcctcagcctcccgagtagctgggactacaggcgcgtgccaccatgcccggctaattttttgtattttttagtagagacggggtttcaccatgttagccaggatggtctcgatctcctgacctcgtgatccacccgcctcggcctcccaaagtgctgggattacaggcctgagccaccccgcccggccatattctttagatcatgagataatttatacagccaccggggactgttttcagcaagcttaatgttttcatgttacttttatatcctgattttatttaaatacaaaatatttactagaaggcaggatttttgtttcaccatcaaatatagatcacaaggaaaacataaaaaatgtagtaaattagcaatttgtatttttatttattggcaaaaagatttctgtttttttttttttttttttgatacggagtcttgctctgttacccaggcagtgcagtggtatgatctcagcttattgccacctccacttcctgggttcaaccgattctcctgcttcagcctcccaggtagctgggactacaggctgctgccaccacatccagctaatttttgtatttttagtagagaccgggtttctccgtgttggccaggctggtcatgaactcctgacctcaaatgatcgggtcgccttggcctcccaaagtgctgcagttacaggcatgagccacatgcctggccggcaaagagattttacgtgggaaactgatcaaataattacaatatacagaaactgtaattgtatttagattattgtgatgtaaaggggatacaggcttttttcctttgggtacaaatagagatggactgttttctatttaaataccattaaaaattgttatacttttctactttgcctgtgacatgtagtggtttttcaggcttatattctctcttccagctcaaagctctcatttaatgaaataatttgaaataaaacttgatttaaaacttgtttttcttatttgatttaatattgtctcctgccgtatttttttggtcttgttttctcttgtatagggtagagggcagtggtgagatcatggctcacagcagcctcaacctcctagactcaagcagtcttcctacctaagccactgcccacctccccctaatcccccaggagctgggactataggtgtgtaccatatggcccgactatatatatattttattttttgttgcataggctgtgtactaacatttttattctgaagttaaatacatcccatctgtgaacttgtcaaacatcatgcactgaactattttaaattctactcaggagacatttcttaaaaacctattataaggctaagtgtggtagctcacacctgtaatctcacaaggccaaggtaggattgcatgtgtccaggaatttgagaccatcctgggcaacatagcaagacttcatctctaccaaaaaaaaaaaaaaaaaaatgggtgtgggggtgcatgtctgtagtcccagccacacaggaggatcccttgagccccaggagttcagggctgcagtgggctatgatctgtgctactgcactccagcctgggcaacagagcaagaccccatctcttaaaacatcaaaaccctaacccctctcctgccaacaaaaaagcctcattaacagataagaactttgaacaccttgagttatataaaacgtaagtgaagacagtctggcccttgatagtttgtgccccactggggactgcaggtacactcacacaaactgtaaggaagaacaccatagctcatgtaacaggcatttcccaaggagcattgaggtacacaagaagaggggatggttaattcagactggggattccagtgaaagcttcaggaagggatttcttcttccacctctcagttttaaactttttaactatgttagaggaagatgaattctggaaatttgggggcaagagattttgttaaggaatacctgagtactgactgtcctctgaccctcctgccaattcaggatgtggttcttgttagagatgaatttgttcaaaaaccacgagtgcccatgttggtaaacattcctttaactggaagaaaacagaacatcaatagaaaggtaagcctgagtagagtcccagtaagaatgtggctattttctcacctctgctagagctggacctgcagagtgtgtcactggcagctgtgagtacttttagctagggagcttgtggcctaggtaagcctgccaagacaggctgcacatgcacttgggctctgtgtagctactgccattcagcttaagttttgtatcagtagctaagtagagtcagagctagatcaggccaaatagactgggagtgagaaagtaggagagtgaatctgtttagcttcttcctgtctgtttgtaacccatttgaaatgttgcacaaatttcgtttccttccccagagataaccactgttacaaatttgaatatattctcccagacaaattctttgtgtacttaaaaatacataaaagtgtataaatacagtttgggttttctttatctttacttttaaaatttataattcttctttagttcttttcttatcagtgtatatttagggttgcccccctcataattttgtgtagtattccatatccataatatagttgtaacaatatatttagccagttcccatttggtgcccaactagatgtttttctcttttagaaacaacactgcagtgaatatcttcgtgtcctgtatgtttgagtatttttgtaggaccagacacttagaagtgaaattgctagttgcaaagatatgtgcagttatacttttgatagatactgccaagttgttcttatgtttcttttatcatatagcagtgtctgagaatcgaatagatatcattcgaagttggaaggaagaggattccacatagagaagtgtgcatacaagcatggaggtagcagagcctggtggggatggtgaggaaaaagggagtaaagaatctggtgtagagtatgggaagcagaagggtcttgtgaaggtgagcccaaaagggtaggttagatcagacaaaaaagtattttttaatgttttgcttagaactttaaacttgaagaaacagtggagccctttgtaaaggttttaaaactagagctttatttcaagaaaatagctagtgataattgtgaaggctaggcttttgaggataggtgattgactataggactgttacagtgatcctgtgctgtaaggaagaacttaatgaaggccgaggcattagaaataaaagaaaggcatcaaactcaagtagtgttacagagttaaaatcagtttgtaagacttggcttaggatgggaaggaaaatggttgaatgttgtggctgtctgggaggatgagtagtgccacttaacgaagatagaaataggttcgatttataaaacaaaggaaatatttagaaaatttgtcaaaatataaggaaaaaagtaagttactatccactatttgtgtatctcatcaggtgtgttcagtttatttattgtagcaaaatatacataaataaaatttaccatttaaacaattttaaattgtacagtttagtggtagtaagtacattcacggtgctatgcaactatcactaccatccatctccacagctgttttcatctgcctgaactgaaactcctaacccattaaataataactccccattgcccccaggtccctggtaaccaccattctttttgtctctatgaatttgactactctaggcacttcatgtaagtggaatcatgtagtgtttgtctttttgcgactggcttacttcacttaccataatgtcttcaaggttcatccatgtagcgttgtcagaattttgtttctttttaaagcagaatagtattccattctatgcatataccacatttaaaatccactcataagtaacttgggttacttatgctcgggtgttttttgtatgtttttgagggggtattcgtgtgtgtgtgtgtgtgtgtgtgtgtgtgtgtatttaatgatcagagagtgaattgcctagttaataaagaatgaatataataaaattgagtttgataaaactctacaaaccactgcactcttatatagatccattgttacaaaatagtgttggttgttaaaaggatgattacagaagaccatacgttgtactgtgcaaatatatcatgaccattggaaaaatagcataaaatatgtatcctactagtagtaagtaccataatggtcaaaggtttagtataaagttaatagaagacctgagattcttaatatatggtaattggattaccataaggaagtgtaataggcacaaaattacgtgcactttgaagtgtccaaaacagtgaaggtgtaatatatgttctagtctttgagttcccacacaggtgactttactaacatttctttttgtattttaaaaatagtccactcagtccaggtgcagtgcctcatgcctataagcccagcagtttgggaggccaaggtaggaggatcacttgaggccaggggtttgagaccagcctggcagcatagcaagaccccatctctgcaaaaaaaaaaaaaaaaaaaaaaagttagtggggtacgtggtgcatgcctatagttccagctactcaggaggctgaggcatgaggattacttgagcccaggaggttgaggctgcagtgagccataattgtgccactgcactacagcctgggtaacaaagcaagatcttgtctcttaaaaaaaaaaaaaagtccattcatttattcaggtttgaggcagtgggttcactgctgcccattatcccagttcactgtgtcatcattatgttccagatattgttctaagtgccttacatgtattaagtcttttcccccttccactgtttttatcccagtttttcaaaaggagaaagtaagtcacctagaagttaagtaacttgcctgaagtctcatagctagtgagtagaggatctaggaatcagatccagacaatcttctcttaagctttgctgccactcttaacacctttgtcaaggtgctgtcataagtgctggaggtacaggaatgtacacatctgaaaatttttcttgatctcacggaacgtacatatttatatttattaaatgtattttaaaatttctgtcctgattaaaatgtataaatagacatacaaaaatatgtaggaaaatactgtatgtagttaggtaatcatatgtcattaacatattaccatgttatttcagtaatatttaacgaacgtttccattgtatgggtgtgtcataatttaaccattcccctgtgttggaaagaaatacccaaacctttcctaataatcagtattgcaatgaccattataacaccttcattttttttttttttttttttaacattttgttgtatttactttatggagcggctgtgtgtccagtatgtccgaccctcttcctcggttctgggctcgggtgggggttcccttggcaaactgcaggcccctggctgggacgcccctgctgccggcgccggcagcctcgaggccttccctgcttgcgcggtgcgctcctcggggtcggcacaggcatagccccgggggacgtgaggttcccgagtgctctcccaccccgccgacaggagggatggtggccgagcgggccggggcgggcgtggcgtgggtgtgccaggagctccgcggttgccgcgaagcgagctggagctgaccctcggcgtcccgtgagcaccccgcggatcaacaccttcattgttgtcgtttcagattattatatgaggctgtttagaaaaacattagttattggcatctgtttctaactactttcctgaagtttatgctttagcagtagtttgctagcagttatttgatctcataatttcataaatattgtgtgttgtaaattcagtagtcaaaaccaaaacaaaataatcagaatttagtcatcaaaaaagtgggccttatttatgttaatttaatttttctgctttcagagcctttgctctccttgatactggcatcacagtgtatttttagtgtattaatatatacaaagttttgaattataaatgtgaattttgatgtaaatacaattctcaaaatattaatataatccaccaaataagttaattttaaaatggaaaattggatataccaaaaatcattttagattcttaatatcatttagcggtgaatgtgtgtttttccctatcctgcctggaaaagccattcctaaatattttcttccattcattcaacaaatatttgtgtacctactgtgtttaatggcatatcagatatacctgccatcatgaactttctatatttagcttatcaatcatatattcgaagtacagtcgtaacattttcacatatttagtagtttctagtgcctattgtgttgcgggctttggtggtaaagtgatgataggtttacagagatgaaagacaaaagttatacccttgggacctcacagcataaaggaaggagactgtagtaactagcatggaagcggaatgttttctagacagtttcataggtgcttttttttttttttttgagacagagtctcactttgtcacccaggctggagtgtagttgtgtgatctcagctcactgcaacctctgcttcccaggtcctgcctcagcctcctgagtagctgggactacaggtgcgcgtcactatgaccagctaatgtttgggttttttttattttttttttcttttggtatttttagtagagatagggtttcaccatgttggccaggctggtctcaaactcctgacctcaggtgatccacccaccttggcctcccaaagtgctgggattataggcgtgagccaccgctcccggcctcatagggtttttaatacacattactgaagataaaaatagagtgcaactagataaaataaagatttgtagttctgtgaaggatacatttgtctggaggagcagagtgtaggaaacaatgtgatatcctttcaggagtgagtgtgtgtgcgtgtgtgtgtgtgtgtgtgtgtcacattcagagccattaggttgttttaaggaggaatgggaaggggccagagggatggactaatgggctaaaatcatcagtttgaaaagacggttgtggctacaggcagagatttcactggatcaggtctcttgtttctgttcttcattagtttcttcccacctactctggtagagttctttcactatatataattctgtcgccattatcagctttctgaagagtgacctacattttatagtctgcattccccacaatctacagtaaatctaaatcttaaaaatacataattttttctgacagtggattgaaagattttcatcagttacatctactctttcaaccaggaaatagtttcattttctccttagcacttactttttagccctagctgggaaactttcatctttattctttacacaagctgttccacatgcctagagtggaacagcttgtgtaaagctgttttcatctacgtctttcctaggaagctctttttatggcttgcgtgtattaaaaatttgccttatcagtcatcttaaagtaatttaaattgctttatgacagtaaatgaatatatttattgatcagttatcagttttactttgtgtagcttgagtgttctttcttgtagctacatgatgccacacttgtggtaaaagcagtgtgaattcttagtagatttaaaatgtgatacatacacttcttactataccatttctaaaaatgaaatattttttatgtttttatgtaagaaagctggggtggggttaggaggaaaggaacagatacctgccaagtcaatcagagaatggcggtaaaacttgatggttagccgtctgtctgttcatttttatgaatgccactatagaagtaatctttagaaactggagctgttttcagtttaatgacgtccatggaattaaccggattcattaataacggcatcaggaagagcattgtttgaaggatcctctgcctagtctattaatcagtttccttttagacaggtgtacaggtgatttctggccctcattcacagaatagaatagtggtcgttgagaagcagacctagcacctagcaagtcttcagaccagtcttttaagtaatttttattccctgagaagaaaattgaagaaacaattggggcaaagagatttgtggggttttactagaaagatctcgataaagcaaggactgtcactctattcctcattcatatgagggttcacattaaaaatgacagtgttacacagggtagcagcagcttttttgtttttcttagtcatggcagcagttaacacagtgcactagcagtttaacataccaacacttaaggccttattttttgtttttgtttttaagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggtatgctttagaaatctcccagtgaccccaaggtcatggatagaatgaacactcatgattctgtatttagttaatgcatatttaagatattctgtatttagttattacatatttaagttatataacttttgattatagatgtggttatggatttatggtagtattttttgttacaaaaacccatggattttctttttcctttatgatacatggttgtggaggatactgtaagtattttccctaagtttttatagtaatgggctgtaatttcattcaccaaatagtttagggattattcatgtattactctgtaattatcttttacatcatagactagttctctacagaactgtcattttatggtagcctgtacaggaaatagttggatgaagtcttcagttgggttactaatttgatcaaacaaaacaatttttatttgggccatttagtacagtttttttcttttccaaagaattttcacttaaaggataatgagttatttatttattttttatttttatttctttttgagatggagtcttgctctgtcgtctgagctggagtgcagtggcactatctcggctcagtgcaacctccacttcctgggttcaaccaattcttctgcctcagcttcctgagtagctggaactataggcactcaccactatacctggctagttttcgtatttttagtagagacagggtttcaccatattggccaggccggtctcgaactcctgacctcgtgatccacctgcttcggcctccgaaagtgctgggactacaggcgtgagccactgtgcccagcctattatttatttttttgttgagaccgattcttgctctgttgtccgggctggagtgcagtggcacgatcttggctcactgcagcctctgcctcctgggttcaagcaattctcctgtctcagccttccgagtagctgggactacaggtgcccgccaccacgccctgctcatttttgtatttttagtagagacgggttgtcaccatatttgtcaggctggtctcgaactcctgacctcaggtgatctgcctgcctcagcatcccaaagtgctgggattacaggcatgagccaccacacctggccaaagatgagtaatttaaaaaattaatattgtgattattgtttatttaacaatgtatgtatgcagttattcatgtgtttgtggtatatagttttgctgttacttgtggttactagtatagtaattctagtcttcgtaatacctacttaatcaaaaaccttttaagtttttatttttataaaattttgagtgatgtaatgaaaattttcttaattatatgaaatcttggaaacctgattttcatactgtgtgtttggtattaaatgttctttttaaagagtagtagaagtgagtgaagaatgctgaattcattaatgttacatcagattcagaactctcttttaggtaataaaagaaacaatattgggaagacaggtttaaataaatcatgggtagataagtgtaatagaaatacactggtatagtccatgatttttgtcagttagtctaccttaatgttaaaatccttttggtatgttagcagttatattcttaatggaatttagttgttaaagtaagatgaaactgctttatattaaactctagtctataacagtgatctaatcaagttccaagatagaatcatctgcttattagccaaggcaatcaattagttcaatcaggaattttatgtctgatgggacagaatagtatccaccctccaaaaagatattcttggacataatggtttcaggatagtgttcaatgtgttgtttacaaaattgtttctttataatacttgctatctcaactttaacatttctttttggggtagcacttgagaatccatttgttttgttttaactccgcagaggtttttgatgtacagctagattgggaagtcctgttctatttggaagacttttttttttttttctttttcattttcttttttttttttttttcttgaaatggagtcttgctctgttgctcaggctggagtgcaattgtgtgatctcggctcactgcaacctctacctcccggttcaagcaattctcctgcctcagcctccccagtagctgggattacaggcgcgagccaccatgcccagctaattttttgtatttttagtagagacggggtttcgctatgttggccaggctggtctcgaactcctgatctgcccatgtcggcctcccgaagtgctgggattataggtgtgagccaccgtgcccggcctggaagtctttataactttgtggttaagagcttacttagatcctggggtcacctcacctgcatttcaaatctaatccttcccttattattgtgacaagttctaagagtgacttgaagaaacccataaatttatatattagaaaaataagcatattgttatataattatataatatgatttatatatagataattatatatatacacacagtgcaggtttgggcatgtaggaagccagtgtcagattaagtgttgatgattattaaatgccagattagatttttttttgtagagggtacgctattacatttttcttaccctgactgagtcttgtactcttctatgctattcctagagtaaaataagccatcactatttgactgatgttttcaattttttgggctttttctcatcagtgaaagaaggtggccactggagtctgctactttatccatgatcatcttatcctgctggggtgatgtgtgtgttttctaaagctgtgtttttcaaattgcaggcttcagcacattcatgagtgggtcaagaaataaattcagtgggttatgaccagcattaaagcatgtattagcatagaaaataaaatatcagtgcattgaatatagaaaagaatgtatttcttgaaacttctgtttagttttatcaaaagattgaaataaaatatatccacatttatgtggatattgtttagttccactaagtgtatgtttcccttagtcatagacatcctttaaaagtggtattagttttatattattttgccttctgagaggaagtgaccagcataagtttcagtatgctttctaatggtatgccatatcctctacattactttcaagggtcctcctaccatcttttacttttattttttgaagtaaaggttgttagagagtatctaaggaatagagagtagaagaacatagcagcagtggcttttgagtaacattaaccaaggctgttttattaagtagagtgatgtagtatcttgccccttggcatgtattgtgatggttatcaactcatagatcagtggttttcaaactgccagtggtagcacactctggaatcaatttagcaagttgctgcctcccgtgaaccccctaccccctaatgaaacagaaaagaacaaaatagaaaatattatgaatgtatcacacaatatatacctttctaaaacttctgtgtcagtggcatgtgtatgtatgggattgcagagacctaatttctagtgattatcaactggaaaactatgaaactcagtctaataaattcatattgccaagctgacctcagccacaaaagcttcagatatttaagacaaatattaccagatcagtagtttttttttgttttgttttgttttgttttgtttatctctgatggtagagaacagttagtttgctataaaactttggttttgtttttttgttgctatattgttttgtgatgtgtatgtgtttgtttgccctggtaaatatatatgtgtatttatttttatttatttttttgagaccaagtcttgctctgtcacccaggctggaggacagtgacatgatctcagctctactgcaacctccgcctcctggattcaagtgattcttctgccccagcctcctgagtagctgggactacaggcgcgtgccatcatgcctaattttttgtatttttagtagagacggggtttcaccgtgttagccaggatggcctcaatctcctgaaatcgtgatctgcctgcctcggcttcccaaagtgctgggattacaggcatgagccaccgcccccagtctgtcttggtaaatatttaaaggttcatacataggaaatttacaatacatcctagttgtggaaggatttacccttgctttgcattgatgtaagagactcatgcagtttaaaaaaaaatacaaataggccgggcgtcgtgtttcacgcctgtaatcccagcactttgggagtccgaggcaggtggatcacaaggtcaccagtttgagaccagcctggccaatatggtgaaacctcatctctactaaaaatacaaaaattagccaggcatggtggcaggcgcctgtaatcccagctactcgggaggctgaggcaggagaatctcttgaaccttggaggtggaggttgcagtgagctgaggtcgcgccactgcacttcagcctgggcgacagttgtgagactctgtttcaaaaaaataaattaattaataaaataaaaagaaaatacaaataaaatgatgatgcacgctaaaacctatcagttcaggccaagtgcagttgctcacgcctgtaatcccagcactttgggaagccgaggtgggcagaccacctggggtcaggagttcaagaccagcctggccaacatgggaaaaccccatctcactagaaatccaaaaattaaccagatgcagttaatctcaactacttgggaggctgaggcaggagaattactggaatctagcacacggaggttgcagtgagccaagatcatggcactacactccagcctgggcaacagagcaagactcttgtctcaaaaaaataaaaaataaaacctctcagtttcactttttatatgttaggacttgtttgtataataggtgcttcttcaattcagaaggcaaatataaaatttaaagttgcaaaaaattaagcataaatccaatacattacaaatattgaaggcagttaaatgttcaaatgttaaagcttctgtttttgtgaagatttcagtaacattttaaattttatttttcttggattagttcctgtgcctactgcagtgtcctcataacagcagatgtttgctttatagatttattgaggatgatcacagagtttctggtgaatattttaaaataaataaggcttcaaagcagggtggtatcagcatatgtatattttaagattgtctaaaatatagtttctttctccttagaaaacagtgaaaagatgaagacttctggtaaattgtttcacagcagtggaatttgtacattagttttctacacttgggagttgaaaaatggaagaattatttgccaaaagaggaggacaaaagataatatgcataattcatctttttctgcaagttcttggaaatttagtcaaagtacatagttcagttctctgaattgggcatgatatgctcttcagaaatcacgttttgaaattacagaagataaataacctctcccaatcagtgtgttaactaccctgatgatggttgcttgtctttgtacagatgtgtgcaggcatacatctttagtggtggaggcagtaaatgaaaacatatggattcagagtatggaagaattgaattcatttttttctgttgctttgtttcaccagattccccctattccacattaaccccttgtcttctcccagattatccaactcttcctactcttttccatagcgttgttttggctttttggcattgtaagaggattgctttttttcccccttaagttatgtttactcacttcattgtcactgctttccacctcatactggttatcctgttggaagcacgaggttttgtgttgtctctctgtggaatttgtttcttcaaagctttgtgtctttcctttggttgtcatcatgcatgatagcagcgtgtattctttttctttggtaaatttctccgcctagagtgtactttagaaggaaactaaactgcattctagtttagttggccccaaactgagatcagtagccagagatggcacccaagggtggtgaggggattaaaaatgcctgtagaagtgttggtggcagcagctaagcagctagattaatcaaatgtgcatgaaatttaactttaaataaactcctttgttgttgaattttctgtggaaaaactaacttgagtgagaaattctagccctggggcagggataggccagagataaatgacacaaatatgcttataaaatggggggtgactgggtgcaagcagaacacactgaaagcattcatatttgaaataaacagtcactatctctgtagggagccaattttcaatccttggtctactttccaaatctgttctttcccctaccctcattagcagattttgcttattttgttgactcctgtaactccatcccctgggacagtgaatagtcataacaggtattcagcaaatattagccaaatgaatgaacttttgatactactaggtttttaagacatgcatctatcttgtcatggcagaacaggtcatactcttatttaccaacctcttaatttacaaactgagagaatagctagatatataagaaggtaatcttattttgaaatgatttcaatttctagaaatttgtcatcactgaactcttgtgaggtggggattggtacatctgaaggccaagaatatctgagtgtgttatgctaacaatgaatcaatattgcgcttacaagatttcccttaccaaatgatttacccagtcttcacaatagctctgcagattgctaacaattaacattcctattttacagagacggaagctctagaataactataaaagtgttgggattttttctttgtttgtttttgtagaaaaacctggattttgaggaagcaaaatgtggaaagagtttatgtaataattcaccagatttttctcacagtggtagatatccaagtgtgagattatttgattgtgatctatgctcatattccacagaagaaaagctctgtatttcaactaaaacatttccatatttggggctgaccagatttggtttgttaggaggtggacagttgcccttttatggtcactagatactccattgctctcttttatttctcttcaacttggtggctgtgacactccctcaaacaatcttttctttctcttttttttcactgctcttttgtactccagtgttctctgctttcctccctctctcttccaacctaccagcccctttctctctcttctcctcccattcctcatttacatgcagcctgaacaaaccaaagagtttgctgtacattctgcctgtaaaagaatagtatgtgaacattgcttttgagtcagcgaactgggcaggtcaagtgagaagttatctgaccaacaaggatcaagtcaggaggatgctgggaatagcataaatcttagatcttaggagattgtccaaaaaggagagagctgatccaggatgagtagtagttttcagaataaaggccttgtcaaatataataactggaccagtggttttaattttggagaaatgctagaaccaaaccaaaacattgataaataataggaaaaattaacagttagaatgactccctttcaacttgatttttgttccaaagttcaaatttttacttagaattaaggttttcttttcaatctgaaattcttctttatatcctgagctcctaacattttaaaagcacaggtaatcaatttgttaactaataacattatgtttaataatgtcattattttcttaaacacagtggtatattattgttactatagtaaagaattgcctgggtgtaattgctggagatctgaacatggtgtatcacattttccaatcaattagttttagactcaacaaaactacatcagggaatttgtaaggtgtattgagagactcccatttagatcttgataccacttctttatagaatctttcaaaaatgtggattatcacttccttgaagtggcaccatgcttcattaaagaacattgcttgtggagcaagtaataacagtaagctatagtgttgtatctttgtagggcattctccataggaaagatagttctatcagttttagctacctgaatttggtaaaatagttcccttttctctccattgtaaaatttgaaaagttagggtctgggtacactggctcacgcctgtaatcccagcactttgggagaccgaggccggcagatcacgagataaggagatcgagacaatccttgctaacacagttaaaccccgtctccactaaaaatacaaaaaattagccgggcgtggtggcggacgcctgtagtcccagctactctggaggctgagacaggagaatggtgtgaacctgggagacagagctggcagtgagccgagattgcgccactgcactccagcctgggcgacagagcgagactccatctcaaaaaaaaaaaaaaaaattgaaaagttaatgtcaacttacaatttttttctccatcgtggaaattaacttaaacattacagatcagtttttttaaatcatcatttaactgtgctttaatcatgttaaattgtaattgatctaaataataatgtagtttaatagataaaattccataataatctttttgttttggttgcatgtgttttaacagatgacttgctattacagtttattcatatagtgagcacctactgcatacagatttgtatttgagaactcaatattgtacacacatgagtcatcttgaacgtgaataatacaagcttataactttggccatatttctctaatgggcatgtatgctattaagaaaaaatactgcccaggattaaaagttatagcctaaaatattgagtgtgcatttccagtttattgtggaaactagttggcatttttttttctcagcacaaatacagtggtatgacattttcttcattgctaggttacttagttataattctttaggagtctgaatttgagtgatctctacagctgttaacacagatttccctggtttatttcaccttatgctattgcttcatattctcaaattggaatattacagtatttcatccttgggattcaacagttttggtttgctgagaaatcaattacaggttaagaagtgatttctttgaaacattaaataatgataggtggtttgtttactgggaaaagagaataaatgttatcagtgaattgggataaagtcattattttggaaaggcaaagaatataagtagtttatggaacagaatatggcttccttatttgttttatatgtggggctcattatctttaacctttgttgatcattgtagagtcaggaatgagggaaaccctcaccttgtggctttccgaccttcgtttttcctttttaaattagaaataatgctgcctctcaggattgttaatgatacttaaatgagaatacacataaggagatgtattttgtctattgctgtctcgtttactttgctatatgaagccagttgaggaagctacaggtataagtggcaatgagacttcatctaatcttacagatttagagaatggagatagagaagataatttggaaatccagttgatggaatttgttagtgaactgcctgtggtggaaggcaagatgagggaggagatcagtaatactagtgctgtagacagtagagacaccacatgactttaggaaacatgcctgtgcagaagttggtgagaggaggaatattaagaattaaatagctacagtggagctcatctttaaagaaaaactagtctcttgtttcttaattaagcaatttgacgtagggcgattgactagacagttaactagtaaattaactgtaacacaacacctttgcagcttgtacaatttgagttcatacatagcatagcaaagtatcaagtaaatacataacatgaatgactcaaaactctgaaaatcgtgtccacttcctaggggccttgttcttgtcttctgcattgccaccccgactcactctctcaaggctttccctcctatactagtgtttccataagttactgatgatgtgtactttaatcagtgcttggtgatctggccagtctcaattccaaacctttccaaaggcaaacattgtcagatgtttgtagaagcattaatgagcttgtagtattacccaaggcaaagcagcttgcagttagatcttgcaccatcaagccttgtgctcctgtgctgtttttttccctttcagagcctcatggcctcctgtgaggcttgagtgagcagatactagctggtgggcctgctcttttggtcctagcaatgcaggaaggcaacgtgacagcttaatggctcagatacacgttggcagaaagccagtaagctttgtattgtggttaagaccgcttcttcaaagtggttttcatttttaccacaaatgtaggtttgatcattataatgtaagttacaattcaaaagaagaaatgtattgctttgtattaacactcaagcaaaaaaggcatttcctttttcatgtaatggtgttacataaaatgttttggaaatctcttctcccccattctgaacataggaattttgattcccatcattttattttagtttattgcattatttttaaactcgtgtagaatatctacaatgtcctattttatatgtgtttaaaagtggcaattgtcatctttaattttttccttaggggcaggcttctctgaagtagcttaaccccttataaacctgactgatggtctttcctttgtgcattaggccttattctgaagggctccataaatgctctggtctctgttattgaaaaggaaagatgcactgctggattcaagtacatgaaaataccaaactgtgtgtcaaaggcttggctgctaagaaattggccaaacatggtttgatggaggctggactggtactgtgtctgtgtaatttctaccaacagaaaaaagaacacaaaacctcttcattaaatggaactctatgtagattcatgttctttttcaatttagaaaaaaagcgttctttgcagaattctgattgatagtgtaagccgtacattcagaagactgtcacagtccctactgcaattgtaacatagtgctcttgtgcaggaaaaatgcaagagaaattgtttcagcatcagatttatgacatacatatatgtgcacacacaagtgtctttatgtgtgtatgtatgtagtcaaggtgtggcacccataacagatgtctttagatttcctgaattttgtgtttacagctttattttttacttttttttttttttttttttggagatggagtcttgctctgtcacccaggctggagtgcagtggcacgatcttggctcactgcagcctccgcctcctgggttcaagcgtttctcctgcctcagcctactgagtagctgggcttacaggtgcccgccaccggcttacaggcgcacaccaccatgtccagctaatttttgtatttttagtagagacggagtttcatcatgttggccaggctggtctcaaactcctgacctcaggtgatccactcgcctcggccttccaaagtgttaggactacaggcgtgagccaccatgctctgccatgtttacagctttagaaaacattttcttacttctagtaatcaaggaaaaatttactctttacccttgcaaaatttagtcagtactgaaggtttgggaaggtaatgaaagaaagtttcctttcagattttttgttgcctccctcactcacactaaatcagtgctatatcatagaaggttttaggtcagttagtgcactttacaattctgtcataaaaattcatatccggtcacccttttctttttttttttttcgagatggaatctcgctctgtcaccaggctggagtgcagtggcaccatttcggctcactgcaacctccatcccccagggttcaagcaattctcctgcctcagcctcccgagtagctgggactacaggtgcgcaccaccatgcccagctaatttttgtatttttagtagagacaaggtttcaccatgttggccaggatggtgttgatcccttgacctagtgatccacctgcctcccaaagtgctgggattacaggcgtgagccagtgtgcccggcccctggcactcttttcacaacatagtgtccataattgaaatgcaattaaattctgtcctaatgcagagtacgtggaaaatcatgaacattataatctagttaacagagtacgtggaaaatcatgaacattataatctagttaacattttgaactgaatttaccagtatatgaacttgtgcaaggtagtttctaagctggtttcctcatctgtatgatgaggataataataactacctggtaagattgatgtgagggctgggcacggtggctcatgcatgtaatcccagcactttgggaggctgaggcagggggatcaccggagctcaggagtttgagactagcctgggcaatatggtgaaaccctgtttctgcaaaaaaatacaaaaattaggtggccatggtggctcgcacctgtggtcctagctactggggagtaggatcacttcagcctgtggaggttgcagtgagccgagatcatgtcactgccctcccgcctgggcgacagagggagaccctgtctcaaaaaaaaaaaaaaaaaaaaagaataatgtgggtatgatgtgagatacgcatgcaaagtatgtaatataatgcctgccctccagtagctgctattgtaatgtacttcatatggatagggacagtgtttcttatttgctgctatctgttccaagtgtctagtgtggtacctaacacctaatgggcacttacatgtgtgttgaatagtgaaagggaaaaggaaccagaatctaggagaacagttaattattaccattctccctcattcctcttcatctcagttttaggtgaaataggcaaaagaatttcactacttaaacaatttgaagtgagggtgagaaataagagagaaaatgcaaggaagaaaaaactgtgtgacgtcttctatgtacaagccagttttccataatcacattgtggattttccatggaagatgttcagtccccatcagtctttgttgggacgcacacaaagcaggcacgaagcccatcatgtagcaagtcaggggaaagggatgcttgctgcgtgctctctggccgcccttcctagggaggcgtggattctagaacagacttcactatgcttctctctccttttgtatccttaccttgatggtaataggaaccatttatattcatacatatactcctcaggttcctttttatctcctttttattgctagttttgacaactacttgtctgttttttctgttactgggcagctggagccacctgacctggcactaacataggacccttcacagctgagcttagttatccctctctaagccatagtttaaggacaaactaaatatatttttttgtggtaaaatatacataatgtaaaattaaccattttaaccaattttaagtttgcagtccagtgacattaagtacattgatgttgtgaatgtacttaaccatcaccaccatccatctccagaaattttcatcctcccaaactgaaactctgtgctcatttaacaataactctccattctcccttccccccaggtccctggtagccaccaatttttctgtctccatgaatttgactactctaggacctcatataagtggaatcatataatatttgtccttttgtgtttggcttatttcgcttagcatgtcttcaaggtttattcatgttgtgttgtaacatatcagaatttccttttcaggctgaatcatatcccatcatatgtatgtatgtaccacatttttgttatccatttgttcattgtcagtgtacatttgagttgttttccaccttttggctattgtgaataatggtactatgaatattagtgtacaactgtcttttaattccagcttctgttttttctgagtatatgctcaggagtggaactgatggatcatatggcaattctgtgtttagtattttgaggaaccatactgttttccatagtggctgtaccattttacattctcactagctatatatgaaaggttccacttttccccatatccttgccaacccttgttactttattgttattgttgttttttgttttaaatcagagccatcctaatgggtatgaagtggtatctcatggttttgatttgcatttccctaattaatgaggttgagcatcttttcatgtgcttattggccacttgtgtatcttccttagagaaatgtctattcctttgctcatttatgaactaagtttctttgttgttgagcttaggagttctttataaaatcctgtatcgatatttgattgtatgtatttttaaggcagtataaatatatacttgttttgaagggaccatttcggtttcacagtattcattagattaggtatcattcagtaatccagccttgaaagagtagtagtgggcttactcagtgctggacactattatagtgctttacatatatgaacctttttgattagaagtacatttatctgtgttttccattgaagaaactgaagcacagagagtttgagtaaatttcttgctccaggtcacaccgctagcttgcaataaagccaggatttcaatttaagcaacctagttcctgagtccatgcacttagcctgtatgataaactttgtgtgtgctctcatcaagtgacacttttcaggtcttgaacactgctttccctctcccaaagatttatcttactttttccagtggccaaactagaaggcagacaaaatcatcagggaactgtgactgaaattcataaaggcatgtgtgccattttaaaggcagttcataagatgaagtgaggcgtctgaaggagttattagtaacaactgaataaacacttggaacctctttaaagtttcattgtatttctctttgtggaaaacccttaggtttgatgtgattctttgtttgagtcaggcatatattttctaaaatggtttccctagtgaaatttgcttactgagacatttttttctgtaaattctttacttatctgcctttctctgtttttattttaagccacttgtattctagagttggtgcttgagtggtcatcagttgatgtgtagagaatgcaattttatcttgtgtcttgtagtttacctaagccaaacttaattggtaagacaaaacaaaacttctttgtcaaattatataatgcattttaaagcaaaatacaatctttgctgctgcccattatcactaataatcacgtgtagggtgtgtgggttttatgtatacactgcggaaggggagatgagaaatgtagacctcatttctctttcgaagttgatgttactaactgggtgactttttgctgtgtgtccttagtctcctttaatctgggccagttcctcagttttttgtttcattttgtcaactgttccacagttggggtttgttcctcaatttggcttgttccttatgtttagattctggttctgtgtttttggcagtaatagagtatgagagaagtgatggtgtattcttcttaatgtaccatatcaggaggcatttgatgtcagtttgtctcattcagtcttgatatatgaaattggagtagtttgccccagagtctgattgcctctctttttttgaggccatagatttaaaaaaattctttttgaggccatactcttcatttaaggctttcatatgagaagttaatggagacccgtattctcacagcttacttgtgctgtctgggtagtggggcttgtgttagagatttaacccaggggaatccctctccaggtatggatatttggaaagacattaactaaacctggaaacaatattggaggtacctaaaaatccagatgctgagggtggctgcagttgatgctgttagttaccctcatttagatcttttcattcttcctgcttctttacataaactgctggcagaatgttataaagagaagttcattggtgtttgtttgttttttaattgaaaaaggtagaataaaaggacttttaaaaattaagtaaatgaggctgagtgtggtggctcaggcctgtaatcccagtactttgggaggccgaggcaggtggatcacctgaggtcaggagttcaagaccagcctggcaaatatggtgaaaccctatctctacaaaaatacaaaaattagctgggcataatggtgggtgcctgtaatcccagctactcgagaggctgaggcaggagaattgcttgaacccaggaggcggaggttgcagtgagccaagattgtgccactgcactctagcatgggcgacggagtgagactctccgtctcaataaaataaataaataaaataaaataagaaaacggtgcttttcagatgtttctgtacagcaaatataatgagaaggaagtacatttcttcacctgtagtggccagttgcatggcatgtctttgaaatctaccccataggatgtgggtttttttgtttttgtttttttttgccaccaggtctcactctgttgcccaggctggagtacagtggtgggatcatagctcactgcagcctggtactcctgggctcaagcaatcctcccgcctctcaagcagtcctcctgcctcagcctcctaagtagctaggaccacaggtgtgcaacactgtattagtttgttctcacactgctataaagaactgcttgagactgaataatgtataaagaaaagaggtttaattgccttagttctgcatggctggggaggcctcaggaaacttacaagcatgacagaaggcaaaggagagacaagtaccttcttcacaaagctgcaggaaaaagagcatgtgtggagaaggaacagtcaaacacatgaaatcatcagatctcatgagaacccactcactatcatgagaacagcatgggggaaacctcctccatgatcacctgctaccaggttcctccctcgacacatggggattatggggattacaattcaagagatttgggtaagaacacagagccaaaccgtatcaaccaccacacctgcctaatttttaatatttttgtagagatgggggtcttgctttattgcccaaggctggtcttgaactcttggcttcaagtgattctcctgacttggcctcccaaagtgctgcaattacaggtgtgagccatagtgcctaagaaagaaacatcttataggatgtttcttcattaaaaacatgtttaatagatgagattgtccagaacacatcttgctttgatcacctttgttagtggccaaggacaactggttatacctagccaagtttcgagcagcattgccattaaatgtggtttttaaggtaagagcaggttcgaaactagaaattgaaataggacaaaggctgacatagtgtcttattcttcttgtgtgacttaagctattttctgcacctgtgggtggagaatgagtaaacttttaaaagtaaaattacatatttatttaataatgtattttcaaatattaacctcttcaatcatattcaataggtacaatatttaagtagtttctgaatgttttgtttttataaattatatagatgaacgtctgtgaagctacatcgttgttcatttgttgtaatagcatattaggtccataaggagatagatttgtgtgtcttgttcattgatgtataccagctacctataattgtccccctactagaggtgcttaatactatttggtgaatgaacaaatctggacacaaggagcaaaagtagtcttacttactaatgagcctgttatgtattttttttgtgtgtgtaaattactaagcagcttcttagtatcatttaacttttcatactatttgttatcatagaatatagtaataatgtatatcacctatttgttttcttcttctggttcatatttgccttgggggtatggatcaggtggcctattttttctccaatcaattgctgcttcatggttcagaaatcccagtacttttgagctgcctaaaatttatatactgtttacagcagattggtgtaaagtttagtttaattatgagtttggattgttgatgcttttttaaaacttctctccagcacatacttcaccgtgtttcttgtcttatttaattttaatcccattattttatttcattttctgtgttaaatagaagatttgtgaaatagagaaaaataaattacttctagtttcacaacccaagggcaagtagggtgtccctgtgagcttgttttttcagccagctatgtttttcgaatcaaagttctactgctgttactagacagcattctagatagattagatttttgctttttggttttttttttttggtagcagtgtaattactatatttttctgtattcaagaaagttttttcttgtttttttttttccttctttttgtgatttttgagttggttttcttatgtgaagcatctgttagccagaaaaggtgttaagatggtgtagttttgataacttttatcacatttgtcctcaatacatttatggtcatattcacctatctatttaaggaagtatatagaagcaaattatgtggtttgggagaaaacaatacctcctctgtgagcaaaacagaagtatatatattaatgtgtatgcaggttttttacttacttgaaaattctaatggattggaggatatgtgggaacctcaatactatttacaggtaggaagcaccatgtttaacgatagattgcagcttaaaaaaaatctcatacttccaggtgtatgaaatcagatttacctacactaactagcattttccccagctgttcttactttgaatataaaatcattgttttcttagaagaggaaagctagtgaaattaaagtaaaatgaatttgctagttttaaattttacttatgacatatatatggtgaagaatgtaaattttcttgagccatggtattatatgagccttactgggtggtgatggtaagcagatgttttctttcttcccactatcagcctgagggaaaagtatacagaacatagagcaagaaggaaagggcattttacaaatcaactatatcctggttcatttttgctttgtttttgttgttgttgttattaaagcccagaatcataacttttttcctttaaatgtatgccaggattattacatttaattaaaactagattttatatagtatgcagaaaatttgagaatcctactcatgcaagtgagatattgacagtctatacttagcaaaaagataagttgggtagtagcagcgattctttgttacaatgaggaattaactcatttcatggagttaaaagggcccctagacacataaggattgattttttttcccattgttaaatacaccatatacctattatcaaaaatgttttacataataattgcctatacatgattggtccaacttatttctggtttgattctcaacaagattatgtcagtagacaccttatttttaaaatagagtgcaaataaagataaaaaatgtgtaccttctttcccagtatccctacttcaagatggagagacagtataatcagttattgatttataattcattaaattataatcaatctgtgagtaattgatagctgactgctgtcattctgctgagaaatgattattttggttgcataaaataaataccacattatgaattttgtttaatcaaattagtagtggaagtggactttggtaagtgcaggatgcatgtagtaccttagcataacttgacagtttttaatgtgtatccctatggagatttattaagtaattagaatttagtttgattgtgacctcggaattatgtattgtctttttttgttttattttgttgtgtttgagatagggtctcaatcctgttgcccaggctggagtgcagtggctcagtcacaactcactgcagcctccattcccaggctcaggtgatcctctcacttcagccttcaagtagctaggactacagactccagctgctacacccagctattttttgtatttttagaagagacggggttttgctatgttatccaggctggtcttgaactcctgtgctcacgcagtccacccaccttggcctcccaaagtgttgagattacaggcgtgagctcttgcgcccagctaaaattatgcattgtcaacctgcctcattccttttgagttttttccagaaaactaattttcttattctttccatactccaatatatacagtaaccattagctttaatgagataaataggaatgtgattgcatatgcattagaaagatcaggattgcatgcaattaatagaaatgtcttattatatacagaagaagcaatttgatcttagtaacatttatgagatttgtagccttaggatggcacctagaaggatgtatcattttgtgtaaaatactgtccagactcaacaggcaaatatattgagctcttttgcacatattttctgtggggcaggagtgttgttgcacaggcgtgttttgtaattgtcgacttgatctaatgggcatttccaaaaaaggacttagatattttaattaatatttacttgttaatctaatattgacagaatttcagagcatcaaggagcaaaatttacagttgaattttgagtgcgatgaatctcttactagccatgtaattaaacctgtgttagagcctgtgttgcatacatcccaaagggcacttgctggttacatatttagtatttgtagctggtatgatgggtggcagcatcattaaaatgctttatctcatttgttaactgtgtgtctctaaaatttttactattttaagccttaggtagaatttggtcatacctcactttgcctctctttataaagtataatactgcatattcacatatgtataaatatctatatctaaagaagtattttaaagagtatcttaaactttctggcttttgtacactattctatatataacctttaatgaagttttattgtaatcgtatgctacagtggtacatttaatcggtgtaaaaaattgttttgtggaaaaagattcagatttttgcatttaattccatagctggaattcgtgggttgatcagtagttcagtgttttgaaatctgtgttcctcagctactttgctgatgttaccagtaaaacattgtgttttgtttctttctttgtttttgagacagggtcttgctctgtcatccaggctagagtggactggtgcgatctcagctcactgcagcctcgacttcctggactcaagtgatcctcttacctcagcctcctgagtacctgggattaggggctcacaccaccatgccgggctaatttttgtactttttgtagagacagggtttcaccatgtctcaaattcctgcaatcaaaacaatccacccaccttgggctcccaaagtgctaggattacaggcatgagctaccatgccttgccttgtttcttgattttagaaattgaatatcatgtgggataaaatcaagcagaactaattatacatcttctttcaaaaacttgggttatttgcccattttttgtgctatttcaattaaagccatttttcaatattttaggtttaatgaaaatactaaaatattccagtcacagatacttaattgcttgtgaattatcaattcataaacagtatcttaggacaaatgaacaaaatgaactaaatgggatcctatgacttttatcatcaaagttaataatcttgtggaacattacaaatacagtagagaaatctttaagtcaaataagacttcatatcctataactgtgtttatgaacaagttacttaactgtttataattgtagtcttgcttcaaggtctttttcaagtgctgtgtcttcactgtctcagaagtttacacttcctatttcagaggaaataacaggttatcacatagaaaccacagtttattctccatatacttatttatctctattaaaatcgtatttagttcctttagttattttggcttaactacttatagctaaaaacgataataattactagctattattgagtatttactgtgtttcaggcactattccctctcctcctctctcctctcccctctccccctcccctctcgcctctcccctctccccctcccctctcacctctcccctcccgcctcttgcctctcccctcccgcctctcgcctctcccctctcccctcttgcctcttgcctctcccctctcccctcccctctctcttcccctctcccctcccctctcccctcccctctcccctcccctctctcctcccctctcccctctcctcccctcccccctttcctttcctctcgtctttcctctttttgatggagtcctgctctgtctctcatgctggagtgcagtggcgtgatcttggctcactgcaaccactgcctcctgggttcaagcgattctcctgcctcagcctcccaagtagctgggattacaggcgcgtgccaccacacccggctaatttttgtatttttagtagaggcagggtttcaccatgttggccaggctggtctcgaactcctgacctcaggtgatctgcctgcctcggcctcccaaagtactgggattacaggtgtgagccactgcgcccagccttatgtgttttctgtatattaattaatatgtttaattccctcaacaactctttgaggtaagcacagtcactgtgtcctttttacagatgaggaaacaggtctagaaagtcaagtaacttcagggttacacagcaagtaaatatggaatcatggatttgaacccagccaatcttactctagagtctttatcttaactgccatgttgtactccagttccagcctgaattgtgctttcttgcctttgctcttgcttttctctttgccctctcccaaccagttgaaatgcttctatgttaggccattttaaaaataggcaaattaaatagttaaaatctgggaagtctcatctctgcctaatgcttaattactttgtgacattgggcttgttgctttttacatttttaaaatgaagcctatgtatacccactagaattttctttttctttttcttttctttttttttaatatattatttatttatttttttattttatttttttgagacagagtcttgctgtgtcacccaggctggagtgcagtggcacgatcatgactcactgcacccttgaacccttgggctcagtctcttgtcccacttcagcctcctgagtagctgcaactacagacaagcaccacaacaccaggctaatagaattattttataatgattacatagggtatataacgaatgtatagcatagtgcctgacacatgataaactttgtgagggtctttggctagctgttttattggtaagtcgtctctaaaagatacctgtcctccccatctaatcagtgtgttacttgttcagagtgcatttgtaaggcttacttagggcatgttgtttgcatgtttaaatgtgtgttttgtaattttgggatacagatgcttaccagaggatttctgtcttcatgttcttcagtgagattgaagtataagtcataaaagagattttatgatgcctgaaaagctttctgtagagtgtatcataaagcttacttaactttattttctttatttttttttttccaggaaatttggtgagcggcctccacctaaacgacttactaggtgagtattatattagtcagctttttacacatacattttatgaaagtataaatcttattgttttagatattatattaataggtacccttaaagtcattcaaatattactgtctagagcataaacttattctcaaacttcctttccctcatctctcctcccgtccctcaccaaaaacaggaacaaaaggatatagttgaaaagggaaaatgaaacctttcttagaattagtcttgagtcttatgtagtgaatacaacatggacggcagtgcaggtagctttctatatctagctatggttagcccatcacaatttgttgattgcaggtaagatttgaaagtaaatgcttttaggaaagaattttaaggaaaacagtttttacccattttaagaaaacacacgttttatctatttttaatgagtataagttgtacaatatacattttaattatgaatgttgaaagtattggtcttaaaaatgatttttaaaatttctagcagccagaattgtaaaataaagagacctagttctatggccatgtcctagagtcagtgcaaaccttgcgtttttagcagtttatttttggtgtctttcaagaaaatgagatatatatatatatgtatatgtatgtatgtgtctgtcctttttcttcataaactcaactgagatcacactctatcattgttctacaccttttcacgccacttaacagtacatcttctaccttgatatttccccttaatggctccatggtttttcatagctttcataccacttttaatatttcacattgatgaccatttaggtcatttccaaattattgctattattttaaaaagctgttacacttaaagaacgatggggacctacagaaggatacaaaggacagtttgaaggggaaatctgggacactttggttatcaaggtaaataatgatagtaatggattaaaacctgtataataaaacaacagctttgaagtctatactgagataattaatctcaggataaatattatttatataaataaaagtcatttataattaataaatggggcaaagaggatagcttttccttacagatgcatgtcgcctaataaatgtagaaggacaaaaacctggacaaaatatgtaaaaaccgttttccaggtattgaacatcaggtatagaaggataagtgattcctgagaaactgggagtccacagagggcaagacagttagcagggctgcaaagtggagaggaattaactgtataaagaggtccagagatctacagaggtttcctttcagtcttcagctgcatattgatcagcatgcgtgtgtaagaaaactactccgtggtggggattggggaaaaatatcccaaaaaatcagaggaaacaatttctaaagttcacttagggctatgaattgtgcctgttaacagtagccagagtggaaaaatctcataatttatggggcattcgctagagtgctcagaagggttttgtttcagtagtgatataaaattgggtccaggcatgatgctctgttttcactggcaaacttaaagaaggattgaagggaacaaacttaattgtgtaccagaacacagctcaagaatacaggaatagaaaaatatccagcactccctcagaaaggcaaaatcaaaatataccagtcatacaaaggagcaagaaaatatccataacaagaaaaatcagtgaatcaaaaccaacccagaaatgacacagataatagaattattagataagaacattaaaacagtaaatttttttttgtttttttgtagagacagggtctcactatgttgcccaggctcatcttgaactcttggcttcaaacaatcctcctgcttccttggcctcccaaaatgctgggattacaggtgtgatccacggtgcccagcctaaaacagttattatatttgtgttctatatgtccaagatgtcaagatcaagagctgggaaactttaaagagtcagatggtacatattttaggttttgttgcccatataacctccatcatactactcacttctgttgtagcacaaaagcagcaatagaccatgtgtaaacaattagagtgtctgtacagtgaagtatagctttatttgtaaaatgggtggtgggtaggatttggcctacagactgtaattagtagaacctgagctagaggagaggttaaatagagacatagaagattacacacacactctctctctctctctctctctcaaattaaatctctaaagatgaaaagtttaatatttaaggtggaaaagtacacttgggattaatttcagaatggacaaagaggagattagtaaacatgaagacatagcaatagatactatctaaaatgaagcacacaaagaaaaagtctgaaaaaagtggtgagcattagtgagccatgttttattgtcaggtgacctcatatatatgtagttagtcatcgtaggaagagtatgaataaaacaatatatgaagaaataatggcaaaaatgttctaactggaaaattagtgaaaactgtaaaaccacagatctaagctgggtgctgtggttcacgcctgtaatcccagtactttgggaagctgaggcgggcagatctcttgagcttaggagttcaagatcagcatgggcaacatggcgaaaccgtgtctgtaccagaaagttagaaaaaaaaagttagccaggagttgtggcacgtgcctgtagtcccagcttcttgggagactgagatgggaggatcacttgagcccaggagacggaggttgcagtgagctgagatcacaccactgcactccagcctgggtgacagagtgagaccccatctaaaaaaaaaatcagttaatcctgagtacagaaaccacccagaagcactttataatcaaattgattaaagtcagtgataaagaaaaaaacaacagaaaaccaaagacaaattatgcacagaggaacaaagagaggatgacagcaggtttttcatctgaaaccttgctgtggataagacagagcaagtgctttgaagtgctcaagggggacctatacttgtcaacctagaattctatacccagtagatatataccgttttaggcatattaaaaattgaaagaatttattgcaaataggccttagctacagtgttaaaattcttcaagcagaaggatgatcatactagatagaaatccgattctgtacaaattaccaatatcaagaacaagaaaggtgacatcactatagagtcacagatgtttgaaggataataagtgaatattataattaactttttgccaataatattcaacttttgaagaaatgcacacaatttcttgaaactagcaaactaccaaagcttactcaagaagaaacaggtaacttgaatagtcctatatttaaggaaattgaacttgtaaaccttctgacaaaactgcaggcccagatggcttcactgttgaattctactgtatatttaagaaaaaaattatctcaattccatacatactctttcagaaaattggagagcaggacatacttctcagttcattctgtgagcatagcattaccctgttgcgaaaagtaggcaagacattacaagaaaatgaaattactgtccagtatcccttgtgaacatagttataaaaagtcttaacaaattttcaaatggaatccaacaatatattgaggggatgatacatcttgacctagtgagctttatctcaggaatggaaaacagttcatgtaattcagtatattaatagaacaaaaaaggaaaatcatatagttatctcgggatttagaaaaagcttttgacatccatttttaatagaaattctcagcaaacttggaataaaagagaatttcctcatcatagggtgcctgtgaaaaaactacatttaacaacatgctgattggtgaaacactggatgtttttcctctaacattaggaacaacacaaggatgtctgctttcacagatttcatttaacattgtattttgaggtactataaggccagaaaaagaaatgaaagacgtcttgatgggaaagaaagaagtgaaactgtctttatttgcagatatcatgatcatatgtatagaaaattctgcggaatcttgctactagaactgataagtgagtttagcaaggtagtaggatacatgattaacatacacaactaaattgtatttctgtatactgatgagcaatgggaaattggaatttgaaagcaatacaatttacacagtagtataaaaatatatatcaggaaaagtctgacaaaaggtgcaaaaactctacactgaagactaccaaacattactgggagaacttgaagtcctaattaaatgttcttcaggtagaagacctaatattgttgaaatgggctgggtgtgatggttcacacctataatcccagtacattgaaaggccaaggtgtgaggatcacttaaggctaggagtttgaaaccagcttgggcaaccaagtgagaccttgtctctacaaataataaaaaaaattagctgggcatgttggcacgtgcctgtggtcccagctacattgggaagctgaggcaggaggattgcctgagcccaggaggttaaggctgctgtaatccatgtttgtgcctctgcactccagcctagatgacagagcgagaccctgtctcaaataaatatatatatggttaaaatgtcagttcttctcaaattgatcctgtggattcaacacaatcacagtcaaaatctcagcaggcttttttgtaacagttgacaagctgtttctaaaatttatatagaaatgcaaataaccttgaaaaaaagaaaaaagaacttacactgcctggtttcaaagcttactataaagctatggtaatttaaagtattgtattggcataaagatagctaagtagaccattgtgacagaatagtggccagaaatagttcttcagatacgtggtcagttactttccagtcaaggtgcgaaggcaatttagctagatttttttttaaatggtagtctttctaacagttgattgtagaacaattggatatccattcctccttcaacccaccccccacacacaaagtaactacagtctatacatagtaccatattaaaaaaatagctcaatgtagacctaaatgtaaaactttaaagtatacagcttttagaagaaaacataggagaaaatgttgtttattaggctaacatttcttagacactaaaacacaatctgtggaagaaattgataaattttacttcatcaaaataaaaaacaaagatgaaaaggactctgaaaagtaaataataaggaaacaatccatttttaaagggtggaaatggtctgaacagatactaatccaaagaatgtgtgaatatgacaaatacccattaaggaagtgcaaattaagactacagtgagtgtgttagtcccactggtttgctataatagtgtaccattaactgggtggcttataagccacaaatttatgtctcataattctggaggctgggaagtctaagattaagacaccagtgtgtttgatgtctgttgggagatgcttcctggttgatagatgactgtcttctttatgtgtcctcacatggcaggagggacaagggcactgatcctattcttgaaggctccatcctcatgacctcatcacctcccagatgccccacctcctattaggtttcaacataggaattttggggggacacatacactttttagcagttagatactattaatactgtatacctgttaaaatgtctgaaatttaaaggactcatcatgggaacagctagtacttttcatacactggcagtgggtatataaagtggtacaataattttagaaaataatttagcactttcttaaaatgttaaacctctaccatatggcctagttattccattcctacatatttaatcaaggaaaatgaaaacatctgaatacaaagccctgaacacaaatgttcatgttagctttagttgtagtagtcacacatacataaccccaatatccagcaacaggtgagtggatcaacaaattgtagtgtattctacagtgaatttctattaagcagtaaaaaaggaatgaacttgatacatgcaacaacatagatggatcttaaaataattatattcaattttctaaatatatcaggaaaaaagaatacgtactgaatgattccacttacatagaattataaaaaatgcaaactgatctgtactgacaaaaactagatcagtggtttcctggggatagggggaggcaggaggaaagattacaaaaaggcagaaaggaaactcacaattgtgaatacctttattttgattttggtgatggtgtatatatacatgccaaagcttgtcacattgcacactttaaataagtgtattttactatatttcaattaaatctcaataaagctgttaaaaacttagaagcttttatacttgaaaaatattctaaaatattctgaaagggattagtgtatcttcttgggtaaattaaggtaagttttgtttatttttttgttttgttttgttttgtttgagacggagtcttgctctgtcacccaggctagagtacaggtgcctgccaccatgcccagctaatttttaatttttagaagagatggggtttcaccgtgttggccaggctggtctcgaactcctgacctaaagtgatccgcctgccttggcttcccaaggtgctgggattacaggtgtgagccaccacgcctggcttcaggtgagttttatttctttttaaatctctgaaagagagcaaactacagatttatattgtttattattgaagctaaaataaggcaaatttagcaaaatttgtataacagcaaatggaaatgtaaaatcaatgaccaaatctgtgataacattttattttattaagcacaaacttggaaatcagaaattttcccctttgataatataattttaggtaccatctggcctttttttgttttgttttgagagacagagtctggctttatcacccaggctatagcgcagtggtgtgatcttggctgactgcaacctccgcctcccaggttcaagccagcctcccacctcagcctcctgagtagcagggactacaggtgcacacaaccatgcctggctaatttttatattttttgtagagacaggatttccccatatggcccaggctagtcttgaactcctaagctcaagtgatccgcctgcctcggcctcccaaagtgctgggattacaggcgagagccaccacaccctgccttgagaatgctttttaaaatgtttttttttcctccatttctcctttaaagaatattcaagttaggaaaattttagtatcttttattttatttgatgagaaatattttaacattttttctctccattggggtgcagagagtttaaaattgggcagattttattccttaaaaaaaaaaatctttgaaacactattcttactcccattttccaaattaagcaatattgaaaaagcatcctgttgtgaaggtcatcttttaggtagtgttctaaacatagttctgcctacacagagtttaaacttttgattaaggctcgttaataatatatactattcactgttactatggattcatttttttttttttttttgagaatggagtctcactctgttgcccaggctggagtgcagtggcgcgatctctgctcattgcaagctcggcttcccgggttcgcgccattctcctgcctcagcctccggagtagctgggactacaggtacctgccaccacacccggctaatttttttgtatttttagtagagacggggtttcaccgtgttagccaggatggtcttgatctcctgaccacgtgatccgccctccttggcctcccaaaatgctgggattacaggcgtgagccaccacgcccagcctggattcactttttttctttttacaaaaattacattctttcaggatgtatatgataggaatagagtgttggcttttaaggacgtcccaatctcttgaaatactccctttaatatggcccacaagtataacttgactgtcagttcaaaaaaaaaaaaaaccaaatagaataatcagatgttatataatgcatagaacaattattcttgtactgttgaggcttttagagcctcaaatcattttgtcatttagagcctgaaaatcttagttgcaatgcagttatgcattggtcttcaggagtgcttagtgtgtcgagtggaggtgcctgtttcttagataagagtaggcctgagctctgaagtgctttttttaaaaaagagatattattcgacttaatactctgttgtactaagtgattctgctctgctgttaaccaaaaggtaagactggaatcctgaagacttctaaagaacgtaatcttaaccttctcccctacaacactccagactagtagccattacctcatgcttttgcttgaatccgtttaatgtcatgaggttttcttcataaaagtttaccatttcttcaaggtttgttgtaattgttgtaactattttgtagtgttctctcactaagaatattttttctctgtcacttggcctaacactttttgcaaagcccatcttctgttagcctccctgccatacctctctgttctcacatgtacctccattgtggccatggtcagatatggaaataatcagtttctgaaattctgttggcttgctttgaaggttgcctcagagtaagtaataataccttaaggtgaaggttaagaaactaagctccaggccaggcatggtggctcaagcctgtaatcccagcattttgggtggccaaggcaggaggattgcttgagtccaggagtttgagactagcctgggcagcatagggagaattaaaaaaaattaaagaattagctagatgtggtattgcccgcctgtggtcctagctacatggaaggctaaggtggggtgatccctctaacccaggaaattgaggctgcagtgagccggattgtgccactttactccagcttgggtgacaaagtgagaatctgcttcaaaaaaacaaaagaagaaatgagctttatatctattgtccacgttaacatgggtgctgtggtttggatatttggacccactaagtagcatgttgaaatttgatcctgaatatttaaggtggggtctaatgggaggtgtgagtctggcacctcccttccctctcttccttcctttgttgccctgtgatctctgcctgctagctccccattagccattagtggaagcaccccgagccattcaccagatgcccagtcttccagtgtgcagaactgtgagcccaataaacctctttctaaaataaattacccagcttcacaaacggactaagacgattatatgttcatatttgtctactaatttagggattgcattgtctttgagaaaacccctgttctttttgaatctcttctcttccctatccatagcatgtaatttttagaagcattttaccagtgcctaatgagaaactcttaaaacagtgtattttctttgtctcctctggattatggttaaagtttctgttttctgtgcctgtttctctttatgattcatctcctcactttgagacaggagagcatccattttaaattgtgagcataggtagacagaggtttctttgcatgacaggtaaaatattcatgtttcaacctagtcatgtattttgtttcatcataagacacctatgagtaacaaacaccatgcaaagtaggtaaatgtaaaatgaatttaaattgatagtcaaattaaagcctaaggttgatctgctacatgaatagtaatacatgaactttgctgttagtcaactaattagtccataaatgggtaaataattcatattaaaaagggttgcaaataagattcaactttatttagaccagtcacatgtttatagggcatcttgagggaataagagaatggagtagagtaggaagagactatgcggtctgatccctgggattcgaagagttaagtttgcatcaaccaggattagaaatagaagaaccaagatggtgacttgcctttgattgtcagcacctcatactattttatgttctcagattcttctagtcccaaatttttctctacataagaggtaaagccttaagtagcaaaatggcttatttgtacaataaccttttaaagctaatagaacacagatgtgttgatgacccattgctctcaatgtaacggcctatgcctatttgggagtgggaggcggggaggggaaaaccaagagctggtcagaatttgaaagaatgtgtctcatagctgtgtgacaggatttgaagcaatttacttacttatctacaaaaaactttttgtggaattttgggacatttttacttctgctataaaaagagaggattgaagtgaggtttgcaggtgtttccttaggaacaggacctgtactgttgtttagctttggtcactggtagatgtagacacttagtacagcagcctcaatgttttattgtgttacaagggcaccaggaccttgttgactattgatagtatccctagattgtcattttcaaaactggtcctcaggcaaacagtagttctcaggaagcttccttggaagaaaaacaaggagatcttagtctggtctaatagcttggaaaatgaaacctacaaatatccctctcttgaagattttgcttaaggttctgagtagttctgccatgaattagtttcactttattttatctgatttcactgaagcatcttggattgagacacgcttctttgtaaaccgtaagtattgtggagctcactttgagaagtgtctgaggcagtgtaaaaggcgagactgccagagtctgacaaaaatagggcagttcttcaaggttttgtgggggtgcgtataaatcaggatgccttttggcagcatccccaagtagatgtgagaagagttgagctgagctttctgaaccctcagttgttcataagtcaagttttgaggaagaattttataaaaaaattcttgattgaatgtcagccgtgcaatatacttaattgatttaattagaattctgttttgcaacttttccttaaaaacttttaaaaattgtctgcagggatcaacaagcattttctgtagcgtcaagtagtatatattttaggctttgagggccacatactatctctgttgcatattattagtctctgttttgtaactctttttttgttgttgttgttttttgagacagagtctcactctgttgcccaggctggagtgcagtggcgcgatcttgcctcactgcaacctccacctcccaggttcaagcgattctcctgcctcagcctcccaggtagctgggattacaggcgtgtgctaccatgcccagctaattttttgtatttttagtagagacagggtttcactgtgttagccaggatggtctcaatctcctgaccttgtgatccgcctgcgtcggcctcccaaagtgctgggattacaggcgtgagccaccttgcccggcattgtaactctttgaaaatgtaaaaggcatgcttagctcctagggggcacaaaaacaggctgctttgtgatttgatgactgtggcctattgtgtttctcaatatgctcttcagttctctaaaatgttcacgagtgatattgtgtgtgtgtgtgtgtgtgtgtgattactttgaaaattcttgatacaacaaaaataagtttcttcattagaagacagagttcattttggacttttattatttggattttaaagtgacagtagtccaatttgagaagcgcagagagtgagcctggaggtaaagatgactggacctcccatctttgtggtggttttctcctcttccctctctcccacactccctccacttaccccttggaccaatcacagaggtgtgtaagagtgtggtgagaaagtgaggaagtctgttttcagaagaatggcgattagcaccataaggacaccgcaaactcaccgctataattaatgtcctagcgggagatgtggtttgtagtgttttccatatgtcttggccctcagaactccgttttaaggaggatcttgcctccaggaatttactttgagaaacactaagctatggattaaatgtacactttactagcatgacatttaaggcttgagccaatctcaccccaccctgtctttccaatctcatctttcagaattctgtttttctttttggaaacagagtctcgctctgtcgcccaggctggagtgcagtgacgtaatctcagctcactgcaacttctgccttccacgttcaagtgcttcttttgcctcagcctcccaagtagctcagactacaggcgtctgccaccacacccgggtaatttttgtatttttagtagagatggggtttctctatgttggccaggctggtcttgaactcctgaccttgtgatctgcctgcctcagcctcccaaagtgctgggattacaggcgggagccacctcgtccagcccgtctttcagaattctgtgtgttatatacttcagctacttaaaagtactcagtttctagatactaggtttttttgcagtgcatctttaccttttcttcttggctttttttgttttaacaaacttaggaattaaaaacttccctttatatccagaattttaaaaatcctgtaaagagacaaacttttctgccgtaaccttagttattcccgccaccaccccttttccttatcagcatgacttacgttcattgcactttcttcccttcctttcattttgtagcttgcttcagtggtgttgcctcaccaccagctcactgagaagattctaattaagccgttccatttatgaactaattgtcaaatttatgaagagtttctaatctttatttttcttgactattctgtaatatttaataacattgattatgttcccttaactgaagttctcttttacctttacgcggggaccaggttcttccctttttttgcagactcccattgcctccattggcataactagtaaaagtagatccattagaaacagcacatgagcttatcttaccattcatggatgtttcactgtagtattctctttgtggtatttttctttcctttttttttttctgtataaaaaaagtttgaattttataaggcaaaccacagtcaaaaaattgacagaggtaatcacagattaagcatgttgaaccagaatggcatttgccataattccataatttcatgttagtaaaattatttttgataacaaaatctcctttttttgttttgttttttttgtttgagatggagtctgtcgctcaggctggagtgcaatggtgcgatcttggctcactgcaacctccgcctcctgggttcaagcaattccctgcctcctgagtagctgagactataggcgcgtgccaccatgcctggctagtttttgtattttttgtagagatggggtttcactatgttggccaggctggcctcaaactcctgacctcaattgatttgcccacctcagcctcccaaagtgctgtgattacaggcgtaatccaattggttttcatttagaatgaaaattttatgtaagaaatcattaaatgaaattagtaaacaatagacttcaaaatttaccttatgttttaaagtattcaaaaaaacagttcaataataaaacagtaattctacggtcaaggattcttcagcacctgtaatatgtttttccaataataaaatttttggtattttttaattaaaaaaaaacctggatgattgtgatatcttaccactgaaattttttgggtttatcccagtagttttcattccatgtgaccatctcactccatcctctttcttgacatttggcaccatctggagacatttttagttgtcataattcaaggaagggtgctactggcacctgcagggtaaaagatagtgatgctgctacatagtcctacaatgcacagcgcaatctctccacagcagaaaatgattttgcccaggatgtcagcagtgctgagatagaaatcctatttattgacacagccttcctctatttggatgaaaagcatatgggctattatttgacaggctttttactatttattgtgtttctttagagtatatcgtcttgttttatggctccttaagatgcagaaagtcaatgatcaagctttaattgccagagaacataatttttaatgttttaatattctgtttaataaagtgaaatttatttttactgttgaaagaagctatttggcaaattacttttacaggacaactattgttcatgattaccttgaggctctagttactttttcaggaatttgtattctaaacatgaaggaaaagacgaggaaaaccagagctgtcaccctgcattcatcataagcactgtgaggtctttgaactgtgaacagttacatccagtagtagaagccagtagaatgcccagtgcctagaatatagtaagcttccaataaatcttcagtgggaagatggatagttgtgcactttacctggtgtacttgcaaaatttgtgctttgcacattgggtaacatgcctgatcattcattcctaggtcattttcaagtttgctctcaaagcctcagtggaagtcccattttccctccctctgcattttgtgtactgttgaaggttgaagtcttctttctaaggaaataatagtaatagctcgaggctactgacacttgctttctgtcagtttgtgggactaacttactttaaagtgtccccctgcccccaccaccaatatgaggcattactgcctttatcttacaggtgagaaaactcaggcttagtgattgacagacccttagtaacagacccggatctatttcacaccaaagctatacccctaatcactaacggtatgattttgtcctcacaagctaggctacgcagatttgaatcctcactcttcagtatcatcttgggaaagttacttaacctctacccagtttctaaaatgtacataatagtgttaccctcaaggtcattggttatgttaatacatgcttagaagagtactggaagagtgattgcttaattttagctcgtttaatgattataattaaaatctttgtagaaagcatttgtgactgcctcggatattatcaaataccaagtttgtgtcctgttttacccgagttgtcatgaaagggatagaaatgtaaaatatggatcttgcctttaaagactttgtagtctatttgggaagacaagaaaaataaacatgaaacctgacaaacacaatgcagttactgctaaatgatgtaatagagactacaaatacaaatagaatttagtatccggaaatacacttaatggcttaaaactattcaaatatatagtagctcttcaagttttgtgctgggaaattttgtgccagttttgtcaggatattggccttctcttggctttgcttttgttttctttttctttctttcttttttttttttttttttgagagggagtttcactcttgttgcccaggctggagtgcaatggtgcaatcttggctgactgcaacctctgcctcctgtgttcaagtgattctcctgcctcagcctcccgagtagctgggatttcaggcatgtgccaccatgcctggctaattctgtatttttagtagaaagggggtttctccatgttggtcaggctggtctcaaactccagacctcaggtgatctgcctgcctcagcctcccaaagtactgggattacagccgtgtgccactgcgcccagcctgcttttgttttctgattcaccctgaactctatgttcagtcacctgactttgcaacacctcaaatccctcatcatgttaccctctccagactgcatctctggtacccagcagtttggtctccctattccctcccttggaatgttagtgggaatcggcaccattaattttggattccaacattagctggtcctttgataccaatcttcagttgttttatttgtccatagttagcttccttttccataccctggaaggtatttccagtattgttttcttatccattagacatcatatggcctctcattttacgaataaaatagagactttcatacttgactcctgcttatgtccttcccccagctggcatctgttagacttcttgctgaaattaaagtgaccttgacttctgtggcatttcacctttgattgctcccttctttcgaggttgtgtctttctgcagcacctgaggctggtttcagttcttcctcttatcagttctcagtttcctttaatacattttcttcttgactctcctgtcaatgtgtttttgttctgggagagtccatttacttccgtggtgttgtttgccaattacatactagtgaaccccaccttttcagcccagacctctctcttgaactatgcatagatacttccaacagcctactgaatactttcaacttggaggtcccaggggcacttcagagttgacttttgtcagcagaacctagtaataatatatacccacttctcccaaaacaaaagatacatagagttatttttcctgtcccctactatcttctgttaccgtcttcttagtgtgagagcctttttataagtttgtcttgtcttctctgcttttgaatcctttctctagaaataactaaaaagtaaaattaattacgtatttttaaaaaaccttaatgagatctctcattgcctttcgtttagattgaaaattcagtttctatagtattgattttctataatgggcttgagagaaaattgactggtgatcttgtcccaattcacaaagggatggattttttttttttttcgttttgagtttttctctggatctttaaagattttactacacgctaccactttttttatacttaaaggtttaatcataatgaataaccatataacaatacttcccctaaaagtgcttcaaataattttccaagaattttttttaaaaacttttattttaggttcagggttacatgtgaaggtttgttacataggtaaactcatgccatgggggtttgttgattatttcatcacccaggtattacgcccagtacccaatagttattttttctgctcctctcccacctcccaagctccaccctcaagtagacttcagtgtctgtcatttccttctttgtcttcataagttctcatcatttagttcccacttgtaagtgagaacatgcgatatttgtttttttgttcctgcgttagtttgctaaggaagacagcccccagcttcatttatgttcccacaaaagacatgctctcattttttttaatggctgcataatattcggtggtgtgtatgtaccacactttctttttccagtctgtcactgatgggcatttatgttgattccatgtcattgctattgcaaatagtgctgcaatgaacattcctgtgcatgtgtctctgtggtagaatgatttatattcctctgggtgtatacccagtaatgggattgctaggtggaatggtagttctgtttttagctctttgaggaatcgccatactactttccacaacagttgaactaatttacgctaccaccaacagtgtataaatgttcccttttctccacaacctctccagcatctgctattttagtaatagccattctgactagtgtgagatggtgtctcattgtgattttgatttgcatttctctaatgatcagtgatactgagctttttttcatatgcttgttggccacttttcatatgcttgttggaacacttttgaaaagtgttcatatcctttgcctactttttaatggggttgtttgttttttttcttgtaaatttaagttccttatagatgctggatagtagacctttatcagatgcacagtttgcacgtatttcctcccattctgtaggttgtctgtttactccattgatggtttcttttgctatgcagaaacgtattaccacttttatcatcacctgttatggggtaatatttgaaatagcataaacttttatacttagtatttaagtatacaaatgtccaattttcaaagcctttcatagtttgactctatcattgtcaaccttattcactgccgtggctcaccttagaatctcacaaaatttgtgtgaattcctgactgccactgttcactataagagcttgggcatgacaatcaaaatggtgttagctgtatagcagtacttatctttttggattatgaggattaaataaaataatggagttaaagtgcttagttcaaggcctggcacatagtaaacactcaagaaacataagctgctcttgttttactgttgtggctgccttactccttagcctgaatgtgcagttattgatgcctttattcacactattatcaggccctgtaacgccttatgctttcctcctcccacttcctgtgtctacttctcgctcagaattagggcttctaagaacttttcccagcatgtagtcctttaccatctacccctgtctttacataggcgttcccttattggtgctttttgtacatatctctacttggattattgcatttaattacaatttggactttgagtttcttttcagtggtagggattagttctcagtctatttatatcctggtattactgccctgccttggagctaacaggttttttcagttggtaaatataaatgctgttattaggttatctcctttaatcccctcagccaccctgtggtagggaggtgttattatcttcagtttccagttagggaatcagaggctggttgaggttaaatgatttgcaccaggctacttagtgtgtaagtgctgtaaacctagaagtcctcacatttaataacgtattactattgtatagctatgctcttatacctgatatttgtctttatagtatcaggaaaataacatttaagtttgggatgtgtaagacatctcaagaattgggattctgcttattcagaattgttatagtttcatctgtgtagagcttgctttctttttactatataatattgcttagcaaaacaattgagtatgtaaatacatttaagatattgaactttgtatagaccatttgctcaataaatatgtagagttgtttttacttgaaagaattaacattgtatttttttcaaaattcagattttcaccgatttcaattactttattaaattttatttatttaataatatccttgagataattatgtattcgtatgtgaactataggcctttcttggtccttataggattgtcattttaggatcatgtaataataaatttggatggcctaaggatttgttacagcttttgtattcaatgaaaaacattgcttccgatagctggggtagggaaactgaggaagggaattacattattaaactacaaaattactgcattttattaactttataatattttagagccacattagcagtgtatatgttgattctagttattctggaaggtgtaattgtggtttgagttacatcataaattccaaagaatgagagacagtttcttatttttaaagaacaaggaatagaattgaaaatgagcagtattcattgtatcattgtataatcttccaatttaatttatggatttactttgctttattgtttttgtttttaagatttgcttatttaaaaaatatttataagcattcctctcattacagagcgtagtaatgatgaaagatttcatcaagaatttcacctctgtaacagtaatatttgtatttgtttttagggaagctatgcgaaattatttaaaagagcgaggggatcaaacagtacttattcttcatgcaaaagttgcacagaagtcatatggaaatgaaaaaaggtaagattatttttctggtggatagttaattgtagttaccacatgaatttgccaattatgtattaatatacatgtcagaggatggcttctattactgggttcatttgctagtacaaaataaaaaataggggatttgtctcctgaaggggagaaacaaagtgaattgtggtatactgttaggaatagataattggtgctgtgaagaaaagtcagcatggagacagaggacctctcagcaaggcagtctttactttctgcagaaagggtgcccctcgcagatggaacaatggagagagcacacttgaacaaaggaaaagcagacatatttgtcccttacgcatttgggtcatccttactgctgtgtcctgcatccattggctggagctggacctcacagtattaaactgatacctgatttgctactaacataaaactttcctaaatacgttaagtgcaagggagaacaaagaagagaggaagttgcttacaaaaggtttaagaaagcaataacatttccaaataaggaaggggcataagctatgagctaagacttgcctgggcctgcccagacatgcctgaataagccaaagcaactaattgggctaaagtgtaagaactgatagttgataggaggctttagagtaagaagctatgatttctagtgtctgttattttattttcaaaccaagacgagctttgaaggtggaacttttctactttctacatacactcaagccagaagggtaatttaataaaggtcatctggttaataaatccctgatcttacaaaatgaaataatccacagtttttcttttgggctacataatgtccccgaaatacttatgtgatacattagcttattcacaaagaagctttctttttggtggaaaatgtagttttttacgcaaatgtgaccccaaaagtaccgttttgcaaaggaaaaggctgaataagctcttgatcctaaaactgtcttgagcttaggttaattgagctatggaatgattataaagaaaactcctggccctctctcttgatcctattcttgtttgggttgctattaagaagaaacagcaaaactgggttcatactctcatactacttgaatgtggactcaacagaaattacctataaagtagattaaccaaaattaaattacaacaaggtgatttttaaaaaattatttattgtggtattctataaatttccgcattttttatgtttaattggggactttcattgttgtttcttcacttggttcctggaattttctttgaatagtttcttgagtctgtctttcaaacagcattttttggttaagcattccatggaaaaagcctgcttatggagaaagatcaaaggttttttaattggctagaaaggtacccaactgaagagaaaaggaatgaaaactaaggttttgggattgttgtgaaaggaatgagtagaattcttagagattgtgacataaaggaaacctcagcttatgcttaagagaagggaaatgtaatatgtatgtgattaaattaatttacatgttaaaagagaatttttaggaagttccttgaagctgactagatctgagctgaaaagaggggtaaagctttctttctttttttttttttttttttttttttttttgagacagggtctctgttgccctggctggagtgcagtggtatgatttccacttactgggctcaggtggtcctcccacctcagccacctgagtagctgggactacaggcactcaccaccatggccagctaatttttgtattttttatagagacggggtttcactatgccgtccaggctgatctcaaactcctgggctcaagtgatccgcctgcctcagcctcccaaaggattacaggcatgagacaccgtgcttggccaagaaggtaaagctatttaattggtagttttaatcctcaaagatgaacaagtgaaaacaatatttaagattcatactgccaggtactgttattcaggcttactaaatttctgattattttatcgtactttactaatacaacttaaacactgatttagggttaaagatgggaagaagttggtatctgtagtttgggacatagcgtaccaactcaaattagtggtcctttttttttttcccacgaagttgatattagaaattcagtattttttttttcataaataaaatttagtgtgtgtttatagcaagttttctgctttttaagcaaaacagaaaaagttaacacccatcattatggaggaagaatctaaaaggccagctgtgcacctcatagtgaatccgaggtagaaacagtttcatattggctccaatcatgagccagacatgattcccaaagtgctttataaatattttaaagttgtaatcctcgtaacaattttgtaaagtagtcatgttatgatccaaattctgtgggcaacgaatctgaaaatcagagactttaaatgtgtccaggttgacattagttaggaatctgtggagctagggttggaactcttgagggcctaattttaaatatttaccctttttactaccctaattgccataccattccatttgcgtttgagtgttggttatctagagcagggattgaggaggaaaagatcctttaaatacttaaactttgtaaacttaactttgcctaggactaacccttttccattacctaggtgagattgggctagcccaattgaattatgaatagatgtgtgtttatcatatagcttcaaatttaggcaagctgcttttcttttctctggatttttgaagatgcattttagtacaattgaattcacttattctttatttctgattggctattgtgtgctaggttttatgcaaaaggacctttactaggagttttaaaagtcactgtgtcatttaataccgggatgtataactgaggcccgttggagataacaaaaggggaagacctatttagaaaattgtgttaaagtccagataaggttcctgtttgttagttactgttaaaaaatacggcccggcatggtggctcatgcctgtaatcccagcactttgagaggtcaaggtgggcggatcacctgaggtccgaggtgccactgcactccagcctgggcggcagagtgagactccgtctaaaaaagaaaaagatccaacatatatagagagctgtagtggtttgtcaagttaaaatggaaaatttaaccatatcttttattgtagtagcttttatttttcttttttctttttgagacagagtctcgccttgttgcccaggctggagtgcagtggtgcaatcttggcttactgcaacctctgcctcctgggttcaaatgattctcctgcctcagcctcccaagtagctgggattacaggcacccaccaccacgcacagctaatttttgtatttttagtagagacggggtttcaccatgttggccaggctggtctcgaactcttgaccttgtgatctgcccgcctctgcctcccaaagtgctgggattacgggcgtgagccaccgcacccagcctattttcaatttctgtgtattatttgggcatggcctagctggtctaaaaccccagtcaaaagaaagctttaacaatctaagctttgaagtcctctaaaaaatgaacaaaaatgatgaaaaggccagagtaactactttcctatatttttactgatttgtattgttaaaaatttcaaagtagacctgcattactttatgataaaggggaaacccattaaatttacttgatttttttaaaaaacaggtgttagtagtaaaggactgctaatgctaatctagccctctggatgtctgtcaaactgccctggattcagagaagtgttctgggctcttacttggtggtggagtgcacagtgggaagaggatctgtcttctttcttgccgatcctggttcaggcctttttgaagagttgcaaaggcgtaaggcgtgaggttacctgggggcatgatcacagtcctcttggctgtgtctttttggcatacaaaataactccagtgagtgatgcttaaaaatacttggttaggaaattttatctccaaatttaaaattgttcttgatgttaaatatggtgcctaataactagtatttatttgcatggcacatctagtaccccatttatattagtgattaatttctcattaagtaagatcttaggttaaagaataaactttttaaaagattattttatctagagctttcttgaaggaagtaattaagcagtagcagtaatgatgctgttaaaacaatgaacagtaaagtcatttagactgattctgaagtcatattgagatttgtgttaattggccaattgtggcatgcaaaaagttcctaaatatggtccttgtgaactgaataatcatcaaaggttagtgatgattctgcaaaggtagcaagataatgcaaatatcatgagtttggattctgtttaacctaatttattttatatattggaatggataaaaagccttctttgaatctgtaaggcagttttcagacatcatctcaagatttgaggaaatcagtggttgaaacagtctctgaaaataaagacaactgtgaaaggagtaaaattttaaatgtgtgcatatcgccaccaagtggcagagaaagtattgtttgttatagttgatagagctgctagggaagatgagaaaataaaggcaacgtgttttataggatatctttttatagcagcagttaaattctgtaagctaaccacttttcagacttttcactgagtgtttgatacatattgaccaactgcccaaattttaaaaaatagtcagtttcacacacctggcctaaaatacaccacataagatatattttaggccaggtgcagtggctcatgcctgtaatcccaacactttgagaggccaagacaggaggatcccttgagaccaggagttcaagaccagcctgggcaacatagtgaaagtctgactctgtctttaaaattaaataaataaataaataaataaagatgtatttaagttttcttctgttaatttggtggccttttatttttaccccactccctttagtttcttttgcgtgtattcttgccttttttttttgtatatatgctgacttttattcaatcactagatttttacgaagtatgggcaacaacttgatttgtttgccgtattttaggggatgatgatattgggatgtttaaggtatgattttatcagcaatatagaaataatttgaatgtttagattatattggatttgctacttccatcatggctttttgaaataatttagagttgacttttttttttttaaagactcagactattgaaaagtcttcatttttcttatatttattacatgattggaaagcactttcaagatagaaccttggtcagtgttttgaatagagaattttttatcaacctgatttttaccatttcatgcattttgtcacagtacttttgagaaaaccagcactactcattcttttatcagtttagctctctttatatttttcagatgtgaaattaagaagtaccatttatgggccaggcgcggtggctcacgcctgtaatcccagcactttgggaggccgaggcgggcggatcacgaggtcaggagatcgagaccatcctggctaacatggtgaaaccccatctctactaaaaatacaaaaaaaaaaaaaattagccaggcgtggtggcgggtgcctgtagtcccagctactcgggaggctgaggcaggaaaatggcatgaacctgggaggtggagctttcagtgagtggaggtcgcgccactgcactccagcctgggtgacagagcaagactccgtctcaaaaaaaaaaaaaaaaagtaccatttatgataactcattgagatttgactactgtatttggcatataggttgcgcattcccaatccaaaaattcgaagtgctccaaaatctgaaaaccccgagtgccaacatgaccctgtaagagtcttgctctgtcatccaggctggagtacagtggcactatcttggctcgctgcaaccccacctactgggttcaagcgattctcatgcctcagcctcctgagtaactgggactacaggcgtgcgccaccatgcctggctaatttttgtacttttagtagagacagtgttttgctatgttggccggtctggtcttgaactcctggcctcaagtgatctgcctgcctcagcctcccaaagtgctgggattataggcatgagtcactgcacccagcctggagcattttagatttgggatgttcaaccactaagtataaatgcaaacaatccaaggtctggggaaaaaaaattcaaaacactgttggtcccaagcattttagataaggaatacacaacctgtactaaaacacagctcttttgagttttatagctgatacaccaatttactaaggagtcttaacatcaatgttcaattaaaaaaaacaggagatgtgtttccaaaattgatgccttctcaacctcctgagagtgtgccaacctaggtatttgactctgtgccatagtaagcattgggtagctcccagcattagaagccagaaagctcccctttgtagacttgaactgaacccactccaaaactagcccagctaatccaggcttccctccaaatttagagtgacctggaactgggcccactaacttggctgtgacctttatatccttggcctcagtgtaagtatacaggcatgaaaactgctcttttctattggattagataaatgtgagaggactacagagacttccctcctccctcagttaaatccgtagggcctccttggtctacttgtccgctacctctggcttcgctgcctgttaatccccctcttgctctgtactccagccgctctggtctgttggttgtttccccactgttggtcacagtccttcctatctgagaacctttgcactggctctttcctctgtggaaatgctcttgccccaggtgtccacatggctttaggtcgtgactcaaagtcaccttcttaaggaaacttttcctgaccaccttgggccgtccccatttcaagtaccccttgcctgctttatttttttctccccatacttatcaccagctaatggagtacatatgcatgttatttcactcatttatctgtttttattatctctctcctattagagtgtaagttccatgaggagaggaattttgtctaatttttttgtttatttttactgctatatccccagtatctgttacacactcaggatataataaataatttggagaattaatgaatattaaataaacccagcttacttcttgtaagtcatatgtaaattgcctctaaagtagtctggttagggttgagcaaaaagtaggttccattaatatattttcagtcagttcagtagataatattgtagaggctgagggggaagcaaacaagaagtagatactaccaccttcaggaagacctgagcaccaaatccagcctgctggtgtctgcttgtgtgtgcacatatgcacataaagtttttttcttttagtctgcacgttgttggcctacagagtgttaataagtgtaaattagttgccaaatttaaaaaaacagtatttcatataaaatttgatttcagtcatctattgaacaattggaggacgggaccaacactaggcctgcatgcccatagttcagccacgtgagtgtgagtgggtatatatacactagtggctgattatcattgcatttaagctctgggttttcttatactaggattaagaaaagtaagccattttctgtactaataacagtacaagaagtgagaatgacaatggaggctgtgtgtttcaagaaagaagagaaggaaactacttctttgggtaactaaaggatattcctaatttttttttttttaagacagagtctcactctaacccaagctggaatgcagctgcactatgacagctcaccacagccttgacctcccaggcttagttggtcctcccacctcagccaccagagtagctgggactataggcgcctgccaccacgcccactaatttttgtattttttgtagacatgaggtttagccatgttgcccaggctggtctcaaactcctgggctcaagcagtccgcctgcctctgcctcccaaagtgttaggattacaggtatgggtcaccgcgcccagcctggatattcctgtttattgtacgcgccgttcacccatttatattacttatgtggctactatagttaattcgagttttcaggccctctagagagatatggcatagatgttttaaagtgtgtacaagtcaacattataattgagcaaaggtgaatttacaccctatataaggactggattgatggtctgaactatgtaaaatatgagccttgagctaggctttgcaatagataatatttttaattgctaaataaaagattataagaaaatcattctcagaagaacttgtgaaggtggtttttgacaactagcaaaacaaacctgtcatattctgtgagttgaaagaatacagtgtattgttctttgagcatgagatatttctcagatatctacagcgcaccaggtgttccaagtgtgtataaaattcaaagatatataaaacacagcactgctcataatcaggagatccatgtatttttggctcttttgcttagttttattaatattttggatgtttctactatggacaatgctctaacacaattttccaggttaattaccacattaagttaaatgcagtatccataatagtaatgtcactcattaatgattgtgtcattttgaataggccttaattagtaattacagatttttgtggtggtttatcgtgttttgtaatatgttagagtacactggatttgctgaactctggtaatttagaactctgagccatacaaagagaagttctgtactctaaaaagtatttaatctaactgtatgcataactccaatattttgcctgaacagatttagtcattgtggaagtcccgatttctgtcctgtgggcatgattatttgcattacaaaaggcttcaccaaaatttttcattggggaataggtgcatttcaatatgattttgtattcataatgttcaaggaaaggaaatgctttattgaatctaattgatttttgcttcttgtttttttttttcccctattattcttcaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaaggtaaatcaagactgctagttcaccagaaaggggcaccatggtaccagaatgtagttttcatattcatttttgtggtggagatttttttctttaataactattggtaacaatttcttgaatatataaactaggaccaaaaaacatgcctctcatagctttggtctagtcactcatgaagcttacgctgctgacattggaaggtggcatgcagtaagcttccccagcttgcaagcagttttagcagactataaatcagatttctattggaagccagtaataaatttaggaggctgattgctcatcttctgtttgacagaggtttatcaacaaaaatacattgttcagtaatgttttactctgctattttaatcttagttttatactagacacgatgatatatacattgtggaaagcatttatctgggttataacgatcataaacgtttacttgacatcagagtgaagcagagtgatactgtagacaagaacagccacagttggctttactcaaattttagtgcgtggcaggggttcttcaattaattttctagagaaaacaatctatcagctagttttactgattatattgtatgaatttagaaagcagtcaatctagatctttttttttcttcccccgggacagggtttttactctgtcacccatgcagaaatgcaatagtgcaatcttggctgactgcaacctccacctcacaagtagcgggaccataggtgtgtgtcactatgtccagctaacttttttgtatttttttgtagagatggggtttcgccatgttacctaggctggtcttgaactcctgagctcaagcaatccatccacctcagcctcccaaagtgctgggattacgggtgtgtgccaccgtgtccagccaatctatacttttagtattgaaagatagttttttattcacttagaatttagctatggttttatttttccttgctactgtactttggaaaatggttagttctgatctcaatgactaaacatcttctaaaatagcgcataaacagctgtttcattatttgatacatccttgttgaatattttagtgtttgctatgttgtagttggcactaggtatatgggttgggagtagtgttggtggaggtgagctaggggatttgtactctcaaattgaattttagtgattttacagatagtactacaggtcttaatgtcaacctccttcaaatttagctgtttgtatgtcatttatatctttatagtttttgtaagtaagatttgttgactatgtattttaaattagatttgggataatacttattacaataaagattgtttcatcttaaaccactaaaactatttctaaattatgatccctgagctaaagtaacgaatatatttaagtggtgggttgatctaatagatcttaagtcttgtctcatctgttttcttgttacctaggaagtctcagagttatatgtctccaggcttcacatgtagacattcagtactatgaatgagtggatcagataggtagtgagaagccagggattctagctacctgtgtgtataactgtttaatcctacttcattgctcattttaaccagttccagcttccagtaattttaaatgaggtgataccaaataaaccaaccagtagtatcactgcttgcctttcgcagcattgtggcttagtagtgccacatcctaattttgtacctttaggggctgcctcaacatggagatctttctgctgtttttcattatatctttcttcaacttccactagtataccctttccccaaggcctagaaactggcagaagaggaatagaatacctgagagcttgagcatttaactagtatttaaaatacctagtaataggttagtacaatgtctgtaagccaaaattatatgttaatatttaattttaaggaaaaattctattagggaagtttatgtaaagcaagactggtgagagttagtagaaggcatcccaggcagaaaaaaaaacaatataatcatgtgcttagagcataaaggtataagaacatggttttgaccaaggtaggcaaagatgtcctgagcagcggattctgagcttcagtgagaggcactttgctcttgtctgcctcacttaaactccattcgtgtaaggaaatagtctgttcattgagtggtacaattagttattgagaaatatgggatattcattttgcaatttttggtgtttatacttattttaaatattcactgcaacaaaattctagtatatctagccctttaaatttatggtcatgacatttggctgtatgtaggtaatatgttggatcttagattttgtgtaatgtttttaatttgttaaaaaaatttacattttttatagtcacagctaggtaagctacgcaacaaggatgacttagttaacactcttgtgtttttcttatttttaaacatcatatactcttggtaacattttgtttctataatttaaacatttctgcagtatcactttgcagcattagatttggtatttcttctttctttcagggaaatgtcttttattgcctaaagatcttgttttcaaagagtatttctagagagatgattatatgccattttctcttctagaattccgttagctaatttaaccttttgcaatagcaaggcaaatgtaattttagttttatttgcttattttctatgagtcagtgactttttccttcttttcttaatggaatttgagtagtttgtggtcagtggccttatagttttttaaaactaatagttcccataaaattatcttgattatgatttttgtggattcaaactactcattgtaattagggatatatttcctttctttccaaggagatatatgtgtgtttgttttttccgaacaaaatgcagttctttttgtgtaggtcttatgatccaaccttcttggttctttttttccgttcttgtttgccaatatgtcttatttatgctggatttcagtattttctctttctgatatggatcttaccttttaattttaacactcaaaagccatctcaacatttttaagctttcccattagaatgtaattaccttcatttagatataaatttcatttttgcttcccatgactgtctgctttagtacattgatacccattttcatagacctcgtcttatgttgcagaagaatttcattgtttaggcttaatttgaccttcaatgctgtctgtcacttttaagagtatggccgacctatgggtatagcagctcacagatgccatctctgagtgcgttagagatcttgggtgcaaggagtgatgtgactgcaaagtactgttgttttttgtttctttatctttattcattttgagacagggtgccaccgtgccgcccaggctggagtgcggtggtgggatcacggcccattacaacctctgcctcctgggctcaagcgaccgtcccacctcagcctcctgagtagctgggactacaggcatgcaccaccatgcctggataatttttgtgtttttcgtagagatggggtttcaccatgttgctcaggctggtctcaaacttctggacttaagcagtctgtccaccttggcctcccaaagtgctgagattacaggcatgagccaccaccctggcctgtttttatttattactatgattggctttatcttatttttgccttctacagagcaaaacctctcaaagcttttaccaaacttttgatttttaaaaacttagttaaatgtataatgttcaagatggcatctaaattttcttatatagctttgctatgagaaatacaataaactattgcagtagttttgtctgctaccgaggctgtctgtgaataaaattttaaagataaaaacctagaagtcattaactgtttcctgagtagcatttgctctgctttttaaaaggaagatacaggagaggcagttgaagaaacttgtttagcttaattttaaagtggaatgttgatcctttaaaaaatataattcgatactttagatacttatgctgtgtttcagcatcatttatcttatctggaaaaggacaataatttagacccctccctgattcacagggatcaagagaataggaaagattttagaattgttatatataatataagcagtagcattttgaagggtctttgctgtttgtaaagtgctatatctctttatcttttcagttatcagaatttaaattctggtaaactgacataatgccttgagcattttctctagtacctttaaattcagttcttctggtgatacatatgaatcgtccttttgggcaaagttaaccattttaaaaatagttctttaaagtaatgcttatataatctctttctggtttaagatattttataatcatccagtttgtctatcattgttttcctcaatcttataagtgattactctagtgttcagctatataaagaaaaatattttatgcactattttgagaagaactactgctaaaatcttttacataatttcttgaattctgatagctttattattattttttttttggagaaagtcattgattttttttaactgtaaaatttattttaaaagttactgctgtaacgttgagtgataattccatgatacagttgtagagctatgtaaaacaagaaaaggctgtttttttaaatggtcttttaaagaggatacaatagatgacaatgtttgtgttctacagactttataaggaagactttgtacttttccgaaatcaatttcagtaatttttatagttgataatttttagagttggttttatcagctatcccttggaattgttttacttattacttaaaccatggccattctgagttttaggtactacataaacaaacaaggttttgctgctgttaaaactttacttttctttcacagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgactgtatgtatgcttttcttatttatccccaactgccaccatgaattaataagacagactcttttttaaattaaaaattgccttttcaatagccaattaattctttactaatatttttgtggccctctttattgtctctctttttttaatcgtaaatcgacagtatgtggtctaatgaagcagttcttaaccagagttggttccttaatgctcccagggacattctggggaaatgggagattttctccttctgttgttacagtgactggagggggtgatgttggctttgggtgtcttgagcctgtggtgctgaattgaatgtcctgcagtgtccaaggtagttcccattccacaaagaattgatctacccacaatgtcaacaagtacccctttgaaaaacgctaccaactaaatgggctttggcaggccttcctgagaatctaaacacaatttttaatgtggttgctctggcagagactgctgtctcatcagcctatttttagactaccaaacaagtatgtttgaattataaatttaacctccacacccatttttctttttttaactttttattatggagacttttctttttttttttgagatggactcttactctgtcgcccaggctggagtgcagtggcaggatctcagctcactgcaacctccacctcccgggttcaaccaatcctccctgcctcagcctcctgagtagctgggattacaggtgcccaccatcacgcccggctgattttgtattttttagtagagatgaggtttcgccatttggccaggctggtcttgaactcctgacctcaggtgatccacccacctcgacctcccaaagtgttgggattgcaggcgtgagccaccatgcctggctgagactttcaaatttatataaaagggagaaattagccacccagcctcaacaggttttatcaattctgtttcattatctccatcaccaccaacacctcttcgtcttctaattgctggagtattttaatgtaaatctcatcctatcctttcaaccaaaatttctgcaatagtgactaatacatgcccttttttttgaaacatcattatacgtaacagttgacagcagctcttaagtgtcatctaatatcctatttcatgtacagatttatcagattgacccagaatgtctttttatagtttttttgctttgttttgttttacagtggtttgttcaaacatggattcagataaggtccacacattttagtctgtaatagtttcttctcaccctctctcacctttgttttccttctatgtcatttatttgttgaagaaactggatcatttttcctgttgtggaattccatattctgggtttggctgattatatgtttctctgtctctcttactttccatgaactggtggttagacataaagactttcagaactgattggtaagatatacatttatttccattggattggaagtcataatatctgattatccccttttttttttttggtcatgttgagattgattatagtagttcagctgttgtaagtctattccacccataaagttcctcagcaaactttaacctaatggttttaatagtcattgatgatgtttaaatccatttcattaaatgctgcaaaatggtgatattctaattttttaaattctaacttctgcattcgttagctggagttttttctacaaagagggactttgccatatcagctatttgcttcaattgtaatatgtaatgaaaaggcaggattaggtgcttgtttactcatttgcagaataataacattccttgaaagtgaccagtggggttttagggtttttgttttgtttgctttcttttcattttgttttattatgagatcatggtttttgttgtggttgttgttattgttgttgttttgtattggttatattttagtccactcagtccactaatatcacttagtttttattacggaaaaatttcaaacactctcaagtagacagagttgcaccatacagtgaaacctcttatgttcattctctaacgtcaacagtgatcttaacattcaaccaatcttatcttcatctatacctgtactccagccccactttcttctgcccttattttagtttgatgcatatccaatcagtgttcaaatttaaaatggtctaaaatattttaaaaatcagattgcttgaatcaaaattcagatctaccacttagtacagtttatattgtgatatgtccttgagtataatctatggacaccccctcaactcttgcaatttatttaagtaagttgaaacatttagtcactagagatttccacgtactagattttgctgatttcatttatttggtatagtttaatgtattttctgtaaattggtagagtcaaaaagaaatagagcgtgggcctagttggaaagacagatttcattcagtactattgcaataggggaaaatagaaccaagttccatttcagaatacaacaaagacacttggggatgaagcagagtgagagggtcaatggatggaaactttctaaaaggagacatcaaaggtagaaggtttctttctgacctgacttaggattcctgctaaaggcaggccaaggtgatcatagatccagagtgggagatagtttaggaggattcttactatatataactgagctaaacagactgatgacggggctcaaggacaaatactagttgattgctcagagcagcctgcttaaaagtatggtcaaggagagaatctttagtgtagaatggtgatcagatttaagtttgttgtcctttggttcttgttttctttctgaaaagcaagacctgcttcaaaggtggtggtgtgctctcttgcactaggaggtatattatgtcttgtattcaggctatttgcatttcagattacacagttttatgtaactgctttaactttgtgtttgtactgaatattagtttcttgatggcagagaacatatttcactttcagaatgtttttctgcttacatggatttattttcaagaaatttcatacaatactttatttagaagaaagcagaattttctgaaatcacagtatgcagaggcatttaccatcaactctgacaaacatccttctggtcccttttctatgcatgtattctgtggaattggatgcaaacacatattaaaaatatatacatttgcctaatggaaccacagcatacagagtattttatagtctgcttttccattcagtgatattccaggaaaatattttcttatcagtgtgtttagatacacatcctttcaataggtcatcatttaaatttctactgtctaacattattttaaaagtaagtttttctctaataatcagcaccacattaaacatactgtgtagctttcactttaaaattatttttatggacatttgatatcattagcttgacattattaataacagttaccttgactttttgatatcatctgtactgtcttggaaagtgaaaatatttgtcaaactgttaaatgataagaaagaataattatacactgccaagcagaatttccttcttttgctccctccccaccttctgctccaatcacataaataagagctgttttttctttgcagtatgcattgcctcaggaacaaaggtggctctgtttaatcgactacgatcccagacagttagtaccagatacttgcatgtagaaggaggtaattttcatgccagttcacagcagtggggagccttttttattcatctctgtgagtataaaagtgtgcatttaatgtttttagtgtgaaattgttaaaatcttttgatgagatacatggatatattaagttttgtcatttgcctaatcataaaataaatttaaaaagatgacaatttgatttatttttccacctactgcagtggatgatgatgaatcagaaggagaagaattcacagtccgagatggctacatccattatggacaaacagtcaaacttgtgtgctcagttactggcatggcactcccaagattggtatggctctacttttgctttagtgataatgtgaagtaaaaattaatttcttaaacaggaaaatcacaacattcaaatggaaaaacacacctcagttttatgctttttaattttaaaaggtatgttagtaatcagtgctgtttataattgacagttatgctctaccttatttcagaaatgctttaaggtaatagccagtttttacaagtacattcttaatgattttttcttaaatgatttccaatatattttggtggcaatttcctttttggctgtttatctgaagatgttcagtagagggcactataaattacatttcttttctttactaatgcggataaaccgtattcatttttttgtggtacctgccatatcccaatgtaggaccaagtttgcaaacagaagacattcttatttcttttgaaatataagcgtaatttttgttagcttactctctcacaagaagatagatttattaaaactgaaataaaattggtatttctaactgggagcagggcataggatttagggcttttgttcaatagaagacattgaaactcggccacgcatggtgactcacacctgcaatcccagcacttcaacaggtgaaggcaggagaaggagaagtgactagccctggcatcacttgagctcaggagttcgagactagtcctggcaacatggtcagaccgtctttaccactgaccccgcccccccaaaaaaaaaattagccaggcatggtggtgcacacctgtagtctcaagcttaagtgggaggatcacttgagctcgggaggtcaaggctgcaatgagcggtgatcgtaccactggactttagcctgggcaacagaatgagatcctatctcaacaaccacagaaaaggagatcttgaaattgtaaaaactacttttgttagtaaaatgaaaacaaaagtcctctatagtgccaccaccctcccaattttccctctccttttctcaaacaatataatttacttatattcaagatgaaggggatttatgagtaagtttgattcaaggtcagactgaagaggttgggtgagtagaagaacatttagtattaatgttcctaaacatgcctcctatttatctttttggtgcaatattccactggcttatattttctggggtcatttcagcagaggctggtttgatctacagttttctaagccagtgattcatttctttgttactgttttttttttttaccctctgtcatgattgtacaaggtgattttatttcccatgtcaatgcaataagctagaagacatgaagtatagtaatagtaatctgtaaagctttgcagctgagacaaattataataaaaagggtaacgttagggaatgaagggcatgaaaaacagagcaggagacagaagcaagcaaaaaatctgaatcagcatttattcattttttttctcttctcattcatttcctctgttccaaggatgatgttcatttgctttggtgttaaatgcttgtactgcagaagcacaacttaggaggatgattctgatcaccaatagtttataatacaaaccacttagaagacagacccaaatttaaaacaatgttttcatttacagttgtttgtaaagtaccagtagcctgccttgcttgaaagtcattaattgaggtttttacactcaaaactgtatggctttatataaaaatgttgcaatgaaaaattaacttattagaaaaagttgcagtaccattattaagacgctgatacataaatctttccaggggtttcatgacaggaattctgacatgcaaagtcgagtgcctctcgtcattgagtttacattttgatagagtgataagccaaatacccatgtaaaggatttatgtagtgatgaaaaaacaaaacaagataataaagggatagagaattggaggagcgcttagagaggtcagggaagtctttttgaagtcgcagtatttgaagagagcccagaatgaagtcaaagaaccggtaattgagtgaggagcatttcaggcaaacagaacaagtacagaactgaaggcaggggatgtatgatgactagtaaagaaaccagtggagctggagcggagggaggagaggtcaagtggcaggaactgaatctgtaaggttagcactaagcaagaccttgtaggatccctctctgtatctagggtaaggacttcatattatctctgcatgttagaaggccactggaggattttaaacggggcacgatggcctatttttgtttagaagtatatgtgtggctgctgtgtggagaagagagcatagcaatgcggccgtggaagcagagagacaggtgcttggattgttgtcataattgaggcaagagttgatgctatcttagacccaggatcatagtattaaggtggtgaggggtgactgatttgttggaaagtggacctgacagaatttgctggcagattggatggttgggtgtgagagaaagcaaggcatcaagggtgactcttaaggtttttggattgagtgaatgctagtgccatttattgacctagatgagttggggaaggatcaagtttaggaggaaatccaaaaatctgttttcgatatgctaagcttgaggtgcctgttagacatcgtaagtggaaatgttgaataggtagttaagtgtacatacaagttgaatgcaggagagaagtctggagataataaatttgggagttgtcaacctttaaatttttaaacagtatagattataaagagaggaaaagagggctgagaactcagctctgggcattttaaaggtcagttggagcagttgtggtcctgaaagcaaaatgtgttgagagcttctgagaaaatgaagtaaaatgaggacagaaaagtgccgtgagatgcatctgtctggaaatccttggtggctttgaaaagcagttgtagtggcgtctttgagataaaaggttggagagattgcaggagattggacagtgaggaagaggcgtttgcagaaaaacaggtagtgagagggagggacaggagcatgtagtcagtgttttctttacttttgattttgagatgagagatagttatgtttgtatgttgttggaagtgatcaatagaaaaggaaacagagtaaaagttctgtgtcaaattttgctcttcatcatgatcatctacttagccattaccttctaggtgtcaagtgtcatatagggtttgatagtattatctttcagatattcatgtgttttgtagactagttgcgttataagctttagagatcagttggacaggcagccagccctgggatcaggacatattctggtccttcagctactaaactggtaattttgagcaatttgtctgacctttctaagcccattttgtaatctgtaaaatgagtttgattttgttatgtttttaaatacgtaagttttggataatagatataagacgtttgcactgacagtagccttctagagatttttccctttgatgttggagtatttgtcattttatgcatattattggaaaatatcattagaacttgctgttcaaaatatggtctgtaggccagcagcattaacatcaactgggattttgttagaaatgcagaatatcaggccccacaagagtcctgctagatcagaacctgtgtttttcacaagaaccccagctcatttatgtgcacattaatgtttgaaaaacactgatctagaaaacaagtgcctgcctgcctgattttttttttttagatgttcagggaagagggtaacagtttctacattctgacatgcttgcaatctaaaagtgttttttattcctagtctttttgtttgtgaatgtttttatatatgtaggcataggacaaataactgtgatgtattattatgcagtatatagcttctatgtacttttgatgttttacacaaggaaaatcctttccatgtgtggatgaccttttatttcttaattgttaaatatagataattaggaaagttgataagcagaccgcattattggatgcagatgatcctgtgtcacaactccataaatgtgcattttaccttaaggatacagaaagaatgtatttgtgcctttctcaagaaagaataattcaatttcaggtatgtttttaaattactggtgaaatctaaaatgtacaaactgtgaggttagcagcttgcaaaaatatgaaattttcatttgctgttaattatatacaaatacatgaagctatacacagatatttatctcaggtatgagcatccttaacacacaatcctcagacatgcaagcaatccttcctcaaggaagaactcaaaattatgaaaatgttctcagagaaaacagttaacatctagttccagggttcttaattgaagaacaaagagcccctcaggatatccaaaaatagattttcagtgctcattgaatcctctgaaattgtgtgcaaacattgtatagacaaagcatttttctgggtgaaggctcaaaatctcatcagatttatgtcgtggtttccgaagatagtaatgatgacatgctttgaaagctaatgttttacatttactcagaaggctttcatgaggttatgacatgggcagatgatttaataagacagttatggtttcatgtgaaactcctttgcagagagatgcccatacacactgatgggcatgctgagtccctggtctaggtgtgttaaggtaggggtaggggctttgccttcccatcttgattccctcccatggaacatgcataagcttctagctgttgcctaagcatgaggagtcccattgtctttcttaggagtccttgaagagttttaaacagccatttacatcacagatattgatctgctgttaatgaaattgtacctgcattggtatactcataatggttgttctgaaaggtattattatttaatatgtcactgaaatagtttgtattataagaaaaactgctgtctatggggtttctgtattagcattctgtttgtgtttatgtagggattggcaaagcaccatactttagaaagtttataagtttttactgagttatcttcttattaactcttgtctgagggttacttggtaaaattttcttatcctattaatacaaactgtataaaacttagtttctaaacttctttctttattaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcaggtgagaacgcctagtccaagttggccttcagctctttgcagctactctcagctgtgacctggcatcatttcatttcatgggagttttgatttttctccaatcgtctgattaggggatttttatatacaccatttgttgatttaaagaaaaaaaaacaaaattaggaggagcgtacttgccagaaaatttaaatgtaaataaacttgtatgttatcttgaaatgtttttagctagctttgtaataaaaaacattttaattgcccttttttaaaaaaaacaaatgaaagttgaatgagaatctaatttgtgtactttaatgaaaaatgaaaagttttctcagtgttgtgattttctgtgaattgcagttgaatggcggtggggacgtagcaatgcttgaacttacaggacagaatttcactccaaatttacgagtgtggtttggggatgtagaagctgaaactatgtacaggtacttgataaaactttttgcatcatccagaggttgtgaggggtgtgggtacaggagattctttcctggcactgattgtaatgtattaaacaaccttgtgttaagtctcatttttaacatgtactttgctttttaaagtgtttttaagtgatttctatttcctcctcaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaatt

SEQ ID NO: 37585 - DNA, 6464 bp, Homo sapiens; identical to SEQ ID NO: 35826

SEQ ID NO: 37586 - DNA, 158148 bp, Homo sapiens
gaagtccggccttccgagagctagctgtccgccgcggcccccgcacgccgggcagccgtccctcgccgcctcgggcgcgccaccatggggccccggctcagcgtctggctgctgctgctgcccgccgcccttctgctccacgaggagcacagccgggccgctgcgaaggtgagttcccggccagctccgctcccggcgtcccgccccgagcttgggcgccccgagaggcccctttgtccgcgcctggacccgtccgcctgcccctcgggggtcgcgcgtggcacggccaggtgcattctctgggccggggttcgttgggggtccctgtaggctacgatcgcgcattggtggaccgagcctcctttgttatggtatgggtactggagagttaaggaattcctccggggaagggaggagaaacagcccgcgctgtggcggggtgagggtgcctgggagccggcgggatttgaacccgcgtcgcgggtatgctcggcagctgggcgccttcacccgtcccgggtgcgcgagggagttgggggctggagggccgggagcgcccaccccgcgctgctcagagacccacactgggagctccgagctcctagcccctgggagcagctttgggcgtatttctccttgtctggagaccctggtggctgaggctgaaaagctctgggccctttgcctggaaacagctgtatctgagctttcccacgactgctgcctaaggcgcgctccaaggcagaagtggggctcttctggacgcccggcttgaagaagccaccatcctcaactcgttgccttctattaatatatattttaaaaaattataaccacattcatatttgagcatgaaaccaaagtgaaactccatgtcattgttccatgcacaaattgtttttctagttttcatttcctttggttatgtgcttgcccagaaaggatctgggagatcggtttgcaggaggtttgcaggagtcgaggcttccagccgtggacaagcctggactgactgttgtttccttttttccttcccctccgagagaataaagacttcagctgttgctcagtgtcacagccatgcagtcccacaggccggaaggtgtggcttctgaacagattttgcagtttctccctcaaatgcttaaaaatgatttttgctacttaccagattttccatacttattcttttactgttcttaatcttgttctttgttttcctctttaaaaaaaaattttacttctctcctggaagaatgatactcactaaatccacttaactgtatagaaattgttaactgttacatgccagagagaactggtgatatacacacacgtctcctaattgagagcttatctccctggaggcagcttctccactgggtattgaaaggactaatgattacatcagcaattaacttcagattgtacctcccagcccagtctccccaaacttcatagccagttatttaaacactctttggtaatgatgacaaaatactttccaaagaacaggcttgagagcactttattttggtctagaaatattgaccaaaagattgaacgcttccaaggtgagatggtgaagcctgatgatggtaaggtaaatcagagaaagttcttcattgggaaataggagctgtttgcatttcgattttctgatggataatgttagcaaagcaaagaaagctaactgtaagagctggctttccaaacatccaggactgtagaaagaaagaaccactcagttacgcaaatcctgttctcacccgggaaatcaaacgcattaatgttgagttggagatgattttacttccctttaatcatttcctaaagctcaattacattcccggccactgtctttgcagtgtcccttgaggtgccatggactgtttttaagagatgcagcctgtgggcacttctgatcacagctgacctcacagatattatcattactctgtattttccctggcttaattagagaaaagtgcttaatgtgcagatgatgtatgggtatacaagaaaatcacttaaaaactgaatctgcctaattttaaaatttgtctcacttttcatgccatcaataacattttggcttacctccttccaaaatcagctgttagatgtaccataacactgaaatagcttcaatactgatccaagcaaaacataatttaaaagcacattttgaatgataagatgctgtggatttgatcagatcctcattcagaagccagtggaagtgactgttggcttacctctcctttgcactgtctgaatcacacttcacctgcatttgtacatccagacatcacctgctgtgtgccaggcatgaattgcccttattgttttttcttcatgaaaggctgtttaattttgtatttgctgtatctgctatggtcatattgtttacgtactcatgggtggattttctaaaccattgattttatcccacgctgaacctaccactctactccccgctcctcccttcctccacttttcttcagcaagaaaggaggaatagcttgcaggctccagacaaacacgtgccagcagtgttctgattgtgagcaccctctactcttagtcactcagttgcactgggcggaatgaacccttcctgcagcagctttcacactcccctctagctggttctgtgtgatgcttcttaacagattatttctcaggattagaaacgtgaactttcccctcagtgtggtgatgcttgtccagcaatactgtcatctcctgaccattagtcaccacctctgggactgaatgacctagagttcaaactaagtgagatttcattcccatataagtatggaccatgttctactggaaatgtagtttagaagagaaggctggtttctgaatcagtcccaacaagagcagcatcgcccaggatctcaggagtgatattggtgaagctattccttatatctgcaagctctttatattaatagatggaattggactagggtgaagggacataactttaagaccaaccagaagacacaatgttcatgtactctgactagattcacagaattatcaatgctatatattattaatagtcacgtgtacacaggatgagtgtgctttaggcaccagaggaccttacattttatacctgcttttaagcagatgatttgggggtactcatcaaactctatacctcagtttccctggcaggtctgtcccttcctcacacggacccgtttgtgccttccttcattccacacacacatcgggaacacctccttcctgccatgaccttgccaggtgctggccatgcggcagggactcacccccactctctgtcctcaggaaggtcaggtgagaaatattggaaaagaaacagacgaatccaagtcaggctggtaaatgtcacaatcaggggaatcgaagggctataggaacactgaatccagctttggggaactcagaggaaacttctgggaggggcttccgcctctgaaatatgagggagaaataggaactatacaccagcatgtcatttccatgtgcactgtgatggtgtactatacacagaagacatggtcattctgcctgtctgctctcaagtctaagggtctttgcactgaaagatgaccttcaagtttgctcctttgagataccaaaatgtcattgtttctgtgattaacaatcttggtggctgaactttgctctcagaggggtggaaagaattggaagggcagggtttaggagaccagtgttaaaaaagagctcccagctccaactgaggccccagtatgtggtcctgtcccttttctcggaggtggcaggtaggcaggcaggggatgtttggaaagttgcggcatggatgactgattctagtcaggagtgcctttaggaactgacccagaaaacctacccttacttgggccaggccatgagggaattcacaaaaccctacattattcattaacaaggctgttggcaaatttctgagaactggcaaggatggtcataacaagttcagttatttagttaagagctggtaaagattttgcagacaaatggaacccaccagtgatgatctaagacaaacctttgtagacagtggaagaacatcaagaagtggctaaatgacaacagtggttttgatgaattctatgatatttgttataataattgttccccaaattgaagaaggattaacctcattaaaatgtctcacaaggaggtttggtattttgagttcttgggctagagtcagctcaagcaacaatagaatgcctaaaataatgttagagcattgttcttcctgctattattaagcaaccatgaaaaaatgtcaactatagaacaatacaaaagacatattcctaccattcttatgcatacaatgaaaagggatgtcaaccagagcatgttttaatggtgaatttcttctgagtcttttgacactgtaggaatgactttggggtgaagactttgatagtctggtacacagtgagctggttccagcctcgtttccctccattgttctcctggtcctaactctgggacatgggtccctcctagcgctctttccgtgtctctgcttctgtcttcttcctcttcccatgcccctcagtgtgggtgagctgcaggggcagctctgcgtggttctctttgttctttgcactctctaacttccactgggggtctgctccatgatgcaccattactccctgaaggggactccagaactccttcttgaactccagttcaacgtcttcacatttccacgcgacgcctccccttggctgtcttgctttgatctcaaactgagcaaatatgttcaggactgaactcattttttacctggactgacaacccttcccgactctgccattttggtcctggtgccctctgatgtttctgggtacagagcccagagactatgaggctttagcctttcctcttctttatcctctgcatctgctcagtcacaaagtctcctacttctttctggatgcttcccagaggtgcccgcagctttcccttcccacggctgggactcccttccagctctctttgccttgtgccaggatcaccactgaaccctcatggccctgcccctcctcccagctctcgtgctctccagcccattcctcaggctgtgagaggctaattgccctcaattccctaagttatggtcatagacttgctggttcaggatctgccatggccacctactatctcactggggttccccctctttttggcttggctgtgcattccctttgtggtacggatctgtcaaatttttctggcctcgttccttgctactcctcgacatacggctttggtaactgtaaggaaggataatctctgcattccacagaagctgtttcatcttctcctgctccccggcctgcagtgtcctctcgtcttccctcggctagcacgcattccactgaagctcctgaaacagttcgcagcctgccccttttccacgtgatcccctctcgagtcagagtggtaatgtgaaatattgttgactatctggattttaaaaaatccagcctaaattgcaattcttgctctgccattcagtagcattgtaatctctttgagcttggagtctctaatacatacagtgagggtagtcgccatgtctagggagagcatgtgcacatgaagtaagcactcgagcggtgctggttgtggttgctgccacatggcttggagttacattgtcatttgtgtcttggttccaacacttgccaggacataacttctttttaaagcatcccaccatgtttgggagagtgcccgacacagaggaggaaatcaggaattaattacttgtaattggttccaattttctagctgccattctcttgggagccccctccccacccccggagtgtcctagagggagctgcctgctggcttacactgtccacccctgtggtattactagtgaacacaaagatgaatctgggcaaacgaaggtgtttccccttaatttggaatttggagtagatattccaccacagactaaacatgacttggaaatatgtacactgctgaacactttatgtaaatagtttattccgtggtttagtaattttctctgtggaagctttgctggatttggtttttaatctgcatactataaaaacatttcattttatctgagttttaaagctcacttgatctttaaggtacaagacaaatgccaagtgtccaaatcagatattaaagcaatcttttccaggccacttgggcttttgtgtttctgttgttgtacctcttacctgataaaggagagctattcaacctcctcatcttctgttgcttttagaatcagtacattgttcagttgtaaaattaccattgtttagtaatacatacacatacacatcttagtgtactgtggccactgattccagcaaggaccacagccagagatactggccgtgagctggaagcatccagtttgatgtcagttgctctattttcatttcaccaaatacaccaacaattggggaagccatttgtgtattcactcatagagagtgcagctaacttaaataaacattgctcaattcagcagaagatctggaggcacactattcctgtattggacacaattaaaattgtttaaagattttattaagtttctgctttagaaaacaaggatattcctttgtgaagaacaaaacccagtgtgttccagctgtaattcaatgttttgaaagctatttccacaaacttttcccagcagccacactcatccctagagatgatccacattcagaagaaaatgacagatgatgcacgttcagaggagaatactatgtgtcttcattgcacaaagataaaccttgcctaatcctcacattcagcacatggggcatttttgaaggtactaggtcagtatttgttctctgtttcagcgttgtacagataaactcaatgataaccattttggtattgtttccttcatatttattaaataaacaatattaatatctaatctaattggtggaagatttggctattacatctctaataatgctttatttatatgtatattactatgtaatataaaacaatcaaaatttattttcagatccgcagttcccttgtgtgcaagtaatgcctgatttctgagcacagtggcatttattttcatatcatccaagagcaccagctttgaaatgtcattttaaaatataagcaactcttttttatcattagcttgaatttttgagttgcattttagagttttttaaagaatgcaatgccattttaatgttacagaattaatactgagttgtgtgtgacgtatttgctaccaccagactaaggaccctacgattagtctggcaaaagaaaagtctgtttctcaaagaagctggcattaacgggtcagacgtgcacacgactttttggaaaggcgatggcaacgtctcaactacatccagagaggagacagtccagggacacactggttgtgcaccagtcacaggccctgcagggaaatgtgtgggccctggtcttcctcatgtgtatgatggggatgagggcagttgctttccttagggagcaaatgtaaggattaagtgagttaatgtctgtgaagcatttataccgagcttgctttgtgccaggcactactctgttaaattaaagacaaattcagaagcataaacagcaaagtaatgacatcaagaccccttggggctggaagggcccacacaaggatctccttcagccgttgtccaacatgagctcacagcagcatcagctggagggctccacgaaacagctccagagcttctgtttttggaggtgtggggtatgccgagaatctgcatttctagcaggtgagggtgcggctactgacagcccgacttctttcactgaggccgccgcttgagcagccttaggtgcaggcctgcagtgtcgggacgttagtttgcactcactttgaggctgaacccctgcgtgtaacatggccctccccgttctctttgtcttctttttccgttgatttctgctcctgcccgcaatcccggttccagctgtgtggtgcagtttggaaggtcagatgggcgggggaggaaggttccagaaacatgcatgtggcgtgtcaggaagtggaggctcctgagtggatctggagagggctgggctgatggtaaatgagcacagcggtgcctggagcagactctgccctccgtggctttctcccctcttcgggagcctggcgtgggtgtctcagaactgatctgctttcagtctgagttttgccatcctctgcggcgagcctgcgagcttgcacacttgggcaggatgcgctcagcgccctagctcagaggccgacccagggcagagccagtcagcgggcgctgggacgcaggactctgaacatgggtcctctgcctccctcccacctcctccaggcccggccactcggcttcctggtgaggaattcttaacgaccgccaaatccggtttctagagataaaagacggttgaaggttagtggtttaaaataactcctaaattttggtccggaaatggcctatacaatgaagataaacttaccaaagcaggaaaatgggtcagtgatgggggaaaataccatccacggaatggttagttcagcctcagcatccgatttatttcggacacatacacaaacccggtccagaatcaataatattaactggaaaaggggatgacacggtttttattacgtaggatatgtagtgggcgatcttcttgaaagatttctcattcctagcttatctttaacaaacatgtttttcatgtaaacattatgctagcgccagatgctttttatcaattgttaaagcctgtctagtctgactaaatagccattgggcgcctccataataattagattttgttttcccaaatacttgaaaataataagattgtatttcttcaggaatttaggcttttaaaactttttttaaaaaattctataattcatacttctttattatttcatgttgatcatagatattttctcttttttccatggaggttatcatcaattaatatattatgatatatggatttttttttctcttgactagatcatttatttaaaacataaataactttgggtattgtcctaggcgagaagccaatttgtaaccaaaggcccatttctctctctcttttttttttttacatcagcgaaagtaaaacaagagtaagaattcacatgaaaacaaagtaggaagtaatagtttgatagctcagtatcttgcttttggcctttaaaatttgttcagtaagtgtgtgttcagcgcttactctgaattaggaaatatgcaggtggttggaattgttcttatactttgcattcggacatgtgcctgagttaaagtgagaataattttggtaatggtatgatagatgttacgttgaaaatttagcacttgcactgttctcttctggctccaaatcttttcatttaagttctgagactgcaaaaggcatcagtttcagactctggagtcagatgagatggatttgaattcctgatgacagttttagtgatggattttaataataaaattaataaaaataaatttatttgcccaaacagcaactagctgtttgactttgggcaaccttcttaacttctttgtgcctcagtttccccatctatccatgagggataataacgtattcctttattgtgttgtgaaggtcgcagacacgatactggtaaatgagtgactgccatatcataagatttcatgctgtgaagtagatctttggtcttcctcttgtttcctggcatacaattcctgaaattcttggaatccgaagtgataagtgtctttgtatgttaatgagttgactggtggctggcccccccaccccgcagcttcagagttaggctggtccctgggaaagaccaaggcaggctaaaggatggattcagccccactcacaacctctggggagaggggccgtgtaggaggttgagttaattaccaatagccaatgatttaatcaatcatgcccttatataaggaggcttccatgaaatcccaaaaagacgggcttgaggagcttcaggatggctgaagatgtggagctgttcctagaaggtggcatgccctggtagggctggaagccctgccccttcccctacaccttgctctgtgcctctcttccatgttctgggtattcatctgtatcctttgtaatacagtagcctttataataaatcagtaaacataagggtttccctgagttctgtgagccttcctagcaggttaatcaaaccccaggaggggttcatggaaattccaatttataaccaatggacagaagaataggtgacaatttattcctggcaatggggtctgaagtggggcaatcttgtgggactgagccttcatctgtgggagctgatgctgtcttcagatagatggaatcagaattgagtggaattaaaggaagcctagctggtctcccctgaagaaatgattgcttgcttggtatgtggggaaacctcccacacagccggtgtcagaagcttgttgtgagagcagaggaaaaactgttgtgcctctttgtatcttcagatgagcattcataaaatgttagcttttactattgatttcgtgattatactatcgatattcgtatgtacttaaaactatgaagtatctttcttttactacgactttatttcttataagagatcagcttcttggataatttacaaaatattgggattataatgatattcaaacaatcgaatacatcttgagtgcataattcttgagggcacaattctatccctaatgtattccaagatggagcccttggctttgaggtataacaattatgagatgaacaaaagcaaattgaaacaaggcacgttgccgtggtttcgcgtaggtggtggcagaatctccgtagcttcacttctcatgagatccatcatagccactcagagaggagactgtcatagatttcttcctgtaagcgatttatgggaaggtcctagtttaatagggcagagtgcaaaatgggaatcacttttgagaactttctctggtctcttaatcaagtgggagaggcgcagggctgaagttagccagcactgcacatctgagttttggcttgagcacagtggagacagctgcccacagcagctcactccccgctagaaagcgcacctgtctccccggagagctggagctgactttggaggggttgcatctctggctgcctcagcctgacattttccatggtagaaaatgtctctggggctccagaggtggggcttccagccatgtaaatatttgcatgtaaatattttagaattcagcataggttgaggtcagaaagccatttaccgtgaggctgggtgcggtggctcatgcctgtaatcccagcactttaagaggacgaggcgggtggatcacctgaggtcaggagttcgagaccagcctgaccaatgtggtgaaaccttgtctctactaaaaatacaaaaattggctaggcgtggtggcgggcgcctgtaatcccagctacttgggaggctgaggcaggagaatcgcttgaatgggggaggtggaggttgcaatgagctgagatagtgccattgcacttcagcctgggcaacaagagcaacactttgtcaaaaaaaaaaaaaaaaaaaaaaggaagtgaactacaagaatattttgtcgttggctgttgtttaatgggacattcaaaagctttaattgaattcaaaaaggagttatttaagatttggacttaaaatcagcccattcctttattgtgtctctgtacaaactccgtctcaaaaaaaaaaaaaaaaaagaaagaaagaaaaccatgtagtgtgagagcctaagagaaaaatctgaacatgctggcagattgaggatgtttatccattaaagagtctaaaagtgggatcttcacatacaacttcataaagtcttctgagctctgtacatgtcttaaggaaatgagtctgatttgtacatttttacattaaaatgattatttctaggacattatggcttttgtatattaagtgtgctcaatgaacagaactgtaatctaacttcacaaaattagattttaaatacatataaacatatgtacacatatacactacataagtagaccatgtgtgcatttcctataaaatgaatgatattcattcattcatgtaagaaatatttattgtacacccactatgtgccaggcactattctagacttggagacaaacagaaaagaattgctgccctcagcatttatttatgggatgaatacagagaagcaaacaatttctgccttttatcatgctgaactagaaattatttaaaaggatatccctctctgctattttagggatggttcaacctcccaaattcaactttgttaaaatagttgtaaggaagagactggagtcctttataggaaattgtgtctactttgtgtctcagaagtacattcatgagactaacagacattgagttgttccaatttttggaaattttgaaatatctctccagtaggaaatgggtttgcagagctcttctctcttccctgggaattaagtacagctagccatgggaaataccacttgggtttagagtggatgaaaccatcagatgtggaaataccagatggaggaatgggagggaggctgtggacagcaaatgtgtttctccagtgtgcaagatttcttggcactttgatgaggatgttgtgtgtcacaactgtaatgatgcaagaatattgtcctttgtcttaaaattgtgttgctctttggccatgtcagccggaccctgtgtgaaggggctggaggcaggcagagaaaagagatgctcttgtaatcatcagggacacacctcagacctctagttccacaggacccgagtggtcgtgctaccatctctgcacaatggcaaccctcagggacagactgtcacaatgtatggcagcaccaagaaattgggggctcgtctcctccagctcagcgcctactcaaacctggaggagttctggtcacaatgagcacttgagccttttctgagagtcaaaattaaaatctggttccaaggaccaaggcttaccaggtttcctgggcaaaagaaacctaatttgtgagttagggataaatgaatcagaaacatgaaaactattgctgtgagaacactcagaggcttaaacaaggaaacgcaggtcaaagttcttggcaaaatatgttggcgaattgtcctggacaattggcagtgcatgtcccacattatcctgcaacagtgacacgctgttaataagggaaagggtataatgtgaaaagctctgatgaagtgtgctaggttacagagcctttttggtggaaaataattctagaaatggtccttaatttgattccttaattggcaattgtcttcttaaagtgtcagagtgaggaagatcagctggtgtttccagtatgttcaaacagcatgttcgaaagtgcaggcctgagtttgggttgctgtatctgagcctatctgccatctctgagcagagtcaattgccatctcaagtcagatgattggcagtaacttctagaagataatgtcaaatttttaatacaactttttctagttctatatgatgtgcacttgtgccatttgagaaactgtagcattaacttgaaagctatagttggcaaagcgaagtaattaggttgagtttcttatcattcatagccttctaggtagacgcagcagccgctacctctacaacattttactgactcttccctgggtcagagcaatgccacaggtgcgagcccccagctttggcagcctgcagacgtccagaaacacttctctaggtgccacagtcctacacacctttggtcatgtttgcctaagctttgggactttgctaatttgcatgggagggctaaacctccagcccccaacggtggcactggggagtagactaagtgttcctgcacggtgaccttgaatggaatccagcatttatcactagttgaaagagagtgactgcacttttagggggtgctctgggtaagttgtgtaggtgggaattgagattttttaaaaataacagccaatttattttcccacaattctagaatctacttatgaatttgaggcgtgatatctttggctgttaagtgacacagattacctggcagttgcctttgtatgctagtgagaaccctggacatatcctgtttctcctgaccctttacatagagataattgacttgatgacccattgatcccatctgcctacctgccagtcatcatcctttgagttcctgtccctccctacatgttgagggagggacctggtgggagatgattagattatgggggcagtttcccccatgctgttctcatgatagtgagtgagttctcatgagatttgatggttttaaaaattgtgctttctccttcgctctctctcctgctaccatgtaagacatgccttgcctcccctttgccttccaccatgattgtaagtttcctgaggtcttccagctatgtagaactgtcagttaattaaatctccttactttataaattacccagtctcaaggagtatctttatagcagttatagcagtgtgagaatggactaacaaaaataaccacctccagattggaaatatatgaaaagttgagagtcaagaaactatagtccagtctagaccacagcatggcctcttttggggggcccgtgaaccccttgagatgatatgcaaatttttatgaatctgtgcacaagtgcatttttaagaagacaatgcctggaacttttatcacattctcagagatgtatgccacagactgctggtctagagggccttggtagcagatttttatagtaagaactgtcaaaaagattttccagggaagaagaccctgaatttggcagtagataagaatagagctaaatttgacaatgcttccaaagctttggctctcagcggcaggcaggatgcaggcacttctgagggtggtgggaaaatcggtcggaaagacagttttggcgaatgttaatcttattgtttgtatcaaatgtttggcatgaatctctcgaaagacatgtgtgcagaccccatcttctcagctgcattttggtttctttctccatgcccctccagggatggcacagtatctgagcatcgccatgtagaatctatgctcagtaagtgtgtctcttgattgactaattggttgtcaaggtcatgctagaaaatggaaatttgaaggtgaatctagattggttcatctgcagatggtggaactggcgattatgatccctctaggaacccagctcagagctcttgaagagggagacaagaagtaaataacccactaaagaagccgggtctggtcacaggagaggtgtttctgtgaacacttttatgaaaaggtgcgatgtacttgggggcagtcagggctctgcacaattagtgaaggccattgcattttcagcacttgacatggggtgggtgataaggaaactgacaagtctagtccctgccacgtggccagcctcgcagggctgagaaggcgatgggagagggctgacttgtggtctgatttgcccaggccagcgaggtccatgctgtgacctgggtgaaattactaatggcgctcccgtgcacccctagcacatcccgacatggaagatgagttctgtggacagccagctgtgaggagatggcatggttaaagctccctcgccattgcctcctagttgcagaaaaatatggcagattcttggttgctgagaaatgctgaagaaatgaaaagacaagatcaagagtttagatgaatttagtgcaaaacgtgaagatgatcaaagagacaagtgggtggctaatgtgatgccaggctacttggcatcggtgtactttttctagacaccaggtcctcgacacaccttaaggtcaggaggggaagccccagtgttctcggacaggtgaggtgggagctgcaagtgtcctgaggagaggggcgggcaggacactcacgtctgtgcacgtgattcaggtcaggacagccccccacccgccctgtgagcacctctgtgctggtccaagtgcaaagaggcccacccctgggggacgtgcaatcgcccttggcttctgccactgcacggcgacccccctgccgagtttcactggccactgaaggcaaagagagtagcagagtgcccagcgtcaccggcaggatagacccaaaagtgacacccacgttttaaaaagtgggctggtccaaatgcagtgatattgacagatcattgatcacaaccagttatagatttctttgttccttttccagtccccacttgctctcgtgcacccaagcttcacttgctaagctttaaaatgtaaaacaaaataaaaactaaaataaaagtggggtggagagtgggtctggtggaggtgtggacagggatgatgagctggaggtgactccagggtgagtgcccagagattttggtcacctggggtggttgatgagtagtttgcgagtgaagctagagtccaaagggaaggaaggatcgaggaagccggaggagcctgtggaaggaatgctatgggtttgtaaccttttaagggaatcttgagtgtagtgtaagcatggtggtcattagatgtactgattaagagggtaaatcataaaagaaattatgacttggacataaaatttaaacagtgcaaggacatgttaatgataaaacgaatgctgcacagattgtgttccctctggggagtctggaaatcaaaatcccagaagccgcctgccgagcgcttgttagcttgcaacgcgctcacgtgtgtctgtgtagcttagtgtgttcgcacttgttgtctaaccaggaaaatgaactttaaaaggccttcaactaggctttaattaagaggaaaagatgacaaaacctacacagcagcatgtcaaaattaccgaacatgaaacaggactcttctgtttagaatagcaccgagtcacctttggaaggagtgacgcccctgcgagggtgctgtgccccccggcagcatcctttcagccaacccttcccttcacgccccttttcagaagcagaccctctatttttacttcccaggggccttaaaacccacctgcttgtcctccatgaggatgtgggtgaagcgctgaccctcattccgtctctgggatctgtccactgggggcagaacatgtttctgttggaagacagaggaagaagcggtggtccgtgccagccaccttgaggagcagcctgggatccggagcatctcatgttccatttcttcttgagttttccatgcatcaggaacctgagatgttggtatttagccctgaaggtggctgtgggtattctctatgcgcttttggactttaacccaaaatacagatagcgtaatttgcagtgtaacgtctaacatgttgaactctttacatattctgtgaaggacgaacctgcaagggcaccgacttggagtatctcatccgttgtcttgggtgaggaaacactgacaactgaccaagaaatcggtgaactcaaggcctgcaaagagcttcctgagaaggtagacaggaatagtaacagggctgcctggagcagtgggggatgggcagggggtcagggtgggtgcgcagggccttgtcccctcacaggaacgagttgattgcaaggtgatgaggagccagagatgctggagaagagggaagctgttcttttgccttgggaagggtctcctcttggtcgcggcagtggatggcaccccggcctggatcgtgctagagctggaactcatcactccagccctctacctccaggcttaggtgcggggccattcagaccctgttctttgagatcaaaatcccctcttccatccaggagaacttaggaatccagcactcgccaaaatgaggagatctggaatggaagccattgctctccccagatactcactgaccttagtccactctgtcctctcctctccactgaagggctaggcctgtgacacgcatcttttttttttgagatggggtcttgttctgtagcccaggctggagtgcagtggcacgatcttggctcactgcaacctccgcctcctgggtcccagttcaagcaattctcctgcctccacctcctgagtagctgggattacaggcgtgcgccaccacacccagctaatttttgtatttttagtagagatagggtttcaccatgttggccaggctggtctggaactcctgacctcgtgatctgcccacctcagcctcccaaagtgctgggattacaggcgtgagccaccgcgcctggcctgacacccatcatttacaggtagctcccgaggcttgaggcatttcaacaacctgtccagggttttacacaaggacatgggagggataagaatggaaaatcagtctgttatgctcaaattgtcagggttaatcagtgttcattatttcatttcaaatgacatacatttttgtgatttttgatttttgtctgtgcaaagaaaatacatatactaaataaaaatagatatagtgaagtgggaacaattctgtcagttgctctaccctgtggttagataatccttaaaatagacattttggttgcaagagacaaaattatgctgatctcctgagccatggatttttctatagtggcaataggagtctctcttttcacattttgctattttaccagcaagatcaaagctgagtttcaaggctcatagtagcagcgattcaaggctgcgctcaggcttaattattattattattattattattttttttttttttgagagggagtttcgctcttgtttcaggctggagtgcaatggcacgatctcggctcactgcaacctctgcctcccgtgttcaagttattctcctgccttagcctcccgagtaactgggattacaggtgtctgccaccactcctgggtaattttttttttttttgtatttttagtagagttggggtttcaccatgttggtcaggctggtttcaaactcctgacctcgtgatccacctgcctcagcctcccaaagtgctgagattacaggcgtgagccaccgcgcccagaccactcaggcttcttgaattcaccaatttcttggtctgttgtcagcgtttcctcaccaaagacaattgatgagatactccctattggtggcattgccaccacttgaacggctctcttctgagtctgaaaatagtttgtgcttcctgtgctgcaggtattgtagcgcctgcattagcccctgaaaggaaacgtttctcttggaaacaccagtgttgggctctcatgtgcttcctccttgtatatagattggaagtgtgtgtgattttcaacttcatgtccttgagccccagacagccgcccaggcaaggccatcccactgtacggcgctcaaggacgtgccggcttctttctgggtctcacagcagggtgagcattctgctcaagtgacagctcatgatgcccggccttctgacctttagagaagagttcatccgatacaatgagagccccaaatgtaaactcacttcatttcattccatgttccaatggaaaaaccgagtcttggctgtggtggtgcttcttgtttagagaggaaccgggaacttcacaaagataagatattaataggactggatcctttgtgggcacgaagtaggggagtatttagatttgcagctgtgtgcagccatttagactagatatctgagtggctggcctcgggctttagggtggggacggcaggctgtctggcttgcccctgagatgtcatgcggcctaaaggaattctgttactattgttgaatggctgaataagagcaaatgagggcgttccttccctctgacacatagtggggaaaagtgcgtctctgcatgtccagtgccctgtggcttggccttgcagccctcatgtctacacctggggtgcccggggcctctcctgcctcttcctaggtgggtggcctctgtgtgaagaaagacaagacaaacagcatctctgtgggccattctccaccctcagcctcaggttttccaaatgccactcctgaattttctggagttttgtgtcgtttccaaacttgtttcgaagaagagctttgaactaatgtagcagaatgcaaagtggaattcttcccagaaacgaattctgtttaactctttgggtttagtggaggtgtcaagtagcttgggacacagtcagaagcacacactgtttatcgtgtggacttgggaaaagtgagcatttgggatcttctgctggtcttgcctgagtccaggcatccatgtaatgcaagctgcctctctgcgaggccagcagggctgcagagccggggctcatggtttgttcacctttgggatctgggaatacagcttcagccaatctcagtgccccacgaagtaacccaccgcctttctggcactccggggtgcctaggatttctctgtccctataggcggctcctctgtatcccagctggtggtcttactgcctcagccccattttcctgggaactgttcctcctcttccaggaatggatttcttggcatgatacttctgcctctctcccccacacaatctgaatgccacacaaggctctggaccctgaggctcctgtctgggcctgaccggacagcgggcccctccaggcatggccatctctccctttagcctgctcagccctcctactctgcctgcagccaccctcaggagcttcgagtgttcagcaccctcatgtgaataaaccagatggttattggcctgggtgtgatcccaagcccccatttcccctccagtgtcaagtggctgagtcccactggcttcagtgtaccctgaatctgcagctgcagcctttgagccaatgctgtccttggtcgttcttggtcttgtcagtattgcccctccatggcagtttctccttagggcattcccgtatccagtcctttccctccttccaggcctctccagactcatagctcactcatatcagggagccgatgttgcacctttgccctctgcactatgagaatctggggcaaaaattaaacggggtcccatttccagagggtctaaccaaggctttggacaggggatgtggtcatcgagtagtagctctgagtcagttttcccagagaaaaggtaccaatacatccagatagtttatagagatataaggatttattataaggtcttgactcacacatgaccatgggggctgagaggtcccacagtgtgctgtctacaagctgtggaactgggaaagcgatggtatggcctgaagtcctgagaactgggagcaccaggggcaggagaaggaaaatgtcagggagcgctaatacaacctccttctgctttttggttttgttcaggctctcaatggcttgagtgagaccagcctactctggggaggatggttctgctttactcagtgcaccagttcaaatgttcatctcatgcagaaacacctcacagacccacccagaaataccgtttcaccagatatctgggcatcccatggcccaggcaaggtgacacataaaactaacaatcacagtagcttagctcaagtgctgatttattatgagtggtagtatttccactgcagaagacagacgcttactaagggctgctgttcctaaatgtgtaaggtacaaaggcagagccaaaactctgtattcacggattcacggagacagtcccagtgagtgaggcccacagggtgaggaaatatgcgtgggattccgcagcacacgtaagagcccatcctatttcttcaccattgtagattcacgtttttggaatgtgcatttccaatggaaaatcgatgcttcctggcttcaacattttaataaaaatacttctggctagtgccctagtctttcattttgaaaataactcatgttagaaaattgatctattggttacattttaaacatgaaaagatccaaacactgctcagagtgttctttccctgaaagcctcagcccagactgacggccatcccctgtgctgctgagggcatgtgcctcgctacagaaagggccattgccttgtaatggaattattctgacatagcctttagaccacaccatcagctttcccaagggcagggacggtgtcatctctaggcttatcttcctggccacagcacattgtctggcacttgtcactgttcatttctcttggagatgaaataggcagaaagtattagctacagtcaagggttgcatcttcttttcagatgttcaggagatggtaatctccatcagcatttgccttactgttctgattaggtgaatactaagcccattcgagcctctctttttcatatcatgaggatggagccatgtttctgctcattaaaaaggccttttacaaaaagaagacagctatggggaatatattttgcttgctctatctgtgttaggaagttagtattcattaatcatgtgctacttctccatgtgttttgcacaaaaatcggtgaaaaatgatggctttctacttctacattcttgaagcgtgtgcattagatttttctatttcttaagggactgaaggctaatattaggatatcatgttgacttctcaagacgttaaaaccaaaagacctctgcagcttccaaatcatgcttactgatttcgggattatgcctccagcccccaaaatcaacacctataatttaaaagctgtgggggtcacattagtcagatgttagagagatgcttgtggcttgtgggttcccagattccagaatttgggctttcctcccagcttagctctgcttgtgacagatgtttaagttagagagacactaagaaaacttccaggaggagaggggtgaaatttagcagcctctttttagatgattctacctgggggagcacatcctgtctgggtgtgaaattgagagctgtgtgtttccacctgcaccacagcatccaggtgcacgctctgtgggatccctgcccgttggtggcctgacctacagaccctttgctgaaggaccctttgctgaaggctcctggcctgtggccatcaccggacagaccctttgctgaaggctcctggcctgtggccaccactgtcatacagcgctgttccttgggctggagggagagcttttgccacctcatctcccatcctgtcgacatgtgacagctttgccagcccagccacagtgactaaagtcttcagggtcatgaaaaataaccccccaaatgccacccactgctgctgtccaagctcaccccaccagcataaggcctggcttagtatggtgggacctgggcatggtgagccccagatgagctcacagatggcaggcagtctttgagggaaactttgatgtgcatgtgtgggtgtgtgcatgagtgtgagagcatgcacatgcctgtgtgcatgtgcctgagtgtgcattgtgttcatatgtgtgcctgtatgtgagggagtgtatgcatgtgtctgcatatgcagatgtctgtatacacagaaaggtgtgtgcaggtgcacatgtgcgtgtgtgtgcgtgagagtgtgcgtgtgcctatggggcgcccagacaccttggcccttccctttgtattcttgctgttcttagtgagtttacatcatggcttgggcacggctcacattctcatctccctacattagtgacatcaacacatttcacatttggcttattagccacttctattcaatgtcaaaaagcaaatgtatgatttaaaaactagctgctgacataaaattttctagtctacattattctttattttcttgaacctctcttttcctgaaatctctgattcgatgactcgtcttttctgaacatattatattatttgatgacagagagaatcaagtaattactcttcagtctctgtctttcctatgaagaactgaacatccttcaaactgggaacactaaataaaacatggtaaggagagaactgaatcacaggcaaggcaaagagagagaaagataccatgcaattgcttaaaactaactgaagcctttatgcttggaggtgaggccccagggcctcaggggcacctggaagcgactgggatcactggctcattttgattttgaaatgtggagacatgcaggaagattggagagggcaatgttccgatggccacgaaagaacaaaattgaattccagaaatcacatatcagtgaacttagcatggacaattatatttccaaattgattttttttgacagaaagcttgtgaatacttaaataaagagttcatgatccctggaagccaacacaggtgccccaaaacaggtcaggagaatcagtaggcacagcagggatgccattcagggacatatacttcagggtacagaccctgtgcttggagaagccatgtcccagggtaggacacacagttatgtgagagcacttcatctcaatgaccttggcagggcctcaaaattctccccaattcagagctcctgcagccatccttgactggtaggaattgacacttgagttgaaaccagcttgccattgctaatctaaaggatgtgcattggaagtgaggacagggtgacttgcgtggatgcagccatgccagggaaggtacagtagggatgaagatggcattgaggagacacaatgaacagcttagaatgcacagcatgagtaggaaagtgataatacctaagagtcaccaccagcttcccttgatgtgccagtactctacatgagtcccccacagtctgcgcaatgacagtgtgaggtgggttgtcttactcccattttattgatgagaaaacaaaaggtcaaggacttttctccactagtattcaaactcaggtctgtctgaatccaagtttacaatattgacattgatatgccacctctccagcattggtagggaattctgacaaggggagagaggtcaaattgtaaaagttttatacactagaaactggtgagtaattggtgatttgtgaccaagggtctttgctggggagaatcctcttaagtaagactaggtggataatggtaagcaggccctaaggtgaggcgaggacacgcagccaggaaaactgaagggagctgttgtgtttcaggcataaactgatggagatctgagcagggaaggtggccaggggaatgcgaaagaaactgtagatgtcagggccttttgcagaaaacatccacagaactgtgtgccgactctctgaagggcagagaaacagatgggttgagtaagtttactaaaatgtgagaggggaattgatgttcctgccagattggtaaacggccataccattagaagaagagtcccttattttgtgaaaattcattggctgagaggtactaattatttcagatagtggaggtaaagtgggtaagactttactctttgatcaagggtctacccaaatcttgactagtcttcttaattacttaatttatagatttttgatgaaattgagtttctgtgtgagcccccatagtggaaatctaagcttcctactgttttttttaaacattttctctctatattgcagcaggtaaccacttcctcttctctttcccttcactgcagtttgtgaatgatctggctgtttttggcttatggcacatctgggttctcctttggtccttctcaagaattaattactgttcataaagtattttgaaataatgtcagaaaatgtccttcaaggagcacagagtactttttggaacattaaaaaattctcagtatttctgcttctcacgttttgttttgggaaataagaattctggctgtaggagatggcggggggaggttagtcttcccagagtcgtgtcatcacagaacagtgttgctccttacagctgttatcccaagagaagaaaacgggagagagtgccggccacgttttgtggcttacacaagccagttgatggtgtcaaagatgttgttgagttctctggccaaaggatgttctgttttctgaaaaagtttagagctgcagaattgtttttatgctcgagtggctaaaaaaatgggacacatggttggggtgaggagaaaagccatattttactgatccaaaggaattggatcactcctgaagcaaacaaagtataatacggcgatctaagtagatagttgcatatattgaacacaaaggcagagcattagagtaagaaaccttcagccagatctcggatgtatttcataacatgtgttcgttgaaagaatataagaaaggctctaggtcttgaaaaaagaaagaaaattctccttcacatttatattcatgtattactagcaagattacaagttctcagaatagcaccaagatgaaagaggcttaccagaattattgaaaaggggatttttcgaggccacttataaaaccaacacaccaaatttggtgttgcagatgtaggcgtgggattgtcctctgtcttcagaggtgtaatacgtaaagcccatgccatgcggcgctgctaagccaaagcaaaccatgatttgtgagcaagaacttgaagattctatataattcattttttgaatactttctcttgtaatacaagcatagaattgttttcgttttcaatggcataatggtgactttgtgatgtattcatgagaattatgaagtttggaatgtgacttttattttaagattttgagggaactcctaaaggcatttcacttttgacctttatctgaaacttgtggctgactattgctgggtaataggcaccaagtgtgcatttttgttgtgtctgaaaatctggatgtgctgttcggcacagatggagcaaacacgcagcaaactaaggaccgtcagtggcttcccattggctcattgaacaagttaacaccactgcagtattttagttattttaaaaactaactttaaagaatcccaagttctttatacgtggcaaacttcatcatttggtaatggatttagaaataaaagtaagctccaaattaaaagaaaattgccaatagaaacagaaaatattcataaggaagggtaagacaggaaaggaatatcaggaagggagaatcaaagtgaattcagtaatgtgcagacactggagttcacaggacctaaagcaggtgcaacgtggacgctctctggaggtgtctggcagacccaggagaagacagtggccacagtaaggagggcagccagccctctcgatgcaggcccacgggagacaggccagcactgcagaagggactcactgaatagtagtgccaagaaagtcagtgttgagaatgaaagaaaatactgtgaaatgggcactggttagaaagttgaacaacaacagcaaaacttaaaatatgaagtcttggggagggaaaaactacctgaagcaaatcctgttaaacacttctgtgtggctggtttctgatgctaggaggttttcccctgcaagaaaagacacaagtaataagaatttggcatattttggtttcctcctataatctatatgtgtgtgtggtcctccagccccccaaaagaatagattgaatgtgtctaacacaggttcaggatatggggaactgagcaaaaaaatacattatatggtttgcacattcaaggagcttacaatcttcctggaaacactagtcattgaaatgatatcacaatgaaaccaacctgagcattatgtacatgagctcagagaaggagcccgtattgtggggaggagcagtactgggaagcatcactgagaagggcctcaggtgtggaactggactccagaaaacctcaccttccatggggagcgatgattattgatatgtatgtgtcataagaagcaaaaatagatcagatgtgcagggagacatagctggaaaaggaaagggcgctccagtgtatatgataaagattggttaggtaagtgccccccaaaagtgcatgcaaagccaagtaggtagaaacataaaaaacagtaggacattgagagcacctgtggccgactcgaaacacttcatatggaattggaagaccccgggcaaagcactgagttgggttccgcagaggagccaaccgtgacagtgggcagatgagatgaagttgggcctgagggtttcatcatagtcctagattaagggaagatattttacaggaaaaaacatgatttgtagtttgagaaaaatgaaaaggaggtgtgggacgcctctgagctgctgaaacatctaaggtagcatatatgtacccagcaatcccacccaacattcccacagtctaggcagatggagaaggtgatcctgtcaagaggcgtggctgggagaagagtggccatagtttgcaagtccaaagaatacatagaaaataaaagaggaggaaatgcccatgaagaaatcagttatgaaatcaatcaggagcatatttgttaagcatttactatgtgtggaaaatgggtatccttggggaggaaagcctttttaaaaaggctgtgaagtcactacatagtactttgcagatgtgtgtgtatatatgtgtatatatatataatgattagaagaatgaatgaatggatgaatgaatgagcacacccaaaagaaatgtctaggaagtgctttcataacctctctagtgagtccagagtattgtatgaaatgcaatgctttcaaattgtgggaaaatacgcaggtatttccagaatccaggtcacaaagaccaaagaagaatgataaggctaggaaggcagaatacataagatagtgcaaagggaataaaaatgtcagatgggctcataaaaattctgtgaatacattgtggaaaaagctaggtgcaaaatagcattggaaaggaggagaagaaaatataaaactcctgtcaatgtaggcagtgtctccttgaaactcacttcaccttttatgagattatcatttatacccatctgccacaattctaagtggctctattgaaacttactaagttcttccgagttattgggagaaaatattattctaaatacgttaacgtatgtacttctcagtgaagggggctggaaataagaaactagagttccatttgggatcattttgaaaggggagaaaaggctggggtaaataggaaagaattttttagaaactttcatcaaaggcaataatgctagcatgggttacttaataattataaaagatgatatgggaattaagggaaatgaagccaagtggagattgggaaatctgaagaaaatgaaattgcttgtttgaagtgagtgacctttaacttactcaacttgcaagacgtgggtcaaaagatagagggaggggaggacaaaatatgtccaagggtcagctctgcaaaggatggcctgagtcacccagagtgaatctgaaatgcctggttccaagagatttccattttatttatgtttacagatttaggggttatgagtgcaattgtgttacacggacatactgtgtggtggtgaggtctggctggtggatgcccatcacccgaacagcagttccgagagatttgagagcagagtgcagaccctgggaagctggaggtgggtcccacacacagctgaggaagaaaagggccttgttgccagtactctggctacgaagttatcatagtacctttgcaggagggattattatattaattagcttaaaaaccttgataaaaagatgttctgaaaagatgactcatcctatcacaggtttcaggcaaagacaaattggggaaaataaagaatggcttagacagaacatgtcagcagccagtttttaaatgacatgtttgccatgtgatatttcacagaaatggctacacagaaatgaaatgtgttaacattgatgatacagaaatatccaataaaaatagcttaagagagtgcttttatgccctggaatataactacagaggaccgtattgataaattatatggtaagatttattgggatgcaaatttcaatcatttaagctcgattaacgtactatacattggttatctaaactggagttcaaaaacccagatgtctactgaggtcaggcagataactgggagcagccagctttgtgagaaaacgcacatccctgcaaaaggatcccagtgggtccctgcttttaaaggtctgggaaggaatcagaagcctggggcctcaattttaaaatattcattcaaaaacttctagaatatggtgcaggccaaacagggtacatctgtggcccgaatctggcctgcgggtcaccagtttgcaatctctgttccaaagttaaggcacccggtatctttatactgcagagttttgaactgtgttgtatggattacgtagcagtcgtggaattaaaactggtcacaacagcaggagagcaggttcaaggccagcatttgttctgagtggctggtgtggagtaccacactgaaagtaggggtttttgaatgttattttgcctacagtcagaacatttacatacttaatggagtgcatagaaattgatactgagaaattaattattgcctgtaatatttggatttagtttgtagtaaatatcctacaaaaatttggaaccctcccatgcaacctgtataaaaacgctccgggtgtagaggagcctcagcagaggagatggatttggcggtacaacgagaatcagtcttgaaggccaggacgcattccccaggggcctaacaggaggctcatgaacatctgcagtgatttattgaaccagtgctggaaggaaaatgacaaaatatttgagtcaacaataaaacaattatgcagatgttttacgaagctctgttccactgtttcgcaatctggggtggtacacatgcaggtttttattttttaattgacttgatttttagagcaagtttaggttcacagcaaaattgtacagaaggtaccaagagttcccacgtacctcttctcgggcacacgcatggcctctcccatgatctctacatcccgcaccagagtgggtcattggctacagtgcgtgaacctgcaccgacacgtcactatcccccgtccatagttcatgctggggttcactctcggtgctgtactttgtatgcatttggacaaatagataatgacatctatccatcattatagtataacatagagttgttttactgcccacaaaattcctccatcctctgcctattcatccctacccccttacctctgacccctggcaaactatggatcctcttgctgtctccgtagttttgcattttccagactctcttatagttgtcttatagttggaatcgtatggtatgtagacttttcagattggtttcattcccttagtaatatgcatttgaggttcctccatgtctgttcacgtcttgatagctcatttatttttagtgtgaatattccattgtctggatgtcccacaggttgtttgtttgttcacctagtgaaagacgtggtggttgcccccgagcgttggcagttatgaataaagctgctgtaaacatccatgtgcagggtttcgtgtggacataagttttcagctcatttgggtaaatagcaaggagcatgattgctggattgtgtggtgtgtttggttttatcagaaactgccaaactgccttcccgagtggctgcaccatcttgtatccccacccgcaatgactgagaatttttgttgttccacaccctcaccggcacttagtattgtcactgttctgggtttcagccactttaataggtgtgtactggtatctcattgattaaatttgcattttccccataacctatgtggaacgcatttgcatatggttattttcaacctgtttatcttctttagtgaagtgtctgttaaggtctttggcccattttttaattgggttgtttgtctttttattgttgagtttaagatgtctttgtatattttggataacagtcctctatcaatcaaatatatcttttgcaaatattttctgtggcttgtatttccattctcttgaatgtctttcccagagcagaacattttgatgttaatgaagtccagcttgttaattctttctttcatggatcatgcctttggtactgtgtttaaaatgtttggtcatcttccttggggaatgagcggaaggtgacggctgcgagcaaggatttttggaagagagagaatgcatattttgcttttgcctttgaggtgctgcaacatttaagtagaaagtccctcagtgctgccatctgttgctgtggccacagcttccctcctagggcctggcgttggcacaatcactgctttatggacatcagttctctgttctacatgacagggaggttcaattagtacatccctaagctcttgctacctatacaatgttatgatctcatgagcggatactgtggctatcagtgcacagccaggccactcttggtttcttttcctgacactcctcccattgcatttctgtctaacaacggtgacgaggttggagagagctccaggggtggtgtgcctgccgcatcctttcacatatattgtatatcatttcaactcagcaggatagatgatgctgaccccacctgaccaggaggaattgagaggtgtagggagttagtgacttgctcaaagacacaccaaaggcaaggaatgcggccagatccaagttcagaccagcctcccgagggctgtgtgctttgatttgatcacctgtttctctttgaattatacgtgcatcagatcagaacatctaataacactcatgggaaagggggcttcctaaaggtggagttactgcaggtatcctgatgcctgctttccaacctgccttgaattttcattgacttaaagttgagctacatacgacgtattagagaagaaaaccatggacttctatcccattataataattagctgatgatattgtcattattcataccactgctgtctcctcattaggtattgtgttcattgggaacagggccttaatatttgcccctgtttacccctagtacttagcacattttatcttttataggcatttaataaatatttatcaaaaataagcaaatgcacaatacagtagtaacgctgtatttttaaataaaaattcatttttaatttgatgaggccctagatctttttggtctgtcttctgaagtcaggatttttgaaatgtagtgagaaaggaagggaaatgggatcatttagtgctttaaactgcagtgtaagcactcagtgtgtctcagttgtaatgctcttttggcagatgcgcgtctgcaaccctgaacaagtttcagcctcacttgactgattagttgccctcatttaaaagaggagccacatctgtgcagcactgatggacactggggtcagtctgaatgacccttctaacctcagaattagagggtgagttttccagactttatacccattccctggtgcctatgcttttgaaagaagaaagaagaaaaattctaggtgtttagttctttattattcagttgccataaacaatttaaaccccttttttccaaccagacagttaactgtaggatctgagtttggaaacagactctgtcctaggatctgtgtgtttaggagcgagctcggctgtctgaagacttcttccctgactaggtgagatatatagagacgacactgctggatggagttgtcacaagtggaatgaggtgatttaggtaaaaaagcttctgcaaaatgctgtggatggtggtctaagatgcactcagccactaacagagcctttttgacacaggtaggtcattccactgattctcaagacgaacccataatagacctttaggtccttcaaaatatacatcccgcgttagcagggaccttctccacttttctccatttcggtacccacaacagtgaccgacagttacaagggttaaatggacattgctgaattcatgtgagtgatttgccaggcccataatgccccaaaggcccagtaggtagttggatctgaaagcacttgctctctgagacatgatcaggcagccatttactgtctaaaaactctctgaaaattttaaccatgcttatttaaattttaccacacatgtgcacacacaccccatttatttccctggaaggaaggagaaggtggaggagaacgttccctttgctttaggattccctttgggcatatctggcacagaggagcgatgcctggggtccagcatcccttatcagtttccatgggcaccttattgatggtgacaggtgaagggtcggacgttctgacatcagccacatcatacttccatagtagaggtgacattccaatgtggcttcctttttacctgctcagggtgtagcgaaaagcaacttctgccttgtctcactgttgacatcttaccttactgttggcaagaaaaggattaggcaaataggaagtgactagtgttaggtactggccttcccggctttcttcttcttttcatttgtagcgaagtgtcaccattgtggaacatccatgtgtgcaatgctgagaagagttcccccccttttcttttagaggggacttatgatggaggatggaagaaatgagaattcagagagacaagcatgggccacctgccacgcccacaggtgatctgcgctacatgcatgtgctcagaagggtttaggggttgctctgtgggttgaggtgtttcttagaaagaagtgtgcaatttcgagagtgtttccacttcaattttgagtccactatatactgtgagatgcagaaaaggcagagtcagcatttgccttcttcatgtgttcacgtatctacggtctatgtgaaattacagaattattactttctctgtctatggaaaaatgtgtgtaggtatacttcattttttctgagttactgaaaaagaaaaagaggtctgacttttagttcaaagccatttttcacctatgtgctgtacattacagttcttaaaacagtaaaactttaaaggatatttctggcggagaaactttttttgttttaaagaggctatgaccagaaatttctggcctaatttatgtactccactttgatattgagtattgacaaatattacctgatcttaccccttgaatatgtcaattctttgggtagtgtacctgtaaaactggctttgaagaccacaaatacgatgagctatttaggattcatttttcaagtagttaataaaattcttaaattttgaaataacttcagacttagaaaaaagttccaaagtattcccgtatatctttcatccaaattccccaaatgttaatgtcttacaaaaccacagaacaatgatgaaaatgaggaaaataaaattaagataatactctgatctgatctactgacctttttggaattttgccctttgtcccatcggtgtctttctctgatctcggctccagcccaggattccatattgcatttagctgtcacatcgccctggtcacctctaatctaaacacatcctcagtctttctgtgtgtatgtgggtcagggcgggggctggcaggggtgaccttggcgagtcctggccagttattttatagaaagtgcttcaacctgggttatctgatgtttcatgactaaatccaggtcatgtgttcttgacagaaatagcacagaactgacgttgtctcctccttgggaggtgtgtgatgccagtttccccaatgcctgatgatgggactctgagggttggctcaggtggtgcctaccaggtctctccatgaagttactgtttttctttggctcctaatatgtatcttgtggaaagggcctttgacacagtatgaatatcttgcttctcctcttactttgcaccgtaacgtgactatccctgaggattcttgcctgaaacagctcttgctgcaacgttcagtggttggcgccgctgtctccatcccgtctcatttgttagttgggattctgcagaagggaagagctttccctttgctcccatttgcttacatgtattcagttatttacttagatcagaatgggcttgatgattggttttattctatgaattgtaatccatttccatcattgtttttcaaatcatctccaatttgttctttgggagctccttccagctggcgcatgtgtctttgtgacacgtgctgtcattttatgaacatgtcgttgctttcctggaatcagaagttccaggctcactttgttctctccctgccccacccctgaaatcagcctttctcttaagacttctggacccttctatggaaaaacaaaaatctaagttaggggggctaggcatgcccattgctactgtggtgtctttgcttctagacctaactaaggctatattctccggtgacgcagtaaatggtcgctgttagagaaatggacatctccactaagggcacagtttcggccagtgcccccagccatggcacgtgtgtggtgatggtggagaggctgtgtggagtggtggaaacactggcctgggaggtcagagacctcgttcccatctgccccaccctaagcctcagcaccttccagtgtacaaaggggccatgaaacgaccctacaatgattaaccctacaatggttgttgtgagaacaagtgagataatacaatacaagcctaaaacagcaagagaaactagaaactgatagctcttccttttatctccttttcttacccatttgcatcagaaccttgggtcctttatggcaaattacttgcttctaccattgttttgatcatttgaataattctcctcttaattagatgtagatttagattctccttccttgtagtctgattagaaaactttaagaggaaggttgcactgttatgcactaaaaacaatatttatcaaggaaatcgttaatgtgcccctactgggtatggtaggatgaacacaggtcagtttcaggtagatgaactttcctgttatttctctgaagaaggtcgcagccttcacagcagcttcacagtcttgccaggtgatctgcagtgacatctggctgatgcagaccaagtatttcaaactcaaaccaacaagcagctgtttgtgttggagtggagtgcggggtgaaggctgggggtgcgtggagaagaacgctctagtccgttaccagatctggtttcattctggcatctccctaaatcaggtcacagccatttcggcaggtatgtgtttctggtctcgcagtgccagcctcctgctgacatttcaccctgtatgtgaggcttcagaccccttcacccagctgaggaggctaacacgtttccttccttctgcttgagagttttggacctgaaatatgatctttatggtataatcacttcagaatctcatacaaaggcctcttgaggttgatggtgtccagggcatgcaatcgggatgcgccctgtggtcagctggcacctaccctgccggcaagggcctgccgtttgtgttgcgtcttccatcagatgtcacctgtgctggacacacgtggagacctagccagcccccagagacccagttccagatgcagcttaacttttatatgcctagtgtgttccaggtgcagcttaatttttataatttcttgtttctgacactgatcatcataaatacataagataaatgtaaaataacaccactattttcataattcccaatgtacttcattactttgattctgtatttcttttctacatgcctgtgaactacaggcccaatcttgcagcataattcaaaaagcgtttttatgacaatgttctctctatgtcgtaggaaaaatatgtatgcttctgattttataaaggtttttagtttacttattctacattttcctatattattaaattatatcataaacaagggtgttttaacatatgcttcgagccctggagaatagaaaagtcttattttactggcatcaggaaatggattttcttctaggtatgagttaattttctggaactttccttaaaatgctacaattatttttccattgatgtctttactgaaataggttatgcacagccctttgttagtagagcatgctgtcaatacagctggcacttttccaagtggctccgggtcatcgtggtgagcctggatcagttctccgtgcgccaagaggtgggccgtggtgctgcaaggcgtgtggaggtgcgcggaggttcggcttttgcacgttggcctcctctgctgggctctggaaggtggtgttcccactccctcctccttgggttcctttccacttctcactgcttcaaacaagtcccctcctccttgtgtctcacctgccctcggctggaagatgggcggatgacagagtcagatttgttgagcctcccacgtgccaggcgtgtggtcctggaagtcagctgatttccttgtcccagttgtgttaagaggcaggtgtcattcccacatggggtcatggacaaggcacccgggtttggagaggtagagccccttggcaagccatgcagccaatggccagcagagcacagtggcacggccagcattttaactgaggcttgaagctcaaaagcattttccctgccacaccaccctgaagtcatctgcagaagccaaatgaccaagtttttctggcacagcagtgaatgttatcctactgtcattcttttactcgacacatttttgttaaaagctcacttggactggcgaggatggttgccttctctctaaagagagcagagagctggccatgccggcttctgcatactcacctccctttccctcccctccccacccaagaaatccctgccatcttttgcattcaggtccaagctcctgagcctggcacgacaggcatcagagtgctcatcacaggagtgtgcagagccattcgtcatccatatgcctttcctggttttggactggcagtgccggtgctctgaggcaggacacagttggcatcggccctgctgaacctggccccttgtctttatatgctaggggttgactgaggccagtgaatgtcttgtatactgtaggtgcttaacagcagtctgtcaaactttcctcctggagtcaaatgtcatgagctttgtgaccactgctttccagagagtttcttttttctgtattttttttttgaggggggcagctgtgttctaggtgttgatgatgtttggagcataccctgtgaataacagatgtgcagctctgtataggatcttcatggggtttaaaatcctgacctacatattttttatgtatacataaatacacatatacatataaatatacatataataataattacctattgccctcaatgttatacaggactgtgttttaaattaaacatgtattgtgtgtcttattttgaagctattccaatgccattatttgggaaccattgaatctgaaaatcctgaaatattgcaaattttatcatagctattatctactccatgttaattttcagttgtttccagctatagatcagttttctttgtctaagtgcttcttacactcgtgtcactgaaaacctgaagagtacagagcccagcccctgttttgggtgcttggataaggggagcttactggtggataaggaaaactccagagactgagagctctttggagttttctgggtgctccagcacagggatgctttgcaaagattcctcaagcccttctgcttgtacaaccaccagaaggtgctttagagaaggggaggcactgagatgacagctgtgcaactcaggatgcacccaagacagaaaaaacacgttcatctttgtgagcttgagttgggcatcctttccgccgttctccctctgtccttcttggaggtgctgaaagtgtgcgtagctccgtctccctgcccctcctccctccactgggtcatgcaggggctccctggacaccagatagtgcgaggtccttcccctcgcctgtgtggatggtggggaggctcagggcccactgggtgaccggaaatcctttctccagtgggctcattgtgctctttgtgctctgctcagcagccgctgccctcgctgtgggtttcctttgtgattaatccttatctgctcaaaaaggcttgcttcacatttgcccttggctgctggtccctggcagagtgcaactctgctgccttatgccttttttaagtttttggattcctttcaaattttctcaaatctcattaccctgattaaacattttttcgattaaaaattaaatttctagaaaagtgtcaggaagtatgcaaataaacgctggcatgctttccacttgagagtcatcaattgcttacattttgccacattcgtggttttactgcctctccatattactcttgttttttgctgtgccatttgagattaagttgtaaaggtcatctcccttagcccctgaacatgtcagcgttagacccaaggacaaggattttcttttacgtaagcatgatacctttattaagttcaggaattgtaacattgttgcaattttatatcccatgtccagtgcacgctcactgtgccagttagcctagcactgccctgtgtgtttccccaagtcagcatctggtctccgcgacgtatactgaggccccacattgccctgcctttctttgggctgctgttcttttgctagatgagttttgagttttaaggttttcttacccccatccagctccgtggccacatttctgctagcgtgactccagggctggaggaccgggggttggcagccttctcttgcttttcctgagctaggattcgtggcgacagagttggaactactccaggcgggttgtgacacgtccgtctccccacatggagaacggtggcttgccagttccccttgcgtcccttcggctggcccggagcttggtgcgtgtggatgctgccgtctgtgagcccattgtgagaccgcacggctgaaacagctgaattggggaatagctttcagctctttatctcagtggcgatctttcgctgtgtgcagtttcccgggtgcaggccggggcatgacttcattctttaggttatgcggcaccccccgcgcgggctgctggctcagtccccctgcttgctgtatctgcgtctggggaccgccaccacccgcatctgtctccacgtggtggccatccaggactctcagtgacgacaccgcagacggttgagctgggagccctcacacacttgcaggcatcatcatcccagcaggcatggtggagtctggggagatgcgcaggaattcccgcgggctcttagagtctagtgttcagtggaaattcgtgctggggataaagaatggccctggctggagtggaatttcgatgactgccacatcatcttcaggaactccattgtattctacgggcagctcccaaacccaagactgctggcagcagaaaggcctccaggaaggcacctagtgacgtagataacaaatccgttttacgtgccacatttcctcataggatgtgcataggatctcctttcctgaaagccaggactggcatgcagctccctggtttggggttgcagccacctgtgtggagtcagttggctgggctgtgtccttgtcaccagaatcagctcccctgactctcagcgtcacacacttcctgatcccaggctcacgcgctgtgaagcctggtgaaagcacatgtgtcgtctctcctgggttcacagcctgagctgtgcgctatgaatgcgactgcacacagctgtagtttagggtgcctcaggctcaacactgtgtgagacttgtttttgactactttaatacttttctttatttagaatgtaccccacaccttttctggctttgtgatgtactcaaattgccttcgtagaattaggaaatctgcatatggaaaataaaccaaaatcgtattgcagtcggcgctttcctctttcctctttctgtgattttctacctccctacctttctttatcctttctttcatctgtctgaaaggaagtgaggtcacactccactcattcccagatcacttgaaacatttggagcctaagggagaatggagaaggcagcgagaaggtctctagcagtcaaggccgatcgatgatggtgggacggcgcccacagcccagcatcttgcagagccgaggtgggctgagctgcagcagcacttggcgatccagcaacagggaaggaggggaagaaagccctcttaagacacagtgagagacaatggggaaagtgtaaaaagcatgtcccagatctcagagcctaatgccctgggatcacgtggtgcaggggccattggccctgtcagctcaggagctccagtggccttcaatccccccatcaacccctgagtaaggggagaggaaggcaaggaaggagagatggaaggaaagaggagaaaaagagagggagaaagaaagagacggggaaggaggagacagagagagaggagagggagagaatattatttaatacttttgattcactgggccaaagtagcatgtcaaaacaatttccttctttaaaaccttttggatttaattaaagtatggaactagagttggcattctttggtagattctgaagcatgaggcctgaatgtgcatccattgaaatacattattttaaccttttacttctttctcctcctctccttccctccttttttcccttatctttctaccgtcctccctctgttgttcttaggaattattgggaatttggatttggttttgggcgcaggtaggggttaggagggtggttgccaagtttgagttttaagagggaacctgcagccaggttagttgactcagctaactccagaggacagaatgaatgattctactgggaatggcaaacagggttctgagagctgaaaatacacattttatgaggtctgcaactccttaaagtctatgtctttccctcccatgaagaaggaccagagtctgcggtcctttgacctcagaaataattaacctggactcctgaggggtgggtgtggaatgcctcctccccgttcagccttcattcctggctgggaggggttggggacgcagtctggggtgtgtgttggaaagcagtgtctcagagcaggctgggagcacagctgccgcagcagccctctcctgccaagcagtgcgagggatgaggatgtcctgaactttttcttttgatacagtttttacagatgtgttggctctgaaaaaatgctggcctacttttttcttttttaaataatagtaaacattcagctgtttaattttaggttttcctttatttacaatgaggaattcatttttacttggccctaatgttgatagcctaaacttacatttctttaaagtttatttgagagccctaataagtgtttgtaagaaatgatctataaaataatatgccatttaatgattaaatttacattttcatttaatatataattggtgaactgttactatccatacaagaggcaaaatctactttttcattcgtctagaagatagcatcaaattccattttgatgataaaaataaacacaggagctgggcatggtggtacacgcctgtggtcccagcttcttgggaggctggggcaggaggatcgcatgagtccaggagtttgaggttgcactgagctacaactacagcactgcactccagcctgggcaacagagcgagatcccatatgccaaaattttaaaataataataagaataatacgcagcttgctcattttaatgcatctttcaaagtgggtctgtaagggcgtggtggggctcagtttatcttagtaatctgttttgtgcttgacatggtaaagggttgggtggttttcccaatacttcttgattacatgctgtattctgtcttatctgaacctccgttcctgattttgaagtatttcatgaggggtgtgacatcattcctggaggccaaggccgtcgtgaattcactgcagacagctgtctctccttggtctggggtggtttgtctctggcttggactggagaggatacactgtgtattcttggctttgagttccttgactgctttctgctgcgtgggagttttccaggcatgtttggagagcggacagggttcagccagctagacctacctgcctgctctggagaaatttggttcacttgatccaagttcagatgcacaatttatggtgtccaactctggtccacacactcaggagctcctctaagctcacgaggtccttgggggatcagtgctagcagccgcctttagggcacaagtgttgatggactccttgcagcccttgaaatgaaatactggttttaaaatacagccgtaaactggaaggttatcatgaaggagacttagacccattggggaacacatcgaagtgaagcagatcaggacagctggaaattccaggcagggaggattaatcagtgcagcagaatcaggagatgcgtgtttccctgaaacatgtattgtttcactttccttcccattgtatgaactctggaccctgggggttaaaagcctgggccatgcttcctcttcttgtacagtagcaggaatgtgggatgaaaagcactccgagattgttgatctttgtgagatttttgcctaaataaaaagtagaattaagagggaggaggaagatcagtaagatttaaaatcccatacttaagttacgcacatgaaaggaacttctgaaaaatgcttttgccttctgatttgctctaaatatgtgtcagcttccagttggacagtttaattaccaccactctgggagggcagacgcattttgaagtagtagctgcatttttcatgttgtatactgggaaggctgatggtggagggtgagggcgctgggtcctgccctgggcggtctcagccccccacttgctggcgggcaggtgcagggcaagctcttggccttgcagacctcgcggtccttgcctgtgggactcaggcagtgacccccacctctcggggtgcggtgaccgttaagcaggaatctgtttctgaagctcctactgcacacggggtactcaaaaacactggtcctctttccattcctcccctaatgtggcgttgaagaaaccacactccacccagttaaaccctcagatggaagcatgggcctcctgcatgtttctaaattccctttaaataggacccagtgtttcccagcttcccgcccggtcacagctgggacccacctgccctgtgcccacctgccctgtgcagccactgtgtgctggcctcgaaatgagtcactcactgtcaccgggggacagccggtgtcccggctctgctctggccttgcagaagctctgaatgaacaagtggcaggcactgcaccaggcccggggtggcagaggacgcagagtgtccttaggagacaatgtctggcagagcccctgcccctgcgcggcttccctcactgtctccacctgggcagctcacaggaagcgccctcagctctgatgcaaatccccagatggcttgaggaattccccttgggtgcggttccctgggcacagcaggatgtgagttctctctaggagggatggaacctgggcagtccatcgcttctgtgtcttccttcttatcttcagtaatttgaatcttaaattttgaggaactccacttgatctaaaagctagggagcccttgggctgctgggaagccacagaagcagcactggggtttttgctctccaaatctaaacagcggtagcacttcaggagaacgcagcagcaaaccagtgagttagcaggctcccaaatccgagaggtggaaaggaagcaacttcaaatgttgttttgagagaatccaaaattgcccaagagctaatagcttggctgtggaattccatcagaggcagtcccttctgggtgaagttgtgatgggtcggggggcttcctgcgccagggcggtgtgtgggggctccattcccccttcctggggagcaggctgcctcttgtcctctcctgtggtgagctctgctgtgaccacattggggctgtaaggggagttcatggaattggtgaacaaatctttttcacatttttaaaattgtggtaaaatacacataacagaaaatgtactattttggccttttttttttttttttttgagacggagtctcgctctgtcacccaggctggagcgcagtggcgcgatctcagctcactgcaagctccacttctcgggttcacgccattctcctgcctcagcctcccgagtagctgggactacaggtgccctccaccgcacccagctaattttttgtatttttagtagagacgaggtttcaccgtggtctccatctcctgacctcgtgatctgcctgcctcggcctcccaaagtgctgggattacaggcgtgagccaccgcgcccggcccactttgaccatttttaagtgtagagttcaccggctgtgagtacagtcatactgttgtgtgaccgtccccaccatccactccagaactcttttcctcttgcaaaactgagactcagtacccattaaacagaaaaaaaatgtcatactgtatgtcagcacgagaggcatgcattccgtcttcatctctagaaagcttgggccggagatggccttttgtaccacccttgccgtggtgacacttggttttagttggctgtgactactagggatctatgagttcagtaagtcacaagcctgtcctgtgtggagaggttacctgtaatggtgtgatgtggtttcactgtatccccacccacatcccaccttaaattgtaataatccccacgtgctaagggtgcagccaggtggaggtaattgaatcatgggggcagtctaccccatactgttctcctggtagcgaataagtctcaagagttgcgacggttttataaatgggagttcccctgctcaagctctctagcctgccgccatgtaagatgtggctttgctcttcctttgtcttctgccatgattatgaggtctccccagccatgtggaactgtgagttcattaaaccttttttctttataaattacccagtcttgggtatgtctttattagcagtgtgagaacagactaatacaggtggcacggagcagagatggcacgagatagaagaatggctcctgacttcagagtgaatgagagagatgtaagattaggttgcctggtagcatgatccatgtacagcagccttcagagtaacggggatgcagctttacatccattacgtaaagaaggaagagcgtctgggaagctgatattttggctgtggccctactatgccatgcatgtcagccgactagtccacctacagattcaactattgcacaagaacagatgcagagcccggaggagaaggcagcacttagctcccacttcctttcttggtctgatttctgtgaccattaaattaatataattaaattaggttgactgacctatttctattttaaattagaatattttaccatgttgcaaacacgttcttaaaaatacacttttagtttcacttgtttttatgaaccagaaagtccaaaaactggacaataagctcagcatagtgaattgttccagtaaagattcgctctggtttttgaaaaggaaaattcatgttaagccagtttcctgtctagtcagcagagtgcaacagaagaggaaagatggacaatgttgattccttcacctccttaggctaaaataagatttcccatcttgtgttttgctccacctagattttgtagacacgcttaaaaattttttttaagtagtattgttaatgaaatactttcagtttgtttcagatttgcacaaagtttagaataaatatgtcctgactggagagtgaatcatgcaattagtcactggactgagtgagttagaaccacctaattagggtcaatgagctaaaaaataaaaataaaacaattaaggctagacggaagaggaggaaatggtgactttttgaaaagaaaacaaggtctggagagtattgccttaaaaaggtaaaatgtgcaaattaacaagatggaaaaaaccattgagtgtggttctgaaaactgagcaaagggcgcacgcgtcagaaatggctttggaagccaagggcctcactccagggaccgggcggccccgtgtcatctgaagtctttgcatccgcaaaggatcccataggttgctcaggatcgccggtgaatgagatcctcaggttaaataaatattttggtgacagatcaaggctgcatatatctatcatacatgtattttccacttttaatgctatgaaatgcaatgaaagacatctaatattaaaactatgctgaacttattttttgaagatatttaatgatttaaggatttaaaatatatatattgtgggaactacagtgtatcagcttctttgcatagtaagactaccaagagctctagttaaaccgaaattgaagtcaaagcaacaaccaaaaagttaacattgtttattaccttatttattaaattatcatttatatcacctggcaatttcagattgactattttttaataaagaggcacatagttggtgtaaatagatggaaatacattttcaaattcaaaatatttattaccatttaaattttcttttctttttttttgagatgaagtctcactctgtcacccaggctggtgtgcagtggcatgatcttggctcactgcaacctctggctcctgggttcaagcgattctcctgccttagccgcccgagtatctgggactacaggcgtgcgccaccacgcctggctaatttttgtatttttttagtagagatgggattttaccatattggccaggctggtctcgaactcctgagctcatgcgatctgcccgccttggcctcccaaagtgctgggattacaggcatgagccactgcgccggcttaaattttattttcttgagtgctgcccggttcactttggctccacgtgacttctgctcatttaagcttcacagtatgtggtagcaaaaggttttctagaattttctggatgttaacatgcttaatacaagttctttgtctttaggaaccatatttctatttctacaaatctcatagccttgttgtattgtatgcactgtaggcaatgggaaaataagtattcaatgaatgtcagtgagaaaagaaagaaacgagggctatttgtgtattactcattcaaatggaaggaccagggacatggaatgaattatattttccatattttatgtatttcttatttatttttataataaattatgaatggtttaaggctgctaaatattcttcttaggttcctttggaaaaggcaagagttcctgaagttgtagcacatttcaatagctacatagcattacgcttgtcaattaattagaccatttggcttcaagagttgctggtaaactctatttatgtattctcttttttcatgtcttaagagtgagactcccctctcagggttatagtggggaagtgtggtttggaaaggaggcctcaacatgcactgaccttgtacagttaaccacagtgtctcacagggtcctggagagatagctcttggcaccctctgccactgttcaaataccagtgtatgtcattgagagaccatggctttgaccagcaaaagttcaacttttctctgtggtatacctcagtttttcttctttaaccacaaatgtacttgtgcttttaggtaggtcctttggaagtagcacttacggtttgcagagtagcatttttggtttaccagccgttatcttccatattcttatggagagttttagttgctgttgtgctcacatttgctcatggccttggaaggatgtcgcatggaagtctcccagatggatctctgaccacttgtcaaatgcagagaaggtttgccgcaggatctcttccacatgttcgttattctgtagggtttgttatgtgcagtttctatttacattatgtttgagttttcaaacctggttttaaagatacaaatcagataatattatccttagaaggtgatgttttcaagagtgatttctttgggttttgggaactgtgcagcagcatttcagaatctatcttttataagtagtataaattcttccatttatttttgaaaagtggctttgcaagtgagtgcagttatgaaaactacactttagtttcattctggctggctgggattagtctaaacatgaagatttttttaaagacatgtctggtgtctgacaaaagagatgaacagctatgattgctatcatagagactatttaatagtccctctgtgaaatggaagtaatattaaattaatcaatagaatgcatttgttgaatgcatagtgagtgcgtggttagatcctatcccacaggaaagaatatctatttgctatccttgttgctgaaagtatcggatagacccccccgccgccggtctggggcatgaatagagtgtagctgggttaaagtggatgcaaacccctcaccccatggccgacctccgcatttccagttgcacctgtaaatacaccagggcttcaaccctctttaaacttcccaatgttcttcaaactccctgtgcacgttctcatttccatatttggttcccttgctttctctttctggaatttcctcctttgctttcccgggcactgacatcctccctgtggttctgggctctgaggtccagttcacctgctccctcgaggatgcacgttcacagtgcctgctggttcctgacagggcagcaccactcagcaagtggccatcctcctctgctgtcttcacctcttcctcccgagtatcatcctcgtccaaaaccatttttccttctccagcatcttgtaggtttgttgcaatcatcctgtggagtcatttagtttttttgatgtgtttttccccccggactagaatatgcccgaaggtagaaaccacgccctattcaccctgtcgcttggggcccaggacaactcttgaacatcttaaacattatataggtgtcttgtctctagccggagatttcatggggaggaggctgaaatgttaggcaagattttaaaacagttaggtatgatttaatagataagaagaacatgagatatacagcgtgatttgtagaataaaaatcttcacataaaatttgtctaattgacagtagaattaccagctaagaaaatgagacctattaccttctcctgtcataagataaggtcagtcacagtcttttctttcctctgcctccttccccctcccttcctgccttccccctcccttcctgccttccccctcccttcctgccttccccctcccttcctgccttccccctcccttcctgccttcccccttcccttcctgccttcccccttcccttcctgccttcccccttcccttcctgccttcccccttcccttcctgccttcccccttcccttcctgccttccccctcccttcctgccttcccccttccccctcccttcctgccttcccccttcccttcctgcctgcctgccccctcccttcctgcctgcccccttcccttcctgcctgcctgccccctcccttcctgcctgcccccttcccttcctgcctgcctgccccctcccttcctgcctgcccccttcccttcctttccctcctttccccctgttcctggtggaatcaccgttctttcattgggaaacctcctgtcttcccctcatgacactgaattggtccttgagccatgacctgcctccctcccttgcactcttctcccgccttcttgcggctgccctgctctagctcccatccccaagggcaaggacgtccttgcaagtctcctcatttcccttccctcctcatgctaatacacttgacacaagtctcacagatgaatgccaccaaaatccagcgaatgggataggtctccctcatctctaaacttttagaccctacccaaggcctgctagaaaatgaggtggaaaacacttggccttttgtgggcacaggcagctgccccaccagtgtccttgcagcactctggccttcaggcagccctgtgcagggctgaagccgacacctgggctgttctgctggcacacagacctcctccgcgggaagtgtgctcctgctggcttgtccagccaccttccttgtaatgggcttagcgtggtaggggccacagcttctctcctcttaaccagcaagctccttgagaacacagctcatgtctaagtcatccttcaccctccagattgcaagtacagtggcaagcacatagtaagtgctcattaaattgctaccaagtgagtaagagtagcaggcctgttcagttgcatattccccagttctgtggaaaaggagggcttacctaagtctgctttttagaagaggaatttatctttttaggatggggacacacagagaatggcaggaggtcatataatttgggttacattccaaatctccactggaagagattagtgatgtcgctattctgggggagaagatgagcacaaaatcagcaatgatttaaaatatttaattgtttaaggaaaaaaagtggtcctactgccaccactggttttactaaactctgtttttgagttgcatgtccgtcatgcttgaaatatttcactagtcacttaggcttttcatgtttccttttaaagtatgttacaaactgtagggctccttaaagggtcagctggtggaacgcagtgggataaatagaacatgggcgctgctgtgtcttcctcagagcaaagccaccctcccgcttctgtgctgtgtatcacttcccagaggcaaacggagccctcatgatatgcttcaaagagagttctgttgatgggaaaactatctgcatactccctcttgctagccgtccagtaaacctatggatcatggcattaagctagaccatttgtttggaatttctcgcttaatgtgacaatatgcagtgcacttcctggaccacagagggatagacagcagctgttggctaagtcatcctctgataggagctaagtgatcctctgttaggagctaagtgatcctctggtttcaaacctagacccagttgggagttcttctgaaggctgagtgcagtaaaggttgtgggtggggtcagagggcatggagttttccatgtgtggtatcatgttggcgctcaaaaagttttatattttggagcattttgtattttggattttggggttaggaatattcaacctgtagcgcatttcttttacaaaccttctcctactccaattaatcatgttgatgggcatgaagacagcacattatactttatatatatacacacacacatacatatatacgtataattatacgtatatataatacatacatacgtataattatacatatatacgtataattatacgtatatataatacatacatacgtataattatatgtatatgtaatacatacatacgtataattatacgtatatgtaatacatacgtataattatatgtatatgtaatacatacatacacatataattatacgtatatgtaatacatacatacatatataattataagtatatgtaatacatacatacgtataattatatgcatatgtaatacatacatacgtataattatatgtatatgtaatacatatatacttataattatatgtatatgtaatacgtataattatatgtatatataatacatataattatatgtatatgtaatacatataattatatgtatatgtaatacatataattatatgtatatgtaatacatataattatatgtatatgtaatacatataattatatgtatatgtaatacatataattatatgtatatgtaatacatataattatatgtatatgtaatacatataattatatgtatatgtaatacatataattatatgtatatatacctaattatatgtatatatacctaattatatgtatatataatacatacatacatatagttatatgtatatataatacatacgtacatatagttatatgtatatataatacgtacatatagttatatgtatatataatacatacgtacatatagttatatgtatatgtaatacatacgtacttatagttatatgtatatgtaatacatacgtacttatagttatatgtatatgtaatacatacgtacttatagttatctgtatatgtaatacatacgtacttatagttatctgtatatgtaatacatacgtacttatagttatctgtatatgtaatacatacgtacttatagttatctgtatatgtaatacatacgtacttatagttatctgtatatgtaatacatacgtacttatagttatctgtatatgtaatacatacgtacttatagttatctgtatatgtaatacatacttataattatatgtttatatgatacatacatataattatatgtataatacatacatacttataattatatgtataatacatatatacatataattatatgtatatatacatattatatgtatatatacatatatacattttgtatataagtatatataatatatacaattatacatatataatacatatatacgtataattatacgtatataatacatatatacgtataattatacgtatatataatacatatatacgtataattatacgtatatataatacatatatacgtataattatacgtatatataatacatataattatatgtatataatacatatacgtataattatacatatataatacatatacacatataactatgtgtagaaacatgctttaaaattaaatgttattataaatttggagattgtagatggaatagattaaaatgtaatttatttggctgggagtggtggctcacacctctaatcccagtgcttcgggaggctgaggtgggtggttcacctgaggtcaggagttcgagaccagcctggccaacatggtgaaaccacgtctctactaaaaatagaaaaatcagccaggcatggtggcaggcacctgtaatcccagctacttgggaggctgagacaggagaattgcctgaacccgggagagggaggttgcagtgagttgagatcgcgccacagcactccagcctgggcaacagagcgagactctacctcaaaaaaaagtaatttatttatgattaggaattaataaagaagacacttatgcccagttgttggaatttctgtaagtcttcccgtaaatgtgctatcacttttcagacagcaattatagactcctttatcagagtcagtgttactgggactaaggagaattaaggcggagaagactgtgcctctgctgtaagtcaggtgtgggttcaaggtctttatgctctcaggctgtgcggccaagatctgaaaagttaaactcctgtctgcctcaggaatgtgctgtcttaattctgtaccggcttgcacctgtgcctgtctggcagcctgttctcgccgtctttccctcatcctgggttcttcctaggtgaacagccctgacttttcgcaactcagctgaagtgtgccctaccttgggggtccccgagtccccctctggcatgcccgtgagtctctgctcacctcccttgcagcccacgttttattgtaatttcacctttccttatccagcttgctcacacactcagctctgtattcttagcactggggggtgcctggcccatgcaggcgtgcagtagatgggaagtgaatctcaccacctgttaagaaaaagataagtatgactgggcactgccaggagctgtgaaggagtgcctggcacaggcctgctggtgcttcccctgccccacccactcaccctagtcttgggcatggggccttggggctgtcttgcgtgggctgggcttgggagtcagatgttgaaagtgaaggcagaagcccacatggccggtgcaggccagggtggcaccagggtgtggaaggagtaggccatggaagatgaaaaccgggaatagctgggagaactccctgcccttcagcacagccgggagccgcacagttctccaaagctggaagaaatagtccaacgtcttttttcgtgcctgtctgggtaaaatttgctgttcttcaaagggtgcctgtaaaataggcactggtggaatgaaggggttaaagatgaaagttacaaaggatgggagcagggctggtgggaaaagaatccggggaaccgggaagagtagctaagagtgacaactctatgggtgggagattccttctctggaattagggagtttgagtttcattgagagaacgaaatgtctctcaagtctacatatttgcctggagctgacacttggtttgggaggggctccgtgggacccggatgctggggacgcactggccttgccccactgtgctagtgcgtcaggccagtgactcacaagcacgggaaggctcgccccaggtcatgcctcccaacagtgtttccacccatgggtcccagcagacacacacgaagcccaccaactcatttcacacacagccatccaaggaaccactgacccatggcaactaatcatactcacatctgcttgcagctggacaaagaccaatgacctggaggtgaagtgccggtcttcatggtcattccctccaggccatcctattccccaagcaggaacatttaatgtccacccccgtttagtgggaaaaagggaagaaaagaagtgaaacatgagtcaacaaaattatatgacagggaaaatgagaccagaactttagtcacatgttgttcctaagagaagccaagaaaacaccctcatttcctcaaggcgtgtggtttcttgggagcctttctgccctgcaaactcagtctctaattgagaagcagaatagagcatgtacctcacatgtacaaatcttagtcatactacagcacagagagagacatgttacatattagaaattcactgtttctcacattttttgtgcttttttttttttttgccaagaatgtatcaactcttgttgttttcaaattagggcagaaatattgtgtaactctaaacagtagtagggactgttttgtttctatgtcttccattattaaatggaacagaaatattattttatttacctaagttgtcctttcaggggagttaatgatgaataattattttcacatctttgggatcacatctatcttacattagtcaaaacaaatgatgatgataataaaacaaatgcagatgaaagcacaatgattttgagttctgtgagaataagggagagaagttaattttacctttaaaaccacaatactaagtatatttttggaagttgaaaaatgttatgcaaatgtaagcttttaagaaatcattatttgtactacaacatttggcctatattttactgttttttaagtaatttttaaatgccatggacacttttttggggagctaattttattgaagtttatcaacttacagaaacatatcaaaggcgaagggtacagctcagtgcattttccccaaagtgaacatagcagtgaacccagactacggaccagaacattaccagaaggcacgaagtccctggagtcctcttctagtcagtagccctcacgagtaaccaggatccaacgtcatcttgttcggctttgacttttacaggaatggagtcacccagtttgtcttcttttgtgcctgcttcagcttgctgcgggtgctgtagctggcctgccctggtgtggccggggactcccttccgtgaatataccccatcgtttctcagtcccttgaactgtttccagctggggcgattgtggatagtgctgctgtgaacaggcttaagcacgtccctttttctcgaattttattgaaatacaacaaagtgcaaacatcacaagtgcacagctcgatgagtttttaccgacgtatacacccgtgtagtcaccgcccgcaacaagcaaagaatgtttcctgcaccccagaaacctcccttgtccctacctttgccacacccccgcagaaggtcatcacaattctgacttcttttccccatagacagatgcctccgttcttgaatttcatatgatgggatcatacagagtgtgctctctctggagaagttttaagattcttttttagggcattcttgggccctgggggtccatggagctggggagagccattttgcagagcctcacagccaccgcggttaaaacaagcgtgacacaagcagcacagcggcaaacaggacagaagctagaaagtccattctccacgtgcagtctttgaggtttcgctatccgaaaaaagtgtgagtgcctgctgcatctgtgtgtggttatcttttattcaccacaccagcattttgtgtgtgtgaatgaagtggaatttaaaataatagaattgaggccgggtgcggtggctcacacctgtaatcccagcgttttgggaggctgaggcgtgtggatcacttgaggccaggagttcgaaccagcctggccaacatggcgaaatcccatctctactaaaaatacaaaaaaattatcctggcgtggtggcccgtgcctgtagtcccagccactcgggaggctgaggcaggagaatcgcttgaatccagatggcagaggttgcggtgagccgacgtcgcgccagtgcactccagcctgcgccacagagcgagaccccagcaggacgtgatgaaggtcaatggggttttgtccaacttgcctcagttggagcaacgtaccagtgcgcccctgccgtgtggccgtggggcttatccctgggagtggaatttgggggaaggagccggggccaggggccagggcccagctacagcggaggcggctgagcgccttccagagggttgggaatgtcccgctcgcaatcccgccgggagcgtgtggggcccgcgcttgctgcgtactcttaattctgcccaagtagccctaagatacagtctcttgcctccatacgcttatttagttgggtagggaattatttaaaagactccccgaggaagtgctgcaaccaggaagagccctcgacggcagtatcaccaggaaagtattttgacatttttgcacagcatagggaatgcgagaaagaatttgaaagataagctgtttagacttggcagatctccacatgtccctatttggtgggatgtgaaacacataaaaattgtgaaagctgcgatgttaaaggtctatcttccatcaaaagcaggaaaaaaaatcagaaaattgaggacctcatcctgtttaactcattccaaatatgccttcatcagaagacatgtcccagttaaactgtataacactgcacccttctcccctccctccctccctccctctctctctgccacacacacacacacacacacacacacacacacacacacacacacgagtagcatagcagctggtattcttcggttcagttaaaaaggcattctgtaaacagaatgagtgagctttcctctttttgcatcctctggaatggaattcactgtaatcttgagaagagcgccctcttggtctgtagatgcgagaaaaccagaaataggctttatttcttattaaaaccattgacttctcttcctcccctttcttctttggcactcgtactgtgtattgtaaaatctttgtgtattttaagaacttaatatactttataacgtgaatactgatggtggatctctgaatatcttaattggagcatgaaagaaaagtttcacagtattaattattttaacatatcctgaaaagtttaagagacttttagagaatataaaagatatttggtttagggattactttgtagtaccttttgcattcctttcatattgtattttttgttttcgtttaaagctgatctctgctattgaagttatgtgtgcgtgtgtgtgtctgacagagtccactggggactattattattattttcttttctgtttcaaacacagttaagtcagtttggcttccatttggagacaacttattatactctgtaggccacatggtctatggggaagaggctaaaaggactttcaaaactgacttggttttcattaagtttgtctacagttttaggagtataaataataaattcacccccaaccccaagagctttctagggtcctctttttccacattggtctggggtacctgtgttgctgttgtccatggctggtctgcttttataagagagaccgagacccccgcctttctttcctttgagaactcccagccatattccccgtcttccaagtggagactgccttcgtgacccactttcatcctcatgaccactcgggttaagtgtgtgcctcacaggagcacaacacaggcattgctccaggaacttggaactcattgaccctagaacaccaatgaggggaaaaccaggaagaggatgagtaccgcacagaatgtaccagttcttcccattctagaatctgaaacagatggtatgggagcttatctgtagggtcatccagacaccgggagaatgcagagccctcataaaggccctcagatatgcagccagcagggagccggtggagtccaccagtctgcatatagctttagatttttctgggagtccagatgcaaggtgtatttcctcaggaaatgatgaaatggtgacatagcttttcacatgtcaggtcaccaatgaaattgtgaacctgggtaacctgcattatttatgtaccccttttaaacacagtaatttacaacagtgaattaagacttgcattacctgacttttattttaattcaccatttgaagcttatacattacacctgagtgaagggggtactcaggtcatcctttgtattttttttttctttttagcagtgaaccattgaactgcagctaaaataccttcatatgccagggtgaaacccagcacgggcccttatatgacagaaaggaccagaatagtgatattttaaaatagattttatttaacaaagtaaacatacatcttaggatatttgtttgtcattcttgtcattctaaaggctagcttttttgttttttttttttaacaaaaccatttacataaaatgctaggccacccagaatgtgacacaaaaatcatgatcttagacatcttttgttctgaaaagctaaccctaatttagatatttttggaatgatcaattttttagaattgataatcaaattccctacacacataaagccatgcatgtttttggtccaggattaaaaaaaattacttgcttatgaaaaagcgtaaggtggtgggggaaggccggggtcgggggtcagtcctgtctcatctctgattttccccagtgttccttagtacctgaagtggtccccagggtaaaactacccacccgcctgtcaccggcaccggctgggggtgtttctgtaccaaaagcacaagaagcgtcttgacccgagggtccacagtcacagccttgcagcctcttatctgcagtcccaggcaatggaagcattcacggatggcttaagggcccagttccaggaaattcatttttataacctccctcaaattgcagaaagataaagcttctgagattttatcaacctttcagaaaactccagatcaccaaatagccattttcagcttcaatcccttaaatccctgcttaatctgctctttcccagaaagcagcaattgactcacaagtcgaaaatccacactacttcaggctggtgttgagtttctgccagctaagcccagatgactgctggacatttcctaaatggactctgcagatacatgagacttagcctggtgggttttccttttggtatctgtaggagggggatgaaacactgcagagtttaaagaacagagatgtgtttccaaacttggctcaaacgcaaacaggttgtgggcagtggcataatcccagcaaagaggctgccccgaaactccagggacttggagatgacctggtgatggaatagctggtctggacggctccaggtgtcaggtgccagatgccagcgcactccccagagtccccggctcttccctggctactctgtgatctggagcagtcaggtaatcattgccgagttccctgtttggagctttgtcccacagtgctgttgtgcacgaatgcactgtggttgaggtgcgcggtgccactggatttccatctacagttgttacttaaggttgcttagatgggtaacaccagtaacagcaccaagaatacaaccataattgggtactgatttcatcaattctaagatgtgcatttattgatgttttaacaactctggaattgggatagatctaacaattgataatgtgtcattgtttaattagtacccttcttgatttcttagtatgggttttacaattggtgtcgtcttagatgaagtacagctcacatcaggctcaatgctacgggagcctggtgtgagctgtatgtgaggctgcctccaaagcactcagggtgtaccggggagacacagaagtaaacaacgagaaacgtgataagcctgacaatagagacatgcagtcagcaattcgcaggagccaggtagggagcaggtgaccctcacctggggattagacacatggtagtactggctgagttaggtacctctggtgaggtctctcagtactggtatttgtccattttggaagaacctcctggagcacaggttacagattttggcctcatctctttggatgcctctgagtggtcaccaaaacccagattatgaagcaaatctgtgcacatggattgatttaaaatgttaggaggttatgagagtgtaggctgaaaattgcctaaaatgtgagtcagagaaaaacacagacctatcatctctggagtttttttggactgttgtcagctgtccccatttccaaaatataaaattgagaacagcttactgtcttggaggcacttgttcagatttagctttacaaaataaatatctccagatgtgattgttttatgcaggcgtctccatggcaatgcagctgaggctggaatatgttgttaaaaatatacactttgcatgatcacaatactattagtggcatgattttattttcaggaaatgataatcacctgaagtagaatataagtaaacattttatatcagacttaaagcagagcctctaataaagcttattaacccgattattcatctcatacctctttacattctgtccacaatacctgtgtctgtcatggtttaaaattgggattcttctaaggaaattgcaagtgcgtgtatgtaccgacgtatttctatcttttcatgtgatgacaattttacataatggaaattgaagttgggttctaatttcaactttgtcctagcgtgttataataaatcttctaattcagtttccacatctgtaaatggggatggcactacctatcttgaaatgcttgttatgatcattaaataagatgatcgctgactgtgcgtggcacctggtaagcgtttgaacacgtggtagcttgcttcctttccagcttttatcacaggcttggattcatttccttccattttaaaagttaatttttatgttagaagtgaactacaggctgggcacagtgtctcatgcctataatcccagcactttgggaggctgaggcgggtggatcacatgaggtcaggagttcgagaccagcctggtcaacatgatgaaaccccatctctactaaaaacacaaaaaattagctgggtgtggtggcggatgcctgtattaccagctacttgggatgctgaggaaggagaatcacttgaactggagaggtggaggttgcagtgtgccaagatcacgccattgcactccagcctgggcaacaaaagcaacactttgtcttaaaaaaaaaaaagtgaactacaagaatattttgttgttgactgttctttaatgtgacgttcaagctttaattgaattcaaaaaggagttctttaagattggggcttaaaaatcagctcattcctttattctgttctgtacaaacttttttttgcgcggccgtgtgtccttgagaccacgtcattgggagctctcagcctccacggtcttaggtctgacacctctaaataagaagcatgacatttgggtagctttgcaaatatgggtgttgccctgttaaactaatccccgagggagtcaacttcaaatagaaattaacaaagggcaaaaagtataggtgacattgttcactttttgggctgagtaacacttgggatttgttctactcaaggatttttttttatctatttgggcaggggatctgcaccctaagtggaactgcatgacagccccatgaaaaccagtgcagataagattgtgtccgaaggacagggcaggcttcgctcataaacaagtcaagatgccagaaccatctccatttgcatagtgccctcgctttgaaagtgttcttctatttaaagaagttttcttttccttccagggtggctgtgctggctctggctgtggcaaatgtgactgccatggagtgaagggacaaaaggtgagttgccgaaatttaaatcacaacatttctttgtgaattggacagtaagtactacattaacagtaaccgaataatcagcaattcaggtgaaagccttattactgttttgataatttccccagagcaatacaaatgaagccaaaccaggcttgacattacttctgagtagtaatattattataatagctcttctccaaagaatgtaatagtatgtggcaattaatgtagaaaaacatatttggtttattttcctttttgactcttggtagaaaatctgttgaatctatcgtactttttcgaattgatgtataagaactaattttaacatttttccggaaaaagaaactagttcctattctacttgaggaccttctcttcaaattagtatttttaaaccatcttttaatccatcacatgcttgtctagatttatttataaaaatattgcttgggaaacttagtgtttcccaaatgtaaaattaaaatgtatttctttgcaagcaaactgttcccctccctttcatttaagaaccagggctccagataaagataagtttctctggaaggcaagttgaatctgtgcatttcagttggttggaaagagggtgcctggctgtttttttatccagaaaacagtgcagcatcctggtactgtctgtgggtcaccgtggaaaccaggtgtggctgtgaggaaatgccaccaccttaagccactcagcctttggtgcaggtgcgcacagcaggttgggaccctgtagaatggagtggatactctgtaggatactgtttccagaaagctgaaggtgtcattctggctagcgtgtgaattcttacttccctccccggcatgccagaggttttatggggccacagactgatgctttcgaaattcagcaaattctagtttacagaaaattctgtggtttctttttgactatttgctgaaatgccaacattattattttaaaaaatatgcctgataggtgatggcactagtgttacctggatagtttttgaatgaatggagtatgtaaggaaagtttcacatcttttcatatcaactctaatttatcttcatgctctgctctcttactttggatttttctagcgatttccagtgtgcatgctcaagagttattttaaagtagacgcaagtgtttctcatgccacagacattttgttaaaaacctaacttgaaatatacaagtgagttcaccaaactcataaaaatgtccttaaaatgataaaatggagaactttggggtcccaacaaagaggaattaaggcctggatcatgattacctctgttttccatgtgactttgaaagcagcagggctggagccaagttggccctgctccctcctagggacagcagggttgatgtccacctccatttccatttgcttctgtccagccggcaggccttggcggcccctcctggctctggagctttacatactttcttattctatccgcatctataaacttatatatattttttaggccaggcatggtgggtcacgcctgtaatcctagcagtttgggaggctgaggcaggaggatcactggaagtcaggagtttgagaccatcctggccaacacggtgaaactcagtctctactaaaagtacaaaaattagcccagcgtggtggcacacacctctagtcccagctgctcaggaggttgagacaggagaattgcttgaacccaggaggcggaggttgcagtgagccaagaacacaccattgcactctagcctaggcgacagagcaaggctctaactcaaaaccaaaaaccaaaaaccaaaaaacttgtaacttttttaacgtaatttatttcagtttttcccaaaaatccactcatcaaaacatgacaagggagaatgatagggtgtagccttccctacctgtcaactgacatctccacaacctggtaacacccctcagagccaagccgcttccactccgagtgggctacacatgtgtggggaaggcaggggaggcggtgtccagcacctggcctgaaggaaaggggccgccaacatttcatctcaacattgcccaaggaggagcccttgctgggggtggccccctctggccaggcgaggtctgtgcctgtcctggcttggagcctgcgtggggcttgcgccctgcttaggacaggaaggcagagaagtgtggggccacgtggaagttgtgtcccgagggaggctccatgccagcttcctacaggggccagctttagccttgacactgggagtcagcagagcccgggccaggactgggatggaaggagcaggatcctgctcccctccttgtgtggccttagccaggtttcccaccaagggacctaggccagggagcccagcacctccaggacttttttggcctgacctgctcctctacactcctgtttctccattgccaactttggggttcttactgtttttttttaattttttttaattccataaagaacatttaaaataaaatgctagcaagctctaccttagaccattctgaatttgtgatttaaaaggcaatgatgattgaatggattcagaagacctcttgaagtctaggcctaggacaatagctaaatggtttagtattatatcattttaacaaaaatggagaaggtctatttttttctcatcttgagcataaacatttcaggtcctatggttcacacagcattgagaaggggaaagagcccttcctcccactgacagaggaaattttaaacaaacttccccttattgtcttggaagtcctgttaaaataatcaatttaatgatgtgaaatgcctcagcttcactgagctagggtttccgatctggttccctttctctcatcccaaagtcagctaagaaagaaatgtactctaggctggcaggtcaagagaagaagtggatcttcctcagtggctgccaccttctaccttctgcacttcctgccaccttctgcatattcagagcgtcccagccctagaaatgccgacctagtgtaaaaacaaaatgactaaaggggttggaataatggaatacaaatctactggtttagatcactagtctgcttatgagctgcaactgaacgccttctatcctcatagaaattattttgatattctcaaatgtctacacattaaattgattttgattggttgttctttaaacaggacagtaggaggcacagctgagatgcagttaaagttaccaagctgggtcagaatgtcacagccttagaaatttggaaattattacttctaagacatattttcccacgtctctttgaggagcactttgacactattatttgcaaaccatcagtatcctcaacagaaactggaatatctccagtacaaatctcttttgactaagttctgctttctatggcgatatgacagaatggacaaaatgtcttatattctgtagatactataaatacattttagtgcaacagatcattgctggcgttataatctcatagttttcaagtaatcaataaatactagatagcttgatctgagttcaacagttaaattcagcaggtttctactggatttcagagagtctttgctgagttgtttattttcccacttgcttggaaggccactcatatcttcagatgttttctgttaggtaattaatttggccttgcacacagtggctctgtgctcctccagagactgcggcagtgtgggaatgctgtctgcttgtactgattagggttttgaatgcttgccttcacagaaatagccaaaagttaagctcttcttttgagtgataatttgattttctcaagtatttaagatagtaggaaaggcaacacattcccagaagttactgctatatgctaaggaaattaaccatttatgttttgctaaaatagagtttacacaagacctctttcaaataatctaacctgggagcccacgtttccataacactatcaccatagtctgtgaccctgcagtgtccaaaaaagggaatttaaagttaaactagagatggaagactggtgtacataaataacaaggcgagagtaaaccatcacattccaggagaatctgttgggaaaacaaatacaaaagtctttctgagaaggaagtgatccctgggacctggagcataaaatcaagggacagcttccccaattcagcaggaccccagcctctcatgtcctcactaatttgccaggcttgcttagatatagactaggttcttctgtcacacgtacatgtgaagacacatgttaattgaactgcattaatcagagaaaacagctcttgggaccagctgataaatgctgtcatagcaaagatttgacggtttctactatagtgactccaaaaagggacattcccaagccacagtcttgtgagcagagtctcaattaagtagaattgtagcatttctagtgagtagtgacaactgtgtggatatctcataccttcttgtaatactttaaccctgctgatacccagatcctcagcaaagatatagagaagcagcacattatcctgttattactaattagattgtctataaatcacagctcctgtccacattggctctgcattgcaataatattgtcatcagatagaacaaccaagactgctttccaagcagagaactttgaagatggcattgctatctgtctgtctaaaatgtgtatcttatctgatttgaaaaggctggagaagtctgtggccagtctggaagtgatttcattgctggcccaggaaatctgggaagagtttaatgtcgtgtatggctgagcttgtacaggataccctttcttttgttatggcaaacagtttgtagctttaccagccatttagcgcctagatatttgacacaatcggtgtatgtccatgtcacacctttgtataaacctgtctctctgcatctcaacatttggctatagctgctgcttttacacaacggatctaggctaggatagaaaaatcctggcttgtgagtgtcagagcaagaaagagaaagagactgtatcttgggccaggcctggggccgagtatgttttatgcacattattgtaatatctattatacagtggaagaaaccaaccagcccgggctttttccacttggtggtattgacagtttgagtgggataatttttggttgtgggtctgtcctgtccattgtaggatgtcgagcagcatcccagcctttacacatcggatgccaggagcacccccaccccagcagtcgtgacataaatatatctccagctgttgctgaatgtctcctggcggggggtggggggtgcagactcaccctggatggaataccgctgaactaaccccatcttctatagctaataaaagacaaataacaggattcaggcactaaccagagtacgactcagtttctactccttcagataagcagaccctaatctgagggagtcgggccagctgaagacacggctcagaatatccgaagtcttgagcaagttcctttcctcttactgactctgtggcggacccactgcgccccaggccacctgccaaggacagcaagccttctgaagcctttctctaacgggtcgggacggggaggactgctggaggaccacaaagaaatgagcctactcctctggggccctgggcagacctcccagttcctgttctacaggagtcaacgtgggcctccagcccggttcaacaactaacccacagcgagcccctgtgtgtgacaaggggcaggtcagccagtcagcagccactcctgccccattgtcccctcctgagacaggttaggggtgcccagcccatcaaaatatgcatcccaccccattctggattgcttttccctgtgcattaggaataaaacctctctaaggggaaggcattttgaagtaagcctgtttcaggcctgtgagaggtctgcagaaacacccccagcgtgagcactgggtcaccccacagcccctgcctttcggaaatcctggtgtagagtccgctccacaaggagctccttcctctgtttgaaggctggtcgtcttcactgtgtctccgcgattacccaggacgtgggcatggccatgcttctcacacgtcctctctttgactcaggatcatcgacttgtgcctctgcctcctccacatctggaagaggcatcttcttttcccttttcacaggctacttagagctggagagggattgtgtctgtcaatccttagatacatgattaattaatcaacgcatgtttttcagttgttactttgctgggcactttgagagatgcaaaatgagcactcttagtatatttctctcaaggacatacaaaataagaagaaaaatattatctgtaaggaataccataaatctaatacctaaatacaagaagagaagaggacagattttccagtctgttgaattagatgtgccattttacattgattgttttttattagctcccattgccagagacattgcaatgtctacgtgataaggagtttaggcttgagcttgcatgctggttttaaacacatcatctacaacattctagtcgtttttgtgctatattgtaacaattgtcaaagtgccttagaatctaacattacctttaaggtatgggactcactttttcctaagatcataaatttagggtattttcatagttgtaattaaatcttagatgaaattcctttttgagacagggactgtactttatttgtatttttggagaattcaataatcttcaatttataaatatatttatttccatgatctttcctctaatttacacatgggtaacaatagacatagttttagccatgttttcattatgaaattaaaatatacaaggacagagtgctttaaatattccaccatatagatagatggactggctcttctcctgttattccttgttattcctagtatctgtgtagaatatatttgcatctccagtaattattaaagaataataattaccttcttgtatgattatctttcttgcatatcttcttttttttttttttgagacagagtcttactctgtcgcccaggctggtgtgcagtggcgtcatctcagctcactgcaagctccacctcccgggttcactggttcacgccattctcctccctcagcctcccaagtagctgggactacaggcacccgccaccatgccaggctaatttttttgtatttttagtagagacggggtttcaccctgttagccaggaaggtctcgatctcctgaccttgtgatccgcccgcctcagcctcccaaagtgctgggattacaggcgtgagccactgcgcccggcatcttctttcttttattgctgtttttaacagaatattaaaaaatttttcctataaattatattaaccattgttttaaacgttaaaggtgttatgcttcttagatactaaattctttactcaagcacatgaaagcaaatatttttgtgtagactctttgaaactttggataagttcattcatttgaactaataatggtgagttattaataataacagtaatttattaagtacttaatatgtgagacgcactgtgccagatttgacttagtgagaatttcaaatctagtctatttaaaaagaaattcaattttcttacttataaggtgtgaaatatataccataaaatcaaaacgcattaaaaagtgttccttagtgtacaatactagggggatttaaaaaataaatataagctttgtttaggtagtgcattaagcatatttgagattactaattttttgagatcaattgaatgcctttgtttatacatgttttgaatattcctgagagacaatagtgtctagtttagcctttcccaaaatatgatcatcagaccatctttaggatgtcaacagatgtttcctccgggatggaaacgggaagaggttccaaggacacaggcgtttggggaaaactgagttcaggttaaatggacatttgttgttttgccctgggatgtctcagagcctgtaataagatagtgtatcatctggaccttccgtgggtgctgcgtcatatacagttccccacacttatttgaacgcccccctgtttttttctttttcttttttgagatggagtctcactctgtcactcaggctggagtacagtggcacgatctcggctcactgcaacctccatctcctgggttcaagtgattctcacgcctcagcctcccaagtagctgggattataggcgtgtacccccccacctggctaatttttgtagttttagtagagacagggtttcaccatgttggccaggctggtctggaactcctgacctcaagagatttgctgtctcggcctcccaaagtgctgggatgacaggcgtgagccactgtaccgagcctctgaccctttttatttctgaagccaggaacggcctttgtgaaagagtggatcggtggataaaaccttgattctagtgtaagttcccccatctacccactgtttttcaccaagttgttttgaccaagttatgccctgacctggaaattccccagagttgctaaaagaactgaatgggggatactgtacataagagcacttaagcaacttaaaatgtcacatgtagggacatatgcgtgtcatgtgaatagcagctgcattttgaagttgcaataagtgtgaggaaaatgtgcttgttagctcagctctagacagatccatggatagaaagacatagacatggatccccatccagctaagtatttgcaatccgcaggtgaagcctggaaacccagagaaatggacctgttccatccgtgacagaagcgctcccaggacctaaattaaagggatgttagaatgttttgagaatcttggcagggccattaggtagtgtttgtagcttttggatgcttttggtggagggaaaatgagatgggctcacttgggaggtctgcctgcagtttccatccaaatttctaatcaacgttgtggttttatcatccatttccggaatcattaccccttaaaatgtgaggaaaacgactctccttttcttcaactccccaacttttccaaataccgctgcgagtttttgttgccaacagcttttcccaatgtgcgtgtacttaccaacgtccagactcctccctcccatcggccagccttgcttggtctagctattattcaaaggggaacatgcgtgagatatcacttcgtttttgccatctaatggattccaccccccaaagtatctgactttgacactcaggctcatctgcaggacccgagggtgtcttccctcccctcccgttggctggctaaatgggttaatagaatacattctcttttccttttccgtgttttgtctggcgtttgcaatgccaagatttttttccagatgtcccctatttcctatttccacataccgcacatgaatcatcatctggcagaggaatcgtgagaatccatgtgatcagtgtgcgttcccacattcacctacttttgtcttttttgatagttctttgaaaacaatgaatttttttaaaaatatgcctgaattcaagggtaaaatatcaacaatgtaccctagaaaagcccctggaagcagatctatgctaaatggtttattttattctgcacacgaggcccacccgtcgctggctcccctatgccttggacgtcactgatacacacacatcccgttcccgaacagggagagtgagctgcacattctcgtttccagctccacttcctagttctgcccaccgtaaaatctgcccttttgccatgcgctgtgggacctgttagactcaggagagaccatcatacaaattgatggctcttgatttgcagctgtatctggagcttaccgaatctagtgcagctttaaaaatagggagccgattctgtttccaagttcagaaggagcagcagaaaatgaagtatctcgaatggcagatcacatgccatgacttttaaagcccagagcactctccaggagtacaggctgtcattggtgtggcccagcaccggcagcctctgtcccgactatttatgggaaaaaatatttttttgtaaatatgatcttgacaaaacattggctggcaggaaaatagctttcttttcaggggagcaaaatgagagtgtatattttaattcaagatcaaagacttaacataaaacaaaccctgacaaatgaaaactgggcaatgggattttcctcctgtttgttggtagaatattttgagcattcaaacacgtttctagacagcaagttgtgatgctagataattaggtagtgtgggtgtggagaactgcacgctcaaaaatggtattaacagaccttcatccttgtgaagtggtttagcacaatgtgcaattaaacaaaggaagaattagtcagagttaacgagcaaaccagatggctctggggacgtggtgcccctttgtcagatttttcttcctttggcaaatccattaaacatggtaaaagtatacttcatatagcttagctttggttcgtcacatagttttatgagtttaatgctaactggccccaaattcaatgattctggatttcctcacatgagaatctgacacgagaagctaacagtgattcctggctaatttctaaaaagctgtagtgaaatcagaagggttaaagacccttggtacggtttctcctttattagatatttggacaaatacctgaaggtaatgaatgatagatgtgaatttcttacacacgtcttgctagagcttgaggacttaaccagagaattttctgtgggcgtcccgctgtagcatgttagggccttaggttaatttgccctcctaggtgagaaatccacaaccctaagacttgagtacccaagtctgtggcatgtggtgacatgcttgattttgaagtggttttccctagaagattggtaaaggaatgacatctgtctatagtagagccagtaaattccttgagctggagaaccaatgtccactcatcccagtgcctccttgtcctgtgggctcctgctgtacccgtgggcctgggtagtggccagcggcagtcctggagcctgccctacaggttcatgatggaagatgctagccagtaatagcacaactgaacccccaagtgaacactctgctaagacctccagggagggagaaggcacggctgcgagaatggatgtccaatgggaagaaattgatctgcagggggcagggaagggcaaaccgaacggtcattcgcaggccccaaaagctcaggcagccgctcaggtgcggtggcccatgatttacgcctccaaattccatttccctgtttgacgtcaggtttttcccgatttggaaatgttggtgctttgagaaatgtccatggacaactgtgcctcctcacctcccccttctcacttccacgtacaagactccagaatgttaaaggacacatctccatgagtgtgaaactgtttgtcgctgtttgactctctgtgtccccatgtggggctccccagtctcatcgatatgtcctgggcaagggcaagaggcacctcggtggatcttgttcccacactgactgtctcctcaccacgcgggctggaaatgctgtgtgtttttctgagtcagggctttgggaggcagcaccctgtctccaggttcttggagttttatggatgcaacgtcattaatcatcctgacggggctgatgtgggtggcaggtgttgggttctgcctcctgattgggaggaggggctgggtgccctgccctgaatctgaatgtagaggccctgggtaaacgggtgtgccctgtcctgcctggaccacacatcaggagccctgggagcagaggttccgggcggctggaggcctccttgcttccgcctctgcacgtggaacctgcatttcttcacaggagaccgtggctccacaggtgtcctgcctgtcagggcagaggaacataccacggggggacttccagcaaacgtgaggaacagcacgctggcgtgactggggcagaaagcagagtggtgttttcttctttgggggcctttgatagggacctgggcagggtgtggtgggggccggaggtgcagtggcttctgcaggaggctggggaggctccccgtggtcttagaggaggtgcaccacccgtcccacctcactcgccccctttacccttcttccctttataaaatttctgccctttctgttcctcccaccacaatttcccatccacttttcctttctctctgttcagggctcatgtacacctgtgtgattttccagggtgtcacgacgagccctgatgacccgcgcctgccacctgtgtgctttgtcctctctacttcacatgtgtgcatgcacacatcacgtgcatgcacatatcacatacacgcacacaccacacacatacatatacacgcaccacacacataacatatacacacaccacacacacatacataccacacacaccacttacatatacatggaacacacaccgtgcacacccacaccacgggcacacactcacacacacacgcactttcttcaggaacctcccagccctccccctccaccacgtggcctgaatggagccctcctcgtccacctgttttgggcttggttctgctcctttttcctgagtgggggattttggagggtgctgcccttgggcactcagtgtggatttgatgctgtggaaggggacaggagagctggtgggccaagctgggagggcagttaccgtggagtgagagccaaggccagccggcagaagtcacccacaagagggtgaacgtcggaagtggggcccaaggaaattactgacattttacagggcagaggcatagggctttttcttttcctcttagtctccccaggatgctgtaataggataccacagactgggtggtttcagcagcagaagtgtgttcctcccgtgctggaggctggaagtccaagatcaaggctccagcagattcgaggtcggctgtggaccccttcttcataggcagcgcgagggcgggggctctctctggggtcttttttctaagaacactaattctgttcatgagcctcatcacttcccaaggccccacctccatgccatcaccttgggggttagaatttccacacaggaatttggggcggggcatggacattcagaacacagcacttttattatcctgggatgcaggacacgtacagtgatgtgtggcgacaaaatgcatcccagctgtgtttaagtaactgtgtaattggctggaaatttctcaatgtgaaaaaattcgagtcattcagatttaaagttgaaaacctcctaagaggaaagagttgggactctgacctctaaaacccttctaaatgttagtgtcctctgagttgagatctttcctgtgaagctggaggtacttcaacactctactgttactggcctttctagagcaaaagctattttactgaaaagaactttggtatgcagtacatgtcagaactgtccactcatttgaagtgaaggaagatcaggcccataatgggtgattacttcacaagcagacatttcctcagtgtcagctatgttttcggtgatgtattctgaggaaaggggagcggtgactctgcagtattgagccaatgtgccttcatcctccctgtctcttcacatctgctgatgggaaaaccaaagtttgtggaatccccaatgccatctggttttcctcccctttttcttttctgaaaaatcacgttccaagttgaagcaatcatagctgggaaattttgttacattttcctcactgtctgtggttttttccattcgctaatcaatttgattctccatattttattcctaaaatcattttatctgggcatgtgaagtggacgctagtacttgaagtcactctatttaaatcttgcctgactttcttaactagctgttctgatttctgtcctcctctagagacaattgaccagatgccatttctttgggcttcctattggataaggccgtgaacccaaagggagggggaaatagatgataatttaggaacatgggagttggtataagcatccgtttcctttcctgtctcactcatttgcctttaggaagttatatcgttaatcctaaatgtgtgtcttccctgtgtttcaaagaagagtcccccagcctggaggctgctcattcgcattctgggtcacgtgttcccttccaaggcttccctgttctccctgccacttggagggggcgcaggagccgcctgctgggtgcgacgggccagaagtgggtagtgacaggcccggaagtgggtagtcattaaaaacttgccttgcacggaagctactcagtatgtgcccttcaaaattggatttttaaaggaatctgcttcacccagtgacagagaagaacacacatgttcttttccatcctgtccaatattttgttcctgatgtagaccccccccccgcccccgcaccaccactcctcaggggcatcctgtgcttgatagcggggtgtcagctctggaagcatgtgggtgattttactgcagaagcacgtggcttggcaggtgctccgcgatggtcccgcccagctgcgcttcctgagtcctgtaaggcgcgtgtatgtccctgtgcatccctttcccacctgtcaccgggcacctcttgcccagcgagggtgacgttcaaatgggcacctgaggactgtgtgtgcagcgaggtgtagctccacccaggagggtgtatttagggaccgcagggaccaggaagggctctgggatcagctcctccacagcgggcctccccggagacccgagacagggctgcctccctgtccttgcctgatttgttatcccaaaattctgggcctaacccacggcaggatatttatgtggaatatcaaatagttgttaaaaagatgactgctttccctgtttcttcacagaacgtgctgattctccctgtggagaaccaagggtgggcacctgtaggtttagaattcccatgagagctcagtttccaccaagttggcaattgtatatttgggaatcaagggaaggccatttcagggtgcatggctgactggccctctcttgccaaagacaaattgcctcagtgatgtgtcccagacctcagaccctgggagtgggaggtctgggggcgtgggaaccaggtgcccccaacctgcctcttagtgaagcttctctctctttatgtctctctgtctctgtctcttcgtttctctctctctttctgattctgtgtttgtgtgtgtttgtgtgtgtgtgtgtgtgtgtgtgtgtgtgtgtgtgtgtctaccgtacccatacttggtcatctatcgcccaattgatgtaacttaaaaaaaaatccatatacgtgggaaagtgtaacatgtttatatactctacaatctatttttattagaaagtttatacctcataatttgcaaactgtaacccagttggtctgtttccacatcttagtttctagccgaagatctcaatattttagtctattgacattaagtagttaagaaaaaaaggcaggaaatgatactgtaagtttaatctttaaaacgtctacaaagtaggcatagtgaaaatggcattaaataaggtcttactgatagaaatttttaaataattgggccacaccttggattgaaatatatctccatattatcttttgaaaacaggcttgccaactttatgaagagcattgaggtgaagagagattagcagctcagggaagaccatttttaagtatttatgaagtagctatttattgtcttaattaagcaccggtattttgcattgagtttgcaattatatgcttttcttatctattcagttttaaaaccaagattttaagcaaaacacaaaagaaaaaacttcaagatgttggcttaatttctttctttgggtgactgtatatgttttaaaggaattaatggtgtttacttaaaagagattaaaattcagttatttattaatttagattgatctcactactgctttttcaaattaatgaggttaggctaatagtgggttttgtaaaacctccagctctgctgagattaccttgtattctatgggcaaagttggtttgtctagttttaacctggcaattgtatatctgggagtcaagggaactgttcttatctcttagattccaagtatgattaatggagtattgaaattattgcagcatgctgggggaaaatgttatcagtgataagatacagacaagtaacttgcttgggggtaaggaagtaatctggggatttcagaccggtgtatgtcgttagctacttccaggctaaccatggaggagtgtggtggctttactaagacccaggctgacctgacagaataaatggaatgttctatgcttgaactgcctgaattacagagatatttattaaggaaaaaacacaaaaccttgagtataagataaaggggggagtttcttgaaactgtcatcttttttaaatactcaagaaattccaattttcttatgtctgtcttagccacaaaaacaggaatgagatacttcctgggtcatgacttgtgggaacactagcagtgtggccttttcattctcttttaaaacattctgtggcttcagaggaaatgcagctggcttgttggacatagaaatcgtgagaataaacacaaaatatttacgtgtttaaaaagcagtgaagtcagaccagtttctttcagaaccatttgtacagcatttaactgaatacttgagcacgtttgatttttaaaataatgctgccaggtaaaacaggcaggtggagtcatccctgacttacagatgatggcaaagctgattttcagagcgtcccaggggttggcgctggagccagcaccagaattccaggcttaggttctttgcccatccatgcagtgactgaagagagagcatgaaaagcagggcgcccggagctccgcgtgctcacccggagtgcaggtgcttgtttttgcagtcatttgaaattaagattcctaaatctgcaccctcttgtagatttatatcattttcttgggatctttcctgagtcactcatgaaaatattttatttttgtttatttatttatttattttttgagatggagtctgctctgtcacccaggctggagtgcaatggcatgatctcggctcactgcaacctctgcttcctgggttcaagcgattctcctgtctcagcctcccaagtagctgagattacaggcgtgtgccaccacgctgggctaatttttgtatttttagtagagacaagtttcaccatgttggccaggctggtcttgaacgcctgacctcaggtgatccacccgccttggcctcccaaagtgctgggattataggcgtgagccactgcacccggcccagtcgtgaaaatattaattgagtacctaccctgtgccatctgttcgaagtgctggggggagggaacgagagggaatgccagtcactgcctgctgggttccagcatctcctggaggtgctatgtacgcggctctgcacaccctggcaagggaaccgcagggactacggaaccactcagaggatggggaccctggatgtcccctggcagggcacctgtaaaacccaattttgataaataattatatctaacacatttttaaggaaaaaaaaaagaaaggtttttcttaattgccaatgagcaattctctcaaggtttaaacctgaagactgtcttgcatgcttttgtattattaactataattcttatcttcagagtatttcatctgcaattttcaagtttacttttatcacagaccaaaaaaagaaaaaaaaaatccatcacctaccttgtggtgtttcctgcctttgctgtgtcctcgttttgttccacaacgctgccccacacccacatacattattaagttcacgttaataacatcctcggctgtctaagtacttaggcactaattggcatttttcaacatttctgttaatgtagaacatgtctttcgaaccctcaggggccttgctttggagctaatgaaaataaagcaaagtgtctttataagaaaaaaaattaggtcaggagcgttggctcacacctgtaataccagcactttgggaggccgaggctggcggattacctgaggtcaggagttcaagaccagcctgaccaacatggtgaaaccttgtctgtactacaaatacaaaaattagccaggcatgatggtgcacgtctgtaatcccagctacttgggaggccaaggcgcaagaatcgcttgaacctgggaggtggaggttacagtgagccaagatcatgccactgtactccagcttggatgacagagcaagactccatctcaaaaacatatatatttttttcttatacaaactcagaagagagctaacctcttattgatattttgttatcaattatttatgttcctgcagtctttcttcttaccccaaatcttttaactaagtcatgacctagaattgtgataaatttcatggaacttcaaaaaaaaagacggttgtgctggtgagcagaggcgtgatttcatgtgcagactctcagcacctcctaagtgtgatcattcctgcaatggctggagctcaagttggaagcattcatttatgccatgtgcatttctaggtctttgaggatagtattccatatatattttttttaatggagtaagtaaaatccaaaaccaaaagttaaccaaagtgttggcagtggtgactgggcatttcagcccctgccctgggttagggctctcttgagggacattcctcagttggcttcccaactcttggcaggtcagtaccaagcctctaaagtctacacggaggctgcctcttgcttggtgtgtcctgccatccttggggtgtcacccaggcaggaacccccagagagctctgtgcaacttatttggaggatggttttgctaccactgggctttttccagctttgtcatattagataaaggcctcctgctgtgccaacacctagcttcggtggctgattttggcctctgattgctgcagtgtgcaacatgcacaaccatccacaccgtccatagctgcagcaagtgaggttccaagcctgtagcagaacacttgttttctgtactgtttttctcgttttgaagatgtttttaaaaatatatatttgagaaacagaatgttaggtagtaggtttagaaagaggcatctgtgattttggttttaatgagtgttcatgctgataggttaagcaaaggagagaatgttatcatcttttttgggatccaaaaaactggatagatttttttttcttttagaattggcaaaactcaggagaatggactaaattaccttaatgcataagttttctataaacttatagtggaagaagaccaaagaagaacctttacataagttttactggcagtgggatgtttagcagtggtttcttagagacctccctgtgattacatttgtatctattttatgcatgctttgtagaatgtaattttttcagtattttctatttccatacagctattttaaaaattgaatttgctattttttctgtattgtcattagattcaaatactctcccaatttataaaatggatgtgaaaatgctatccagaaaatatccatcattctcattatttataggctgaccgcatttacctgtaacgcaatagcctcgatattcaggttactagtttttatatttaattttaattaaattttgaatcctaattaaaaatatttaccatagagttcttttaggccatatcaaagtgatttctctcactccgcccacagaatgtgttcaatggcactgaatatttaatattttaatagtaatatattactacaatgaatatttaggaaaaagccttaattcttttttttttttttttttttttttttaaagcagagtctggctctgtcgcccaggctggagtgcagtggcacgatctcggctcactgcaagctctgcctccctggttcatgccattctcttgcctcagcctcccgagtagctgggactacaggtgcccgccaccacacccggctaattttttgtatttttagtagagacggggtttcaccatgttagccaggatggtctcgatctcctgacctcgtgatccacccgcctcggcctcccaaagtgctaggattacaggcgtgagccaccgcgcccggcctgaaaaagccttaattctttaaggtccaccagggaggtttagtttatttgggggaaaatgtatagtcccagagctccctctagtggcgagcagctgcagcccacggagactcctcacccaagccctgattgaggccgttggttcctccgcccgggcctgtcacgggctggatccactgtctgccagagtttgggttttctccagatcattcagtgtctgagtacttcttcaacaagggggtgcttggctgagatcccatgggtgtgtctgaggtgccagggcccgccggggagggtgtgaatgtgcctgtttcacatgaaggcagcgctctcgaatgtgctgaggggtgccagggccctggggtgctgctgtgtgggtcgcaggtgcctggaggtggatgaagggtgggtgtctacggacgccccgaccaggagcttggcccttcacatgggcatttgaatgtgttgttgatggagcccggagccaggaaaatacaagtgtttccagagaacgcactgtctgctggtgtggtttgatgcgaaaacggaattaagctgttgatgacagacgcgctgcctgagcgcaggcacacgtggaatctgactgagcaggttcacaagcctttggaaaaagatcatcatcatatttttcttcctttccaacgtggaaatctgactgctctgggggactgacttaaaatggttctgtttaacaatatttgaaacggagtactgctttggagtaagaattaatgagagcattttggactgttttttctgaaaaaagataagaaaaaactcttgaagataatagttgcctctggagacctttgctgctgctcacagctttactgtgcgcttccatgagtgagtctccactttcatcatggacaaatgtctggaactttggtaagatttaaagacctttggaaatttttaagattttttttggctgccagtaatttatcagcactcagttctcctagaacatttttactggatcggggacgtcagatggtttgtttgcttttggatggctttcggggaacttttaaattgtttataagaagaccatactgagggcccccttgagttattcttgtgttgaatgatagttctttagaaagtattttctgaaggactctttttaattcatttttttcttttaagctgatgtgcaaagtggattttcatggatcagaaaatatctatggttttatttctttgtaaatgtggatctatcagaaatattcactgtgcatctcctttgtaaccatcgccttctagctttggattacatatgacttgagtgttcagctctgtcagtcaacttcatagtgaatgttaaaattcatattagaatacttgagcctagaattgtgccagaattcatcatgggctcagataatgtttcaacatcaggatttgtccaatagaaatctctccttgaacatggacacctggagacaattctgcattaaatgctatagctgcaggcaggctttcgctgagcacagggtggaccttcttcatcacatggaccttatcgtgagggcttgggattttccactcaagaatcctggggccagaagtccagtataaaagttgtagtccaggcttggccatacggaggaaggcattttcacttctagtttatccagcccagctcccacccctcagaccccagccactgttctttcggccaggagactccagcactgagttctctcccattcttcacacagatttgctcatctccatcatcggcagccttgggagtagtcagaaccaagctaatgatagtcagaaggaggacggtggaggcccatgaaatgaggaacttgcccaaacaaccccacgtgctttagaagaggcaggacaagtcccgaagtctcctagaaatagaacagctctcatgatatctgaaagtcatggattttgaaagatcaaaattcaaaagataaaaactttgaattttgatcttttcctgggctagcattgtgcgataggcaactcttgcaatgccagtcaggagccacaagccgttctggttttcacttttgatacagaatttgataaattacacaagatattaaacactttattataaaacaggctttgtgttagaccattttgcctaacgtaggccagtgtttaagttttctgagcatgtttaaggatggctaggctaagctatgatgttgggtaggttaggtgtattaaatgtgtttttgagttaaaaatattttctattgggctgggtgcagtagctcacgcctgtaattccagcactttaggaggacaaggcggacaaatcacatgaggttaggagttcaagaccagcctggccaacatggcgaaaccccgtctctactaaaaatacaaaaattagcggcgcatggtggcacactactataatcccagctactgcggaggctgaggttgcagtgagccaagatagtaacactgcaatccagcctcagtgacagagtgagaccctgcctcaaatatatatatatatatatgtatatgtatgtatgtgtatatatacacacacatatacatacatatatatacacacatatatatacatatatatacacacatatatatacatatatacacacacatatatacatatatatacacatatatacatacatacatatatatacatatatacacatatatacatatatacacatatatacgcatatatatacatatatacgcatatatacacatatgtatatacatatatatacacacatatatatacacatatgtatatacatatatatacatatatatacacatatatatatatatacatatatatatatattttcaacttacaatgggcttattgggacataccccatcataagctgaggtgcgtctgtatgtgctgctcaagctcttgcgtatacccacatagttgatggagggccactgcacacatttcctgatattcactgtctcaagctagacgtctgggctggagggagaaaatgagaatttcgggaagaagatacagatttgcagccacgctttttatgcatgattggtttaatctttgctgctttaatgttaaatatttaaatgcaagaaataatagtaatgataaatgtagctgctaagtgcaacaatccacactgttaaatttcattcacatacttctagtgaacacatatacatccttttaagagttcagttgtatgtctcatagagcaaaggagagtgagcactcacgccttcctcttaggcaaagcagaccctctaggggatctccttgcatctgtcccccctcaaactgtggtggcagtattcctgccctgacgtcaagcctcatggtgtggagggagctcccggcggggcctcgccacagagttttccatgaccccgcggcacccaccgcagctttcccacccctttcccagcggcggcattcaggaaatggtcctgcagatgtctcttctgatgtctcttctgatggtggttgggctcaaggagttggccttgtggaatttcggaaagagttctgcagtcacccactgactgtgacccatccttgacatcatttccctttcactggatacttggtgagctctggcttcaaatgtgagggctttcattccctgaatgatttgcagtctgctcgtaaatggaaatctcgaggcgctagatgacagaaagcagcagcagggccatcgtggtcccgaacgcagcttgccctgcacctctcagccactgctgcggactccagccagtctggaatggtgcctagaatgcttggactgcaaaggcgacgggggtcctgtcctgcccagtaacctttcactacctcttaaagtttttaggattcgtatgtggaatcctacctcatgctgagcgtcatgttatgcaattggctagttcagcatcccatgacattttattgaattcaaacaccatgaatgaataaaacaatttcattgcctgtgaagaagttacagggttgaggtggagaaggaattgcagtttccctgataagcattgcttgtttcccttggatgcacccagcacatggaggctgccatacccagtacactcagtgctcagtaccaaacccggtacccgtactcattccgtgcgtagaggaagcccccgagagctggcagcatctctgtgtgtgcttcagtccattgtgaagatccgtgatcctaatatttcagattggaaaaatccattaaaattttgatttaaagatatggattccatgtcagccactgaaacaggcctttgacagtaagaattttgatgactgcttattctaggtatattttgtgttaacatcagtttttgttgttggtaattatattttccccccacatttagaagcttcatgctattttaacttcagctgtcctgggtatttgatttgtatttgaatttctgacttagctatgacggaagcttattagagtatttgctttcctgaatcatgaacttgtttctacaagcattggaagaggaagggaaataattgggtattataaaatgactttctatccacgcattttaaggattttttaaaaagtatatgcttgctttagataatgcattaagcaagaattttaagttgctccatgcatgaaaccctatttcatgcctaatttacaatgcctaattttggtgctaagattattctccatgttgtattctttcatctttatagacaatggcactttgttctccctccacaaattctgaatttcatcatttggggacacagcagtagtcatctccggctttggcgtatgattttccttttttgatcagtgctctgcattgcactgatgttcaggaatgagagcacaaggttcagctgcacgaaaactttctgtgtagtatttttcaagtttctcgtttctttcttccattttaaatagtctttgctgtgacagacaatggttgtggttttcatttttgcctgacatgaagtctgtggccgccatggatttttggaccttgccttgagcacaccatgggaaacagatgatcgagggtcctgttgctccctgactctaactgtgcacattctgccttgagctccagtggaagtggggggtcactgtggtcacgttagtagcattgccagttgcagctgcaaagtctggcttggaccctgctagctccaataacctttgcacaacatgtccagctctttgctcttcttacaatcctggtggaaatgtgctaaaatcttggaggaataatttggccccatactgcatgctggtcgccagctaactgtatagctgtttaagtgcttattctgtccgtttgctctgctctggttcccataataaccttggacagggtacagagtattagattattcgtgtgcacttttatctggacaaaagattaagaacgttaaaaaaatatgtggggaatggcaagaaccatgtccatggaggagtcacttccttcttagctccttcatttcaaagctctggggatacacagattgcttaaactttctggtgacatttgggaaagaatgtgttcttgcggtaaaagcaaggtctgggaatttggatttctgtgttctgttcccagcagcacgaggggtcacccagtgacgtacgacaagtcagttaagcatcggaatcttaatttccctatctgtgaaatggacatagaagggtcggtaccttgggctgacatgaagttggtgaattgtttgatgttctgctgggaaccggcttgctctagtgacccagaaaaaacagggactatggtggaggctgacctcatttctatttctggctgtagtgctgactcagtgagaaacttgtagaaatcagttaatctggctctggtcctcagtgcattccatggttaaattgagaattataaaatcttatcatcgctggtctcatggcgatactgcccatattaattaagtactaaaaatactccaccaaatgtattagaaagcttctacatggacctgcctttctcatttccttcctgtctgatgttgggttacttggggctacacaagtccatatttatttatttattttagccgctgtttggagttcagtcctattctggtttgagcagacttttcctatatccgaaaactgggtgccccagattggtgaccttgtgcactgtaactccttacagcaggattttctgccattgtgtcctggggccatcactgcagggtgtatttaaggagctcttcatttgaacaagtcctggtctgggaatgtttttccttcctcactgtcacaggcctcagggagaaggagccagccttccctgtcaaaccttgggatcagggccctcgtggagtcacgtctgtgcttctggccgactccctggatgctgctggcctgaaggggcagtgccacagtatggggcttgaggttctttaatccatttactgtttgattcaattctttagggtttgaaacaatctctcccatatttatccacatactgtgtctagactcctgacatatcctttcaacgaaacacagctctatggaggtgtggcggctgagtcccaggttcataacgtccttcctgcgtttgtaaaaatggagcaggcagttaattcaccagttaagtgccaggactggctgagtggtttggaaagaaggacgactttggatgtttatgttatgtggtgtgtagcttgtcggttgatttttactttcaactaatgcaactttgagaaaggcactgaacactaagtaatcctgcctgtgatctccaaactgtctgccttatgtttttaaatcagctaacaatggttactgaatctacccaattcgtatggtaaggctgcactgaagtccacatgctgtaaagtaaataggttttcttgatttcttacaatggttatgggttgttgttttttttttttttttgagacagagtctcactctgtctcccaggctagagtgcagtggcatgatcttggctctctgcaacctctgcctcccaggttcaagtgactctccagcctcagcctcctgagtaactgagattacaggcgtgcaccactacacccaactaatttttgcattttttagtagagaaagagttttgccatgttggccaggctggtctcgaactcctgacctctggtgatctgcccgcctctatctcccaaagtgctgggattacaggcatgagcgagccaccgcacccagcccaaaaaatactcttgaaagacatttctcattaaagcccaccatcaccccatgatggcccaagggaggctaagcatcttgcatgaggtgcacactgtggactctgcccacccacatctcctaatggtctctaaagaggaagacgtcttggaggctccatcacagaatctcagcactgaggctgttgctaacaagagagttccattgattgagcgaaattataaccagttcagtgaaaaacacctcgctatttgttactctatttacccaagaaattatttggcattaagtacatataaaggattgtgctaggaatgagatataaatatttcctgccctcaagagtttaaaacacagtagagcaaaaccacctgaagtagtcgttgctatctgtttccagacactcactgtggacttgcgcaaggctggatgctgcttagatttattatgggaagtggctcataggattatagaggctgaggagttccatgatctgccgcctgcaagcctgggaactcaggactcctgaagtgtaactgggtccaaggccagcggctggagagcccaaggggctagtggtacaagtccctgaatctgaaggccagagaacccagagttctgatgtccaagggcaggagaagatgggtgcccagctccagaagagagagaattggcctctcttctgcctttttgttctatccgggcctcaactaacaatgacacctgctcaccctgggtgagggcagatcttccttactgtccatgtattcaaatgcccatctcttccagaaacacaccctcaaaaacacatccagaagtcatgctttaccagctctctgattatcctgtgacccagtcaacttggcacctaaaattaggcatcacgggccaggcgtggtagcccatgcctgtaatcccagcacttttggtggccgaggtgggtggatcacctgagatcagaagttcgagaccagcctggccaacatggtgaaaccctgcctctactaaaaatacaaaaattagccagcgtggtggcgcacgcctgtaatcccagctacccgggaggctgaggcaggagaatcccttgactcaggcagtggactttgcagtgagccgagatcgtgcatgcactccagcctgggcaacagaatgagactccatctcaaaaaaaatatatatatagccatcacagttggtcaccaattccttcctctgttctttactgctgccttttgcctgactgatgttcctcttctgtagggtgaaagaggcctcccggggttacaaggtgtcattgggtttcctggaatgcaaggacctgaggggccacagggaccaccaggacaaaaggtaagcacggctgtgggattgggggtgggtggatgtaagattgcccgcattcttgagatagcggtgatcaatgacaatggcatttctattctgttccagggtgatactggagaaccaggactacctggaacaaaagggacaagagtgagtacagttgctactcacaatcgatgattccatgcgtgggacaggcccgcttccagagccgggcaccttttccctcctttctccttgccctcgtcctccatctcctctcccagctcacacagcacgggcaggcaggcgcgaggcaggcagtgaggagcagcccgtgactccctgagccccagtccttcccatggggactgtgcacaggctgagctccttagtccttggttctgcaaacttgctttcccccatttgttcttcttcaggaatctcttctgggcattttttaatttgggggaaggggcaattgatgatgtgtccacagtcattagacagagatgacttcatttaatggaaaagtcatggtattttcagagccagccttgctcttcctcctctccacctcttagtaatgatgaaatgggagcagagttattttgtgcatgggcagccttatgtttgaagggatcagcagtcagcttttaaaaacttatttttttgtttttttttatttcaattttttttggtacaggtggtgtttggttgcatgtataagttctttcgtggtgatttctgagattttagtgcacctgtcacccaagcagtgtacgctctacctgttacgtagtttttgatccctcacctccttccagccttccccccacctgagtcccgaagtccattgtatcactcttatgcctttacatcctcatagcttagacgccacttatacgtgagaacatacggtatttggtttcccattcctgggttacttcacttagaataatggcctctagctccattcaagttgctgcaaaagacatcattttgttccttgttgtggctgagtagtgttccatggtgcatggattccaccttttctctatccactcgttggttggtaggtacttaggttggttccatatctttgcagtggcgaatggcagtagtgtgctttgggtgtagcattgctcctgtaagcctgggccatctgccctaggctgtgccctctgctgcctcttgtgcagagtgctctgtctgctttgtgtgtgttctgacaccaaaaatgagggcatgactccattaaccggggagatgcaggaggaggaagtgaggcttcccggctcttcactgacacgcttttacttccgccctcacagggacctccgggagcatctggctaccctggaaacccaggacttcccgtatgtatagaaaacgtgctctacttcttttatgaaatattcttccatcaggcgattttctgcctgggttacattttcactttcttcattgcagggaattcctggccaagacggcccgccaggccccccaggtattccaggatgcaatggcacaaaggtaaatccagaaccgagaccctcctttttgtgtgtgtttacgtaatttttgcatattaaggagtcaggtagtgtgattctgttaatagagttttatttgccacaattggaaagttgcttgtcttaaagtttgctttatttagtaaggaaatacagttttcccatatttagtgtaccagaaagatataattgttcctttcttttttgtagacttttatcctaaaattgcatttaagcacgaaagttattacctataatcatttactacatcacgtaagaaaatgccattatgggcctttgtccctattaatgatactatcaagtctatttcttctttcataaagtggtacccagtagcacagcttgtgacaaactgtttttaggaaatgattttaaccaacaaatgaagggtagggcagagtgatgcatgcgatgtcagggctgatgtgtctgccacacacagtgcgtatgaatgatgctctgctgtctccccagggggagagagggccgctcgggcctcctggcttgcctggtttcgctggaaatcccgtgagtagaggttatttagggcagaacttctttcttttagttatgacttctctcttttcattccatttccttttctttctttctttgcttatgttttaataacttatattttatatataatattacatgataacaattttaatgctaatgatattttgagaaaaacaaaactaacaccaaaactttcttttttagggaccaccaggcttaccagggatgaaggtacattttattttattttgctttattggattcattacagggaatctgtttacaacaagtgccatagaagcacattctctttaaaccactttggctgatcgattgtttctgaacacacttccctaaactctgttacatgaaaagactgtacaagtaacccacaaactcagatctcagactctaacgttcagacacttggcacagcttcttaatggggaataagcagcggaaggaggcctggtgtggtggcgaaggctcacttcacccaaactggggaggcagatgggagaatggggctccctgggtgcctctcagacttcccaggagggaacctggggcagcttttcccaggcggggtgttgatgtcttggggctcggctgctggcatcagcccgacctcagactgtgcagtcatgtaatgtgtcggctgtgcttgggcacagggcggggacctcgggcatctggatgttgggatcagccttgtcaaagggaggcttacaggtctcagcagctgcagtagagataactgcttacctggatgaaggtgagagtccctgtgctcgctcctgtgattcagaacacgtaggaaatagatcctcataatagccctgtgtgttagcatgctccagagacacagaaccaggagcatgtgtgtgtgtggccagagagaggagaaactgcttctaaagcattggttctcatgattgtgggggccggcaaactcaaaacctgcagagtgaggtgggcaggccagacaccagagaaggggtggagttgtagtcttgggtctgaaggtggtgtgtgggcagaattccctcttcctccagggaggtcagtcttttatcctgtaagaccttcaactgatgggatgaggcccaccagcattatggagggccatttgccttattcagagtctactgatttaagtgttaagctcattttaaaaatcccttcacagaaacatctggtctggtgtttaacccaataatgtggcctagccaagttggcagataaaatttaccattacgccgtgcttttataaaagtattcatcctgagccttttctcaaaagagaattcttgttttgtgaggagagcctgtggtcacgcagtagtctttcaaccagagacaagggcccttgtctagagttgggggtggtcctcgggcagtgtggcagacccctttgctttgccgtctctacattcagtcccggctgcggctcagttgaccaggcagtggttaacgctggccattaagacggcaatcatgatgggagagatggccaggctattgatttccagtgtagacggggtctaaatcccagacttaggctagtcctgtaacactaatatatgccaactatcaaagagttttcagcttctttacatgaatgtcgatatttgcaactttctattttctttcttcatcctctagggtgatccaggtgagatacttggccatgtgcccgggatgctgttgaaaggtgaaagaggatttcccggaatcccagggactccagtaagcatttgctgaatcattatgaacatgtgccacctcaccctcccagttcgcatctgaactcatttctttctcatgcattctagggcccaccaggactgccagggcttcaaggtcctgttgggcctccaggatttaccggaccaccagtaagttttgggggctgtctctccgaggcaatcatttaaaaaacaactatattgaggtttgaaaataaataataatttagtaaaaactttacacagttgtggtcgctcttaatttggacatggcggaatcagcttccctcttactaaacgtttggctggcatcccggtacccatatacccagagctgtgggaaagggatgatgatagtaccataaactgataccctgaaacaaataatgcagtcatggttgaaggggctggcggggtactgctgatagtcacagcctgtgggagtgagttcaaagatggacagacaggctgtgccccaggtgacttcaccagggagcaggggagatggattggtattggtatggtcacacctgagggtcctgcacctgctaggagtggggagggaggggaagcccaggaaaaatatttcacaaataaattatcatgttgaccagagaatcttaagataacgtcagcctgaagaagggcttaaagctccctagagttctgaatcctatttaattaaaatgctgtctctcccagggtcccccaggccctcccggccctccaggtgaaaaggtaaaagttcttttcattttttgttctttggcattagtataaggctatcatgaaattgctatagctcactcttcttattctttcagtctctaaaaaaaagttggaaaattaacactatatctaactatacctttaagtatctatcatatatcatttattatctattgattatctatcaatatattgatcttttctttcatccatcccttagtcaatactttggaatcacactgatatttcccttagttttctaatgcaagagtttaaaaactgtaaatttttaaaaaggtctttggaatttttgatcagtcatactttaaaaactttttcatagacattgaattcagcatgatcgttactttccagaaaattttatgagagttatgggacaaagctattgcctgaaatctaccatcttattgcattttgtgtgaggtttgtagaatgactttgaacgaagtagacaaatctaataatgagagcctaatttttaatccacagggacaaatgggcttaagttttcaaggaccaaaaggtgacaaggtgagtgcatattgctctggagtgctttcatgttgaaaaccacagtcctcacctgacagttcccacctttggatcaatgtctggactcttacaagtatagttactcttctctgcatgttcttgcatttggtagttagtgttttccttaaaatgccagcattattgaatttattctagcttattcagtacgctagaatttatggaagtgctctgtgatctgacaagcagagaacaacgagactaactccaattatctgtacaaagagttcaaactcttcttcgtcagtgatgaggtcagacctaggatttatgagtcaaatttaggacttgaccattagatgagtaaccctgtaagccctgcagagcgggagtccaccgccaggaaattgggagtagcacggtgggcagcggcccctcaccaccggcctctcttctcagaggcgggcatgtccagggccaccaccaggagaattaggactagcacggttggcagtggccccgcaccaccggcctctcttctcagaggtgggcaggtccaggaccaagtgggtgtgggaggagatgcagtgtggagccgggagggcacagaccacacagcaggtggcttcatcctgcagagaggaggcaagtggtgggtccctgatcctctccaggagtttccctggatcagaccaatgaagcaggcactggctaagaagggatgcctgccattgctgtagccagcctgtggaaggccagattctcctctgacatccaagctggtggaggcaattacaaccagagcgcccaatacagtggggcctggatggatctggatgtgcaggtggcctctgcttgccacccaagattttggcccagtcttttcataaactttgaaatatagtgactctgaaatgtatgcagttgtaatttttaggcgtacccggcagttaggatgcccgaggagggagactcttgatggttgtcttattctgggattacctaaaatgccttcttttttctcaagctctattaggtagtttgtattcctttcctccgtgccatcagaagccagtatacactatacaggggcacgcaagtccggaggtgtcttgcaggtgttcagattccatggttattcctgagctagtggccacccatagaagaagtgaaattctcctcctgggtttagatacttgttgtatcatcttcctattgaaatttgattttctgcagaggcaaggatgattagaacagaatagagtataattacattttaaaaataggtgttttattttaggcttttacctctctctgcaatttttcatgtctgcataattgttttcatgcctaattaattttacatttttatgtcgacagggtgaccaaggggtcagtgggcctccaggagtaccaggacaagctcaagttcaagaaaaaggagacttcgccaccaagggagaaaaggtatgagtgggcttcatcagtgaatactgattttctaattttggacaaattccaaaagataaagagaaaatgggtcaaaactcagtttttccagctacattcaatcctggtctggaaaacagatttatagactgttcagtccataaaatacgagcccctttgagagcagagacagctggaactggattggtccaagcctgatctgaggctcaccccgctggatcagggcttcttaaatgtgccccaagttggagatggcttggtcaggaggagggagctgggctggggggcaggaggggggcagggccagtcatcatgggtcaagcatgataaaccctgccctgcttacatttataccagtcaatgtcaagtgagtgctggagatcaacatgaatttctttgttaatatatcagaaaaaggttttttttttttctgctgtgtgtttaatgcagcatataacaaatgatacagctgtttgatagtgctgatctgtctctcgaattctttcagggccaaaaaggtgaacctggatttcaggtcagtactcagtttctgcctatcatttttaggtcaaagaccataaagatttaagtttcaagtttttttcaccttaagtttaatatctatctaatttaaattttgcttaaatagacgaataaatctctttgtctttttattcctttaaggggatgccaggggtcggagagaaaggtgaacccggaaaaccaggacccagagtaagtgctttccaaagtccttttatcataaaacaattctccttccatgcggaaaatcgcagattcacagaaacacaagaacagaaaaggctcgtagggacttctagtttatccctttcatgccccgaagggcttttccgagactctcctgagctatatcagttgcaaggcttcccaggcaggcgaggtccttccctgtttaaggatccagcactgaaggtgccaccgccggctgttcagagaggcttctgaagagccctgggccatccctgaaaccttcggtcctgctctgagagcagcaggttggttggactttgccacccagaacaccagacagtgtttgcacagccacaagcctgagaggctgagttgcttttcactttagggatggtggtggcgtgagacccaccccactgccagtcagctgggatggttctggtttctacctggaaggagcatgcagaaacctgcattaaatgaagcatttgcataagcttgcaaatactcagctgccaataggcaaacttctctaatgttagctttgctaccaagatacaatcatattttagaagacttgtagctcatcggactctgctctttaaaaatggagttctcttatattgtaactgtttcataattattcatcatatacaatattacttattattgtggtattgtcaacttacatagaaccctcatttaccttgcttgtgtttcataggagagacaacatattaagctatctgaatcagagctttggtgttatatccgttattatatatatatacatatatatatatttgagacagagtctcactctgttgcccaggctggagtgcaatggtgtgatctcggctcactgcaacctccgcctcctgggttcaagtgattctcctgcctcagcctcccaagtaggtgggactacaggtacctgccaccacacccagctaatttttgtatttttagtggagacgggatttcgccatgttggccaggctggtctcgaactcctgacctcaggtgatccacccacctcggcctcccaaagtgctgggattacaggcatgagccaccgcgcgcagtctattatttattaaatactaacgtttacatctttattctacagggcaaacccggaaaagatggtgacaaaggggaaaaagggagtcccgtaagtgtttctctgtggtttttacaagcaggctcactgttcctaccactggcctctgacggttactgcttctctcttcggtttcagggttttcctggtgaacccgggtacccaggactcataggccgccagggcccgcaggtaaacgctggcactattgtgagcctttatcttcactttccaattcaacccagaagtctgtttattctttcctagaataaaggactctgtactcaagggaaaaaaatcatttatgcttcttctgggtaaaaacacaatttagtggtttcctttatgttcatgattttttacaaaataaaaatatatgaaatgtgccattcattcaaatttttatatctttttttggtagtagattatttttttcctgatcataaagcaatagaaaatacagaaagatatcacgaggtaaagaaagcttacctaattttttctgttacctgttcagaagtggccagagttcgccttgttcctatgtgcatacacaagcaggcagtttttaaaggtgatagtgaacaagacatcttgctttttcacgtaatgatagaaggaggatctatttcaatggccgtcagtgtaattatgatgtgaacatccatgccttttgttgcgtggtatttaggccatttccaaatttgtatgcttacaagtatttttgctcacttgtctggtcatttctctgtcaaattcctaaaagcgtaatattggggtccacagtcagacacttgttttgaaatttttgccacatgcaaccaaattgccccagaaagtccttctgccagaccagggcccttttagttggggaactaactaaaaaaaaaaaaaaatctaaaaaatatttgtcaatctgacaggcagaaaaaaaaaacctcattattgctttatttttctctcttaatatgagactaggtaatgtaagtctttactaatataagagataattttggaatagtcatcaccaaaggcgaatggaaagctgcggggagggcctcagtagcctacggttaatttattaaagccagggacaaaaggaagaaacccttggctgtaattttttgaggaagtaaaatcctgtacattttaaatggtagatatatttagaatatagtggctaagatatttatgtcctctagatatttctaaaatcttctggtattcatataagaaaaatcaaaacattcaattcttgtttactgccttaatttaaaaggaaaatatatacattcatggtaaaatgtacatatctttggactgtttaaatcattacgatgacgtttatataaaaatatttgatatgaaagggttaatttctttgagtttttcatctactatggatgagattaaaccttaaagtgatcagaatttatccactaatgttttcagttaatattagattttacattatgacctccaatgcaaatttgagaaaatcttcacctaaaaacatcatataaaatgatttatttaagaaaatgtatttggaaatcatgcttttatattattttatttcatttctctttttaaaattgaaaaaccctggttgccagttccgctcatcaatgattctgttttccgaggaagtgtgcagttgatgggacaagtatctgggcttttgtaaggagaataattagcccccaacttatattttgcagagatctttattttcatgtgtcatgcgtgtgcaaagcaaaatgaaatctattcatttttgttgtaatcgtcacagaatgagagatattaaagagagaaaaatagttttaatttactgtaggcacactctattttaccagaagaaatgtttaatctgctttctgcaagacaatctttatagtaagaatatgcaaggaaagttattttttcttttgtagggagaaaagggtgaagcaggtcctcctggcccacctggaattgtgagtaagagtgctgtccctgggtctgtgagagcgctgggggaggaaggagaggaccctgggtctgtgagagcactggggggaggaaggagaggaccctgggtctgtgagagcgctgggagaggaaggagaggagatgcagggcacacacccacagctgtctctagaattgcatttgttatgtaaagtggttcatgctacttgaaatgattttctaatttgttgtacggagtttcgtgtttattatttttattatattttgataatttctgcacatctttaaatcactgaaaatgaaaaggtttgcacatgaatgagaatattagcaacatatttgactcctttttttttttgaaatggagtcttgctctgttgcccaggctggagtgcagtggtgcgatcttggctcactgcaacctctgcctcctgggttcaagtgattctcccatctcagccccccgtgtagctgtgatcgcaggtgcccgccaccatgcccagctaatttttgtatttttagtagagacagggcctgactatgttggccaagctggtctcgaactcctgatctcaggtgacccacccaccttggcctcccaaagttctgggattacaggcatgagccactgtgcctggccttgacaccttttttaaaaaaacgtggtccattgaggaaaatttttgtaagagaaacaggtcatctgtaatttaactatcctggtaaaacaatttttatttttgcaaataacattttactactggtcaacatacatattttgcatacttgtcagtgatgtgtgtgacatttaaaaatgggcattatcatgtttgcacatatcttcatggtgatcattttcagtgtcctatcagagagttgtgctttaatttttttagccattttgcccccagacttttttgaaataatgaaaatgttaccgttctctcctttgctgccttccttgcagtgccacaggtaatgcgttcacacagcccattttatttatagatttacattgaagggttttactttcattttttaactgacaaaaattgtatatatttatggtatacatcatgatgttttatatatataacttgtgggatgactaagtcaagctatttaacattggcacattttaataatatctattaattgatacaaaggaattatagttcaaaggtaatatgcaaaagttgactttgccgcttgtcttgaattccattaatttagaatcagggccagtgaattttctccttgttaaggagccgaaagtgcctcttcttgtcttgcgaccttaaggaagcgcctactttttttttttttttttttaagagtgttcctctcataatacgttgtaaagtaaaacattctgtttatggctagtatgtacaattagaaattataaatctaagcctcaaattgatgttactccatctttacctcactggagtgttacaaaagctgctgccaggcaaactattacaaaaggaagcagaaccgcctgcctggcaggatcctttgcagggatggttgcagcatgtttattccatatgctttcgttgttgttgctgtttgtttctttgtttgagacagagtctcactccgtcacccaggccggagtgcagtggtgccatctcagctcaatgcaacctccacctcctgggttcgagcgattctcccgtctcagcctcccaagtagctgggattacaggcatatgccaccacgcccgactaatttttgtatttttagtagagtcggggtttcaccatattgaccaggctggtctcgaactcctgaccttgtgatccacctgcctcagcctcccaaagtgctgggattacaggcgtgagccaccgcaccggcctgtcccatatgttttagaggcttatccccttcctccttgtccgctaccattgctgctacttcactttcatatttcttgaaataaaaacaaatatgtacatttcttcactcatactgctttactatacaggactagccattcccatgccacgggatgatcaccttttccttctcgattcaggttataggcacaggacctttgggagaaaaaggagagaggggctaccctggaactccggggccaagaggagagccaggcccaaaaggtagctttcttgcctttttcccccctcctcctactccccctccttctctcctcctcctcttcctcctcctcgtcctcttcctcctcctcctcctgttcctcctcctccttcctcctccccctccttctcttcctccgccccctccttctcttcctcctccccctcctcctctttctcctcttcctcctcctcctccttctctctctctccccacgctttctatttcttcccctctttttgtctagttttgacctgtgttcctccatattttggaagcatctgcaggccttgcaggactgtctgtgaccaggtctcctccaagttcctatttcactgtcacaacaggcttcaggagcccttcgctgtagctttgagagcaatgcatttccagagtgggggctcgggtggtctcccgctctgttttctacgttccctttggccatggacacttaccaatgcaccaagcaaggctttcagtagagaaataagaagtgtatacaaacgggtgaactgttctgtttgatccaacactctctttctcttttcaggtttcccaggactaccaggccaacccggacctccaggtgagactccttaactgatttgttatagcatacttgcacaccttctgtgctgtttatattctgaatatataatttatcacgaatgttagatatttgcacacaatcggtagcaatcttacgacatcttttctagtgatgaaagcagagtagacaagtgcttgtagataagtatcttgtcttttgtaagtgaccacttagcatgttaatgaacatgtacacccttatgtctctcctggggatccagatctattctgcccagctctgatgtaaccccaccagagccagcctgcccccctcttttcccacggctcccactgagcaggtcctgtctttccacagagccccgattctagcacagtcaggcgccttcctcctcagcgtcctgaccactttcccctctctctgggatgtttcccagctggagatcagactccaggacaaaaccccttccagctgctgtgcccagccccagccttgcctccctggaccccggggctcctcagggtgaagtcattctccagtcactccagacgtgccaacctgtgtttcctggcagactgcgctttgcagaggctcgctgttgtctctgtccatatgcgcagatgcacgtgtgtccacgtgtgtgcgtgtgcacctgtggtattctcccaggtcccagagctgacccgataagcgtctgatggaaacgctcacgtgccctagcattggcacacaacggagtgttcgcagcctttacgctttttgctttgtttttgatgtttacatttatttttgtttttatccccgtttattattttatatttgtttcctttccagctggtctaagttcttgcagagcccccttttttcctttattgggaacagacgacaccccacacagcccacgcctggctcagggcagggccttcgtccactcccactttctctcttttctgtaaaaactctgactctacccttaaaagcatcccttttgtctcttcttaattcttggattctcggaaatgtgtgacttcatgtctcctcacagaagccttgtttactgtctacagccttttatctaacccttagtggtctcttaacccagacgcttgataaaaagccattgaagttgctctggctggaggagttacccacgtccccctcccaaagtcgctgcgctgctctctgtccagtcctgccctgggctcgcctgtggccttgaccattgcctctgcccgcccccagctccctgaccgtcctcctcaccctgagggtctggttggcctcgtgcccgggtagttccttcattttcctctccattagacatgctgcccctcattcaccactcaggaagggcacacagtattttgtggaagcccacaggggccgcccctcggggctcttggctgccttggagcacgttgtgcttgtggcttttctccccagtgacaggctggatgtctcaggctctgtgcccctttggtcagcgctcttccctctcctctccatgctgctcttcattcctgccaagtcttcctgcgtcctgtttccctcgactgtcctttttctcacactctcctcatcatagcctgatgctgggagcagaagctggtgcgtccctcacagaagcagcagagctttctccatgcagcctcctgcaccaccactctctcaagccctgcgtccggcctcagctctcccaggggcacatggtcttacccttacagagttacagtggctgaacctgacctgatatgttcacacctaatggctactctgacttcaaacccttttacagaaccatcttgtgtgtccttagttgtgattttctgctctttcttctagattgccaacccactgaccatccctttgctccaggtccactttagctttgttgaatgacatttctatgccctcattggccaagtagaaatgcagtgcaccctctacagcctttttaaaatatgttgggaatactatttgcactgagagaaattcacagattttaatatctacgtaatgagtccctgttctttgaagttaatttgtaggaaacatttgactgtcagcatgaaatggcaagacacctgccagcttaatttggttttacatgtctaaagcagttcccttttcagtgatggtctggttggatttttaccttgaacagagttaggagaatgagtttatgctgtagttgctaagtggccctgaggttactgatgtgagcttctgtctggttgcaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaagtgagttccctcagaaatggtttaatgtggggtgcaagcagacaccagggtgccgggcagacccaggttgggggctgtgatagtcccccacagccagagtgtaatagaaaggcgtggattcttctaatcatccatattcctctaagggaatcttcagagaatgaaccatgctacaaaaagcaatagttaaaatttcaaaataaagctggtttaacggagtaaataacacgttaaccacctctgagactcctggcatctaaagttaaaaagcaaaactgttgagttatgtaatttttattgaaaacagaatgcattcttcttcatctagagatacaaatgaatactaggacacacacacacacacacacacacacacacacacacacaccccagaaacaaggaagacaggattacatgggtaaagattacattagtaaagtccagaaaagccagcttttattccagaaaaggtgaacatgtaacatggaagtcttgactcaattaagatggccgtgtggtcccaatacaataccaaagcaaattcgaagaaaatctccaaggatttaagccaacctgtgcaatgggagtgtgttcagatacctggagccagcctttggaacctgctggatcaaaaccaacgtgtgctctgtggggcccctgaaacacgaatcctctgtggggttgattgagaaaggattcacaggcttcaagtcccagcaagatttatttgctagaattcaagcaaatctttacgaaagggagttctcatggatgaggccactgttgggggctgggccaggactagatggagccatggattccagcctggcagcttcgatggggaatgtgatctacatgaatttgggtaggagaaagaacagatcatgtgtgactttggggaacttttctcctctgctcttgtgattgtgtgaaacatgggaaatgaagataaaatattgcagtcctggagacactcaatccagaggctccttttctctgtgtgtctgagagaaggttgtgagctctgaccaaggggcctttgggttccagattcattcagcggggaagggagtgcctgggaggcagagatctagcagtggtgacaagactcaacagatcctgctgtcctggagcaagtattccatggggctgacaggggttacccaagacaagggaattctcatgaatgcaggagatgataagtccagggataaacttaagcaggagagtcaacagagggttctggggtggggggtgggcaggggattgtggttttaagcagagtgatttacaaagacatgaagggggtgagggagccaatggtggggaaatctgggaaaaggacattcttttggatgttcgtaattttgcaagtgatgaaatataaacacacgtcatgtaaaaatatgaactttacactcttgttaattgaatgggatgtgttagctgagcacattgtaatatttactattccaggttttctaggtggcctttttagtccacgtaaattaagtaattctcaatcacagagtatcgagtaataatttagaaatgagatttgtactaagatttataatgtatgttaaagaggctacatcttaaagccattgctacctcaggacttatcgatagagcattaaccacacaatgcagccatttgtgcatgtaagttctgccactgcattcttgtctcaagtgggtacagccagctctaaaccatctgtggctgcagatacccttgatgagaaggcgttgtaaaatgtaaactctagatttgcactttagaactcctcagaaataatcactgcataaaatgaatttaaatggactttggtgaggatgtactattttttttttgtttgtttgttttttgttttttgtttttttgtcagggatttgaagggattctggttgagctgaagcaggcaggagttatgctctggaaaaggagtataacagttacatgtctctcaatattcttgagcatacatttctagagtcaaggaattagtataccctaggctcacagggatgagagatgtgggttctttcagtgaagtaatttaggggctgctctttgaagcataaacatggagtccactttgtttaagacgatggtgccagctgcaccaatgtcgaagggctaacgaggagccaggcaggaccagagtcaccaggagcaggtccctagcagtggctgtgggggacccatggtgaccccacttgggctttcttgcctcctgtgctttgtggggagaaactcagggaaagacacataagcacataagcaacaagcaaagcaaaagcacctcccccatagttcctacacagcggaagctaacttgttctgctgagctctaaaccaagtcatcaaacaaggtgtgggatctttttaggcattctggttctagctggggtgggcgagctggagagttgaccttggttaatatattcaagcccgagggagggccccacagccccactccacaccctggggcccttctatagtctgggactcagggcgtccaggtgacagctgaacagagactgcccatgactttgtcattaggtgaagaccctgtaagggagaggggagggccttcagtgctggtgcatgagtgttagggttatgcctgggcagggatgctggataccaagttgttcactgtgtcttttttcttcaaggatcttggggaaggaaatataaactccatctcagtgtgtatccaaatcataaaacaataaacaatactgatattttttactagaacctaggacagatggtgtgtacattactgcagtttatttttatgcctctttacataaatgatgctcagaattgaatgtgaacaatttgaggcatttcctcgtgggcagtctgcagctctaaaataatgattagttttgctgtaaattgggttagagggggaaaaaaggaagaaaatttttctagtctcagctttgactagatgcatgaccctggacaaatcacttacctttcttgagcctcagtttcttcatttgtaaaataagggtgatggtaggcacttcgcaagatgaaatgaaatagtatacaggacagggctgatgcacctacagatacttcagaatttgtgaaatagaaatgttggcagtgatggcttgggatggtgagtgggtggtgggtggtgtgtggtgattatgttttgcaagtggtggatagcctaagatgattttgaaacaaactaaagctgaatttctaacacttgtcaaatagcctaaaatattttggttttataatagaggttgagttaggagagggtaaaaacacctagctatgatcctataactctgacaactcaatttcagatggaattgtggaatgtcagcccggacctccaggtgaccagggtcctcctggaattccagggcagccaggatttataggcgaaattggagagaaaggtaagaaattttgatttttttaaaatggtggttgtgtctttgcgtatgattttttcccacatacttaccggctttggagccaagtgggggtgggcagagttagggcgtaggttccttttatttggaaccctcttcacaatctcttcctagaataagcatcttccggaacttagttgatgatctgggtgggaaaggtggagacagccctgaaagtcagagttttgccccttctccctttccgaggaccgtgaagtcagtcttgctacagtgggcgtggtcagcagataaaactcagactgatttgttaccgcaatctttccattcagtgtttgagaagagacttctgttaccaaagaatgctcttccctccttcaagccaagtcaaaaatctgcacatggaatgctcaccaattcttccagtggtgtttgcatcatcagtgtgagcaaatctaccgttgatgcattaaccagcttcactctgggctctcggttccatctttaatctttccaagtgtttgccttactacccgcacaggacacttatttatctcttccgccatcctagacacagaggtggattatcactgcatcaacagtcctgccttagaggggaataagcaatggatattctgatatttatatgcctgttagtaacccgagagtaggacaaataggaggctgtccctcaaatcaaccccactgtgtaccatttctgcctgtgaactgtaaacatgttttagtcttcaaatgtgtaagacagaaatgatgcatggaaaagtttcagccagcatcttagaattctgacagccacatacactgcaggacctgaaatggaagcgatcttgggcgtcatcacaggggtgccactgatctgagtcagtgtacagtttgggttttaatgagtctgtctgctctagttaccaggcgctcagtactttgtgagatgggctcttccattttatgacagatccagcgtccagaggttcttcacactgcaatcttagctatccatcccccagatcctaggagaagcatctgtcttctcgagtcttcccattcctctttcgactccatcgtctgctgggaatgcaccttgtctccccacccacctgaagccttgcgaacagacacacccacgaatgccccagtgcccagaacttagctgggttctcagctgtgttgtaccgtgccccttccactgatgggctcctgctctgcctcctgaaagagctcgaaatgaaaccatgtgcctgctcccacacttcgggggcatggcctacctgcactggccctgttttacttctgactgaggggcatcccagggcagagtgggcaatagcagtgcccgtgtgcggctgccagccagggcagggatgggaagaacatggccacgccgcctcgatgtccctggcatgggcttctctgcgagcactttttgctctgtattatgcctgatttgtgcctagaaaccagacatttcaatatttaagacacaggaatagctaagacaatgtaaggtctctgagcttggcttgaaaatcaagacttcagatgttagaatttccaaagaagagcatctcctctcctttttcagggctgcagtctctctcctcttctgtcctggatcacatatgtgttcttgcttttgtggcttcttattcccaagtccaccaaccagtgaagtccatgaactggactaagcactcaaccaaagagaaaggggatgggtagttttcacattacagacaaattacaaaagtcaagtcttttcaggctgataggcacagttgaatttctggaccactttttactgaggcagccctgtcttttcgctgggagaagaacttggatctttaagcagtgcgtctgtggtcacacgtgacgcgtgctgggggcagtgggcccgttcattgacagacagggacgtgcgtttgactgcagtttccacccattagcagagagctgtctggaggagccattgccactgagcaaacctaagtttggatgtaatatgttagtgacagccttgcctttttctgttctctcagtgcactgcggagacttctggtcacatgttacacgtaagcacctttgtgttttcttttttaggtcaaaaaggagagagttgcctcatctgtgatatagacggatatcgggggcctcccgggccacagggacccccgggagaaataggtaagacccacatgtgaaaaggaccaggtcagagtttgctttggtgtgttggcatctttcctgtgaaagggatttcactccatagaaggcctgattttcggcagccaatcctaaagcataatcagaagaatgttgggccccacttccaggatttgtccacattgctgggaatgatcaagatggcctcataaagatttcctaataaaagacagcagcataacagttccctccatgccacagattctgttatctcacaagcagttaatggaattcatgtttttcctttaagtggtccctgggtgtgtgggcaggggggcaggtgtggggtgctggaagcattcctgcttccgggtgtacatgtgcgtcgggtcacctattccctttctgagtccgtcttgggcattttagttattactctctttggattatccaagcaatcatccacttcctatacagatttttatgcttttgagtcttaagaaaaggttttgagaagtgtctcatgaatgctgtgttgctgtctttttccctctctctcacgaaaggtttcccagggcagccaggggccaagggcgacagaggtttgcctggcagagatggtgttgcaggagtgccagtaagtaaacctgtctgagttcatgtacatatcagaagttgccaccaagcacgtggacagagttgtgtcgttttgcatttgcaagcatggcttctgccttgtgtgggagctggtaagtgttgctgtgtcgagccctctggagtgactccatgcggcccttgtctcaggagaatgagcaagactgttacccacagagcccaaatcacagctgcctttcttctcacctggtcaacattttttcggctgctgccgacctgtgttcaggtgtggctgaatgggagtgtgtccttccctcagggtctctgggatttctggaaacaaatggtgtcacaggagccacccccacacagccacagtgcagagccgaagtgccgtctttctgtgttaccagtgctggtaacatcatatcagatcatctaaaagctggttagtcagtaggttcagcatcaatagtttctatgaaaagatcaaggaaagcagatctgtttgcctctgaggattagaaatatgtttttattcttcttcttacagttgaaaatttctgttacaacatctattgtgcagttgctttttcaaatccataaatgaaatatccggatcacattgacatgaaacctttcaatggaacaaaataccagcttcttagcttttgtagtttgttttaaaagaatccactaaatagaagagcataataataatcttgaattttgaaggacattattttcttgcatataatgacttctgtttctgaagttttgaaatctcaaggcattgttcctctcgtattttctttgttcttctgagctttgcgagcatggactggtttccacaattcctttcattcctttttttctttttgtaagatattgaaagtcaaatttcagaattattcatttctgatgtagcccttcaaattttttaatttttaaagatattgctggaagcttctacaaaagaaaaccagggcaaaagcgagttgaaatagcaatgacccagctggaattcagcaatcattttctgcttttgaagttagatcttgggcttttgctctccagaacttccctggtgcctggggagctgagttagaagttgcaattgtttaagatatatctaaataaattagaagttcaaataactgggtagccctgactgtagtggggatcaaagacagaagaactttgaaggaagcagaaaaggacgtttttaacctctatgcaccgcttcatctcctgggctttcctggtggacttcctgcctcaactctggctgaaactcagtctagacatatctaataaaagacggaaaaagaggaaagaggtgagaaagaaggaatattgaggaaagatcataatatagaagaaaagaaagaaaacatacaaccccaattctactccttatgccttcatcaggagctcctttctttccggagttggaaaaagtctctaaaaataaatttatgggtaaataattcaattgagaagttagtaattttccttttattggaagctgtatttgaagctccgtgatttaactcgctcagaaatgtggttctcttattttgaatttggctagaggctaaaagagatatccataaacgagcacacaggagagtagattaaaatgtgaaatgctctgatttttcatttgacttagatagcatttctgtgacatttccttttgaaagacaagtatttgattttggggaaagaataatgaatcacaaaaggccgactccccgagcggattgatgatgcccaggttggtctgagcaggtttcatggttcctggtcactgggaggatgaattgaaaccaacactccctgactttttccacagtggcaccactttttagaggcagacagcgtaggtgtcagattttctccaattaatgcagccaatgctaaattttccaggcagtagttgaatcctcagcatttattttcagggagacggatcaaaagacctttgaactacttagaatcaagaagttctgtggcaaagaaagcacacgagatgtcctagggtcaccaatgtcactgttttaaaaacccagatttctcccgtaaatagaatgatggcaggcaaggtcatcattgttaaaataaaaaattatattttctcaccctaagatcacagtattggggagctttatatttttaggctgtgagtaatcaccataaaataatataatgatgtttgcaggttgagaaaaatatacattggttataatttcttacactagtattttttaatggatgaatattgccagttcagtgtatacttcctccagtatctcttttgttctggatgccaaggatacaaagataggaaaccttggtcctaccctcagagccctgaaatactagtggagagacagctctgcaaatagactgtcctaatgaagcaaagtgatttacagaatgaggaccagaaggcagcccgagcccacaagaaaggccgcatagaggaggctaattttagctgggattgaaggatgcataggagctaatattaactcaagagaaacagtttaaaaatcccaaaacacctttcaagtaaataacaaattttccatgactctctgctacaatttctggcaggtggctcatagaaataatttgttgcctttcctgggacccagagcaaatagactgggtgtgttccacctttcctgagtagatccaagtgaagtgtcccaggtcataaggggcattagagtgcggggccagctcagaccactggtagtcgtccatgagaagcttctgccatgacaggagcgtgctacgtcagtgccatctgatctggcagctgctggccagtggtggctgttgagtctttgaaatgcagtcactgctgggtacggtggctcacgcctgaaatcccagcactttgggaggccgaggcgggcggatcacctgaggtcgggagttcgagaccggcctgaccaacatggagaaaccccgtctccactaaaaatacaaaattaactgggtgtggtggcgtatgcctataatcccagctgctcggaaggctgaggcaggagaatctcttgaacctgagaggcggaggttgcggtgagccgagatggcgccattgcactccagcctgggcaacaagagcgaaaatctgtctcaacaaaacaaaacaagcaaaaaacaaaacaaaacaaaaaacaaaaacaaatgtagtcactgtaatggaggaactgcattttttgtgttatttaatttaactttccaagtcatattgaacagtgcagagagttgctgccgactctctccatacttctggaagcctgcttgatgggattgggccaggagtcagtgcatcgtggttggtatggaagatggaatgggaggcagagcagcttctcccgttccttagcctgcgatgtttcagctgttaggaagcaattcaggcaggaaagcaagtctgctccatttaggttagtcccacatttgctgtttgtttgactttgagcaggacacagaagtccttcaagccccacctctccccctgtgtaatgggcagattttactcgctcatccctaactctccttagcactccagaggcacaggcataaggtacaagttttgcagctggaaatgcataaatgtggatcccagttccagcactttctggctgagtagtcttggatctatcagctcacttctttgagtatcagcttcttcctctgctatgtcctggtttccatgttttccttgcagagctgcaataagggtcagagatgctatagaatgggtcatagtgcctagcaggctggtaaccaatgctagccatattttcagtctaaagattgggcaaatgttggtctgtccttggttgaccaacttcttcctttgagaagcacatagcatctgtacacacagaagcgtgtgcatgtgagggattcatacatatctaagaaccttctgcaaggaagtttatgaaaaaaaattcacattaagtgaattgtgccagagttaaaattctgccaagtcgacagggagtctgaagatgcctttctcaggcctaagtgaacaagtcaatgggacaattgttggaaacattttctgtttttcttgtgaaacccaagtctcaggatgctggaggagaagccattggtgggtatgggtgttctttgcagttttaactttccaggaactgagcaacgttctagtgtgagtctcttgggaaagtcaatttgactctgctgactcaacataactcattttagagctggcccagtgcccactcccagagtttcatctctcactggtgccctggaagtccttatctcttctggaattctgggcatgagcataaaaggaagcctgttcaatatgcacaggagtattcagcactggccaggaggtgctgacgggtagctcagtgggcccagaagctggagaaaaggcttctgcgtgctgccggtggggctgaggcagcaggcagagctgaggacagcgattgttctttgagtctgtctgttactgaagctgcacaatgaaccacacatcaatcagaaccttctgacaggtgctgtgtgttcctatgaatgttgagcagttgttagggtaagaaaactcctggaggagagctgggtgcccaaagccacactataactccctctgccccatccaggtctttgcttgaaatatctaattaagataagtgtttttaagaaaaacacaagaagtgcagcagaccagggctttgtcacagagctcctggcttgcatctagaaaatcaatgatgaggcatgaatgcatgaccattttcaagaaggtggcttcttgattctatggttgcttgtgttacagtcacactggtgtgcttcatggatgggttcttctgtggatcacaaggctttgttcttacagggccctcaaggtacaccagggctgataggccagccaggagccaagggggagcctggtgagttttatttcgacttgcggctcaaaggtgacaaaggagacccaggctttccaggacagcccggcatgacagggagagcgggttctcctggaagagatggccatccgggtcttcctggccccaagggctcgccggtatgtttatctccagactttgaatgtgcattttacagtgtggatctgcaaagcattgagaaatgagtaatttgaatcatattgatgtatttctatctccttgatgatggcacaaatgaacttgtttcatgattcatggttcatggaacaacttaagtctataaacctaggcattgccagttattattgacaaataattaggtgataacagatcagtgtcttctgatgcatttgggggaactgaacagatgtgtttgtgtatctttttgctttggatgggaggtgaaatctaaagttaatagtattcatgtcattgttttcaaaagattccaggtatcaacatctcattctctaaagtatctccctaagtagatgagggaggaagaatgctcagcttagggagaagaatgctggtttcacttattaactacaaggtggccctcctgggagggtagatgaagtaaataaatagtgtgagccagttaactctagtacttattgaccacaaatgtcagaagaatgcgataaggacagggtgttggtgtgtctctgataacggtgtctttttcttcttctcacatcagggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtgaggcctgagaaactcgtgatgcagcatgaagttgtaaacggaggttagggcaggcacctcgggtgcacacagaggcctggggttcgcataggccagggcgcacacttggctttgattcttccaggaattggggcaggacctgggcaagccttcagccttttgtgcctccctttcctcatgtatgtgatgggccaggtaatatgcaggtggagaacttgggtttacagtcctcataagtaagtacacagcacgcaccagctaaagtcagcctttgtatagaagtcacaccgaggtcaagtcattttcctctccttacccatttggctttccccgatgagcagcccattttggcttctgtgcatcccgagtggtgtgatctccacctcttcacagtcggcagacgcctgtgaatggatttagaggtcctacagcgcgatgacgatttcattccatggtggttttagttgtctgctgtttttggagtgaatcacgcgccaagctctatgctgagcattgacaacacatggtcaaaaccacagacgtggtccctgccctcctgcacagcctgttcagaggttttccagagaacctgtagcagggatgagtgtgggctccctcgtcgttctcctctcccacgacttgcttattttcagggccagcgggagggggctgtggcgctaggccttgcacacagcaggtgctaatagtttattatctgactgcgattcccagtagacatggagcacgcctgttcttccctagaaaatcccggaatgagaagaggagaggctaggaatgccttgtgtgtagatgagggaagtaaatgcgcgttgctaggaaacattcaaaagttgtaaaagtgagtgaaaggacttaaggtgattaaaaatatctaactagtaaaccttaaaaaacatagttatttataaagtagctggggccaggtgcggtggctcacgcctgtaatcccagcactttgggaggcagaggctggcagatcacaaggtcagacattggagaccagcctggccaatatggtgaaaccccatctctactaaaaatacaaaagttagctgggcatggtggcaggcacctatagtcccagctactctggaggctgaggcaggagaatcgcttgaacccgggaggcagaggttgtagagagccaagatctcgccactgcactccagcctgggtgacagagtgagactccgtctcaaaaataaataaataaataaataaataaagtagctggatatttgaaatacccaacaataaccacgttggagcaattacagcatgccgttctggctcgcaagtgtgctgattatgtcaataaccatattgagcctgttttatgaattcctattcccattagggactaatatttccttattaatatacagtgtataggctgggcacgctggctcatgcctgtaatcccagcactttgggaggccaaggtgggcagatcacctgaggtcaggagctcgaggcctgcctggccaacatggtgaaaccctggcatctgtaatcccagctacttgggaggctgaggcaggagaattgcttgaatccaggaggcggaggttgcaatgagctgagatcgtgccattgcgttccagcctggatgacagagcaagacactgtctcaaaaacaaacaaacaaacaaacaaaacacacacacacacacacacacagtccagttcctaagcattccagtatgggaaatgtcagccagtgtttgatggaagcccaggtgtagtgtgctaacataactgttactcttatccttctccctgttggtataatcagtgagtacttagcatcaagttctgactctgttgatggttgttctttgtttagaagcgtcccagaaatgtctcttttatgactccattagaggtaggggataccgggtttgatggaggaggacttcggtgagccaggcatagggacttccgatcactttcccttgggtctcttgattccacaatcaacaaatcaagtgctgtctttgtgcttgtgacatctgcagatttccagagctgtcgaagggaattagcttttcttttggcgagaaactaccatcagagaaaccaactggagtactcacaaatataccctagcagatggggaagaaggcttctggggagggggaacagggctgttgatcctctctccccacagctgtagggctccttggccatccagagccaattagcttcgagattagaaaacagatgtctttgatctgccagagctgtgtgtaactgtggtaatcataaaagcctggtgcccagggtgtgtgtcaccaacagcaggcatttcctagggtcgttcagttggcgtttcccacagtctgtagctaaagaatgtgctggctgttctagggaggccccacatagcttgaactcttacgaggtgtacgaagattcagtgcgtgcattcttggaggggaagcctttggtcctttcttaacagcgaaaccctgacactccggtggctctcctaggcatgagtgcccagagggccggggctgtgcttcctggcttgggaggaaggatggttttgcctgtgttgctcaagtgagcgcagagctctccagctgcaccattacagataatggatcgttcgtaatcacccgcggatcatgttgtttggataatttcccaccaaacgaccgtaatttaggtcaatctcaaagcaacttagactttggtaaattgagagagaacagcaaaagtattttgactttttgagaccggctcactaagaaatcacctagagccacctcacatgttgttgttgtagatttttcagcttcttgtgactcttaattgtggactcttaagggattcttgtgtccaacaaacatcttggtcattttggacatgcaaacgcatggggagaagcgtagctctctgtgaaagatcctagaaacaccaagggaagaagtggagaacacaggcagaggctctgctctccgggcactcgtggtgctgggtaggatgtggcgtgcagcccacccactgcgtgtcctccctgtgttccgtgtggtcctcattccttcatcgtttgtctttgctctttttttcctctaggtccaaagggtgaaccaggaaaaattgttcctttaccaggcccccctggagcagaaggactgccggggtccccaggcttcccaggtccccaaggtacgattggaattccagctcaccgggataccacgagagtttcctcacgtttttctcacgctgactgttggtctttctcaccacaggagaccgaggctttcccggaaccccaggaaggccaggcctgccaggagagaagggcgctgtgggccagccaggcattggatttccagggccccccggccccaaaggtaaccctgccagacggacccgagcctttggtccacctgtgacttctgtgagaaaagaggaggtggtagacatcaaaacaccacagaagctggtgaccgctgttcagggaggctttcagaagagcccaagcagtgctgagcccagtgatttcaggagcttctaggcaatagctgccttgcagtgtagggtttggttgggaagatgggacgctaaggctgtgcaagctgcatgggcactgccaccaatggtgcccgctgaaacccaccctccaggtgtttgctttttatccgtgaggaagactcgcagtccacctgaacacagccagggtgggttgggagttgggggagcgcccagggggaggtgcaaggagtcgcagggaggggcctttgctccgaggggaggagtcctaccggtgttagagccgtcacttcctgctgaaaactggaaggaggtgaggagggaatttcttttccccctgcttttcacatttcttaggtctacttgtccctcaggtagaccttgatcaacacacttgtcatcacagaccttctgttcaggactgaggagaaggtgctgtgagcacaaaagggacgtgttgtgtaaggaagtttgtcttcgtacaacacaccacgcagccacacttaggttgaaatctcctccaggctcccaggcttcttacccagaggctccaggccccatccaccctcactgctgtaggctgctagcttggagaacaggagacggcagcccctttcctctgacagccacgcaacgcccacccacaccacggctgcttccctcaggctgggcgggcagcagagcatccctgttcaggagggccaggcgctgaggcctcgtcacactcacaactccctcacattccaccattgcctcacacagtgcctccttcacctgaggccgtgacccatgtgacatggagttgcttggctttgtggcagtgaggaggacagaccctatctgtgcagcagcctcacagaagatgtgattcgggtgtgtgccactgcaaacttacaaattactggacatcggagacctcagtgttgcatacaaagggtctgaactagtggctggccagcttcatagcccatcagagcttccagagcggggcccagacagtgggcaggtgtccttcagtgacagatcctgtgggatcttgaaaagtgggcctgccttatagacccctggggtctgcatttctaatgaagtgatggtggtgacctgcccccccaaccacaccttgagtagatgaataaagtgcccttctcacctgcaggcgccaaggggtatatttgttttgtttggggagagtaggatgggaaagaaaagtttgaagagagcagaagaaaaggaaaggagagagaaagaggagggcagaggtgctggaagagacagcaacgcacctgacccctctgccgggcagtctcccctggcctcttccagccacctcggaaggcctccacagttgaccttctcagatcaggtcggcatctctgggcaagactaaaagtgaagaaagtggggaacggcattgtaatcgcaatgattgtttgtttgttttttttttttgactctttaaaacaggtgttgacggcttacctggagacatggggccaccggggactccaggtcgcccgggatttaatggcttacctgggaacccaggtgtgcagggccagaaggtgagtgccaagcattccctccatgacccttctcccccatccttgttattagttggatggaaaaaatgcaggttgtgaacgtcccaggacatgttgggccagcagatttttgtttttgatgaaataacatagaatagaaagtatcagagaacgtagcacatggaagtaagtattttgaagggaaacacttgttttgattttatgaaacatttgtttcaattttatgaaattttatgacagacattttcttgcctgtgtaagctgaaactcagggtaaaatatgtttcttactgtgagaagcagatgaaggctgtttgaaagccactgtcctgaaagaaagcatagtcacccaggatggtttctcagcctcagcactactggcattctgggttcaatagctcttttctgtggggggccaccctgtgcctttgtagggcttttgacaggagcagccctccctccacctatgggtcaccaaaagagcatcccccttccacccagtcacaactgaaaatctctccagacattggcaaatgtcactagggcgatcagattgccccggcttgagaactgttggtacagggtgaagtcaggattctccttgccctcaaatattctgctaccaacttgcctatacttgaaattctgctcagcaaatgtgagcgactaccgattagatcctttcctgtcctgattgtaaggaaccaatgtgaaattgccagaaggcattggtaccaaacgggagaaagggccaacggccatcgataaacgttgccagtgatggacccaggtggggcctgctccctggccctcaggagagggcagatgggcaccacaggggccgtgcctctgggatcccaggggggtttcttccggagaaatacctgacagcagggtgccctcctctggtggctgaggcagaagagaaacctttggacctttgtctttgtacaacccgccaccagcttcccctgataacctacgttgcatttgaacatttagtcaaccgcggcaacttgcggatcatcttaaacttagtgcaagactcaggagttagtaaatgcctaatggaatgggaatgaaagatttaatttatgattaaaaataccatgctttttcaagcatccccttgatggagtttgttccattttgagaatttccttctgggacaaatagggaagttaccactgcccactaatgtccaaatcctccctctctggaaatatcatttgcagacaggggacaccggtggagccctgtgatttcatggccacctgcttgctttggagcctcacatctatgcctaaatccaggctgtttccaaggcaccttcaccctttattttaatcatctgtatctatcaaagcccagtgactcatgccatagtttaaaatgcttaatttactgtgaaaccttcattaatccaaaaaactaaataactggtgtccatgctagccctggaaccttgccatctcttaggaagaactccattaactactcacaaatcatatttggcattttaccggttactcagggccagtgctttgtcacaggcaccaggctgcagagttgaggggacaagctcaggtcagaagacttgagaaaaatgtcatttatccgtggggagccttgcttttcctcctttgtaaaatgaaaacaatgaaagttacccacctatggggcttgtggtgagattgaaaagatataataggtatgaggaagctttgcaaacgcttgaaaagggttgagcagataatattcttactaaatgcattggcagtatctgttaagtcttcacttacgctattggtttgataaaaatactgactttgcaaatcaatttgcttctctgtgctttggggattttcagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtaacttcatgcagatcagtctggagggtttcgaggacaggatgtgcttatttttgcattcccagagcccctaccgagtatatttgatatgtatttgttgaacgaacgatgcaaatcttagaggcctagagctcgtggctttccgttgctggggccattcgtgtgcatgggtctcctaggccgggagacgtgccactgctcctgtacagcttactctcaatttttcttctccaggtgaaccgggacctcctggattgccaggctccgtggggtctccaggagttccaggaataggcccccctggagctaggggtccccctggaggacagggaccaccggggttgtcaggtgagtgacatgcttctagaattatctgttcccaaaagcatgcttttctgaagcatgggggatgaggccggggtccctataaagtgaagcttagcacaatgtatgagataaaaagagaaaaaaataaaactcgagtttgtgaaaataggtttgattgtttgcttaaatgtagtcccagattcttctcccacccactgagatgatgtgccaaacaaagagacctttcctttattgtgtactccgtcacgtttcacattttattctaactgatgtctctatattatctttccataggacggttaattagtggtggataatttcaactaattgagtccatgtctagaacctagctttgcctttgatcataataatcatagaattaaggtggtgcatggaaattagagcaaaactagccctagtcctaagtactgcgacaaggcagtggtggtgcttagggtggccttgctgactctcaatgacaggaaaggggagtgcttttcttttagaacaagagccatttgattatcctgatgaccccaaacaccaacacctaacagatgatccattcaagttcccagtgtgggcgtgctcacgggctttctgcagaaagtcatagttaaacagagcactgtacattgtagatcattctgtaaattctgctaaaagttatttgtgtttcacccaactgcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggtaagtgatttttgaacttctgcctggatccatcatgaagacatgggcctcaccttattctttttatgactcagcatttactgtcagcattcagagcaagaaaatgttcacagtcctttcctttggccacaggttccaagggagaaatgggcgtcatggggacccccgggcagccgggctcaccaggaccagtgggtgctcctggattaccgggtgaaaaaggtaggggagctgataaccctagaagctcattttgtgtctatttctcgatgccacttgggaaattctcaagttgtcatagatcatatttccctttaagacgcctacaaaagaagttaggaacatcaagcagaaggctgggagacccccttcttccagtaggattcctggtgctcaatgcacatggggttgaaactgtgcttggccaagcaaatcagaaagaagctgggctttccttcttggcacagatgagattcttcttgtgagaaatggtggaatcttcagccatgccaagatacagggaccgagtccttaggctcagattaacaacctgcgcaagtttacaaggcttcgtctttatttcttatcgttatttgaagttgttccaaaataatgtcttttacaaagaaatactgtaaatatgacacatgaaaaggtcatttgttttgtagaatgataaaattcctgttctattattttgtatagaactgaggggcactatgaataagagtgataaagatatgtaggaaggagagaaatgtaagttatctaaacctgaaagccaagtcacatgcagtagagttattagcgaataatgaattgtagaaaatggctttttactgctcatttacctggggttggattcttctgtgtctcagacactggccattaatgccattttggacaagttatgagtgctttgtagcctttttgccagctgctgtccctgtcaacaagaacgtgagccttttgagcacctctgtgacactggcccaggctcaccagtgccttctctttcctctgcaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggcaagtccaggaggcttctcatggccaagctcggaaccacaatgtgcctttcctgggttatcgggtcctccataaataataaccaaaccaacctgcgtttctgcagcaacttgcttgcaagcaaatgcgggtcattgctattttcttctctgatgtgtaggacaaattggaccaattggtgagaagggatcccgaggagaccctgggaccccaggagtgcctggaaaggacgggcaggcaggacagcctgggcagccaggtacagtgtggagctccggtccccagtgtggcaagggctcaggatgaggcctgtgttccccagctctttctgtagatgtcaacctgtcagactgctttctttatggttctaggacctaaaggtgatccaggtataagtggaaccccaggtgctccaggacttccgggaccaaaaggatctgttggtggaatgggcttgccaggtaaactggatttagaagaggattctttagcatgtgtgcgtgtgatactggtagggcatgtctgcagaatgagatcctcttcagctgagacggacagaatccaggcacgtgtgtctttcacatgaattcacatccccagctctgaatggtctcctgctcagggatggatgacatttggctgacagaatggccattgctaagaaaactcaccatctaatggaataaaacatgggctgtatacagtcaacttttgatgatctccaagtgaccatccccttgtctaggatctccctaagagacgacggcttctccatccaggcttgtcagcctgagtagcttatggctccagagccctttgtgttagttcagaagaattctccggactcctctgctccaatcccggactagccttaatgctttgccatcagtgtctattgtagtgagagcagccgggaagaggaggagagtgcgggaagggctgggtggtgatggtcctcagagctcactcagaaagggggagagttcagatgggaagcccatctttccatctcctcttgagtcttgaccaggtgctgttatcactttaattaaaatataagcatctagattgctggtcatgcctatgtgtgaataagcctggctaccagcatgcatcacagaaccgagtgtgcacagactccggcctgcccgcctcatagtccctgtgacgtctggctgatgagagctggctgtataataaagaacataagatccatttttattctgttgagaaagtaaatattctaggtagttaatgtatttcttccctgtcttataacatgatggtcttaaaggacgggagagacatttcctagcgtggctctgatgtgatctgggtgactgacgtgttctgggtcatgagccgattgatacatgagggatgtgcattcttgtatctcaatcttggctggttgtgggggattcacgttcttgtatctcattcttggctggctgtggaggcactttttcatttgtaataccagcactagctaagcccaaatcaagtttcaattgtttgtgtttataggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaaggtaaccagcgctctgcgtggaaaggtccccttctcccagctcagtggagatgctgcctgagaaatgctcagcaaatatctcagcacactcaatgagccataacacacagggagtcccataaggcagcacaagtcgcctctccttccccttgtattcactacctctcccccaaggaagaatctagagactggtgagaggctaaggtgggagacagctgtcagtgggataaaacagagaggatggaggacgaagaggaatggcaggtagaaaccagatggttggctctactgctcttaagttttcctctccattcagaagtggactttgattctttgatgagaaatctggaaatggagttttgcaatgcaatattcattgcaccaaaatgtataccattatctataacatgcctacagatgcatgcccatggacaaatgtaaagttaatatgcctgacttttacttgcagggagatcaagggatagcgggtttcccaggaagccctggagagaagggagaaaaaggaagcattgggatcccaggaatgccagggtccccaggccttaaagggtctcccgggagtgttggctatccaggtaggtgaggggggcttctcttggacttggggaatctaagaaatcaaagaaaagcccaaacttatggatgttctggtgttttgtttttttctttaggaagtcctgggctacctggagaaaaaggtgacaaaggcctcccaggattggatggcatccctggtgtcaaaggagaagcaggtagagggccctctttgggacacagcccgggcacatagagaacagtggccaggggatgggaggccccaaggagttcccatcacagacggggagcagggaggccagctgtcctgtctcccatcttcagatgggcaaactgagtctagtgcaggttacaggatctttctgaggtcttgtcactagcaggatctaggacctaaatctccaaactgtttttgtggccatcatggagtttttgtcaccagcttttgagggtcagggtttggtggtgttgctgaaagcacgcagggtcctttctgaagggaagtcagaactgacctcaggaaaaccaggtgtgcttgggagggaacagctcccttaaaggatgtcagcaaagggccattttgtatggcagctagggtgctgtgagaggttatgcgggtgtctgatgtgacttttctctttgaggtcttcctgggactcctggccccacaggcccagctggccagaaaggggagccaggcagtgatggaatcccggggtcagcaggagagaagggtgaaccaggtatggcccaacgccccattccctatcagaatcagcagtgtccactcccagagacctgcagactgcctgtgttcagtgaataaagctgggcacagaatggcccctagactgcacatccctgcaactacttaaacactgatgtggatgtgtggagtagagtgggatgagtggaggggaagaagggaaggggtatttattatcccataaatactgagggcatcttcccctgaaataacctgagctctcagtggtgagtcagagacacataaaatacctgctgttagaacactttccatttcccttgtggttgctatgacaaaacaaagcaaagcaaaacaaaactcttttctttgcccagcatttccccatttgaggggaaatggttggaaatattggttggcccctgagtctgctcctgtcactggtgggctttaacttggccataacttggacaaaagtgcaggtgtgatgatgacaatcacatacacagtaatatttgtatttaatgcaagagagagataaacacaccatttgaagcaggttacccctgacttggggggacactgggaggaccaccaagagcatccacagctattggtgctggctttcttttcatttttttcattccataactttatattctatacatttgtttttctatacaaacaattcataaaaatacccctgcactcctttcccccgatttgaatcttccctcaagccctttgctgacgtttgtcatctccccagcatctgctgccccaaatctctttggctttccccacctccctgagaatagcaattagtggatggttgtctgagaatcccatttgcttatctccagacggcagcaggaaacaaatactcatttgcacagatcatttgtgctaaatgccgtggtggttctgagctgaaaggtacttaggaaaaagtactaaattaggaacattcagtcaagggtatcttataactgtaggaatatcattttattacaagggtgcaattaactaatatctatgtactccacaatatacgtagtattattgcagagttgatagtgctttgtgttgtacctgcagatggattgtttaagtaaagagaaacgtggcattttaccctcatcttataggtctaccaggaagaggattcccagggtttccaggggccaaaggagacaaaggtaatctttgctcactgtgctcttccttttcaaccaaccgctgctgcctgattagcagaacaaggggcagtgtcttcaggatgaagccccatgcctgttggccaggcagcaacgggatggaggatgggtgctgagcccagagggcaatgcctgcaagacacatgtggttcccttctaattaatggatcaaaatggcgtgcagtacactcatgatcagaattatcttttacttggactaattttgtaaaaatccagcagagaggcgagacccctgtcatttttatgcctagaaggtcatcagaatattgaaattctgactttctagaactggttatacttatgtgaatgcaggacagtatgtagcacacaccacgagacaaaaacatgccctgcgcagccacgatgtgctcagtactaagtgcagctgagagttggccaggagcttgggaaggcagtctcttctctcagagagctgagcatttcatgggaaagcaaaggggacacagaaaatacaaggcatgtgagctgcacgacactgaagagaagccacaggtggccgcagccaggagctcacacacagcatccatgggcatgcttatggcccgtggctgggctggctgagtgatcccactcagtgggaggattcagaaagccctggaaggccttggacttcagctgagaaggagcaggggcacggaggtgttgtttctcccaccccctggttctccccgagaccagcccagagtgtttccttggcaggcatgtagtctgacactgggaacccctgggttgagaaggatggcctggtgccgggtgggctgccttgggaatggacacttccctctcccttaactcacagaatccctcaaacacagagccccttgcaaatgcacctgctcaaggggtcgctgtgggctgttcctgccctgcctttcctaccttgccatgtgatcccgcacactcctttggacatgctgcactgcccttgcacaaactctacgcagcaccttgcgttttccactcattgctgtgtgaaatagcagggagaatccccaggagaagagaatcccaaatgaccactttaggtcttgaccctatttcattcccttttcctttgttttggaaataaccttagaattttggcatttttattggtaagatttggatactatgtttaaaactaaacatagaatttctttttcctacaagctgttactttttaattttttaaacctgctctattgaagtttcactgacaggtcataaactacaaatatttaaagtggacaatttgataaggctgacataggtctacaccatgaaaacatccccacattctagatagcaggcaaagccttcccccaaaagtctcctccgtggcttcataatccccccctcctgccctctccccattccccaagcaaccgtccatctgccttctggtcctctaggttagtttgcattttccagcagtttacaaaaataaaaccatacacttcgtagtcttttcagcctgactactctcccacgacataattcgtttgagatccagcccagtggttgctcacttctttctatggctgagtagtgtcccactgcatggatataacatgattggcttgtccagcccattcatgtgctgatggagtgaggctttcgtttagcagtgcagttgctgcagatgtctttaaacacaattcagatgcctttgccatagaacacgtctcgtgagaagtatgaaaacgatagctgggttcctagcattctgagctctttttccagccaggccatggtcggattctagtgtgttattaaagagaaggagggatcggagcccttgctgcagtttcctgtggtgtccctggaagctccctctgagcggtacctacaggatgaggcacgcctcatcccatctctgccgtccacgctggagattactgttctgctgctgcgtttcccatcacctcaaactgtttttcttgttcaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggtaagggcatctcgccaggggccagggctgaggactgggacagaattcacaaaaggaaatagcgtaaaagaaatagttaaattctcaattgggcttttttatttagaagtctgcagcatttattacagcttgaaattgtgtttggcccccatcgagtcaaagcttttcttgtatcctttctgtcaaggaatttaagtaattagggagatgcaagaaaggaaatgattggacaagcctggactcgtgccccgtcggtggcgttggacttaaaccagcgcagcacttgggcccacttgtgggttctggtgaagacccccgtagtggtagcacagatgcccgggcaccactgaccgcaggccattttggacacggagacagtggcatttctatgtctgtccttccttccttccttccttccttccttccttccttctttcctcccttcctctctccctccctccttcccctcccctcccctcctccctcccctccttcctccctccttccctcccttccttccttcccagaccttcctcaatttctgtctcaagggttcacattgtcggtccagtgttttatcagagatagtagtgtttctattccctccctccctccctccttccttccttcctggacctgcctcgatttctgtctcaagggttgtcactgttggtccagtgttgtatcagtgaggggccgtgggtggcagtattgatagccccacagcccagggacacttgtgcatatttaaccccaaatgtgtggctttcttctcttccattaggacttccgggacccatggggcctccagggcttcctgggattgatggagttaaaggtgacaaaggaaatccaggctggccaggagcacccggtgtcccagggcccaagggagaccctggattccagggcatgcctgtgagttattgatttgtagatttttatttttaaaggagtcttttctggccagaagtattcatatgtgtctatgtgtgtatgtattttgtgtatgtatatatatgtgtgtgtgtgtgtgtgtgtgtgtgtgttacactcccacatccccactaaatcagttctttctttctttcttgccagtaacccacatctttattggcatcagagtaggaaactattgtaacatttttttacaatccagttttccaagaaccataaaagggaaatgttatactgctggaaattatggctcaatgcctaaatttaagacctatttacaaactcaatgtaaaaagcaagccaatgttgttttgcagagaacaattctgtaaaactagcccagccatctcttaggactggcaggaggacagggaattgcagttgaacagttcaagtcataaaagataaccagcaatattccatctttctttactgacctgatccagatacagagtctaagtggtgacttagacaagccttcagaagagcacatctcagggtgcaataagtgaccagcagccttgtgtatttctgtgtgtgtgtgtgtgactttggctctttgctgcacctgaatatatagcccttcttagtggtggtcatggatctttggtttgatttttagcttaaccatgtccatggctaaaggattgtgtttacgtggctcgctcattcaaatagctggattagcagagctttattctctgtgtctgtctctctgtttcctctatctgtctccatctgtctgtctctctgtctctctctaacacacgttaggagaaagagagagtatatcaggggagatcatgaataggagggatttgagacagacctctgcagttatgttggagcaagcggggttcttctgtaagtcaacacatgttctcccttaaagggaaagctttgaactgctcatcagcagcagagacatatcttagagtcatcagactactttctcaaggatggatacagaatagctaagcttgctgggtgcaaaacaatacgtggtgctgatttacttctgaatcagtaagttatgaaatgcttataaataattatgcagaactggctataaggagtagcaacagtcatgtttacccattccttgtcctcaaagctgtgtatatctccacagtatagcaaatgtgtatgtgaatgtatttttgggcccctattgctatattgcagttttccagtaatgtaagcctaggtaatttgtcaaatatttatgtattctcatttttattcctcagtaacatagaaatataccccattcccggctgggcctggtagctcacgcctgtaatcctagcactttgggaggccgaggtgggcagatcacctgaggtggggagttcgagaccagcctggccaacatggcaaaaccctgtctctactaaaaatgcacaagttagcatggtggctcatgcctgtaatcccagccacttggaaggctgaagcaggagaattgcttgaacctaggaggcagagattgaagtgagccgagatggtgccactgcactccagcctggatgacagagcgagactctgtctcaaaaaaaaaagaggaagaaaaagaaatacaccccattcctggtgccagtcagtgtctgtctgtctctgtatacatacttatgtataaatatgtgtttgtatatatgtttatatacatatatatttgttcatgttattttggtttgacacttttaaaataaggctaagaaacaaatctacgtaagaaataaaacaacttgttacatgttgctgtccacgacttgagaaaggaacgacttgttgaaatggaaagaaaatgagcccctattttaaaatacacgaatattgccacagtataaaggaaaatactcgttccttagcatttcttaattttctttgcatatttaaaatcagttttcagataagacatgaaactaattctaaagaaaactgattgcacttgaggattaaggggaaagttttcagaaaagctcgttggctggtgctggatggctatgttgccgtcacaggtgttgagggggccctggctctgtctatggcatcgtgctgtgagctggaggtggcaagggcaggacatttgcctgctcctcaggcgcttcccctgtggatggacaagcagaggagatacatgggagggaaacaaatgcttctactttccagcttcccgattgaggcacatgcaaaggtgttgttattctgtcatttaagaaaccacaaggcaccatttgttcacaaatgtgctttccagaacattgaggggctgtttccattttccaactagcaggttactggagagacttaacctacatatcctgagcaattcccaacctcctctttgcgtgtctagggtattggtggctctccaggaatcacaggctctaagggtgatatggggcctccaggagttccaggatttcaaggtaagacagcacagaccttgctgcacagcctttgcagcagcagacgctgtgtgaagagcttgctaacctcgggcaccttagcactgatagcaccgctgccattatagcacgagatactgttctcttcaaattaaaaatggcatttctgtgtggcagcccaatttgtataatcttatggatgccagtgtaaagacattctgattttcttattaagaatcagtggatcattaatatctcaataagaagtcatggatttgggctattcattaatttattcatatattaaacacacatttttgggctgcttaccagctccccaggcactgcagtttttactgctgagtcagatacacgtgaaaggtgaataaaacaggtcgcagcctcaaggtgtcttgtggtccaactggggacatgtgtgaatcagatcgggaccaaaaacagtgccctatgcccctccactagttggatcattttacagttggctgcatgcttataaaaatgtagcttctgggttctagaaaaaagagtttcattaaaagttttacacacgtgaccagaaataatgctgttttcttccttgaagataaattggaaatttgttcactgtctatgtgtgcatatatgtgtatatatgcatatatgtgtgtatatgtatgtgtatatgtatgcatgcataagcaggtgtatgaatgtgtatatatgggtatgcatatatgagtatatgtgtgtgtatatgcatttatctatacatttgtgtacatgtatgtgtgtgcactagagagagatatatacacacacatatttgtatatcattgggaattctgtgcaagacagtgctttccctctgcttttaggtccaaaaggtcttcctggcctccagggaattaaaggtgatcaaggcgatcaaggcgtcccgggagctaaaggtaggagagtttgttgatctgtggacaccttactggtgctttgtgaaaatgtaaaagccaggaatgcacagaattggggtgtttggtttttcatatgtgaaatgactcaaaaatcattaaaaacaattgatagggaattctttgcagcaagtcaagattcctgtagttgacattttaaccagcgacttgtctgaaagtagaatctgataaatccaggactgagggaactccaggggaggggtggccgaggttctcactgacaggctcagaattcagaaacttcccaaggctctcaagttagcctgaaatcaaccactgaaagttataataggaaagaaaatcaatcttgcacttagagacggagtgcattcctgctgcacagtaaagaattcttcctgggaaaggtgctgttggcttctccaccggtgggagcctacagcatgaaagtcgccgaaaaccacatcatctcaaaagggaatggtttaagcacagtattcatcctgcttcctctttacagcagaccatacttctagggcatcatttaattttccaaaccatgttttgggagagagaatgagaaaccacatgccctgagaagtggaacccaaggaaggagaggggagggagggtgtgtggaaggtgagggagggtgtgtggaaggggagggagggtatgtggaaggggagggagagttgagggtattgggctgaaaacggggaggctgaggggaactcgcactttgtgtggttcttaccacatgccaagacttgccatgcagaagaaggattaagttcattcgtcactcaaagatcaggaccagtgtgatactatacagtaaggcaggtttcagatgagtgtgggaaaaatgtcctaatcgcagagtggcactctccacgtcagaagcgggggctgcttgggaagaacaagcttctctccctgctgggagggctggcatgaggctgcagggcagttgtcaggggtcccagagcccagaatgcagtgggaagttacgctgatgccccaatgcctttgcccgagagttcaggatttcaggttaaataataaagatgtgcagattggacatgttttgtgaagatctgattacctgggttttgataatgactttacctttgagaagtacgttccatttggatagcttcacccgggattctccttctaaagttgtttccgccccagtatgtggacagtgaaattgatcaatgccttccctattcccacaggtctcccgggtcctcctggccccccaggtccttacgacatcatcaaaggggagcccgggctccctggtcctgagggccccccagggctgaaagggcttcagggactgccaggcccgaaaggccagcaaggtgagaaggcttggcctgtgcagggcggtatggggagcccagaggggcagtggtcagagttcctcctcacccatgtatctaaaataagtttctgggtaatgattatacacacacatatgaatatgagtttcttacctcccttcaatgcatatcaaaacctatgacatttttaaagggacctaaaaaaaatccagaagaaaacccaggaaaagctagaggaacacataacaacacatctgtgttcagttagaaaaacatgggctcaaagaaccagatcattacctttccccctcctgcctcccgctccagatgggggtggcatgtagcaatctggaatggtaaaaatcggtgctctccatccatgcccccaggagcgctgcctgattggcactgtctgtacaattctctgttatttcctgaaaccctaacatagtcttctgcttatttgagtgaaacatctcctatttgaagagctactgataaggagtgggtgggaagtaaaggagaatgaaaacattttaaagttgaaagcatcaaagaaaatttaatgatacttaagaataagctagccaggctcactgggtcacacctatgtaatgccggctttttgggaggctgaggtgggaggatcacttgagcccaggagttcaagaccagcctgggcaacatagggagagtctgtctctacaaaataataatgataaaattagccaggtgtggtagtgcatacctgtagtcccagctactcgagaggctgaggtaggagaatcgcttgagcccgggaggtcgaggctgcagtgagcggtggtcacaccactgcactccagcctgggtgacagagcgagaccctgtctcaaaaaaaaaaaaaaaaaaaaaagagagagagaaagaaagaagaagaacaagctatgtacatgaaaacaaaaaaactatccatgttggtatatctgttgcctaaaaattgagaccccagtatatggctgagagggaaagttatccagtctctcattccctccacatcacctgccttttccaaaccaatctgccaaacagcaagaaaccagggagaactcagaacgaggtgcccaaacacacacccccttatgaatatccagctgcttctgcaaagtctgtactcgactttgtgggaagcaactcctggctgtccgagaaaacgttctcatctgcagtgagactttatgcttggctccttgaacactgaaaaggacatttaagaagggaagaaagagatacagcttactgccatacaggatcataaattatttttcctctgcctcaggtgttacaggattggtgggtatacctggacctccaggtattcctgggtttgacggtgcccctggccagaaaggagagatgggacctgccgggcctactggtaggttgcgaaacttccaacgtaattacccttgaccaggatctttgggatagaaggagcagaaccaggcatggggaaacagcagaatgaagttggatatatcacttgacagatttccgaagaagtctgtttcttagaagaaatagaatcaaatagaagagctgaagaagtgttcttttttctgtgtagagacagatattgatcaaagtgtacgtttcccagatgttgttgaaaggcagccaatagtggtggcccatgtggtttcctaagtgggatgtgagctgcagctgtgaaaattctatttcagcaaaggacaagggaagtagaaatgaaaataatgccagcattggcccaaaggcatgggatgaacttgatctgcttccttaggagaaggcacactcgagtgtccggtgaaggctatgatgcaaaaggctgaggccactgactaattgaacaaagagctcagcccagcagacctgggcacagtttggcacgtggcacagttagagaggggacagaagcaggccttgcctgcgaggtcccttactgctccatttccatacgcaggctttgggctgctatggaggaagaaacaccttaagatgaggttgtttaataattctatgatagtcctccccaacaggagccccacgattccgtgtgaatgacatgcacagagtcacgtcattcatttattttcatttattcatatatccattttcatatgtgtcatatattcattgaactaaattgttcaagcatctgctctgcaccgagaactgtgcttataaaaatatcttgaggtggcaggtaaaaagaaaaagttaagacaccatgaaggaggtaggctgctgtatttagttagccatgcattctttttagacttttttggtaacatgaataggtaggatactttgtggaaatataaaatattaaaaactctttggagaaaatgattttgaaagcctttaggggagcgtgtttgtaattagggaaactaatttgtctcctatcttccaggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggtaagaagcctgcagatccatgcattcattcagtgtaggtgtgttgagtgccttcggtgtgcagtgctggactcgcctctgctgctgcagtgagggcagtagcgagtgaaacactgcgccatgagggcggtagccagtgaaaaagcagcccggccccatttccctccattgattacaaataatcggttcaacagctgctgtattactaatggcaagccaagaaatgtggagactgaatcttcgaaaatctttaaattaataaaactttagatctcatcttcaaattatcaagtaggatcaagattcctggagtgcacttaacaatttgcattgatgcggcttaaccattgctctttgtaaaaaaaaaggtccatgttatcctgtctgaaattctctacagctgctgagctctgctcctctagtttagatcagcagaaagctacatatctgtcctcattatcttaatctgacccagatatcctccaccaaactgtgttttaattttctctgcctttaacttttatcagggttagaatcagcaagctgctatagaaagagcatctgcattttctgcaaaactgttgtgaaagacattgcccaatttgttactatccatcgtataacgaaccatgtgttaagttccttctagaattcagctttaggaaaaggtttctttgtgctggtaaactggttttgtttcctttcatcaaaaatgtcctacataatcctttatacatttccatttcagtgattatgttgattatatgtttttgcttgttgtccagctgaaatccactttacatagagatagattgtgaattataaaggaaacatctcacattgtcttcttccttgtctaggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgagtcgagcatctgtaggaacaaatgcaaaattgaagaggaaaagtctctagtctggacaagcatatgttttctatttttctccaaaacgttgaatccattgccatttagcttattatttgtgatattcgagttttgtaatggaaatctaccataaaaattatttgacataaaagtcagttggctgggcacagtggctcatgcccgtaatcccaacactttgggaagccgaggcgagagggttgcttgagctcaggagttcaagaccagcctgggcaagatgacgagacttcatctccacaaaaaatacaaaagttagctgggcgtggtggtgtgagcctgtggtcccagctacgagggaggctgaggtgggaggatcacttaagcctgggatgttgaggctgtagtgaactgagaccacaccactgcactcctgcctgagcaacagagtgagaacctgtctcaaaaagaaaaaagagtcagctattctcttttaaaattgtggtgcaaaaccatggtgagataatgccaggcttgcagagataatttatattttgcctgactcactgtggtggttgcctttcctcctgtgagcaaggtgatgccactcgattcttcagcaagcgttggaacagtgttgctcaatctttctttttaaaaagtaacagcttccccaaggagccttttaagacattgttttctgaatcatccctgcccctatgaatttttttttttttttttgagacggagtctcgctctgtcacccaggccggactgcggactgcagtggcgcaatctcggctcactgcaagctccgcttcccggggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccctatgaatttttttaaaagttatttttaattttggtaaaatggacataacataacatttaccatcttaataatttttcagtgcacagtgtagtggcattaagtacatttgcagtgttgttttaccatcaccgccatccgtctcctgaacttttttattttcccaaactcaaactctgtccctgttaaacactgactccacatccctcctgccagcctctggtgaccccccattctactttctgtccctgtgaatttgacccccgtagacacctcatgtaagtggaatcatacagtatttttccttttgtcactggcctgtttcactcagcataatgtcctcagggttcatctatattatagcatgtgataggatttctttcctacttagggccaaataatatttcattgtgcataggtgccacgttttgtttctccattcctctgtcactggacacttaggttttgtccacacctcagctattgtgaacaatgctgctatgaacatgggtgtgaaaatatttctttgagagcctgcttttaattgttctggaggtacacccagaagtagaattgtgggatcatgtggtaattctatttttagttatttgagaaacctccatgctgttttccacagtggccacaccctttacattcctgccacagcgcacagggtcccagttgctccacgtcctcaccagcatgcgttgttttctgcgtttttgatagtagccatcccaatgggtgtgagggggcccctatgaaatcgtaataccgcagacatactgtgtatctcctctgtttgtgtattgtatgtatatctgtgctttatacataaaattatacagatttatacataaaaagttatacaataatacacacactccccagttccaccagtttttgctcccttgggtgatattgtacccatcgaaaatgcatgtgttggactgagcgatctcccttgagtgtttatccgcactaatatctgaagtacgttttcaggccccaggagcctccctgataggaagtaagatggaaaactgaaattattaccactgaaaataacatgactgtcctctctttgcctctttccttctaattaaaagtttattgctggccaggcacagtggctcacgcctgtaatcccagcactttgggaggccaaggcaggtgaatcacctgaggtcaggagttcgagaccagcctggccagcatggcgaaatcccatctctactaaaaatacaaaaattagctgggtgtggtgttacatgcctgtaatcccagctactcaggaggctgaggcaggagaattgcttgaacccagcaggcggaggttgcagtgagccaggatcgcaccattgcactccagcctaggcgacaagagcaaaactctgtctcaaaaaaaaaaaaaaaaaaaagtttatttcttagaaatattcagaaataataggaaagtggccagtgaacaaattcatttgactaagaagctattccgtaattttactttttacatattaagataatgataaaaaaagatacaaagttttttatattccctttaaagaaatcagcagtctttgaatatgaagaaagatgtagcagtatcaggtaggaagtgccctacattcaacagaaaagggaaaagggaagcaaatgcttggagtcacccctggagctcctgcccagctgccccaggctgtgcctttagcccaactcctttcattagatgaacatgccctgtttgggggaagaccagggttacgtgccaggcaattcctggcagatgacaatttagtgagagagctatgccacgtgggaccatggaccagagggctggaaggtgcctcctatgtaggaaaatcttagatctttgatccccttacattaaaatatctactgacagttttctttgattttttttgagctataagaaaacttattttataggtcttaaaatggagaatatcattcattacacttccagaatggcacttttcagaatgcaggcaatacttcacctgtgtgagtggctgccagatattgactgttttgagacttttcttgctcagaaccatgcctgataactagaaggaaaagtaacaacttttgtgggtttctttttttagcttcttttacacaacaggtagaaaaagactattcattgataggtttcctgtttactttcttggcaatgttgacatttgaccttgattcagagctccttgacaggagctctggcatgccctggtggtagtccaaaaacaggtctcagagaagctgtgtgtctgagaccagcatttctgtgtgatgcattcctctcagtaaaacacccctggtctttgagcaccaagagtctaagtctctgtatgttttgatcctgagatgagcttctaaagccaacggggaggtgctaaaccttagagtctaagcaatggggcacagcatttcccacttaacatgtcattggaccagaaagtcctgaaatgtcccaggactttacatttccagatttttatgtcttcctgttagttgacacatcgaagctcagcatgaagggaccttcccaggcatgtacttgaagctgctgcttttgcatcaagtctgcctctacttccctctcgtagagaggctgcccctttgtccctgtctctgagcaagcaggtttccacggttactgaacttagtggtttccacgacttctcaggacttacaggttccttctcagctcttccctttagggaggtccgaaagctaaattttagaaacagcaaatgacacaaaagccttcgttttgagcagaaaaggtggcagttttccagctttcatccgatagtagggcacaattttctaagtactttctagctttctgcagacaagactcacgaaataaatactgattgctaattgctctgacgaaaagaccgctggattgagagcaaggagaactgcattttcgttctgtcttggacacaactaaccctggccttagtttcttcatatgcaatatggagaatttggccatgtgaattttaaggaatcacacagctctttaagcctgcaatggggcaggacccttgaatccctcagcccagagacagtctgaaaaagacaaaacccttccctccaggctgtatttctaggtctcgtgtctagcaaacagatggtggcagatgtataaggccaatttcagtcactgttgtttaactgaaccttttaattcatctgcatttgggtgaataaaatagaaaattgcacacaccacacatacacacacacacagacagacacacacacaagtccatggaaaatcaaatgactcattcagccctattcccccttctgatccacgttcatgcaaatgtcccagtataactaggtgtaattattgacaccatttatagtcatttatcagcattgttaacactctgttcattttgtgacttgaatgtaattattcactgttgacgtttaatttttttttaaacaaagcattatcccaccatcaagggttcccttcattgagagggtcttagtcagaacactgtgctgttttaatgtgtttctggtgcagtcccaaggctgagctgaatcagcctggcttgggaggcatcctgtccttgggagggtcctctggaggtcacttcagcggcagtggatgctgacagccttggaccttggacatctgagccaagagggcagaccaaaaagacaagtttcccgcaggaggcccatgtggacattcagccttaagttcattaaagcatgcattatttgtcttagttactcaactcactaagtgcatttcttatactaaagattattagtagcttcaaactgttgcattccagaaggagtagctcttggatttcaccagcattttttctgaagcatttattgtgcttgtggaaatacgtatgcattgttgaaagattggaaaacactcaaatgcccaaagaagaaaagttgcctgtaaccccagcccctccaggagagccactgttagagctttgccttcctattttccccttctacaagacagacagttaaataactcgtgttggatctattttttaaacaatattttaggggcaggtctcgctatgttgcccaggccgtagagcagtggcccacaggcaggccgagcatagctccctgcagccttgaactcctggcctcaggcagtcctgcctcagcctccccagtagccaggactacaggcctgtgtcctgctctaattttttttttgagacggagtttcactcttgttgcccaggctggagtgcattgacacaatctcggctcactgcaacctccgcctcccaggttcaagtgattctcctgcctcagcctcccgagtagctgggattacaggcatgtgccaccacacccagctaattttttgtatttttagtagagacagcgtttctccatgttggtcaggctggacttgaactcctgacctcaggtgatccacccgcctcggcctcccaaagtgctgggattatagacatgagccaccgcccccagccatcctgctctatttttgaattgaatgttttaatactgagacaggcttataaaaccaacggggaggtactaaacctcagagtctaagcaatgggcacaatgttttctacttaatatgtaattggaccagaaagactgagtgaggatgttgagtgtaggtaacggggcagtgcatggagggcggcctctgccctgcaccccggctgtgctgagtgtctctgctccacttccaggtgtgctgtgtgtgaggcgcctgccatggtgatggccgtgcacagccagaccattcagatcccaccgtgccccagcgggtggtcctcgctgtggatcggctactcttttgtgatggtaagtgtctggggagacgccatatttcccgggaagagccccactcacgccccatagtcgcctctgtctggtgcctccacaccttggagttctctgcatctcgctgcttaagcccctccttcttcctccaaccatccccttccaaagcatgcctcaaagcctggcctgccctgcctggtgacagcaggggtctccagcaccagccagaaccctcccctgctcacagccaaggtagctgggatgagcatcttcctggaaatgcaggcccaggcctctgcttccctgtggctgctccactcaggtgctctacgggtctgttccagcaccagcaatatgaacagcttctctatacaaccagcttctccatacaaccagcttccctatatgagcagcttcttcatatgaccagcttctccatatgactagcttctctgtatgaccagcttgttcatatgaccagtttctctatatgaccagcttccatctttgagcagcttctctatatgaccagcttctccatatgactagcttctctgtatgaccagcttctccatatgactagcttctctgtatgaccagcttctccatatgactagcttctctgtatgaccagcttctctctatgagcagcttctgtatatgaccggtttctctatatgagcagcttctccatgtgaccaacttctctatatgaccagcctctttacatggagtggaggcctctttcagggaaaggaggaagagagcctccacgtggggagtacacattctactacaacatgcacgagcttgaaagcagaagcttgagttagggagagaacacccgagggctggccgtggcctccacgaaggccctcctggggcagtgccgcctgggacccttcccagagggcaaggactgctctcctagccccagggcttccctttcccacaaaagccaactgaaacagaaaacaaggcccctgtttgatacactcattgtagcttattttattctattaccccagttggcagtattgattgaatatatacaagccgtgaacttgtaagatcagagttatcccggaatttgccaattcccagtaaatgaccctacacatacatctgcaccatcattggaagtcctagtcccatcttcacactgtcaggaatgggcaagttgtacatttgacccacagatgaacattatttattatctgattgacaggcttcatagctattttcttctgtaaattattccaattgtagaaaaaattggcgggaaagcatttttttaatgtttgagtgaggacgctgagggtagataacaaggtaactcacggatggtgtggcgtctgccctgcgccccagccgtgtggagggtctctgttccaccttccagacgtgctgtgtgcgaggcgcccaccattgccatttccttctactggttttttcttgtgcttttctacacatttttccaagtgtagaaaaagttggcaggaaagcaatttttaaaatgttcgtgcacgtgtacaagtttgattgtatgatttgctgggttgattgtactgcagctacactcttcatgttgcaaccaccagattaacaggttgttgcaataattcgaagtgctgcattgtaactactttatcgagagagccagaaaggttgaaaatgctgtatagagaaatcaggacactaacaatgatgtaagcttgccatgttcattaaaaggtagattggattcgccactccataatcataagaaatactgagtggaatctctgtgtgtcagagaaagcccacagttgcattgaggacccacaggaaagctgttgtcaccaccaacccttgtccgggtgtcaaaaggcctgaaacagtgattgcccataatttgtctaaatcaggagcaaacgaaaatagtgacgttctagagaacagtgtcttccagcacctcctctgagttctcaggacggtggctctgatctggaggtctggagaccccgtccttgcctctgctccgccttgaagctatgtgatcctggtcagatccgagaatgtcctcagctgggaatcagtggagttagccttgtcctcaaaggtcccttgtgtctccaaaattctagagttcacatttcctatatctgaaataatagtcacggggctctgttgtaatgtcttagtcaagtttgtatgtcattcattttaaggtcttgatttctgagtacaggaaggtcctacttaaacctgctagaccaaaatgcaatttgatatagtagtagctatttttttctctttctcttgtttttctctctttttaaagaaaaaaaattgaatgattattctttaccttattataagataaatagcatctaatatagcaaatacaggaatgcatttgtaaagtctgattccacatcagttgtttacaacattatttgaacattttggctattgtctcatgacccatgttagaatgggttggagtgtttcaaatctaatacacagtgagctcttctttaaactctaatgaagctgggctggtcacctatttgggaagcagccattagacgatccctggggccatgctgagcaccatggggccccagccatgcaggcactggcttgcgggccagcccgataatttgggcacagagtgtgtcctgtggtgaccacatgaggctgcagtgtgtggctttccagagggaacaccctggcgccttcctgggaaggatcgatctctttcctggtgtttggggagggaacctctgactcacggctcgcatctgttctgcagcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagtaagtgggagcactgcttttttgcaggctgctggcccctttgtgactttattttttaatcatccgcgatccgtaacaccttccaatgcaaagtctcaaagatggttagcaatgaatatttgatgctgttcgacatgggcagatgaccgagacgattttcaaaggcagaccttcagtcacaggtttaattttttcatttaccgaagaaccatgaaagaaaaaggtcattttccattttttctaggtgagtgtactaaaatgtaattaaagcaactgaaatctccaaacagagcatgtttgaaatacagtatatttaacaatcccggggagaagaagtgagcagcgttcattttcatgccattcataacactgatcgtaatgtacactttgtgtaagttctgagtgacttcacaaggtatttttttagacctgtgcaaataaaaattaatttcagcacaaattcagctgaaactgagagggaagacccttccttccttttccattaccaaaatctcacctttaaaatgactggcccaagtggctactaaccttgctggagttgactgggagccgggccggtccccgaaggccaggaacgcataatgaaccctctatcccgagccccagctgcagccccgctggagccaatgcaggaggctgacggagctggcacagctgcttactgttcatttccaaaacaagcgcttctcacccctggagatgagcctttccatcttcacctttttggagagaattatatggaaccctgctatgatcctgtctctttccagcttagatagtaagaggcagaacaacatacacgcttctctaattcgttactcatccaaaaagtgccgcgtgcctaactggtggtttattggagcctttcaaggaactggaaacttgacatccatgctgcagatagagtttaaccattcactaccaaaatgagcgcactttgttcatgcctcagcccttgcggtgtcctcttataaggttgataggtaatgatgggttttttttttttaaccagcagcctgatacaataaactaaaatgttttcccaaagcaaattaggtaagatcccattaatttaaataataaacttgagggtactagaatttgcaccaaaagttaataaaataagcagcctcaattttaggatgaggcactctcataaatggctattttaatttagtttaattaatttatttattttaatagaattttctcagtaacaattttagttcagattttaccttttcaacaatcaaaataatgtagagtttctaagcttgagaaacacttgggacattgaatgtctttccctctttttggtctcaaagcagaccatctgcatagaaatccttcaaaagttataaaagtatttcgaggtctagggaattactccagatttattactcatcacatcattccacaaatatttaatgaatacttactgtgtgtgtaaagtgttgcagagaagaataatatcttcttcttaccctggaggagtttatgatctagtggaggagaatggaaaaaaagtgaaattgtagtacgaggaggcagggtggcacagaggggaatggccaaggcttcggagccagactgatgtggcgggacttcagctgtgccctatggggctgtgggcactggggcaggtgccagggcctgggtgtgcagctggtaacctgcagtgttctgtgtgcgtgggaccgtgtgtgcactgcacccagcacctgcctgctcactgggtggtaccaggttgaggcctgatgccaggggctgggctgatcccttagagatttccgagcagggcaggagtgccatgtttctgacgtgctgtgagatgatggccaatggtctgtctctgtgtcgtgttttaggaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcacaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctt

SEQ ID NO: 37587 - DNA, 158148 bp, Homo sapiens; identical to SEQ ID NO: 37586

SEQ ID NO: 37588 - DNA, 113405 bp, Homo sapiens
ccctccccggccagcatggtaagtggaattggagcccccttccctcctggggtgccctaccggaagggtgggaatgggccccggggctgctgagccatcgctgctctccccatggcggggagaggcgcgtgcggagcctggccggtgacacatgcgtgcagagtgtgcagccccggccctgcgctcccatccccccagggatgatggctcaggcctgggagggccctgggagcgcagcaggcacaacccttgcatctggtgtttgcctcctgcagctcctccggataataactatcgtttattgagggcttactacttgccaaggccctgcgcgaagtgattgacagtgcagtagtatttaatgatcacaccagccctctgttcggaagtggggagactgaggcacggagcaattaattccccagctcaaggtcaagcgactttttaacagtgttaagatttgaacctaggcatctgactttgaacctaggcatctctaatacacttagagagctgggtgattgtaggagaaacatctcatctagctgtaggtttatatatgaggaaacagagcgatttacagaggtcacttgcacaggtgatggcaaagtcaggaatggtcgtgatcttttgacactgaggctgctattctacatgctctgatctctgctgaagctaccttccacgttttctagaccgatactttcaatactcccctaaatgtgtgtactcacatctctttgtgtatccacatctccacgttttctagaccgatactttcaatactcccctaaatgtgtgtacccacatctctttgttaagcatttgcctttttgctcttgtaattatttctgagccttatctgtctattgcggtatacacagctccttcaaagaccaaattgtttgaacccttatctgctccagctcctggcacatagtaagcccttggtaagtactggatcacctagcctgtggttgagcacctcgaggagtggagctgttctcctcagtttcacccattttacccctgccaagttagtggtataatagagaaagggacatagctgcatcttttgtgatacagaccttaaggcctgtggaattttcgaaacattcaaggggcctgtgggtagtgtgtaggtcctgagatatggagcttacaaccagctgggtaaagtacaccattaatgctgagcagcaccgtacagtatatgctatacgtatagtgtatgtgttttatttttatttgttttgagacagggtcttgctttgtttcctaggctggagtgcagtggcacgttcatggctcactgcagcctcgacctcctgggctcaagcagtcctcccaccttagcctcccaagtagctggggctgcaggcaagtgccaccatgcctggctaattttttgtggagatgaggtctcaccacgttccccaggctggtcttgaacctgagctcaagtgatccgtcctcctcagcctcccaaagtgctgggattacaggcgtgagccaccgtgcacagctgagtctatgtattttaacatatatattacacagtatgaattgtggcaaatcagttaagctctcagttccaatttcctcaactatgaaatttggggataggatttctctaaagagtaatctagaggtatgaggtataacatttagtggctaatgaaagtagcactcattccttccttcatttattctttcagtaatgctttttttttttttttttttgagatggagttcagctgttgttgcccaggctggagtgcagtggtgcagtctcagctcacggcaacttctgcctcccgggttcaagtgattctcctgcctcagcctcccgagtagctgggattataggcatgcgccaccatgcccggctaaattttgtatttttagtagagatggggtttcaccatgttggtcaggctggtcttgaattcctgacctcaggtgatccacccgcctcggcctcccaaagtgctgagattacatgcatgagccatcgcgcccggcctcaatatacttaagttttgttttttaattgtagtaaaatatacataattaaaattagccattttaaccatttttaagtgtacagtttagtgaaattaagaacattcacattgttgtgcaacgatcaccaccatatatctccaaaggttttttcccaaaacaacctgtacccgtcttttttcagtctctcccctgccctactttagtttctatttctatgaatttgactactttaggtagctcatgtaagtggagtcatgaagtatttggcctgttgtgactgccttatttcacatggcacagtgttctcaagcttcatccgtgtggtggcgtgtgtcagagcttccttccttttgaaagctgaattccattgtgagtatgtgctgcatttcatatatcctttcatccttcggtggatacctgggttgcttccaccctttggctattgtgaataatactgctgtgaatatgggtgtacaaatcttacaagtgaattttcagtagccaccaccatataccagggcctagggcatgtacagatgaacaagacacacattcctccccttgggaaacttacagcattgctttaggacccttggacagaattttgttattgactgagctagcccagcacccttgtattgaggtttcattttaattggcagtcagtagagcatcatgggaatgaccacctttgagtaatgaattgtaaagtagttggcttcatgaactccatgtgcattttttctgaggtacgttgcaagtcaaagtttttgtcacctagacctcagttatttaagtacacagggggtggccatagttgatgtgaataggattgtcctttttgtgtcactgacacagtggttcatctgtaggtatcccagggtcaggggcttgggtagggtaggccctgtcccccaaaggtaaggaaactgttgcctggctggtgtcttacaggcggagggtcttttccctgggatcccagctctttattccaggaaattatttcctctccatttcttgctgacttaacatttttacttttaagggtattagttggcataagtttgagcccttttaacatcttctttttaaatcttcaactctaataagacttgaaagtggcgtaatgtgataaaaactaccacttattaagcatctttgatgtgctagctattcttcactcattacttgttttttctttcttttttttgagacggagtctcgctctgtcacccaggctggagtgtagtggcatgatcttggatcactgcaacctctgcctcctggattcaaatgattctccagcctcagcctcctgagtagctgggattacaggcacgcccagctagtttttttttttgttttgtatttttagtagaaatggggtttcaccaggttggccaggctggtctcgaactcctgacctcaggtgatccactcgccttggcctcccaaagttctggtattataggcgtgagccactgcgcctggccaagtttttctcttagtcattcagtatcagtaaaccccaccaactctgctaggttccactatggctgttcctgccagagcgggagatggacagacctgctctgtgattcctagttgacaagtggtggagttggcatttagacccaaagtgctgtactccggagcctgtgctctttgggtgctgcctcatgggaaggaagatcaggagagtcttccacctgtatgttgtttggcttagagatagatagtggtggagcatagggagtatggggaattttgtttacactatccctgttgaccttcacatttagaaccagtttaaaaagatttatagttgcagtatagaattacaggaagagctagcatactataactgtatttgattaaatcattttttgttgcattcccatggattcttaagtggtgtgacatgttagaggttcccactactttgctgagaaattattacttagtattgagcgagctgttgcttaatatgaaaattgtgtgcaaaattgagtttttgcttatattagcatttcttttttagttgcttagaaattgaattgcctgctaaggtttgttttctttctttctttctttccttttttttttttgagatggcatcttgcttttgcacccaggctggagtgcagtggtacgatcttggcttactgcaacctctgcctcccaggttcaagcaattctcctgcctcagcctcctgagtagctgagattacaggcacccaccaccatacccggctaatttttgtgttttttagtagagatggggtttcaccacgttggtcaggctggtctcgaactccagacctcagatgatctgcccaccttggcctcccaaagtgctaggattacaggtgggagccaccacacctagccttatttttttaatatcagttaccgtgagtggcccctgtaatggaggcagaatcagaactgaaatttagccactcacatggcatgtcatccacttgttcatccacagcattgcattgtaccccatgctctcagaggtacaaagaagacatgggggtgcagggagatggcagggaaaggttcagcagtacccagaggttttgtatgtcagtcacagcattagagaaagtctggagaaaaagttacctgtcaagaaatgacttgaatagcttctgaaaaaattagtatatgatatggttcaaatcacctgataaaaccaaaatgtggtcagcaaaattaatgtagtataaagaaataggtagattaagccagagtttttgttattggtttttatatttattatatatttatttattttttgagacagggtcttgctctgttgtccaggctggggcgcagcagcacagtcacagctcatagtgacctcgatctcctggtctcaaggcaatcctcccacctcagcctcctcagtagctgagactacaggcccatgccaccatgcccagctaatttttttatttttattttttgtagagagtggggattgctatgttgtccagcctggtcttgaacttctgatctcaagcagtcctcttgcctcagcctcccaaagtgctaggatcacaggcgcgagccaccacaccaggccaaataatcatgaaataatgtattgacttcctgctatgaagtttacaaccctaggtactgtggttacaatctaacaatataatagttaatatgtgtgtgtgtgtgtgtgtgtgtgtgtgtattgctttctatatgccaggcatcttacatctatgaacctatgaacccatttactgtcccaaacaactctaggaggtagaggcagtttttttttttttttttttgagacagtcttgctctgtcgcctaggctggagtgcagtggcgtgatctcagctcactgcagtctctacctcctgggttcaagcgattctcctgcctcagcctcccgagtagctgggactacaggtgcgcaccaccatgcctgaataatttttgtatttttagtagagatggggtttcactatgttggccaggctggtcttgaactcctgacctcacatgatccacccgtctgggcctcccgaagtgctgggattacaggcgtgaaccaccatgcctggcttaaaggcagctttcatttcatgttttatagctgacattcagtgcactgagaggttaggcaacttcccaaggtcacacagcgagtcactgctcataaccgttacacttccagggtaatatttaatactgcccctgccctctgggagtcagtttagtggggaagataagtcaacatactctgaaaatacaagagactgtgatacaggtgatagtagaagaatgtgttggtgcaaaggggcattggtacaaagattgcataggtactgacctgagagagattggctgagaagagtcagggaaggcttcccaggaaggtatatttgagtcttgaaggatgaggaagagtttgacactgggacaaagaaagggccttccaagtgaaagtttcttgcagacagttacaaaggtcacatatatagcaacaaagataatagaaaatgataggtgtgaagtgagagtgaaggaaataaacatttgttgggtgcgtaggactttctagggctttatatgcatacctatgtacacatatacatgtagtacacaaacatggtattttttttatctgaaacctttactcctactttcctggccagttattgccctatttcttttttcccctttgcaacaaaaccccaggaaggagtggcctgtacttggtctctaattcctcactttccctttgctcattaattttagacataggatctcgctctgtcgcccaggctggagtgcagtggagtgaccatagttcacagcagccttgaactcctgggctcaagggatccccctgcctaggcctcccaaaatgctgggattatagatgtgagtccccacgcctggcattattctctcttaatctcacttatcaaggtgataagtgttgcttatccagtgttgctaaatccagtggttagctctcagtccctatcttactggatctgtcagtagtgtcagacaagtggagtaccccttctgcagttcagcctttcgtcacttggccgctgggacactaaggtgtgttcttggttttcctcctgtcgcacaggttgtttcttcctcatctcatagccggaacactctaggcctcgaacttagtgccttcatccaggacacctataacccaacatctctctcctcagctccagttctcgagtctccagctgtctgcttgacatccaagctggtttgtgagacgggtcacatctcccctctagctcacctcctttagctctcactggctgtgctgcagctccctcggtcttcttactgctcttcagaccttctgggcatgttcctgctccaggcctttggcctggctccctgcctctgcttggaccgtgctctccctgagaatctgcttgactaaacctttaagcctcgagtcacttttccagtggggccttccctcaccaccctgtttaaaatggtaatgccacttcagcacttccagtccctgacatcctgctttacttctctttttgtacaattttttaacattttatatactcaatattattaatgaggttggtcttttgttgtctcctgctaaaatgttagctccataaagctagggaatctctcttttgttcatgtatcccaagagtctagagcaattcttggcatagtgggcaattaaattgtggtagggatgttgttgaggtcttgggtgttcaaagggagctttagggaaggagtaaactaggctccctagcagtttcagaagtttggaagtttcagaagagaaggatgtgaagaagtagttggagagaaggctatcaaggtagtttgtggctagatgatggagggtctccagtactaccctagggagtttggctttctcttgttggatggtttttccttaaaggaaacttaatctgctgtgtataggttagatgtgggaaaccagatgttacaccatgcctgtgtggatgtgacaagggcctgcctgttcttgcatgtgtaattagtggttgagaggaagacctggtaagggagttgtcacttaaaactgattccagagttaagagatgaggaagaaggaaaagcacaagctgattttggaagcctgtaacctggcgattgagagtagtagaaagttttaatcagttggtgatttggatttggtaggaatggaagcgataacatgtaaactgataggaagagatgacaggagatgggccatgtgctgatgaaatatgggatgtggctatctctgtaggtaggtgagcagttgtggcgctgttgacatgaaggtagttggccctgggcacgagaaggatgttgaagatcttaagtagttgcattgtcaaatgtatctgtctaagccaaggaagatgtgatagcacaggctgtgttgaaagggtaggaattcctgaaagtgtggttgccactctacctctactttttcaacctcccacctctcctttccccctgtcattcattctacaacccattgctgactgactttttttttttttttttgagatggggtcttactccgtcgcccaggctggtgtgcagtggagcaatcatgtcttactgcagcctctatctcctggggctcacgcgatcctcccacctcagcctcctgagtagctggaactatacgtatgcatcaccatgcctgggtaattttgtattctttgtagatacgaggtttcaccatgttgcccctgctggccttgagctgctgggctcaagtgatcctccggcctcagcctcccaaagtgctaggattacaggcgtaagccaccacgcccagccagcagactttttgtctttaccacttttcaagattatgtgtaacatctgtgtgctgagttcagtttaatgcgtattttcaatccttaggtcatttgacctctcagtgtggcctttggcagccactgatctccttttcttttcttgaaacacttttcttcttggctcccgtggcatccatggtattagtctcttggtttagcctcccatggcttcagctatgacccgtgtaccaatgaaaactaaaccctcaccagctgtagatatccagtgttctgacaacatcaaattaaatgtgtgttaaaccaaatccatcatcttcctctcaggttagtgcctcctctgtcttgccctggttctgttaatgacctcattttctagctagtcaaatgatgaacctgagtcatctttaacttcctcttctatagcgcccccctgcttccagacctgttgatgctgctgctaacgtatctgtgtcctgaccctgacctttccctccattccctctgctttgatcaagctgtcattgtctcttgctttggttgttgctgtcatgaccggtcctctcttccaggttctgcgtccctctgtccatcttccgtactgctgagctgcctcatagagctcagatgtgatcatgccacgtgaaccccagtcattcagagcagagggttcccactgttgtctgagaccaagttttcatcatggtagagtaacatgggccctgaattttaagtttcttacttactttgaggtccctcagtaaggatgaagatggttcattaaatacttaaagtgatttatttggagtatctatgaaagacttcccaaagtacaccttgttttccagccacagcaaaccatttgtcattcccagaacactcagtgcactttaatacttgtctgcctttgctgatgctgttccctctgctctagcgcccttttctttcttgcaaatgaaacttatgtgacatctcaaggttaccataaacattacctctctgaggctttccagctgctagtttatcataggtcatcttcgattatagtttggtattttttggcttttattattttgatatgtttgtttttgttaatataagaatgacaagactacattattattattattattattttttgagacggagtctcgctttgtcgcccaggctggagtgcagtggtgtgatctcgactcactacaagttccgcctcctgggttcaagcattctcctgcctcagcctcccgagtagctgggactacaggtgcatgctgccacgcctggctaattttttgtatttttagtagagatggggtttcaccgtgttagccaggatggtctcgatctcctgacctcgtgatccacccgcctcagcctccccaattgctgggattacaggcatgagccaccacgcccggccaagactacattcttacagtgagtgtcagacagttcagaagtttcaagagcaaaatgtggatctcttgcctccttccccactcctcctccttcccactccaagcctgggggtgaggaggattagttctttctctttaagagcccatagcagagtgcgtcttactctgcttcgcctctttagtgcctagtaagcattcagcagatacatgagtaattaagagtcaggtgtaaaaataaacccaagcaggtcaaggtgggcccttgaggttagtaaatgatagtaatagtatttggagagggtggtaagagtgaaatagagtatgaatgcagtaacaccttgtatttccaaaatccatgcaaccagcaagctcagataactgtattttttcccccggtgggtggagatgggcagcaggtgagcaagggaagttgtcagaacaagtgctgtggggggtggtgtgcttactggggagccccaaagctaattgctactgggagaaccgctgaggaacaatgaggagtgggagtgggtgaggtgaggtctttgtggatcttaaccaaggaaagacacagggcagagaagtgagggggtgaaagaggctaatgggaagggaaggaaatgggcatagagagagaaaaggtctgtgtttcataattgcactctgtgctagtcgtcgttaaggggccctcatgcataccgcgtagggtatttgatttaatctctcatagccaccctgccaggtaggtattatgttcccattttatagttgaggaagataaggacgctgaggcccagggtgggtaatgctaagtaacttctccaaagttacctagtgttctcttcatctgggctaagaaaataaaaaaccaaaaaaacagaaatcagaattacctagtgagttgacagagccaggattcagttctaaggttccaactccaaggcccatgtttttttctagatcactaggtttcttttttatgagacggaatctttacctgttgctcaggctggagtgcaatggtgcaatcttggctcactgcaccccagcctgggtgacagacgaaactccgtctcaaaaaaaaaaagaaagaaagaaaaagtagtatgacttgagggcacagtggtagctggtccatattacaggacatcaacaaaaaggaagattgcttgatttctttgagttttaattcaggtaagcccattaggcttagcatatgcaataggttcatttccattagaggagcctgctgctgttttatatgaaggttataatgaaaaagatctctggtctagggctccctgaaaagttaagggtattttataagccaaatggagctggaaggaaaatcgttggtttctaaactcattaataatcagacctgagaagttctgtcctttcctttcccttttctttttttgagatagagtctccctctgtttcgcccaggctggggtgtagtggcgtgatcttggctcactgcaacctctgcctctggattcaagcgattctcctgcctcagcctcccgagtagatgggattacaggtgcccaccaccatgtctgactagtttttgtattttcagtagagacaggttttcaccatgttgggcaggctggtcttgaactcctgacctcaggtaatccaccgccttggcctcccaaagtgctgggattacaggagtgagccaccgtgcccggcccagggaaggccttttaaaaaattcatgaggaggccaggtgcagtggctcatgcctgtaatcctagcactttgggaggccaaggtgggcagatcacaaggtcaggcgttcgagaccagcctggccaacataagtgaaacccattagccaggtgtggtggtgggtgcctgtaatcccagctacttgggaggctgaggcaggagaatcacttgaacccaggacgtggaggttgtagtgggctgagattgcaccattgcactttatcctgggtgacagagcaagactgtctcaaaataaaaaggccgggcatggtggctcactcctgtaatcccagcactttgggaggccgaggcaggcggatcacctgaggtcaggagtttgagaccagcctgaccaacatggcgaaacctgtctctacttaaaaaaatacaaaaattagctggacatggtggtgggcacctgtaatcccagcaactcaggaggctgaggtgggagaattgcttgaacccgggaggtggaggttgtagtgagccaagtgctttgttattgtccaggaaattattcatctgcattttgtttttagagaaagataaattgagtgatctatcaaggattttttaattttaggggcacatgtcatcaggacctcctgaggctgtgtcacggactcatgtccttttaaataaaaacatttttataaaaagggtttgtttatttaatttaatttcatttttttgagacggagtttcactcttgttgcccaggctgtagtgcaatggcacgatctcagctcactgcaacctccaccttctgggttcaagcgattctcctgccttagcctcccaagtagctgggattacatgtgacaccacgcccggctaatttttatatttttaatagagatggggtttcaccaggttggccaggctggtctcaaactctcaacctcaggtgatccacccacctcggcctcccaaagtgctgggattacatgtgtgagccactgcgcctggccagatttatttattttaaatatgtaattttgagataatgtaagacttacggaagagttgcagaaatagtatagggagtttttgtaagctcttctcccataggtacttactaacaaacaacaaaactgcagcagccaagccctccaacatttgtgaccaacaatttattttttaaaaattttcttttttttttaaattttaaaattattattttttttcttgtatcaggataggatctcgctgtgttgcccaggctggttttaaaatcctgggctcgagcagtcctcctgctttggcctcccaaagtgctgggattataggtgtgagccgttgttcctggccttgtgaccaataatttagctcagtttctgtgccttctttattctagtactgctagacaattaaagtaggtgctgatgctactgtagaaacacaaaatcttctctgccacttcttgattttgcttagttgttattatcctgattgtaaaaagtattttgaactctagaatatttgataattaaaaaaaaaaattaccaccattggattcaatctctaataacattttgatttgcttccttctagtcttttttcctatttactttttcaatatggttgagattacactgtaaatgcacttttttcttctgccttttccgctttatagcataagtggcttttcaaatcattaaatattttataaatatttgcagtggctttataataccgaattgcatggatttttaagcagttcattgttctgttttttgccatggtaaataataatgtgattaatgtctttgcgaaaacctttgtatgtattttagaaaattgccttaggatagattcccagaagggcccaagggtatgagggtttttttttttttttttttttttttaataaacttagatgtagtctgaacaattttttttttttttttttttttttaagagtctctctgtgttgctcaggctggagtgcggtggcgtgatcttggctcactgtaacctccgcctcccgggttcaagcagttttcctgcctcagcctcccaagtagctggtactgcaggcgcccgccaccacgcctggctaatttttttttgtatttttagtagagacggggtttcactatgttggccaggctggtcttgaactcctgacctcgtgatctgcctgcccgggcctcgcaaagtgctgggattacaggcgtgagccaccgcgcccggcctagtctgaatatttttaaggcacttcatcacatgttttccagaaaggttacacgagtttattcttcccatcagctgtagataaatatcctcatcagcgttgggtaatcttaagaaaattgtcgctaatttaataggttaaataatggcttctcattattgttcctcagtatctttttctgtgtgtctatgtaggaaacttatcaacaagttagattttattttttgtctgtttataggagacagatcccttaagctttatttaggtatcccttatatttacattaatgtattagaaatagtggcttaacatattttaattttttccagtcgtaagttagttacttttcaaaaagctgtagtaaaatacacattatttttttttgagtcagagtctctctctgtcacccaggctaaagtgcagtggcgtgatctcagctcactgcaacctctgtctcccggatttaagtgattctcctgcctcagcctcccgagtagctgggattacaggtgttagccatcacacccggctaatttttgtatttttagtagagacggggtttcaccattttggctaggctggtcttgaactcctgacctgaagtgatctgcccgccttggccttaaaatactacatgttttagtctgttttgtgttgctgaaggagtatttgaagctgggtaatttgtaaagggaaaaggtgtatttggctcccaattttggtggctgaaaagttcaagattgggcatgtggtaagggactcaggctacttccactcctggtggacggtgaaggggaatctgtgtgcagagatcacagggcaagagaggaaggatgagagtgagaggagaggcgccaggccctttcaaacagccagctctcaggaactaggagaatgagaatttacttaccctcaccccccgaactccttgccagggagggcattaatctttttatcagatatctacccccatgactcaaacacctctcattaggccctgcttccaacattggggatcaaatttaggcatgagattaggtggagacaaaccacatccagactatggcaacacataacataaaacgtcaccattttaaagtatgcagttcggtgacattaagtgcattcaccatgttgtgtaagaatcaccactctagtttcacactttttcatcactccagaggaaacctgtacccattaagcagtcattcccctttctcccttgccccagcccctggtgaccacaaatctaattcctgtctcatgaatttgcttattctggatattttatataaattatcatacactatatggtccttccttatctccgaatgcataaaaagatgacatagattaagtaaaagttgaattgaatctgtattttgaaaatagaaatccatctgtggcagcagtcttaaattcagcatatttaattggccaggatgtcccatgccccagccactaggaagaaatagtttataccaatagttactgccagtggacagagggttatagaccttggggtaggatggaacctaaaatagagacaaagacaggaaaagtatggggcttagagagtgaaagccagtgaatggcaggcagcacattccatggtggaataaacagaaaacttctaggcatttaccttgatttggagtgcaaattggagaacttgcaggtaagtgcaagttcttccgtgatcaaaaaaataaccagcctaaagaatgaatgtttgtgacagtgtctagtacataagaccttagtaaatgtgcggagttttgcttaagagcaagagtggtatttgggatgacaaggacaagcagagaggatccccaggcatctctttctcagtgtttgacattttctctctttctttttctttttgagacgagtctctctctgtcacccaggatggagtgcagtggcgtgatctctgctcactgcaacctccgcctcctggattcaagcaattcttctgcctcaacctcccgagtagctggtactacaggctcacgccaccacacctggctaatttttgtatttttagtaaagacgaggtttcaccatgttgaccaggctggtctctaactcctgacctcaagtggtccgcccgcctcagcctctcaaagtgctgggattacaggtgtgagccaccacgcctggccatgtttgactgggatccttgggtgtggggaaatgtgtttttaggtgagtagttttcatggttccatatacatatatgtatagagcttattcactatttttcatagttagtaggtgttctacagtgtggatgtaccttatttaaccaatcctgccttgatggaaatttaagttgtccccattcttttgttttacaaacggcattgacatgaagatcctttacacctaagctttggaggaaaaatcaccaaaagtgtattgctgggtgaggttgtctttgtgtttgaaatttgataaatattgctgacttgtcttggcccccactgaggtggcaccagttgtcttgccatccctgtatgagagtgaaagatgtaatttcagttcattatggtcggtgtcatgttgaagcccacaaggagtgaggagctctgagggtggggaagggggaactgcattaggcttcacagagttggggaccttttcgaggagtcaggagcattctagatagaggaaatggtgtgtgtgaagacatggaactgttatgtggagagaaaagggtgagtttgggtttggctgaggcagagggtgggtgggtggctgtggatggtgaggtggggacagtaagtcagctaggttagggccaggtgatgaaatggtttaatcacccctggtggtcaggtagcaaagaccctgggcggcagtggtgatggggcttgcaggtgaaagatacttgagagagaatgtacgaccagtctttttagcaatctttttttacccccgaaaaactttctagacttgttagaaccagaatcacaaagctgggaagggctttagtgcagggcttttctggtgctctgtaggcccatagggattcttggaggtgtcacagacactaggtttgggagtacagacaggcatttgagaccccctcctctacccttattaattaagcagtttctcatttagtctgctttatatggtggggttctatgcaatatttctttctttaaaaagaaaaaaagtgtttgctgctagaatcatgagtctagtcccaaactcttactgtcctgaacacagatggaggcctgtgggacacgttttcattcttacattcttcgtttgcagcagtgagaggtgatttgtatataaaaatgaaagtgaaaaggcatttggcattcttgggatgtttttgagcatttagctaattttttatgtaggatttttattttgttcctttttttttaagctcattgactcaccagtgaaatatctagtgaaatagttttgctcatttatggatgagggtgctaagggatttacatccattgatgtcattcccatagctacttggtgagggggagtactgttgaaagttcattttgcaagtgaagaaacttgagctccgagaggttaggtaatttgctcaggggcaagcagataagtaatcaggaagtcatcattagatgcgacctgccctgattccacagcccacacccttcagttcatgctaaggccttcccaggacaagcgtacccagccacctgttgggggtggaagggcccaggaagaagaagggtgttggatttctggtcagtcttggctttgggctggtgcctgtagaaggggcagagctgagagacggactgagtcacttctagcaaaattggttgagaatcgtgggacgggtgatgcgtgcttgctgtgcggggattgaaggctcatggaaaaccccatgtagagttatcatcttctctctccagggatgtgagcaaggccaaggttattggccgagtacctgtttcatttcacctgtgcaccgactccctccagaaaggcgccatctgctttcttgctgctcactgccaccacagtcaccactaccactgttttgcctttctaatccagtgcctcgccagtggggtggagggatggaactgtgtatagttccagtattacaatatagttttttatattgtacaagttttagtttattagtggaacccgggcacatgaaagtccctggttagagagttgctttgcagcgtcttctccctttgtggctagtaatgatctgcggggatgggaggagcattgagaacctattggccatgaagagtcacttcctcccgacacagatctctgcttgtgcagcgcccccacacttcctgcgtaatgcagtgccctcagagatcccccagcagctgccaccccggcaacattatctatatttgcagggatacttaaggaccctttggcaattggcagtgatattttgagagcctttgaggaacgtgactgaacatgaattttaaaaaagtataaaggtggcactaggtgtattcagagggacaagctggtggcaacttagggggactttgcctttataaaaggagacccacacatggagtttacgtaagaagaacttacagtgagggagagatgactgtatcagccaatacagatgaagaatgctccaggagcttgcggggtttgcccacagtgccacagactagactcagtagagccaggactggctctaatctggtactttctctgcctgccatgcttggccctgtacccctcagtggcagcactgtttcccattagagaaaacaaacctgttagttttctcattgcttatgtagagggtaaccttcctgtgtcccctcattcttgctttagcctacattcaggggggttttgactgcacaccaggtgggagcagtattggggcacattcttctggtcctgtctccaccctctcatttcttcctttccataggagtgatttatctgattggtacaccagggagagcctcactccattggtccacatctacccagtgtgaggtcactgcatcagaacactgcctggctttgtgcttgaactctctcccctgcttacccttaagagaagcctgtccttagctgtgtcctaccttccttttgtggctagcaccattctttgtccctaggtctggaggcgggtggcaaggccaactagaaatgggaagggcgaggcattgcagctttgccattgacaaagaggatggtagactttggtttgctcttggtttcttgagactttatagcaaccgagtggaacctggaggggatgattatgctaccccagttcccagtagtaatgtggtctagagatttttaccaaagtcaaataatattataacttttttttttttttttttttttgagacggagtcttgctctgtcacccaggctggagtgcagtggcccgatctctgctcactgcagtctctgccacctgggttcaagtgattctcctgcctcagcctcctgagtagctgggattacaggtgtccgccaccaccactcctggctaatttttgtatttttattagagatggggtttcaccatgttggccaggctggtctcgaactcctgacctcaggtgatctgcctgcctcagcctcccacagtgctgggattacaggcgtgagccaccgcgcccagccattatgttaacttatttaaaatgccaagtctacctgggaataattcaggatgaaggtggttttacaagagacttgctcttaaatagcacaggtggtaatagcagctgaaatgaaattactcacctgagcagtagcgttaatcatcatgttagatttgcagcatgcttttatagtggttcgtcagtttcatactcattcattacctgatgtcatccaatgccaggtaaagccagctcattcatcatccttaaaacccttggagcagaactcctctgtgcttcctcaaggggtgtaggagctgtcactgggcaagagctctggtggcctgcccctgtcttcacttgacccacagctagctgactttgggaggatgctctctctcagcttcattttcctcattgtagaacaagattggacttgctgtgctctggggtttgtttacttctgtcttaagattctgtgatcgtgttttagcatttcttggtagcttgccttgtgttaatgtgcccagtaagtatcttttgagtttaatactaggcatgcagatataaacatccatcctcctgggatatgtacctgggaaagggaagcagatgggactgtgaagacagagcctactcttggctgtattacttactttagacagtttctgcagaataactatttttatcatttactttttttggctgtttaattaagccttctgactggaatataaataagtatataaaatatatgtattttagctcctagtggatatggtttgttgcccaaccagtagatgcaaacattttaatgtctaggctgtgtaactgtggtgaaaataaacctggcacctgagagaataattctttcctattgtatccttttctccatttctctttcccatatgcctagctagctgggagcagccaggggcaaggtagagggtaccggccagtggatggtattttaaaaactgtttatttcaaaatgatttcaaatagaaagatttcaaggaataagttatacaaagatctctcataccctttacccaaactcacctaccgttaatattttgtcctgttaacgttatttgcacgttccctctttatatgtatatatagacatatatgcatgtacatgcatgtacattcacacacacatgtatttttttctgaacaattttagagtaagttgcctttgtcatggtccattgccctatatcatatatttcttaataggggcattctcccacatgactatggtacagttaccatcttcggttaatagaacattgattcagtactttgatctaacctactaccacctgtattccagttttgtcaattggctcagtcatgcctttcatagcattttttccctccagtccaggatcaatctgtggtcaggtgtagcatttacttgtcatgctctttagtctttagatttgttgtttaaaattattgaaaccaggctgggcacgctggctcaggcctgtaatcccagcactttgggaggccgaggtgggcggtatcgcttgaggtcaagagttcaagaccagcctggccaacatgatgaagtcttgtctctaataaaaattcaaaaaaaattagccaggtgtggtggcgggcacctgtaatccgagctccttgggaggctgagacacgagaattgcttgaacctgggaggtggaggttgcagtgagctgagattgtgccactgcactccagctgggcgatagagctaaactcagtctcaaaaaaaaaaaaaaataaagaaagaaactggtgcacctctccattggtagctgattgatgagtcttgtttttatgcattctccaatactatgtggatgaggtttcccagcataaaacgtaccatcctctgtatacaaagatgtttcctctaactggtctccatggggagaaaatatgctgcttccatgttatcactgccacagtgggatcagttgaacttcctggcccagacacccggcagtcatcttgcttctaactcttggtcctcagcagtaattagaggaagagacagacaatctgactgggcactttgtgcaaacccaagaaataatagaggaatgttctgccatcgatcaactttatggtagttttagattaaagcagaaaagtgctttttaatgactaaaattatgtttagatgcagccagagtgtatgttttaatcaaatattaaatgtctgtgtgaagatattgtgcaaagttatgtctagatctaagctgcagacaagaaaacaagaagcctttctcatgcgaggggatgactttgttccagattgtgttaatagaggggtgggcgcgcctgcccagccttagcagtcctgttacatgctgtggttgtctgtttgcttcagtagaagacatttttttttctcctgcaactcttgtacacaatgtttagaatgaattacatcaatgtatatttgtacctcggtcttccctctgcttggccttacgctgtcctatcacagtcaggctaaggaaaggaactcacatgggtgtggctggggctgagattctggctggctgctcactggctgtgtgtctttgagcgagtcatccagtgtctctgggcttccctgattgccctgctgactgctagactgtggagggtcagtgggcttcaccactttttcttttttttaaatagaggaataaagtgagatttccacttcaatatgctgtgctttttttttttttttttaaaggaagtgtcagctgggcgcggtggctcgtgcctctaatcccagcacttttggaggctgaggcaggcggatcgcttgagccctggagtttaagaccagcctgggcaacatggcgaaaccccagctctacaaaaaatacaaaaatcagctggatgtggtggtgtgcagctgtggtcccagctacttgggaggctgaggtagaaggatagcttgagcccgggagatagagtttgtgccactgtactccagcctgggcgacagagcaagacctgtgcctccagaaaacaaaaggaaaaggaaaatatctacgggctgggatgcaaaagagcagtagtgaccggagggagagatgggaggaagcattgttctgaatgtcgttctcctgactggggcttccttgatgcacttttctagctttctggctttttgagctgaatgacttcaggagggggataggtagatgtcactcgccctggttcccatgcatgttattttaagcttagtatttcatctcatacttgtgtgcaggcctacaggtcaaagatttttttctctccttttttttttttttttttttttttttttgcagtggtgaagggtgtagggaagtgagagtgatgatctgagagtttagacatctatggtaatcctgttagctttcagagaaagtttacatgagtttgaatatctttgctaatcgcatgtgttgtaacacaccggatatgttttgcatactttttaaccttcgttggcagcagggatagaatcacttttcttcgaaacctttatatacagcaaatagggtaatgacactgttctagatatgccacagggatatttgaatggcactctgggatactagtcctcattttgttgaggtttggtatctatgagcccatgaacctgaatataggagacccatatgattcacctcctagtagattatacaaaatgaggctctgggaaaggatggcaaaaagcttaatagaagtgtctttaaaaaatagtcatttttggctgggcatgttggcccatgcctgtaatcccagaactttgagaggcataggtgggaggattgcttgaacctgggggttttaagactagcttgggcaacatagcaagaccccatctttatttaaaaaaaatttaaaaaatagtcattattccccaagattaattttgtaaaaaggttatgcttagagggggttgttttagaggccattaggtaacatattacagatttaatcagggtttgaggaaaccaccttctagctgctacatcttagggaaaagcaccttattatccaccttcagtctcagtgttagcagtctcctgtttttcaacacagattgaatctgcgtgtgagcagaagtctgcttatggtcagaacccttaaaggggaaaatgtaaagagtcacatgtatcttcaatttggaggaattaccagtattcttgagaaactgaaagtgataccaacagttttcttgttccttttactgtcttgaatttggtctttaagatagttgagccaccagcccatggtagatattgtagaaaatacagacatactagatagagcatctttccagacagttgatgttctgggtagagaagcctaatatctatgacgtatgaacagtgactttcagcccacacttcatgcctgacattgtgtttactatgtattttacattttatttaattctcagaatgacccaatatgttaggtacttttactgtccccacttgtgcacaagaagaaacagtgacacattaaataactaggccaaggtcaagctgcacatttggattcaaacttggggaacctgaccctagagcctgcattttaaaacttttgccattctgaaatgaccagagaacagcaccaagggcaaaattctgtagtactgattacaagacaaagacacaagatgtaaatgacctgatctgtactgtaatctgtgtaggaaaattcatgaaggttaaactataaattgcagtctcagaagcaaatgcaggatggggctaggtactcgcttatgagaccatgagtgttcagattggagtggcttcctatggcgagtgacattgaatcaggcatgctttccttcttatcctcctagtaaacttccttgctcttcaaaacccaaatcacccctttgaagctttctttccttcagatagagttagttttctctttggtcttctgaggctgtttatatgtacgccaggactacaggatgtaactgctaggccaccttcagttctttgaagttagggaccgtcttactcatcattgtatcccaggggcttaatttaagcaatatcagttacttagtgagtattgaattctcatttctccaacaaatagctgagttgcttagtcactccagaattaaagctaggtttagaataattggagcggtgtgatggcatgtgcctatagtctcagcttctcaggaggctgaagtggggaggatcgcctgagcccaggggtttgaggctgcagtgagctgtgattgttccactgcactccagtctggggtgatacagcaacactctgtctctaaaaaaaaaaaaaaattaggctgaatgcagaggctcccacctgtgatcccagcattttgggaggccaaggtgggaggatcacttgaagtcaggtgttcaaccccaacctcggcaacagagcaagacccaggctctacaaaaatgaaaataaaagccagatgtggtggcatgtgcctgtagtctcagctatttgaagctgaggcaggaggattgcttgagccaaggagtttgaggcctcagtgaactaggatcatgccactgaactctagcctggcaacagagaccatgtctttagcaaaaaaaaaaaaaaaaagaataactggggcagaaaaatctatatttaagagaatttatctggcggtaaagtactgtttggattggaattggaaaacctggaaaccaggtaaaagcaattatagtaacgtaggcaggagatgattagggctccgtagaaatagtggtgagggagaaggtacaaacctgcaaaagagtgagaagcaacagtccgcagacctgatggtgtttgctgtggatggagaatatggggaagaagcaaaggcgatctcaaattatgtcacccttctgcttcttccaagttttaatttttttaggtgattatgggtcttggtggacttagtagtcccttaataaatgagtcaatggcatagatctctgaactgctgacccatgagcagcaaagtaaaaggagcagataaagtcagggcaggcacagttgcaagcttatcacctttgcagttttaactgtttctggaacagaaaacttgggtttgttttagatctatgcagagctctccaagagtatattctgagccaagcttaattcgtcatcctgcccaaggattttaagtgtatgtgccatttgctattgaggtgagccaagtaactcttggggaagcataggcttatggggttgtaataccttgtgctgccatcctggcagctctgaagacaagagatggttcctagaaatcaggagcctcatgctcacactgttacctgcaggcttattgccagtccccagagccatagttgtgctgatagagctaaaatacagtttctaaagagtctgataacaccaacctggactttagaaatgaggattttaaaacattaagtgtttaaaattgcagtatatatttacacagaagcagataaattgtaaagttgatcatctttgtgtaactaacactcagataaagaaatagactattaccagaatccctcctcctccaaggtaaccactagtctgattataacaccatagataagttttacttatttaaattattattattattattttttaagaggcaaggtcttgctctgttgcccaggctagagtgcattggtgcaatcatacctcactgcagccttgaactcctgggctcgagtgatcctcttgcctcagccccccaagtagctggaattatagatgtgggccactatgcctggcttttttttgttgttgttgttaaaattaatataaagtgaataatgaaaggttgtgttttggtttctttcactctacattgtgtttgtgagattcatctgtgttgttgcatgtagcaatattaattcctgttgtcttataatattctcctctatcaagaaatcactattcatccattccagtggtgacggatatttgggttcttttgactttttgggtattgtgtataatagtgctgtgaacatttgtgtatgttttcgtttggtatacatgtaaaaatttctgttgggtatatatcaaggagtagaattgcagggtcataagatatgcatatgtttagctgtcagttttctagagtggttgtaccagtgtatactcccaccagcagtacatgcatgtgctggttgctcagcctcctcatcaacacttattattgtcagtcgtttaaattttagcctttctggtagatgtgtagcactatcttattttaaatttgtattttcctgataactaatgaggctgaacacttatttataggctttttgaataccctcttttataattaattatttgcctgtccaaaaaaattgaagtcctttgtctttttttttttttttactgatttgttgaagttattttatgctctgatatgagttccctgtttccatattgcagatagctcctattttgtggctttcttttacactctctccattgtgccatctgatgaacatttcaacttaccagtcttttcctttatggttagtggtttatgtgttctgtttaagaaatttttccctacccctagctcgtgaagatactctgtatctacaatccaactggaatttttgtgtgtgaatgtgtctcacttagttttaaacttatcttacctttccttagtttgtcaagatctgtctgaggcttaaatcccaagcacaaggtaggaggcagtcagataaattttcttattcttcataaattaatgcagcgcaggagataaagtttttgaatagcctttgggaatggaagccttgtctccctaccacacgatggcacttggattttgttttatgttctttgtccctttcattacttgaaagtgtaatctgcttggagtattacctcttcctcacttgcagttaattccttaactcacccaatctactttctggcttcaccacttgcttgaaacagctggccaaggttccggtggctttgttgccaaacgggagccagggaattctccagtatccttgaaccagtatccttgaatgtgccttctatgtcttttctacctctgttctgattgtgtgatgttagcaaattcttggcctcctgatttttcccgcctatacattttacatagcttcattttgaaatctagtctgaaaagccccactagatatgattgggagaaagcccttaaacctgagggcatgagtctctagtttcaaagtaggcctgaccacttttgttgttttgctttggtctgttttcatttggtatctaagaccaaataaaaatgagatcagccataactacagattagataattccttatggtttatgtagcagttttacatggatcgcctgattggatctcatatcaccctgtgaggcaggtattgttgttacagatatagaaatgattaaaaatgcaaacagcacttatttgttcttgttgagaaacacctggtaatgccccggatttggttttggagcttcctttttcatgtagccatcatttaatgggaaaatgcatctgggttttttttttttttttttttttaaactagtgaagtgtagtagtgagaacgggggaaagagtagaacaaggagttggatctgtaactgactgcaaacagtccagtgagataactcagtacctttgggccagcccatctgggattcttaggagtacttttgtccttccactttctgcaggaactgtaacttcttgggttggggcagagagtaaagggtagatgggactgggaatggtggcagagttggattctttttggagattatcaggaactttccagtaatcatttatttctcagatctcttcctcaagaatctagtactaaataaatggtggtggttgattgcctggatgtgataagctcaagtttgctgcaggatctactttaaaatgattcaacacaagaagttatggagagatatgatttgcagatgtgtccttagtttccaggaacacattttggctccagaagaactattgatttattttaacatgtgctattttttttgattcttctgcatcttcccacagcctttttattttaaatagcaaatccttttttcaaatgaaatggcacaccagactcgatttatgaaacagactacggcgttcttttattatgtacactcattttagaggtttgcatttatagcatttatttataaagtcagtgagaacagtgaggctgttttgatcaacacaaacacttgaaacattttagaagattgcagtcttattttagcttcacttttcagtttatttttgggtttgaaaaaatagatagtttttaataaaacagcttggcttgcaagccaaggatattttttagttaaaccgatatggaagtctgaaagaggagtagggggctaggctaatctttatcctaaatacaaagttcagggaagaaagtctctctcactcacaagcgctcaaagtattgtacaataattcatcattcagtgtgtcgcagttcaggtgtcattgcagagccatcattctgtgacctcagtgtgggaggaacgtggccctgtgttctgtgtagtgagtgcacttgtgtgtgttggttggtgtgcacacgcttatgaatcaagtctgattcagcctctgtaattggtactgagaagtgctggtttttcctcagagatgaaaatttgttcctcagtcttcacaaagtcaatcacccgacggaggccgctggtatactacagtttgacatgtgacacatttgagtgtgggcttgttgttttaaaatgcagtttttatagtcaggtctcagtccatggttgatggagaggatatggggaagggagataggtgggaagaaagaagttaagagataattaaataatcacaactgctgctggctcttgattatgtctggggtagaattataccagtgatgactcaaaaatggtttgggaatggttacctttttgcaggcaggttgtgtgaaggagtgttaactcaaggtcattcctgcgactcctacttgagtaagaataaaggaagtgggttttggggctccatatgaaccccaaagggaggggatgggtactgggggccttgagctgcctctcctctcatttccaacctgagcagttctgctgagagtctggctctcactgtgggcctgtggtttacaggagctaattttgaatccctagttagcttggctctcagctgcactttaatctctgttggctgctcacgtgagattgagaattgactgtatgactcctggaatgccttcaaaaacctccaagaatccatggccagttgcagtgaatgactcacacttgtagtcccattgctttgggtggctgggatgggaagatcgcttgagcccaggaattcaaggctgcagtgagctatgattgcaccactatactccagcctgggcaaacagagaccctgtctcttaaaaaaaaaaaaaccactctccctggttaccccccaaacccctgagaatccatgaagctgtttgatataagtgctgtgaatcaaaatatgacaaattattcagacacaggggaaatgtatcagggatgaatagtctatgaggagttctggccttcttgaatctctctgctctgcccattcaggaagggccaggggctaatttgctttcaatcattattccagagttgaattttgaatttccccttttcttagcatacataattgaaaatcagctgcacagtagcatgaatttatagaggatgcaacaacaacgttgggttttgagccagctgggaaattcccttcagttttttctggcatataccatgcatttgaagaatgttgaaccaagattttgaggaagtaaattgctcttgctgttgaatgtgacctagaaggaactgaggaacagtggaactgaagatgcagcttattgattttttttcaaattcctttgttaggcatctgaagaagcctctctcagggcattggaaagtctgatgacagaattttttcacgattgtacaaccaatgaaagaaaacgtgagataggtaagtggagcattgacttgtaaagaggaatttataatgaggaggccctggtagggaggaaggagttgttcgtagccgtgactggtcaagtctgcgtgctttccacttgaattcttgctcttttcgctctggttctgttggctggtggctggggaaacccctccacttgaccaaaggaaagaaaatccatcactgtggatcttaatttcagcaatgttgttgaactttcatataagaagcctgcgactttttggtgggggcgtctagggtggggtgggacagggtcttgctatgttgcccaggctggtcttgaactcctggcctcaagtgatccttccatctcagcctcctgaatagctgggattataagcgggagccactgcacctggatggttatttaaagagaaacagtaacaactcaggaaagtgtcaaaatgaacatgttttgctgtgcagacgtctgatctgaacctaatagtgcccagaaatcccataactggtattacttttgggggcttcccactgcctgggcaatgtaagatcctgtctcaaaaaaaaatttttttgttttgtttttgagacggcgtctcattctgttgcccaggctggagttcatggggcgatctcggctcactgcaacctccgcctcctgggttcaagcgattctcctgtctcagcctcccgagttgctgggattacaggtgcccaccaccacccccggctaattttttgtatttttagtagagacggggtttcaccgtattagccaggtgggtcttgaactgacctcaagagatctgcccacctcggcctcccaaagtgctgggattacaggtgtgagccaccgtgcctggccattagtcttcgatattctgacactctactgtattctttgaagtcttgttttagattataattgaaatgcttttgattcttttaatttttggtttgtaaatcaaatatttctcaccttctatttcatgaattaaacgtagaaccttctgaacatgttcatattctaatctgatcttaaaagagatttaagtagccaaatgctccagatgccaaatttgagtgcaggctgaggggaatccaggggtttgtttctatacagtaggcttgtcttagttcagttctctttgtacctagtcattgtagctttatttgagtgtgtggacttggactacttattgcttcttttctatggtcttgggataaactctaggcttttcctagtttggtcagagaaaggaaggaagccttttcttcaaagggctccacccaccctccagcaaaggtaaatcactagtgctctagaaattgatagagctgttagcagggacctcgagaccatgtggtcattgtagagtggaggaaacagaagcatcaagggggagcagtgactcacctggggtcagactcagagtctagaacagagcccagagttcctcagttccagtctggtttgacttcactttggggattcacagaaacctttgcttaattattagggcaggctgttagcttccttttatggatttgtaattaacttttatttttattaaaataatgtttttgactaggcatggtggcccatgcctgtaatctcagcactttgggaggtcaaggcgggtggatcacttgagcccaggggtttgagaccagtctgggtaatatagcaagactccatctctacaaaaatatgtttccccccttttcttatgtctcctcaggaaaacagcaccattgagtgctatggcgtcctatagagaacttcagtctttggtcatagcattaagagctcatggtttcatagccccacgagccctctttgaaatgatctaaaattaaaaggcttggattttttttttttttgaaatggtgcctcactctgtcgccaggctggagtgcagtggcgcaatcttggctcactgcaagctctgcctcccgggttcaagcgattctcctgcctcagcctcccaagtagctgggactagaggcacttgccactacgcccagctaatttttgtatttttagtagtgacggggtttcgccatgttggccaggatagtctcgatctcttgacctcgtgatacacccgccttggcctccgaaagtgctgggattaacgggcatgagccaatgggcccggcctttttttgtttttttttttttgttttgttttgttttaagagataggattttgctctatcactcaggctgggtgtagtggcgtgatcatagctcattgcaacctcggcctcctgggctaaagcttcaggcacaccaaagcatgttcattttgacactctcctaagttgtcgagtttttttttttctttaaatagccatctgtgcgtggtgtctcatgcttataatcctagctattcaggtggctgagacaggaggatcacttgaggccaggagttaaagaccagcctgggcaacagagcaaggtctcctcctgcctcagcctcttgattaactaggactacaggcacttaccaccatatctagttaagtttttcattgttttgtagagacagggtctcagtgttgcccaggctggtctttcaactcctggcctcaagcagtcctcctgcctcagcttctcaaagtgctgggattacagatgtgagccactgtgcctggcctttccatggattttttaatgagactgcgtcgttgcatttagcttaagttgtagggaactagcagagcaatgacttgaggattagaagaagctgctgtgtgttctgcttttccaaaggctttctagaatctctcaaggttgtgggcctttgcacttttaccctttttggattatatttcatgaccagtgcagcaggtcaaggtgactaagggacagcatgtccagaaacatgatggtagccccgtaatgcttgctgccttgtgggttctggctgatgccatcagcagcctcaggaggaggaaaaccgtttctaaccaacgtgatgtgtggacagggctactcgccgcaacactcgtcatcgttgctcttgccaccggtcgattcacttttttggtggcagtgttttaaaataaaaccaacccaaatgaagagttagccgttttgaattctcttgcatttttttcctttcctatctttgtagaattagtcttaatcttttctttttctgcctttctagccgtcattttgtgtgtgtgaacaatgtaggctccactgaagatttgtagaggaatggcgaggccctagaatgtagctcatattcagacgaagtaagttagctagcagttttaagaagatggaagggtactcttagaacattccagccacacattagcttaaataagaactttagcagtgaaagtttctctgcctagagaaatatccatagcgaggttattggcttttaggtggctgaaaacattgtcagtgtccatggtcacctcagacgcagaaaaatattgtatgatttattctttctatcttaaagaatccgctggttttgacatcatttacattatatgcagagagacatgtttaaataataataagatagcccagtcttgtctaatttcatgtattttcatagctttcttttgttgccatttaacttttccagaggagcttcttaataactttgcccagcaaataggagcctggagattctgcctgtactttctctccagcactaggaatgactatgtaatgatgtacagtttaacagtttttgaggtaagttgtcagtaattttatactcttctgaaaaggattttgtagttctattgccatatcattagcactagactagagctgtaatgtgctgggagagggtagctcagctctgggatgtcgtcccacatactgtctttatgtagttgtctggtgtttggggcatcttccatcttccacactagaaaggtaagatggatggttgactttagggttaagtaggtaggtcatttgtggtaacatgtaactattccctgcctgttatcattgataaaggaaagataattaaataaaaacattttaggaggagaaataataaccataataccatcatccccaacaacaaaaagttttatttatcacctctcttccaatccttgtcttctgtgcccccctttaaaaagcctaactgtaggccgggcgcagtggctcatgcctgtaatcccagcactttgggaggccgaggcgggtggatcaatgaggtcaggagatggagaccatcctggctaataaggtgaaaccccgtctctactaaaaatgcaaaaaaaaaaaaaaaaattagccgggcgtggtggcgggtgcctgtagtcccagctactctggaggctgtggtaggagaatggcatgaacccgggaggcggagcttgcagtgagctgagattgcaccactgcactccagcctgggcgacagagcgagactccgtctcaaaaaaaaaaaaaaaatctaattgtaatcatattgcccatgctattttgtattctacttttccccactttattttatatccccacatgtggttatgacattattcaccaaggcatgctcctgtttttgaacattgaagttgcttctgtcattatattttggtggccattagagacagtggtgtaaaaaagtttttgcacatacagctttttgtttctgttatttggcagttcttcctaggaatgggactgttgtgtcctaagatttgaatacttttattattcttattgccatattgccccaaacctttatttaaagagggattcttgtttattgaagtgataatagctacctgtgggatgaaaagcagttatttttgtgtataggttgttaacttaaaagatgtatatttgtttttcagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacaggtaaggatatgcctaaggaaactttatcttgtgaatagtttgtttgttgaagtgattatttccttgtcctgaagaggacttttaagattagcagtttggaactgcagtagtgaggttattgtaggactgattatcgcattcactttatatttataagacatattgtatctttgtgaggtggagaaagtgggggagaaaaacttaatctctttttaacctcttgtgcagtttgttcagccagtatttgaaagcctgttaggtgctgtactaggtgttgggggtacaagggtgaggctttcagtagtttcggcgtttagtgggggaaatagctgtgcaaacagtgattactcaacaatatggtaattattgtggaagtatatgcagagtgctatggtggcatagcatgtagacttggtgttgttgggctgagatgtgagatggtgaagtggcagagtaaggggctagattgatgggcagaggccaggccaggaagggttggggggttccattgtgcaattcgtagtttttcctagggagctaatgaaaagttttggggagggagaaaacatggctacatgtttatggtggaatgatggctagctggggtctggattgcagaggggcgaggtgagagggaaagaggcagggtgtagaggatctgagccaaaaggagacgacctggtgggtggaggtgaggcacccaggggatgggggcaggaggccagtgacaataggtgagaggggagagaagggaggaatctagaatgacttccagttttctggctcagatagatttttcaggccagggttgaaagaaggggaatgaatttgggcagaagatggtgaattcagtttgatagaaaatgcatttaaaatttgtgtgttccttctttgtaataactaatgagacattaggaagtgtggatctgggatcaggatttggaagtcagaagggagtaactgggacctaaaagctacgagggagatgctgttgctcatttgaatcctgtgatcaagttggaaacattttcatgtattgagctagtcttgggtatgcaggaagtgggtattatatacagtttatagaaataaagttctttgaaaattgtttatagtctcagtgactgtaggattttccagaacaatatcattttctaatgttctgcctgctcttcatacaaaccattttaatgatgcagcaattcaaaaagaattcagcatccaaagtgcttctctcagattgtctctcaaaggggcacaaaaattcttcatttagttttgttttgtacagtgcttcatttatctagagatttattgggttgttactgcaaaggagattcatgcctttattcaagtaaactatttgttgaacactaagcacatgaggggatatagtaatgaacaaagaccaagtccctgccttcctggaatttatgatctcagggcggggatgagggcatcaacgaacaataaacaggtacacacttggaggtatttataagtatgatgagaactcaatccagggaaggggaaagaaactagcgggggttgtgtttagatgggatgctcgtagaaggcttttctggggacagacatttgagcagaaacctgagtgggggtgatggcgtgcaccacgtgggtatctaggggaacagtattttgggcagagagaataggaagtgcacaggacctgaggaatggcaagcaggccagtaggcctggactggggggacacgaggtgggagacacttccctggcgttctgtccaatacacttgccttcaatccaagttgaggacggttatggtaaccctctccaaggctctcttaagtgggcgtcagggaagcccactggagacaggaaagaccaagagggttgggagtctaagtgaacctattcctgggttggttagtggtgcgtcctgtgacaagaagagagggaccttgagacggagagtcacaggcctgatgatagcaggtaaggtggagccacagttccaccgctgggattggtccctttgatgaagaacagaacgtttcctggctacatttgaagtataattatttgtaacaaaagatggatttggaagagagcacttttaggtgaagggcttctggaggtttaaaaaggctaattgtccactgttctccaccacctcccgctttcaaccccttcagtattgactcctttaacctcatgtagctttcgtgactttgaaacaccatgtagtagaaggagccagactgtgaggcagcaggtttgggttctgcacccaactttgtgtaaagtcttctttttcttttcttttattttaataaatagagatagagtctcactatgttgcctaggctggtcttgacttcttggcctcaagtgattttcctgccatggcctctcaaagtgctaggattataggcgtgagctactgcccctagcctaaagtcccctttgattttagcacctcctgccacttaggtaagcttccctttctttctttgtaaaatgagagggttggactaagtgatctttgaaatcctttccagttgtgttatgtcctgcttcttatttattcttgtgaactagacaatggcatataagccttgtcaagaatgatcagtactcaatgatcagtgcccaattgctgacatttctgataatatagtggagttatccctctgtatccgtgggggattggttccaggacctccttggatatcacaattcatggatgtcgaagtccctgatataaaaaggcatagtttgcacgtaacctatgcacatccttttgtgtaggttagaccatctctggattacttctaatacctaatagaaggtaagtgctctgtaaatagttgttatactgtattgtttaggaaataatgataagaaaaaactatacatgtttactacagatgcagccattttttcttctttttcctgattatgttctatctgtggttgtttgaacccttggatacagaactcatggatatggagggctaactgtaaacattttcttcaggtattggtaaataatgccaaactggttctggaatccatttcaccatcacttgatcctttgagtaaatcatctcaagggtttttttttggctcatgttgtgtttgcagtctggggtgcatggttttgttttttttaaacgctgtgacagtttgttgggtggtatctatgcagtttttgttataattgtggtgaccaccataaccagatagagaggggttgatttggtaacccagccttacgtgcggtgggttggttataccctttctaggctcctggagaagtaatcgaaattgaaaccgaccgctttccttcccacctgcctgcatatacgtcagcacacacataacactaatggttctagaacctgttcttcaaattcctgaagtctgttgagcagaacctgtggtcacattgtacgtggggctagagacttaaggggcaagcagcataggagagaattgctgtttcttctgttgggtcgtgtaataaaaacaatggaaccttttcagaagttcacgctagaaacctgaacttgttcttcaacctgcaggagcttattgtctgttaaattgcagagattacctatgttacaggcttaaattatagatgtgaagatggtaaagggagacactattttaatcaaaagcttcctgggtacaaagctaatgagaggaaaaattatacattttatcaagctctttttcaagtaaagaatagctttcttttttcatctggcttcttgcctgaccttctccccttcccctaaatggtgagaggaaggagagcttgcagatagattttccatatcgtaggggatttttatatctgggaagcacagcatttcatatttataggagggtgtatattgccaaatgggatatttggcattacgagtcatttccagctgagagagtaaggatgcagcctggaggggaaaatagagacaaaagaggtagaggagaaagaaaggaaaaggaggaagtaatgggaatcttttagaatatagactgataagccaaaggtctccaaatggaaagagatgcttaccaaggatcagttctatttcattgtgtgaagagaaatttcctgtcctccctacactgcatgatctgaatttaagtcagtgttagaaataggcccaatttgtagaaaacgaagataaaaattgtggagaatatacaaagttttagtgttcaagagacctgaatttatagagagcattttaaacacatcattcattgctgctggttacctagtgctgcttctgaagacacttgaatttaccttaagttcccattattgagtacttgtcctgttctttaggggtgagcttttccttgctttgtgatagggagagttatttctaagggaaaggaatgtaccctgtatttctttctttttctttttttttttttttttttttgagacagagtcttgctctcttgcccaggctggaatacagtggggtgatcttggctcactgcaacctttgcctcctgggttcaagtgatcctcctgcctcagcctcctgagtagctgggactataggcgcctgccaccacacccggctaatttttgtatttttagtagagatggagtttcaccatgttggccaggttggtctcgaactgctgacctcaagtgataaagtgctgggattacaggcatgagccaccacgcccagcccgtaccctgtatttcttgaagtgaagaatataaagtctgtatgggtgcagttcctgagtgttctgctcttccctaaagtttatatatttttttagcttaagtaaaaaaaaaaaaaaagtgtgtcagggaattaactacatttaaagttaagattaaggaaaaacttgaagtgcttttcaaattgtctgctcttttatagattgtagcaattaactcaacagataattttagtggcaacttgtttacttttatcatttctggaaattaaaaaataagtgtaatagtaatgctttgaattttgtaaaaatgattaggaagatgtaagtagtgctttgctgttgaaggcgtactttttttgtcttgtttagttaaactttcttatggtagagagactattacacgtgatagaaacagcaacttaatttgctacatgggtatttgcaaaatcctaactaatcttagtttaatgacatgtatgtatggtgttgctctgctatatttaatcatgaacttttctgaagcatgcaaagtttagaagtgtaaagttgatttaacaacatgcatattgaaaagacatcacaaattgatttacacatcttaatcactaatacagatataatttatatacatacacacacaaaacttggctactagacaaagtaacaaaggctgtgttaggaatctggacatgtataaaaattgtcatgttaggtataaaagaccattgttttctagctgtttttaagttcatggtattagaattttgtccataaaatatgatgagaatgtattttgaatggttaaaaagagctacctaaatatcctctaagtgatgtttcttttttttttttttttttgagacagagttttgctctcggtgcccaggctggaatgcaatggcacgatctcggctcaccacaacctccacctcctgggttcaaacgattctcctgcctcagcctcccaagtagctgggattgtaggcatgcaccaccacacccggctaattttgtatttttagtagagacgggatttctccatgttggtcaggctggtctctaactcccgacctcaggtgatccgcccgtctcagccacccaaagtgctgggattacaggcgtgagccattggagctggcctctaagtgatgtttctgaagtgttgatttatgttcatgtaagattaaacacacacagatgcttcatagctttaatgctactgagtcctctttgtactttattagtccaacactctgctcagaacatgctttttcctggcagttgatccagtcccctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtgagcagtatggtagtgcccagagatagaggcctgcccgcaggcacccagagttcaggccttggcactcagcagctttgagcagttgtttgcgctgtttctgagatagcatgaaaatgggaagctgcgttcccaacacctatagcccagggtctagcacacagtaggactacaaaatagatttgtaccttattttcctcgtagtctttcacgaagtggtcttcactgtaactgtgatcagtgaggtagagtccaggtcataggagtatacctacagtgccgatcactgcatggtaagttaggtgggtggcaagcactctatttaaaataatttgaattgaagatcaggagaagttggagtaggaggatatgaaaatttcccgttctgggtaaggaagtgagacatggtgtggagccagccccttgtgcactaggttgtagttgtatgtagcattttgtcttttctgtttgatgagagcctcatgacaaggtgtaaagggtaagaataaacagaaagcaaaccacaacatgagacaggaaggtaggaggagaggggagtgccctgggtgactggggtggctgctgtgtgctgctgtgatacctgtttgctagggagacatgtatgcaatgcctggccgtgaggccctgagggtgccgggagcctgggcttgctacttgagggaatcttgtagtgaaaagaagtttttatctctaactcctttatccaggcttcttcttggatgtctaggaactttctttatatctccagtttagtgcttggcatgtggtgggcacttaaagttggctgaaagaaccattgatttaaagtaaacttgggttagtgcaatggctcacacctgtaatcccagtgctttgggaggctgaggtgggaggatcacttgagcccaggagtttgagaccagactaggcaacatattgagacccccatttctggaaaaaaaaaaaaacaaaacaaaaaagttagctgggtgtgatgatgcatgcctgtagtcccagctactcaggaggctaaagaaggagaattgcttgagctcaggagtttgaggctgcagtgacctatgatcgtaccactgcactccagcctgggtgacagagtgagaccctgtctctttaaaaaaaaaaaaaagaaaaagaaaaagaacttggcatttgtccccccatccttccctaaagccccaggggtaaacctaaaccttcagagtatttattcattcaaagcactttttttttcttttttcctttttttgagacaggatgtctctttgttgctcaggctggagtgcggtgatgtgaacatagcttactgcagcctcagattttggggcctaagcgatccttccacctcagcctccccagaagctgggactacaggcatgcggcaccacgcctggctaatttttgtatttttactagacatagagtccctgtattgcccaggctagtctctaactcttaggctcaagtgatcctcctgccttagcctcccaaagtgctgaagttacaggcatgagccactgtgcctggtctcaaagcacattttttgacaccccaactaaatgttaaatttctaatgttagggaccatgttttatacctctgtgtcctacagtgcccagcagtatattaaatattttaaaaattgagataaaactcaccattttaaagtgcaatattgaccggcttttagtatattcttgaggttgtgcaaccttcaccgctatctaattccagaacattgtcatcactataaaaagaagcatcatacccattagcagtaccctcccccaccccgccccattctcctctcccccaatccctggcattcactaatctacttagtctgtctctatggatttgccttttttggaattctcataaaaatggaagcatacaatatgtgatcttttgtgtctggctttttcacttaacataatgctttcaagatttattcaggttttaatatgaaaaatttgagaataagatattttcaaaagcctttgtgatcaccttatgttccgggttctgtacgggtacaaagaggaagaaaacacagttcccaccctcaggtaatttacacttgagtggggagacacaagtaaacagttaaagatgttttaagagctaaatagaggtatgttttatgtgcaggaattcctgaaggaggtgacagctgaatggaattttgagcgacagacaggtggcatttagtctggtggaaaggtgatgttgaaattgggaggaggagagcaggtcagaggttgagagggacacatgtagaaggaacagcagacagttgagcatagcaaggccgcgtctgtcgggtgagctgaagcctgggtcaggtgaggctagatgaggtcagcagaagccaggatttccagcctgtttcctgcatgaggaacgaaaaaggattggtggcaggtttgtggggaacgaaaagttgagtttgggatatgcacgtagcattgtccaggaagcaggtggacatgcaggtctgttactgccttgccttgtttctgaagcccccatcgtgtgaggcagagcttggtgtatatagtcaaggtgagtttgggccaagaacaggagacttgagaggcttcagaatatattgaagccatagcagtggatgagtcactctagcagtgagagtgaaatgagaggagaagcaggtcagtcagggaacctggggaaacgtgtgtttaaatgactcatgggcagaggatggaagtaatagtgaaagggatagaattgagttcaaagaaaccagagaaaagccaggaaagagtggtgctaccagctcagagaagggtttaggcaatggcctgtaatgccacagtgtggtcaaggaggatggggattaagtgaccagtgagtgcatgcagcaaccaggtgactctggcaaagagcagtgctggaggcaacagtggggagaggccacaccacaaggccacagtgaagcagtggagagccagaagatagctgtgaagtcgagaggcacagccgctagctggaggaggacatggtcaagaaagggatgttcaagtactcatgtttgatcagaggtatcaagaaactttctctaaatatgatttttatatgctggacattatttctcttataactctgtttctcctttcttggtaggtatcttggagactgtctgggacaaacacagtgttactgctgccactccaccaccatccccgacctcaggagaaagtggtatggtctgcctgccagccaaggcattcttctttttaaatgtattgggggccaggtgtggtgatttgcaactgtagtcctcagtactgaggaggctgaggtgggaggatcactagaggccaagagtttgagaccagcctgggcaacatagtgagactctatctctgtttttaaaaattacattaaaaaaatagtcctaggttgtttccctcatttttttatttttcctgaatgtcatggttatgtgcttgtgctgagattgttaggagcctttgggcttgaaacgtctgcttgtccttctgtaggggtggcaggaggtgggcagcagcctgcaggagaggacataggaacaggaatattgagtgctttcttcctcactggattcatgttggccaaggcagagtggagacctctctgcctgcatagtggagacctctctgcctgcatagtggagactatgcagtagttagcattgaatcaacattggttaagagtcatttggtaaagcggggcatatttgcagaggctattaaatagtttactggttgctagttattgtccacagttatgttaatatctgcttcaaaattcagagtgtagttcttctaaagatgactactttcaaggatggatggaaagaggaaattgcatctgaacaggaacttttagtttctaaatgctgctgtttacactaaatgatcacaaatgcttttccagcagagtacatcctgtgaattgacacatatagcttcctctactgtaaaggttgatgtggctaatgagaaatatttccacatcttctcctttatttcaaggagataggctgtggaagtcagacgtctctaagcccaagctgttttatgtagcctgttgttagtatgtggaagctgaaattcttacagagttactctagaattgaaaaatctatctggaagttttggggagtactcatagtgcactaattattacaaattttcattatcttacttggattaaaaattattagagagccatttgtcatactgcttagattacaaacaattatagagttctagagtgcattataagctcataggaaatggaactttgtatttggtggcaaacctttattctttaggtagatatttgaggtggctcagcagatttatatgttgcggtatctggagattaaagaaacatttggaaatgattcagagatttgattttatgagtgaacgaatgtcttggagtatccacagttaagtttgttttttcgtttaaattctgtttgcaaatattaattctttttttcgagacaaggtctccttctgtcacccagactggagtgcagtggtgtgatcacaattcactgcagcctcgacttcctgggctccagcaatcctcccatttcagcctcccaggtagctgggaccatagatgtgcaccaacatgcctggctaatttttgtattttttgtagagacggggtttcgccatgttgcccaggctgatcttgaactcctgagcttaagctatccacccgcctcagcctttcagatttctgggattacaggtgtgagccaccatacccagccaagattagttcttttgagttagatttattttagacagttgaatactcgctagcatggtttattagcaacagcagtttactgtagaagaaatgcttgtttgtgtttctgttggcttcatccaaacaggttctgagctaactcagtttatactttgataggctctgttttcctcagggccatgttggggaatgtcagataatacaaaccagagatatgtgcttacttcttccatgtgttgcctaggttttatgcggctaagcggaataaaatatgaactaacttgacatttgcttgtaacaaaacctaaaatgtggtgcctacttcttgagaattgcctcttaaaattttttgaagtgttggattttagtatttgagaaataacaaaataaattgagactgtgggggcacttagggagttatgtaagcttttaagctggtaaagttcccctttaaaaaaaaattgcatgttcatttgttacagtatttttctttctttttatggtaatgtaagtgaagtcattagatcttgccccactatttggacagtgctgatgatgcaatcaccattcattttgatgcttttgttcaactgtctttgtgcgcttaagatgccaagttaagcagtaaaacttccagaaagttgttttgctttcttgaccgtatcagttttctagagaaaatttgttctgagaaactgtagggcccagtgaagcaaccaaatgaattccttagctcagcccctgtggggctctcctgccctgtgtcttaggtttagtagccacctgaggcttgtggggtttttttccccatatactttcttttaatgtaattttctgtcttattacttttaaagaacaaagcccagggactagttcctgcaacaactcctttaatagtctggatgtagaaaaaagtttgaaggagtgtgtgtggtttatttctcagcatagttcccccaaattgttaccttaactcctaaactggctgcaatagtgatcactcacctcacgagatcagactagtctgtctcttgcttacaaacaaggaagcttgccaggggttgcatcgccagtgagcagagtggggacatgaacccctaccagaaccctagaattccaaatctaggtgcacggtcattgtcctagctttgctttcttggtcgttctcaccaattctgtccacttccttcttcccctggtttggagtcttggccctgccacttactctgtgaccttgagtggatccttcaccttctctgaccgctgatgtccttgactttaaaaaaggaatagcttcctctgaggataaatgagggaagatgtggacattgcccccccgcctgctgaggctgttccttcctgctgcacttgagcagcctcatcttccttcatctcctctcatgttcacttctctttgcctggaccattggggaaaaaagtgcacagaatgagattatgtgactacagcaattctgagttagctttgattgctctgcagtaaaattaagggaccatatctttctcatgcacatgatatatagtttcaaatatagatctgtacatacgtgatgatgaaaagttcttcaggatgaggatgtatcagagagtgtgaattgaggccagtcttctgtttcctcccaaactcttaacagattgcatatcttcatgcaaatcttttcatgtattccttgtatactacctatagaaaggtgggacttgggagggtcacttacaactcctgtgatcttattttctcctccaggggctccttgaatagagttttcccccattttactggccaaggctgcagttagagctgtggtttgtcctgcaggggatatttgtcagtgtctggagaaatttaggttaacgcgactggagaagtgctattggcatctagtgagtggaggccagggatgctgctaaacaccccgcggtacacagcagaccaaagaatgatctagccccagatgccagtagtgctgaggttggaaaactcttaagttagtaaatatacaactgataggaaaaacatgaagtttcaataattaaaaagctttgcacgaaagtttattacagggctgggcatggtggcttaggcctgtaaatcccagcactttggggggccgaggtgagaggatcacttgagcttaggaatttgagacctgtgttggcaacatagtgagaccccatctctaatatatatatatctgggcatggtggctcctgcctgtagtcccagctacttgggagggttgaagtgggagaatggcttgagtccaggaggttgaggctgcagtgagccatgattgcatcactgtactccagcctgggcgacagagcaagaccctgtctccaaaaaaaaaaaaaaaaaattacaaatatgccaaccatgtcttcattccttctaagtcagtaaatgcaccagagttgtctacacagctctgtgggcattggtgcgtatcgctgccagggtcacaggttttgtaatcaagctaccctcttccatagagaacttgataaagctctcttaggtttgcattggaagtgctgctgcatgaagcagaatctgttttgtgctgattccttccactttgattacggtgtaatttttgaaaaacacttccgccatccactaaaataccttgaaacatttaaatttgagtaaaatcgtttttatggagaaatagccttaacaggttctttccctcaccccaacctttttaggcaaatgagttgtggtacactccttagcagatgctgacttccatgaccatggtcctgctattttctttcttttgaggacaaaagtaatcgcagatcattcatatccacctaaacagtttttgcctttgcataatcttgttcagtctttgtcttcacatatttgtctttctatgcttgtagtcatggtatacacatgctattattttacatatgattttaggccatacatatttttccatatttattttttcactttaatacagaggagaacaattaggaatatttttctgtatttaaatattagctttcttattgctcatttttcctggttgcataatctttccagttaacttggtttttggaaggaaacattggttttgaggccagaccctggtttggtttcatttctaccttatgctagcagagggacttggggaaacacttggtctgtctgtgccttagttattttaatggtctgtaaatatgggtaataatgcccaccttagagttgtgaatattaaatgagaatatgcatatatagttttcagtatagggccaagcaagtagtcacacagcagatggtggctgttactgcttttaccataagtattattatagatgttttgtttttttttttccttttagcatccattctggaaaaagtcttctgagccacatgctagggacagcttttaaatctacttttcttttttttggctcctcataaatcaacttgataagtccacttttaagaatagaacttaaacccttcgttaatgaattcacaaaatcctcattataatggcggaggaggttgaggctgagaaaggctagccaacttgttcatgttcttccagcgttagcataagacctcagctctcaataagtctggggacccctggaagtcccccaaacccttttagggagtcccaaaggccaggtatgtgttcataaaaatactaagacattgtttgtcatttttattcccattctctcatgagtatatgaataaaaaagttaattccagattccacattgcagttaacccttcagaaatgactattcatcagactttaatctaatatgatagaatagacacagttatttgaaaaggccactaaagccctttgttcatttgtagttgcatatctgtgtggagttgcattttcttcacatacttcagtgaaaacaatctattgcaaaagagtgaaggcagaagcagttgggagagtctagttatcttttaaaccagccactaaagagatttcaaaaatagaaaaactgtactacctttctcactatttttgggtaaaatacagtttttttcatttaaaaatgttatgctaacatgatggctttgtaattaaatgaattaaatatttaaacacttctcagctttaatttctaatatggcaaatatcaatagaagtaatgctcctaagagctttctcttcgggatgcttagtaatttttaagagtgaggacttctgaaacccaaacatttgagacctagtgctgtaaagtacaaaataaaatgtaaacatttacccagtatcttacatagaaagaacatcaaataatatttgatcactccagacatctctacacagagataagacagataaaaagacaaaaatggcatcagattatatattttttaataacatttaaattttagttttacttgattttttttttttttttggtgatggagtctcactttgttatccaggctagagtgcagtggcatgatcttggctcactgcagcgtccgcctcccaggggcaagcgattctcctgcctcagcctcctgagtagttgggattacaggtggcagctgccatgcccggctaagttttgtatttttagtagagatggggtttcaccattttggccgggctggtctggaacttctgacctcaagtgatttatccgcttcagcctcccaaagtgctgggattacaggtgtgagccacagtacccagcattttacttgatttttttttttttttttttttttttttaagacggaggcttgctctgttgcccaggctggagtgcagtggtgcaatctctacttactgcaacctccacctcccgggttcaagcaattctcctgccccagcctcccgagtagctgggattataggcacgcaccaccacgcccagctaatttttgtattttagtagagacagggtttcaccatgttggccgggcttgtctcgaattcctgacctcaagtgatttgcccgccttggcctcccaaagtgctgggattacaggcgtgagcgactgtgcccggccaggttttacctaaacgtaacaaaaattgttaaacttaaggaattgctgaccttgaggtgctttttctacaagaaatactaatttctaaaagatacctttatggttaagaaaaaatgataaaaatcaattttgtactacatgtttgaattttatgtatcacctccccccgccaccatgtttaattttagaccatgtattttgagacttcttccttgtgaaagatgggaaagttagctagcgcaccctcttaattcctacgtctgtttagtcttgagtctctatgtaatttgatgccagtgtgtccttttgctacagcttctccattccttaattctttattttgatttatctctttatctgtgtggtttctttgtctgttatcctccttgagaagaatttgtggagttacctgagtttttgcgtgtttgagagaatgtccccatgctgtgaatgttactgtggagaagtctgactgaggtgttttctcctttgtatctgtactttttctgcctacactgcttcctcattttaaacattcttagtattgatcactcttcatcatttttttcttggaacaggataaaaccctttcatgttgtagagtcatgtcaaatttcaggaaatttttcttcttgttatagttttttttcttcttttcttttttctttttttaaagacagagtcttgctctgtcacccaggctggagtgcagtggtaaaatcgtagctcactgcagccttgacctccccgggctcaagcgatcctcccacttcagcctcctgagtagctgggcctataggcatgtgccaccatgcttggctaatttttgtattttttgtagagacggggtgtcgctatgttgcccaagctggttttgaactcctgggctcaagtgatctgcccgcctcagcctaccgaaatgctgggattacaggtgtgagccaccgctcctggcctgttgttatagttttaaatatttttcttcttttgtcttctctaaaataattttatagctttttttcccctgtttcattttgtttgatttcctttagtctagtgctttcaaaaatcaagcaagcataagaatcacttggagtgcttataagaacacagattcctgggccccaaccccttcaggctctactccagtaggtgtgggatggggcctgatgatttgtatttctgacaagttccctgattacattactggtccaggtccacagagtagccccgtggtcctccaattttgggtcttggggtcccttgactcttaaaaaattactgaggtcctcaaaacactttgtaagttatatctgctgatagaaaaactgagaaaaatgtacaaatagtcattaattcatttaaaaatatctgtgatgaacccattacatattaacagataatatgctttaataaaaaataactatatttttcaaagcaaacagaaaaattcactgagaagagtggtgttgttttacagttttgcaaatctctaacatgtggcttagtgaaaggcagcttctgcatttcatctgttgcaatatcccatgtgatgtagcctctggaaagctccattgtacacttggagataatgaaagtgaaaaaggaaaagaacatcttagtattcctttaaaaatagttttgaatttgtggactcccttccccgtaatcaacagccattttaatgtagataacctctgtcttctgtttggtaacatgttcttgtaagaacttactgttttgtgtccatgtattttaatatgtaagtggtatagtaaaactgtcattctgtttcttacttttaatttaactgtatctttttaaggtctctccaagctgttgcccgtctgtgccttagtcctctacttctgctcactgtgtgatatgatacctgactctgcattccctatcctctcccgccaaggaggaggccagactgcctccagctctccccctcacgcctgtcccttcatggacccgtgtgagggttgctttgggagcataccaggagaatggtcaggtgaaaggatatgtgaatgtttaataggactccagagtgccaggtcctcctcagaatggcccttcttcctgcaccgccttgtgaaggttcctgcatccattccttgtacttgacgtctggcatttgccaacattttttcagactccttttaatttgctttttctgattactaatgaatttgaaatctcttcatatgctttggagtttctttctctgaaaattgtctctccatatcaactgcctgtttttgtactggggttgttgtgtttactgatgtgtagcattttaaaaatagattttagtttttagtccttttcgatgttagaaattgtgaatatcttctcacagtctgttgtctgcctggtaactttcccttaatgtttttcattgattaggaactctttttttatttttattttttattttttgagatggagtttcgctcttgatgcccaggctggagtgcaatggcgtgatcttagctcactgcaacctccacctcctgggttcaagcgattctcctgcctcagcctcccaagtagctgggattacaggcatgcaccaccatgcctggctaactttgtattttactagagacagggtttcaccatgttggtcaggctggtcttgaactactgacctcaggtaatccacccgcctcggcctcccaaagtgctgtgattacaggcatgagccaccgcgcccagccttgattagaaaatcttaattttgttatattcctcagtattttttgttaaggttttcttttttggtagttttaaggagtctttttctctcttatatttcaaatactcttatattttcttctgttaactttaaagttttatctttggtttaagtctttacttcatttggtgcccaactttgtatgtggtgttagggatttttatttgtttatttatttaatggtcatgtatcatgcttttcaaaagcaaggtcatgatttgggggaacagtagcaagaaaacaaaaacttgagtggatttggggttttgcagccagagaataatcccatcttctcttcacttatgtctcctgggaaactgctgttgtacaaatctcactaaaactaaatttgagtcaaaacactaaagattgtatccagatccccctcactaagaatcataatcaattatcttatttttgctgtactgttaaaatttcctaattagtgtttaactttgagcatatagattttatttttttatttcataggtaactaaactgatacatatatgtatacatatatatatatatttttttgaaggagaattacttaaagtcatttgtaagagatttgatgctggatagcttaaaagcctttcttattttcaggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagaggtaatgaaaccaagtgtggagctggtgtgccccaagaaagggccctgactgtttaccatgctgtgctgcatggcatctgtaatcctctttgatttcagaatatggggctcctggtgaggaacagaaaggtaggtgtgtgccagtaagtctgagattagctggaagggcttgggtggttaagggaagtgactgagtttgaaaaatgcttgtgccttgtgtaggtttgttgtcttttctccccatccatctcctgtcctcccttctactcctcttgcccccttttccttactatttgcttgcaggtctgaggtggtgcagggactgagactgctgctcctgcgtagccaagaacaggagaagaggtccgtggaggtacaggagttataatcgccttttgtcacttggtgtcagtttttactatttgacttttcccaagtgaacatcctgcagtattcaggaatgttgttgttattgtgagttttacaccaatggcaagttttcatcaaactataggagggatgttaatgtgtgcacaggttaatgtagcacacagctgtgtttctttgttattgtcctctcaagtggagcctacaatgacctacttttttttttttttaaaagcactctaaaagacgactccatcacagtactctgaggcagggtttcatgatttatgtctcttgcagatgaggtcatttatgtatcttacaactgctgctgtatgaaaacaggagggaatttggaaacttatattatgaacaatcagattgacggtttagggactttcaagcaataaatcgtatcgaattagtaaatatttacagatgacatggcagcaaaagttgctaatattctcagttttccttagattgtcctttgttattaagctatatagaattaagctattttcttttccttagagtaaatagcagaatataaaatcaagtgcataaagttgaaagttgtagtgctttttaaattgggcagttttgtaaaatatttctaaaattaaaaaattggtacataagattattttggtttggtttattgtaaaaccgtgatgtttgctctgtataagaacacaatctgatatggtaatatgttcttaaaaattatttggtgatagctttccatatgaattcaaaggcatcattattcacactttcatattctttctgtctgtggttaagaaaggctgtattaccttttttttaatgatctgtgtgtctcatgtctatctcttcatatgttaatttaaaaatctagctgcttgtatcaactatcaaatatcagttgttttgactttaatcataatgtagtcacagacaactttgttgtggcttccatttggatggtatagaaatgtcattatggattgtctatgtactgatgttgttacgtgtaacttttgtgctcttggttttacattttaatcctgtgcttcctattgccctgtgaaagctgagaggtgcctgggagcagaaaggtgacataaataatgctgtgtgcttgcttcctggctctgggtcccctaccactaattctaaacagctcagtccattctcagttgtttaggagctgctaaccagatccttggcttctctttccctctactgccttttcccctaactttctactgttcattagcacctgtaccagaaggtgggcaagggaaagaaaatgaggtgaaataaaatctgtagttttagctactgaacagccttgtttgtatttttaaaaaattgggttagatactaaagtaaaattgagattgttctgtatttagcccatggcttttttttttttttttttttttttaaatgggtagtagggaattgagtgcaccttcctaaagaacagtcagctgggtggtgactttgaatatccatgtaaaactatcatgcggtacataagtgagtgaggaaggagttcctactcttgagtattagtgattgatgacaccagagagaagtgtctttgtatgttcctgtctctaaaaacagttgattttagtgccttactgtttttcgagtacttggccccatgatccacagagacagccattctctttatcaaaacaaattaatatgtattttttaaaaagctgcaaataagctcggccgcatagaggtcaggcaggcaggctggccaccctcagggagataggtcccaggagcaacatgggacattttatttccgggccagttttgcttttctgagtagtagttttctctgcttttattatttcacatatctctgttttgaaaaatagcttttgcagtaatgagcttcagaattgcttttagccattatttcattttcagctaaggcctagtatgtctttacctttttgtgttggtctctgaaatgtgatttatgaaggtatggccatctcattttctaatcaccttttggtatttaggggcttaaaatgacagtttctgaaatgtgagagtgatgatgtgctgtgtatttaataacagagatctcttatccttgcagctgtgacccatactcttctgtgaaatgattttgtgaatacaaatgagttggggattcactgtgaagtgaaaagaaagagcactggattgggagtggatgatagtcctgttctgccatgagttggctgagtgactttgggctggtcactttacctctctgggcttcatctgcaaaacggaagcatcagactaaagtccctgaggcttgcccagttctaatagccttcctcccttatatttgaaatcacttttagagtattgggttgtgctgtgtttaattagcaccaggaaccaaagggggaaaaatggccattaagttgcaagcctgagtacatcttacctggatgccatgcccttcgtagcctggttttgtttttgtgtctttagcaccattcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctatgtttcaggtggttaatggaatgaagggttgcctgtcctgtaggtaattgttgcaggcctttatatttttaaaagaaaatatattacaaatttgtatagttctgtactgaaagaactttggattgaatttaagttctaaggaggtggctgggtttcttattgtcaccttttgtcttgtctcatttagctatatcgagaagtttactgactttcttcggctctttgtgagtgttcacctaagaagaatcgagtcttactcccagttccctgtggtggagtttttgacacttttgttcaagtacacatttcatcaggtaaagcaccaaagtcatccttcccttccagagaaaaggtttattaccttgttactttgagaagaaagaactttttctttcaactttattttccaaacattaatataatgcttattatgtgaagagtcacaggtttaatcttcctaacatccctgtgaagtaggttctattaccattgtcatctctgttttgcaggtaaagagactgaggcacaaagagtaacttgcttagagtcatacagttagtaagtggtggagctgggatctgaacccagagtcagggctcttgaccactattatgtgaacaaagcaaaagaaaggaaaagtctgaaattacggcctttagttctgttctgtaactgccactgaaacctccttcaagaagattatatatagtgaagctctcaagagttaagttttggtagtgtccaagtttttctccccctcacaaatattttttgagctcctattgtattccaggatttagacatacaaccttcacaagcagtctttgcctgcattgagtttacttacattctagtgaccctagtcattctagtatgtgtgtgtacacacacacacacataaaaaatatataaaattatatatgtggctttattgaggtataattttatataccatgaaattcactcattgtaattgtataactcagtgatgttcagtgaattcatggagctgtccaaacatcaccacagtacaattttagatatttctatcacatcctatcccccgtgcctgttggtgtgtgttttatcttagtttttaaagtttttggtagacattgggtcttgctatgttgacgaggctgactttgaacacctggcctcaagtgagcctcctgtctgggcctcctgaagtgccagtgttacaggcgtgagctaccgtgcccagctgtgtgtttttaaaataagctttttattgaagtatgacacacatacagaaaagtgcataaatcttaggtgtagttagatgagttttccccaaattgacatatgcatgtaaccatcacctaagtcaagaagtacattgttgccagcaaccaggaaatctcctcatgtcctttccaatcacttcccctcgtttctccccagaagtaaccccaggcctgaccttaataccacagactagtttcgcctgttttagagcttctctgaatgaaagcacataatgtatgttttatctgtgtttttattggccatcgtgtttgtgagcttcgtttgcgttgtgtgtggcagtcatgtgttgattttcgttgtgctgttgttaagtcattgtttgcaagttcactcccctgctgatttggctgcttccagtgcttactgatcttgcagtgaacattcttgtacgtgcttttggatgtacacagatagctgttttagttgatatgtaccagggatgaaactaatgggtcactgaggacatttgattttagaagtagcctttttttttttttttttttaaccactagtgttgtagcttaatgtgtctagaggaaaggcaagggtctaggctaggagggttgtgtatatgacttggagcaggggtttgttgggaaagctgtcctttctcaaggaagatcttggcatgtgaaaatagaagaggacccagtggtaaggatgagccagtcctgggagcaggggagggaaggccaaaacttgaagaagctcagaggtgtcaggtagaggggcaagtgcgtgcagagcatgaggagagccgtgccgaggtcatagtcctcaggagaacttgaagtgactgcaggagggtgaggatgtaggggagaagcatcagaggtggaacagttttgggacatccagaggaattttaaaggagaccatgaaaaaagaggatttgagagaatgttgagtgagtgttaaatagcgtaacagaaatgagggagctgaggagccagttctgaggccagaaacaggaggcttacttgggggagatggaatgacaatgtcttgacatttcactctctatgtaaaatggggtcttctggtgtgtatagtatagaagaaagtgaaacatcttttaaagtaggcatgtcttatgcctgattctttggattggacccaaaagttttgtgtttgaggtctgcttatttctattagttctgtgtccttggagaaaccttaaatttacttagatttcagtttcctcacctaagaaaatagactgcagtggacatcttcaggcctttcccctggcttattttttatgattctttcagtagactcctatgtgtcatcgaattgaaaatggtggttttatatatttatatattatatttatatattgggaaagtaattggggaaaaagtatgctcatgaagcaaaccacaagcttctttcctcctctctgtacctggaatcgtcagatgagctcctttctgctctcctgtctcctgtatgaggaccttcctttctgggagcaggctggccacctgtgggagtaggtatgtctttgacgtccagacagaatcagattctgagcattaggtagagggacaggaacctgaaaggtacactgtcccagcttactgtgggtaaaccagggcagacagccctttgctggggaggtagaatggtgaaaaggtggcaaggtgcactctaggaccaaggcctgcttataggggaggtctttggaataagacttaagaataagaaattaaatgatctcaagagacagctttaagttctcatctgttcactaacaagtatgatcttactctctcatagctttattacctgtaatgtgggaaaatgtgtctttctctcgtctagagggttatataaatatatttaatattcttgcctgttgtttctaaaattcacaaattttagtacagtcgtgtgttgcgtcccttaattgacagggatgtgttctgatgaatgtgttaggtgatgtcatcgttgtgtgtacatcatagagtgcacttacgcaagcctagatgggagagtccatcacacaagtaggctaggtggtgtaggccacaaacctgtgcagtgtgttactgtgtagagtactactctactattctactgtgtagaatactgtaggcagctgtaacacaagggtagggatttgtatctaaacatagaaaaggtagaataaaaatacaggggttatcttgaattgggccactgtcacacatgcagtctattgttgatggaaatgttgttatatggtacatgactgtactgatgaacataatttcgaagaacagtcataagacagaagatggtgctagtatcttctttaaccgtttctccttttctgtttcttttcctgcatttttctgtaaatgccctgccgccagcgcctccaggtagcagtgctcagcaggtgtctgctgcctcctgccttgctttgcttgctgagcctcctggctgtctataaacctatgtctctgtcttaatgctcctaagcttagtgcgtcctcaccacttccttcttgttcttgtgtttttcattttgccccttcttcctgaaactgtgcctgagatggtataccctgggggggagggctgtggaccacagagccttaagatccaccttccttttgtttttttttttttttattttctttttttttggagacagagtttcactcttgtcgcccacgctggagtgcgatggtgcgatcttgacttactgcaacctctgcctcctgggttcaagcagttctacctctcagcctcctgagtagctgggattacaggcaagcaccatcccacccggctaattttttgtatttttagtagagatagggtttcaccgtgttgaccaggctggtctcgaattcctgaccttaggtgatccacttgactcagcctcccaaagtgctgggattacaggtgtgaaccaccgtgcctggccaagatccactttctagttctgattttgttccttaattgtcttgttaccttgggcaagatacgactggacttgacttttgagccttggtttctttatctgtaaaaggggaagatgcaaaatatttgttcactttccaagacttatgaagatcacatagaccaatgcaaatgaaaactaaacactgtaaaccacttggaagatagaatggtatcattagtttcttaaagaaacctggatttgtagccctggaatctgaaaagtaaattggggtctaggtccattttaaaaatgggtctgtgaaggttttgaaaagttaggcgacttcaaaaatggagccagcccatcatcttgatgaccggaatgaaccatgtccacagcaactatcagaggccaggtcatgggcggcctgtgggcagtgcacaagccctcgcagtggggcctgcaggaatggatgtgaaaggtggtgcttcaggttatacagggtgtgtctgctcacctttcccccagccttgagcatatagcaagtcctcaattcacatgcatgaagtttatatgtataattataaagtactttgacggagccataatacttggatttatgtggtaacctttcccaaaggcacttccatatgcatctgatgagctgtgctcttttgagggggctagtggatagttttgaaccaaggagggataaccttggtgattgacttgagggaagctcagcaagttgaacctaggacaagagtgtgtctcttggatgggcaagtctagtggcctgtccaaggactactcatatcatttcttctttttttttgagacagggtcttgctctgttgtccaggctggagtgcagtggcacgatctcagctcactgcaacctccgcctcctggattcaagcgattttcctgttaagcctcccgagtagctgggatcacaggcgtgcatcgccatgctcggctaatttttgtatttttagtagagaaagggtttacaccatgttggccagggtggtctcaaactcctgacctcaagagatccacccgcctgggcctcccaaagtgttgggattacagatgtgagccactcggtctggctgccgtatcatttccatgtggcttattcattgtttttcctggttattctcctggttcacttcatgtcgtggatattgtcagtattgccaagtatgaggtagagacaggacttggtcattttgttttctgaggttggtcctgtctagttccagagctaccctttgggtcgtgaagttggaatttgcctggctttttaagttacactcttttcttttttctttctttttcttcctttcctttcctattttaattttttttctaaaatatacacaccgagtctcactatgttgcccaggctggtctcgaactcctggtctcaagcagtccacctgccgtggcctctcataatgctggaattacaggcatgagccaccacgcccagccaagttacacttattctgtctcagacttcagcttaggtacagaactcccactggataccaccacccattgttagttatttcttgggcacctccatgtatgcccttgtaaacgtctagatttccatgtggatcagcaatggaaagaaactgatccaagaaggtcatgttattatttattttcatatttgatcttgtcaccaaatatgtggtccagtgagacagccaccagcaaaaccaaaggagtctttcaggtagtgagcatttgagtggagatatcagggtttggagccacaagttgaacctgaatgcataggggaaggagtagctgttggagattgtgttgcctggactttgcatgaaatagagtctcagagcccttgagaaagttaactagtgcagtggtcttcattgtactactaggatcctacaaagacttctcactttgttcctccacatcagcacctggttggaggttgctattagcacgtttgacacccttgcttttgcaaatgggataatgccctgagggtcagacttaatgagctcattttcagtctgttctgtaggaagactgcaagtgttactttccttacattcaaatgtgtgaacctgtcacctttggagccactgaaactgatttttgctttcgtaatggtttgtaatggaaagagcattggctgggggtaaagggacttgtttttacctctggccttgaacaacttatatctctgaatctcgatttctctctggaaaatagatttaaactagatgatctgtaagagccctctctaccagtctcagattttaagataggtttttgcttgacttattttataactcagtttatgctgcacagtatctccctcatgatgtgttccatggtacccttgtcttgtaaggttcaggagggcccaatggtatagaccgactaaaagccaccagttttggttaccaggaaactggggaatctaggcttatgatttcatcattctgctggaattaaacactggcatgtgtgtgtttctaaggaatagtagcattaaataatttcattgtctggattttttttgtaccatagcctactcatgaaggttacttctcttgtttggatatctggacgctgtttttggactatctgacaagtaaaattaaaagtcgtcttggagacaaggaagcagttctcaacaggtaaactcctcaaacactgaaaactagatatggtcattttgccagttattctagtggcctaagagacagccatgcatttggaccttttcagtgaagctgagtcatgtaagctgtttaggcaataatgccattgagcatttccttttttttctcctttaagtattttgttaagactttttaaaattttaaaagtaatatgtattactaattttttatattttagtgcatttgtgttaatgttcttaattttttaatagcccttattttagagatacaaactgaagtatttattggataaaatgatatgacatctgggatttgcttaaataacccagtgggggtagaagggaagtgggttcctgtagagaagaaacaggctgcccatgtgttggtgattgatgttggagttagttcctaggaacttggggttcattatgttcttaccccatttgtatgtgtttgaaaatttcctaaataaattaataaatacctgttaagaaaaaggtgttcatttttaaatctaggaaaagatataggaaaatgtaaggaagataaacataatcccacaccccagagataattgcttttgcactttttgttgtatttttaaaaaacagagaatgcggaatggtttgtttccccccccatatgtttctcaaacccatttttcttgcttgcaggaagagagtatatttcctgtacaatatgttctttgtgccacagggtggggagaagaggaggggaaggtggagattcagcatgccaggaaaataatggcagcatccatatatggggaaagtaaatgtggcagcttttcttagcagaaacatacccatcatagtctcagtaggtgactgcatcccagtcacacagtgagcaggcagtcatgaaggaggcaaagaagctatattttgcattttaggatcagagtagtttcctaataaactaaaactgattcgtgtaatttgtatatttatgctatgagattacaaactaggtgatctagccctaagtactttatcatacttaacagagtgcctgcagattttactcagtttggttatagctcctacttctttgcacagtatttataagagcaatttcagattaggtggtcattgtgttgtaaaaccagtgcatgagggggttctgtcgagtggaagccatgacggggaatcgcacagacctatgtttggatcctggttttgtagttcctacctaggggtacttgggtaaggtacttagcctgtggaagcttctgtttcctcatttgtaaaatgaggatgaaaataatagttgttgagacattaattgaaataacgaactaacatatttagaatgcttggcacactgcaagtgttcacctggtggtggtgttagtgaatactctttccccataaatgtaccaaatggaggaaggtggagaggagagactccactgcagagaaaaggttgggctggaactccaaaggcttttccattgctgaggttttatgagtttaaaaaattctaaacaggacctagatgtggtagtatgtacctgtagtctcagccacatgggaggctgaggcagaagaatcgctggagctcaggagttcagaactgttgtgtgcagtgatcacgctgtggctggccactgctctccaggctgggaacatagtgagactccttgtgtctcttggtaccagtcactggtaccatttgctgaactctgtctctattgaaaattaaaataaataaatatgcaaatattctgttgagaattttattttccaagtttaaacatttgttcttttgttcccaaagatggtttttgtaattgtggaataagttccaggttgctatggtgtcaggtcacatgtgtgattataggtagtacgttcatatatcagaaatcgtattacacacaggagatcctgtttttggtgaagttgccaactttaagtaattatgtttttgaaatgagattcttgaaggaaaagttacttttgccaaaataatctttcttgcatgctaaataggcatatctttttggttctgggactatgcctcatttttctatatttagtggtagatattccttcatatctctcaagcttgttgtgagaataaactgaggaaatgattaatatgaaaatgctttttaaaaaacagtacaaggccgagtgcggtggctcctgcctgtaatcccagcgctttaggaggccaaggcagggggaccacgaggtcaggagttcaagaccagcctggctgagaaggtgaaaccctgtctctactaaaaacacaaaaattagctgggcgtggtggcaggcatctgtaatcccagctacttgggaggctgaggcaggagaatctcctgaacccgggtggcagaggttgcagtgagccaagatcataccactggactccagcctaggcgacagaatgagactgtttaaaaaaacaaaaacaaagtacaaatgagagatgtgaagaatatggtcctgttgagaaaatatatactagcagattattagtattaaacacacacttttgcagatcattatactaatagagcagtggtatagagaatttaaattctttttttgctttaggctagccgtgttacttttggtcaagttatatgctgatcacatttcctcttgcaaaatggacgtacttaacacttctcttgcaggatggttaggattcaaggaaatcatgtatgtaaaatacctggcacagcatctagatgtattaggcactcagtaaatggtcacagtgatgacaacagcaatgatgaataatagaagatgttactgcctttagactgtggttgtgactgtagcgttaggtggcatggcccctggacagtctaaaggcctttagcccacctgcagatgtttacctgcctgccctggcatctgttgtctaatgtcacagttgtcagttgttctggctgaccacttgaaacagtgggaatttttctcattgatcatgtgattatcatcctaaatgaggctttttaatttttcatgatttattcttttttaaacataacactttcatataatgcctttatgcctttgaaaaataaaacaacaggccaagtgccattgctcattcttgtaatcccagcactttgggagactgaggcaggaggatcacttgagggcaggagtttgagaccagcccggcctacataatgagaccctgtctctacaaaaacttaaaaaacaaattagccagacatggtagtgtgcacgtgtagttccagctccttgtggggaccaaggtgggaggatcacttgagcccaggagtttgagaccagcctgggcaacatagcaagactctgtctgtacaaaaaatacaaaaattatccaggcatggtggtgcatgcctgtagtcccggctactcaggaggctgaagcaggaggactgcttaagcccaggagttggaggccacagtgagctatgatcatgccattgcactccagcctgggcgacagagcaagactctgtctctaaaataaaataaaacaacaacaacaacaaaaacccctccaagctcctctggttagtgctgttaaatagtaaccaccgtctggggaactgcatgtcctgtcagataccccttagtggtctaagacagtagactacaaagaacatgtgttagtccagtgggctgcacaaagaaaatatttcaacttcagcttataattttttctgtaacccttaacattcaccactccagactatgagagactcttaatatatcagagatatgctgttttgcaggagcagctgctgaagaacactggcttctggtgatgaccacatttatgttaactaagagcatgcacatgtgatcaaatgtttgtcaactgataaaatataccagagagaagttgggatgttctggaatcatatttcagaagcaactaatcttgcaggaagtagtcaaaaatgttttcttgctgtcttaaatgggaaatgtaggtgtggttaagtcacaaaggcagcactcatttcctgtcccctgtggtttaaaggttttgcatcattcatcacaacaaagtggtaagcattgtaggctacaaatttagaagcacaaatatacatagatttatttttggtcctaggagcttggaaattggagctctgcatgctcacttgcctggtcaggagcgcagtggcgcgatcttggctcgctgcaagctccgcctcctgggtttacaccattctcctgcctcagccttccgagtagctgggactacaggtgcccgccaccacgcccggctaattttttgtatttttattagagacggggtttcaccgtgttagccagggtggtctcgatctcctgacctcatgatccacccgcctcggcctcccaaagtgctgggattacaggtgtgagaggaatttcttgatgagagactgtggggacttgagagagcctgagccccagtgttaatggggtaaatgttctgtagccattcctgcagagtggaatggccgatggggtagatcatcctgatctgtattttgaggtggtggcatggaaaggcccggattttcctttccctttccttgtttgtgcttttggatggttgtgccttcctcacagattgttgagaaagtgggatgaactaatgagcgtaaagtgccttggctgacagtaggtgctcagcaaataagcattggttcacctcccctttctctctcacttccggctctttgtgcttgtcaatgtgaagggagtcacctgtgtagaaacttatttttacaggaaggtgaagaaacctgagtgtgtgaagcaacctaaagtcattgtgtcatgttctgtgagcctctttgtgactagacttctggcaagtgctggccacaaaccaacgtagggattctggtgacattagataggactgtaaacaaatgtgagtgagggtgagaaaaactgctccttgctttttggagtgggtgaacctgcttaataaagaggaagtgccactgttacacatgacattgtggtgcaataaaggtgtgaactaggtttagatcagagctctagcagctttctagttcttgctcttgactgccccacagggcaagtgaatagagtcttagttgctttattgagttgaaaaagctatccaggaatatgcttcaatcctttgtatttacctgacttggaattttgtctgtttatcacctgtgtgtttttcattcatttctttgttcatttgttctttattcatatatattttattgagcacctactatgtagttgccttaacatgtataattttatttaactctcagaacttgaggcttataggcttatctctgtggtgtatataagcatttaatgctgtaaatttccttctaagccctgctttagctttatccctcaaaaaaaatttttttttttttttttgagacggggtctcactctgtcaccaggctggagtgcagtggcgtgatcttggctcactgcaacctctgcttcccgggttcaagcaattctcctgccccagcctcccgagtagctgggattacaggcacaaaccaccacactcagctaatttttgtattttcagtagagacagggtttcaccatgttggtcaggttggtctcaatctcatgaccttgtgatccgcccgccttggcctcccaaagtgctgggattacaggcgtgagccaccacgcccggctatccttcaaattttaatgttacattttaattttcatttgatttaaaatattttctaatttctttggagatttcctgtttagtttccgaatatttggggattttccatatacctttttgttattgttttctagtttaatttgtacatgtctttttttttttttttttgagatggggtcttgctctgtcacccaggctggagtgcaatggtgtgatctcggctcactgcaacctccacctcccaggttcaagcgattctcctgcctcagcctcccaagtagctgggattacaggtgcccgccaccacgcctggctaatttttgtatttttagtagagacagggttttgccacgttggccaggctggtctggaactcctgacctcaggtgatccgcctgccttggcctcccaaagtgctgggattacaggcgtgagccactgcgcccagcctgtacatgttgtctttatcctacttattctatcagttactgagaggggggtgaattctccaaaaataattttggatttgtctgtctccttttagtttgatcagtttttgcttcatttattttgagactctgttagttgcatacacatttagttttcttttccagtgtgtctattgagtgttggaccacatttctttatgtgggtttttttggtggttgctctgggtattacagtatatatacttaacttttcagagtcacattttaccacaagggtggtatggaaaccttaccaccatatagattagagtcctttagcctctcttctttatattgaggttttacatatacatacttggaaaaccccaccagacagtgttctaatttatacacgtacccatcattcatattttatagctcttaagaagaaagaagtagtctattagatttacccagacattgccatttctcttgcttttccttccttcttgaagttccaggtttctttctcatattgtttaccttctctattagttagattgggctaccataacaaaataccacaggctggccttaaacaacagaaatttattttctcttagttttggagtctagaagttccacttcaagatgctggcagattctgtttctgtgagctctcttggtagcttgcagatggcgccttctctctgaatgctcacgtggcctttcttgtgtgcatgtgaggaaagggagggagagaacccttgtgtctcttcatcttctcataagggcaacagtcctattggattaaggccctactctttgacctcacataactttattacctttttataggccctgtcttcaaatacagacacattgagggttaggcttcaatatatgaatgagtactttttgggggaagagtcgcacaattcagaccatagaggaacctcatggagcattgttattatagctgttttagagtcatcgataattccaacacctttgtcatcttgaggttggcatctgtcgattgtcttctccttgagaagttgtgtctctttgagtagcaagtaattttttgaatcctcttacttatttgttctaccattaggcgtggcttccctctccatcatcatcttatggtcagagatggatgctggatgatgctacagacatcatacccatgattcaggcagtaggaacgagaagtgggataggttgggcaaaagaagctttcttagaagtcccacccagtagctgcttttaggctctcgttgaccgcccccatcttcaggggagatgttgtccttgagttggcctcaatacccagtgctctcttgctgaggaaggagaatgggtattgggcaggcaaccagagtgtctgccacagccatatactttctccacctcccacatgacactttgggagatcagtgatctatgtgcatgtttgcctggttcctacttggacttaattttctaagcgatacgggttttttttgcagccagagttgccaattgccagttaagattttaggtctaatttagggttacatttgcatagaaagtctctaaatttccttttagcacagcaagacaatttatagatgacaaaattcatctgtcctctggtctgaagtagattttctttcctaggagaattgtggaaatattttgatctgtcacagcaatttatagtgtggaacttctgtaactttagaaatttatgtcttgaacaaaggcaaaaacataaactctaggcctaaatgtttgatcttacctttctatggagtttactaagtgggattttgactttattgggtgaattttcccacagacgttgcagattttattagtgcctttttccctgccggcattctttcctgggccctgttcagttgctagtctactttagggctggcgtgtgttaggttgttaagtcgtttgcatacagttggggagtcattgctggatatgggcaagtagggagtgtctctgtctctagttaagaaacgagctgtcgggagctaaatagtgggtgctcgtggacataggatggcaacaacagacactggagactgatagagagggagtggggaggagggcaggggctgaaaagctattgggtactatgctcagtgcctgggtgaggagatcagttatacctcaaacctcagcatcacgcagtatactccggtaaccagtctgtacatgtatcccctgaatctaacataaaagttgaaattatgttaaaaaataagtaaataaatacaaatgtcaattttggcataggttaaatttttaagttaaaaaaaaaaaagatactctggtcaccaaaatctgaaatgggacaatccaggaggatttgtaagtggtctgtagactgattctcatcacatgggctgtacctcctggactaaatggactgtatttggtcttggtattggatatcttttaactttggttatcatgttgtcccagtactcaactgtattagattgggtggtgtattagagtcctgtcaggaaatcagaaaccatacttaattatttgaacagaaaattcattttaggaaattgattaaataggtttcagaggaaacactgagataacacagttgataagtacaggaagtggcttcacccctaaggctagaagtacaaaggcaagaagctggggctgtcaaaatctggaagatcactgcttggtccctgagcaactagggttcagatctctgaagagagggccccatctagctgccacaggagttcagaggagggatcttttcgaactgggaccattcctttgaggagagggtgttgcctccacctctgagggtgcacgatactagttctgggaatgtggaatgaagctggaaaccggaaccagttgcttctgccaggtgtctgttgctggggcagcactgccaggacagcaagcccacaggaaggatgcagtccttttgtcccttctgccttccagtctccctccagtgtccctgctggcagaacctaacagaccgaaacaaagtgtcctttgagtctcagccccagcatcatagctttggagagcagattgatgtggagagcttactaaccagcactggtggtttgctctgtgaatgggagcagtcccttaacttatcttagaagcgtttcaggataggcgagtatttaggcaacatgatttgttcttgaaaatgagcagtttgttggtccttgtggtagcaattgttgcttataacttggtatcttctgagttgggttcttattacatgtgggaaatatccaaacctaccgctctgagtatttctttgagaaattattcttagacacaaatcaaagggtcagggtttccccaggctctttttagtttctaagtcttcttaaaatggactaaagattaggttttgggagttgggtggagcaggcttaaaacccattggtgctgggcgcgggatcacgcctgtaatcctgacactttgggaggtcgaggcaggtggatcatctgaggtcgggatttcaagaccaatctggccaacatggcgaaatcctgtctctactaaaaatacaaaaattagccagacctagtgggtcatgcctgtaatcccagccactcgggaggctgaggcatgagaatcactgaacctggggaggcggaggttggagtgagccaagattgcgccgttgcacttcagcctgggtgacagaggagactctgtctccaaaaacaaaaacaaaacaaaacaaaacaaaacacttcattggtgatttatgtgtagcgagaacatgattttgaattagggggccctaggttcgaaatagctttgtggccttgggcagtttatttaacttctgttaattgttgtttcctcatcagaaaaatattgataccatttacttctcacagctgttaaaagcatgaaatcattgaattaggtaatatttatatgcagtgcctatcatccccagagcagctgctaagatcataacttgaaaatacttagtaaaagaaaggacaagggatttaaaatgcagcactagaaaatacctgtttgacacaaaagaaggcaggaatggaggaattgaggaacataagtcatagaaaataaatagcaaaatggcaaaaatgaggccttccttatcagtaattacattacatttagtggattagattctcctgttaaaaaaggcagagaacagattttttaaagccacgacccaatgacgtgttgtctacaagagactcactttggattcagatacaaatagattgcaagtaaaaagatggaaagagatattccgtgcaaaaagtagccaaaagaaagctcgggtcactatactaataggagacaaaatatattttaagacagaaattattgccagagacaaaaaaggctgttatataaacagtctgtcaggaagatacatggtgcctggtacgtcattaaataaatacctctgcttctcttccatgggcgcacacacgtaccaacccataaactcagcctcaggaatttcgatgctctttttccatggtgatcaacatagacaccatttcttttatagtgcaggaggcattttccaaattctaagctgaaagcctcctttcaatgttgaatttctccctgccacataggtacgaagatgccctggtgctcctgctcacagaggtgttgaatcgaatccagttcagatacaaccaagcccagctggaggagttggatgatgagactctggatgacgatgtaagcggcatgccctgattgattttttgtcgctgtcatgttgtgacatcaatcagaatggggacctggaacccagagccctctgctccgaagactgttctgaaaccagagtagtcttctggtttgagtcgtacatttgaaatttttaatctcctgctggtcccttttggcttattaaccataaaaaatgttttacaggcttttttatctatgtggactagagatgtaagtagagaaaccatatgcacaatgaaaaacggtttagtgagaactctgtatcctctctgtctcccctgccttgcaccctcacctctgctccccaacctgggcagcagtaacagctagctggatgcttgtggagaccgttagcaagatactgaaccgataaggctagaatgaaaggaagtctgtttggagtacattatgcaaacttctgcttcttaaaatcagccttgaatttattgatgctgatgtgcccaacattaataaggaaaatgtctttaaggaaacaattccagtgtttttttttaaaccattaggcactttaaaatttttcaaataactgctgctcttctcaaagtaagagtgactgcggcatggtcaagagcttatgggtggtcatatttgggttacagagagccctttgcttagagccagatggcctgggtttgaagctctgcaaccttgggcatggaggagattggagggctgggtgtggcatttctgtgagccttaatgtcctcatctcccaaaaggggagtgacgtgtcttgcttcttaaatgtcaccatggataagaatcactggaacagcttgttaaagcagattctgattctggaggcttggggtgaggaccatagaatttgcatctctgacagcccaccaggggatgcgtttgctggctggctgtggaccccattctgagtggcactgagtcagtcagttatgtggatagggatacagtagtggaccgtgtcagaaggtgatgcgtgatcatttccaacaggtgatttcacaagtggctctccatctctgtatcctataacccaaaggggggaaaatagcttattctatgtggatcatttactttctgaggaagtagttttttgtgaaattaattcattgtttttaaaaaattctagcttggcctttttatagtaccagataacctggttccatcattttccatttcttcaaaattttatgtctgagagtggtcttgaggttggcaaggaagatgagaggattctgggagagctgattctcctgtgcttcccctacagcagcagacggagtggcagcggtacttacggcagagcttggaggtggtggccaaagtgatggagctcctgcccacgcacgccttctccacactggtaatgtgctgtccgggggagtggagagtgtagcgatttctctgtacacagagcatggctggttgactcccctggatctctctctctctcccctctttcccctctatgtaatttttaaaaacagaataattaccataagtgatgctcaaactgaacaaatattaacatttccacaaaatattaaaccaacttttggaaccttgtttagtcttggatataatagcaatttgactaaagccttaatacctttatcagtagcttgcaagtggccaggccgagtgggagctgttacttatagaagttacattgctgaaaagctggcctttgtaaagctcgctcttggcaaattgctagctttctctgcgtgtgtctatacgtgctggaatctttagttgtaaggattgattcccttccctgtgtggtgcgtgttattcaaagagatttcattaaattcatcacttcttcaaggcaaggcagttattagggtaatttttttttttttgagacggagtctcacgctgtctcccaggccggagtgtgcagtggcgtgatcttggctcactgcaacctccacctactgggttcaagcaattctcctgcctcagcctcccgagtaagtgggactacaggagctcaccaccacacccagctaactttttgtatttttagtggagacggggtttcaccgtgttagccaggatggtctcgatctcctgacctcgtcgtctgcccgcctctgcctcccagagtgctgggatttacaggcgtgagccaccgcccctggccatagggtcatcttttgcattgaatgacccagctatacttgtgttctctcctggaaagcttcgtactttgccatctgcctttcttaggggccagtcacgttttaatcttactggtgagtgtagcagcttgagaaagaaagatgcagctccggttatgacgttctgaccgctacttgagccagggaactgacttccaaataatttggccaatcttatcactttaccatgtgcttaataaggcatagctgacatttctctcaaggtagaggttcccttggatttgaagggagatatggtcccttctcagagttctagaaggtgtaggtcatttcagggtttgatctcctctattaggaacgtaagagtcataccacagtgtcctttgctttttttttttttttaaaaaaagggttgaactaatacgttttctttcttattctgtgtattaattggcggtttcaattatagaaactagttggggggcactgaaggggggtcatagctttttagctgcatttaaaggttcccagagaaaaggttttgatcctgttcctcacaccatagttacgtgttaatgttgtaatgttaaaatgctattaaaacttgcatttatggcttaaaatttttgttgtttttgtttctttgttttcagttccctgttcttcaggacaatttagaagtttatttgggattacaacagtttatagtcacttcagggtcaggtaaactggtttttattttctaatttaaccaaacattcaaaaaaccatcggactgatatttcattactgctgccgttgctgtcggaacatgatttcttcactgcagcctccccactggcatctctccccacttcgaaacagggaacgtttttaaaggcttatgatgaaaagctgtgggggaggtaaaagatgaggtcatgacagtgtattccaaggaggtgtttggaaaagaaactgatttggagtaaagagacaggacttactaaaaagcctctaattagtttccttatgtcctttcaaccagcaggtgtactagggagaacatggccttgtgctttcttgcttcctgctcactttagaattggaaggccatagtgcagctgatggcctgtggtccccctgccccctgcacctgttgcaaatggccccaggggctctgaccagagctggttgaaaaggcttttggctgctgtttacaggccctgcctgcttggggtttagggttagtttgctttgttattttgttgataacaataatagtaatagcttccatttgtagctctcattacatgccaggcactgtgttattgacttatattacttaattctctccatcgtcctgtgaggtgtaagtgctattactagttacccctgttttacataagaggaaattgatgttcagagatgttaatttacccagggtcccatggctttgttggtacaagtcgcatgatggtataatagggaatgacaaaatgttgaaatagctaacatctgacattcatttttgtcaactgaaaacaccagtaactgaaagccacatgtgtcctccctgccccatcagctgctatgcaccactctcactgcccttccttcttcccagcatgcttcttatgggatctgtcccggctctggtgcgcagcccctgtgttgggtaactgttgtttcagcccagcacagagccgcccagtgtgcagcccatctcctggatgagcttgtgattcatggcagagcctccacaggagcctttttccgaggctgtccttggtggtctgtgacggctggtttccatgactatataagcttctaaataatctagtgggccccaggaggctgatgggccttggcatgccccgaatgtaggccctgactttgtagatagggtaagaaatttaaaaagacaaaactttaaaaagacactttcaaaacaaacatgcttataaaatgtgctgtcaccactaatgaaaatcatttggctgtgtagaagtgctacagatgtttccagaagccatttttgggaataatcgtgcccaggtggtctttccttcaggaccactattcaaattagaatgtactcaggaccctgaagacactgttcttgatctattaaaaaaatcaagcaggtgttctttcctcccccacactgacccttcagtgtcctgtttacttttgtaaaagctggtgtttttacattctgttgtgtctgtctttaggtgaaagtctagtgaatctgaaactctatttctgggacatagctgataattctgagctcttctccctagaaggataatgtgatttattttttcctataggaaataccgcatacttgctttcactaaagcctgtttactggcaatttcacagaactcggctcgtccggatcatttataaatctcatcctcagcactgatccttggcttgtactccagtggcaaaacctcccaggccagaaaaatgcttatttcctgctttaaaacgagctctctcatccatgacaaagcattccccaatttttggtggctcagaagccaagtttccagtgcaaaggctattaacaaatggaaactctgagtacattttttcccctggttcccatagccatttaccccctcaaataacctccatgccacaccagtcagtcagcctcatgaccctcagcagaaactgtgccctctcatccctgataggctctgggccttccttcatttgcatttactttctagcccagcctttagttcttgggtctcctctggagcctgtgtaaatgggcgccagccgcgattcttgtctactcctggtgctgtgaccgtgtatgacaatgggatgcacattttggccagcagtgaggcctgcagtgtggttacccagcctggaaggctcccacttttgcttttgtcagagcagttggattcagaagatctcgtgcttctcactgtttcccttcctgctgctgagcctgcctccacttccctgtcaagaccaaggcacagcttgtcttgctgggccacgttggttgctctgtgctgctctggctcctggcaggtcatcctttgctccctctgtcttttctaccttatgtgggttaagaaaccctcattggtggtgttccccttgcacagcattgacatccgtatgtgaccccaaagcctccattctgtatttgacttctgccacccctcattggcatcttccttcattgagacagtatttctcctctaagtaaccctttaacttttctggttacccatgcaaactttcctgtgtaagggattattttgcctacaacattttatgtaagatttttagacttaaattgtttgttctgcttgggtccgtttatgatttatgattatgatttgttctctcagagggaaatgcctgaatgctaatttttagacctccctcaactcctcaaaaagagaagactaaattatgtttaagacttttttttcccctagggcagtgaattgccaaggagctgttctttggatgtggcttaggtcatacctagacagctttagaatgacttggtttgtggaagataggacttttgtgtggccatgatgttttgtgcctccaaacctttcagcattattctcatctgaaggttctaccttgcagatgtcctgtgcttttggggggaaatctaagccttgaccagacagaagaaagtgtgggtggatctgaacagcttttcacagtgggacactggcctatcccctcaagtttacttgatgccctgcgtgacttttgtggtggtgaaattaggtttataggctgaaggagggggtgtcaagggtagagaatttgatttggggtatttattgcccatgcgattgtctgccttgcagatagaacaggaaagaaccagctgtacttttgatgaacatggatcttagatacacatatgtgtgaagtggaactgtatggaattgcagttttgttgggtcagaagtgatcaagtgtcaacagtttcatattgttcaaactcacagtttaaaacacacacccagcacttccaagctgttttccatcctgggtactggatgctaggtacccatagttgtcatcctaggtactgctctttgctagacaaaataggacaagttcagaggggagggatcaggatggcaaggattctcaggagggtaatgaggggttacatccccagggctatcatgctgtcagcaggctttggcttgttctgtgttctaccctcaaggagtgggccaggggtgatgagcaatcacagggagatttactttacccgtgtttgtgaccaagttgtccagagatggaagggctcccttgagctccctagcattcagccgaggtccaggaagaggctgaagggccgggtgtgcaggggaagtgctgggcagaggggacggcttggtcagggcgacttttaagctctctagtaattgtctattaaggaccatactcaaatggaaacttgatttagggtagtgttttggtttggtttttaaaacaaatacagtgttccccttgtacacttaaaatacttaagaagcttgttctcaggtattcagcaggtacctagttgaaggaattggatactatagagaagttggaaactggtggtcagggtagagcctggggggaggtggaggtgcgaaatgaaggttgagcatgtggagagtgccagggactgctgaagcggactcagtgacccccagtgttgctctgagaaagaaaagctggcctcccctctttttgggcctgtactatgctatacccagtgtcagggtgtatttttcattagagtttattcccacagagccctgaggtctggttggtgtgcagaggaggagcaggttttagaagtcaaccctgggagttggttgcatagatataaccttgaaaatcccattgacattcagagggtgtataattttggcacttcagttaactgagagattggggctgtctctttttgtagcccatgaagtctgtgttccctttcgtacaaccagtgtgatgaaaatccctctcagttcattggttccgtgagttcgtctggctgggtgggatggtcattctgttgctgtggttggaggagctggcttactcattagctgcacccacagcctcttcagggctgccatcttgtttctgcgccagggcactgctgtccttgtggagtggaggaggcaggaccaggtgatttgggacaggtcaaaaccagcctttgtcactggccctctctgtctgaggtccttccatgagttacctcttctttcgttctcctgctccttaagatgtggccctctgtcccctcttccagcctcgtgtcttcctttgggggctgtcgcaggcactgttgcgagcctcatcccttgacgttggtggcggatcgaggcattcagcctgctacttcatttgccacgtgctttgtaggtgtccacccttcctttctgcaggtgccacccatccgtgtttactgtcagtaatacatgccagtattcccagggacagggtgaggaaggaagctgcctgggactccctgtcctgctctagtttgccgtctgttctgttgcatctaaatcattcatacatttacggtcactcactctgtaccagctgctgtgctggctgctggacatagctgctcaccacgagggattttgtggtcagtaaggagatggacttgtaaatcatcggtttatctccttatgggcacgggtgccaaggaggaaggcaggagtggggaggccccacagagacaggatgcccctgagaggctggaggctatgtaggagcttgcaaagcttgggtgggcagaggatgacatgatcagcagtctaggcagaggcacagagacacgaggctctggggaattaccagtggatctggatgacatagtggcatagtagaaggtggcgaggccatgagagagctgagttgatactggagagtctaggctctccccttttagcaggagagagcctccagaggcttcagcacctgcttcaggggagctgcaagcttagtctgggctctgggaagctgattttggagcacagcgggaggagggttggtggtgaccagtgtgaggaggagggttggtgatgaccagtgtgagtctcgcctcctaagagacaggagagaactgaagtagggggagggagcaggtgtggaaagtacccggggagttctgggatcgtaggtgccctagttacggtgccctagtggtgttaccaccccaccctcattcctgctgtgtcagtgagaaggacttgaatcagacctgcaggtctctgttcctgcaggtctctgaaaattcttactatcttttgtggacatttgtgaagagagggatccaaaaaccaaggaagtgaccgaatcaagggaggatgttttgtccttcatcttagcatcctccttattcagtttgaagaagttgtgttgaaaagtaaggaaatttcagaccttagtaagtcactagttctttgttatttataataattagaaatactgaacaatgctctgtagcttagagggttatatattttaacatggcccttgtaatagtgatactgaggcttaggagggttgtatgaggcactgagcccagaagtggcggggaatctgtgtcttcggaatccaagtcccatactctttatttcatactgtgtcacctcccagccttcaggggtggagtgctgagtgtacctctcctctcttagcaggggcgggtcctaactgttggtccatggaaatttcattctgagatagggccctatcctaaaggaaccagatttggagtcacatagactcagcgtagaacaccagccttgccccggaaatgtgacacgtgcttggcaagtgcctgggcctccctgggtgtgcctccttgtatgtaacagtgatggtgtcaggaccttacagggtcaaaaggaatcagatcaggggctccctccacgttagcacactccaggctgtctgccccttcccacaactctgtctctgtccctggactctggagcacaaacgtgtagtgttaggtggataccgggcccagtttccctgctcagtactgggaagcagcccgtgggttgctttgtttcgcgaattggttttgctgctggttttgctgtgtgtggcttgctggaccagctgttatctgtagtatctaaagcgtggtcttcctgtgaaaaactgtctggcgtgttgtgttccaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggtaggctggcagttaccttatggagctgttccttcttcagagttcagctttaccttcttgtgtgaggggcagcatattgccaaatagcttctgctctggccccgggtaaatctaggctctgccacatacaagctgatagggaacaaattacttaacctctctgaacttcaggtccctcatttacaatatgaagtagatgttgtttcctgtaggtttagtgtgagaattaaatgagataaagcacttagcactgtgcctagcacataacaaaacgcctgataagttatttaaggtattgtttctttgaagatcttgtgtataaatgtaaacacagttgtagacccaggagaaaccaggagaggtcagtcttcatgtctttcctcataggataaagagatattaagaaagccctactgataaggagtcaactccattgtccaagtaggcagctagatgcacagggtgctttttgtgttttttccagtcccattagggcctcgggagtgaaagctgggtagcctccacgcctggcccgaaaggtggttcccagcctttcaccactgggctccttttcttctccttcctcttgggtctcacaccaggtttacagatgcacttgttgaggaacacttgattctactcagtcagcagtccctcctccctttctcccctcgaaaaacccaagatgtaagtgacaggacatttagatcatttcaaggcagctgttgaattggttagatcaaaactgagtagatgtggatccagcccaaagccaagacacctgatgcttcgactggcccagcagccgcatcactggtgacgtgcagaggggaagtgagcctcaggagcctgggtgcatgcatgccagacttcactgccacatcttagctgaaaagcaaagatagccaaggggcttaaatcccttaaaagccagattcatattaataataaaaacagcacacagtagtaggacattttctgtgtttttgcacatggtctttcattttgttctgtactttgagagacaggcattgccgttttattgttgagtaagtacattgtggctcagtgatgtgagtgccttgcctcggttcacacagtctttgagagggagagtggattttaacagtttcctgggtccacatgttgtgcgctttccaaaccgtagcgtttgtattgccagtccgttcctcctcctcttcttgtactgggcccatttgcactgaggtttagcagggataagacatgtttttctgtctgaaatccaaagataagtccattatttgaacttactctgttaagcaatatagatatatcttatctgttcagttggcggggcgcagtggctcacgcccgtaatcccaacactttgggaggctgaggcgggcagatcacctgaggtcaggagttcaagaccagcctaaccaatatgatgaaaccccatctctactaaaaatacaaaaattagccgggcgtggggacatgcgcctgtaatcccagatactcaggaggctgagacaggagaatcgcttgaacctgggaggcggaggttgcagtgagctgagattgcgccagtgcactccagcctgggcaacaagagtgaaactccgtctcaaaaaaaaaaaaaaaaggtatatctgtcagtcatctcaactttgtagtgagatgatgtctcaaagatcctgaatcatttgataggtccctatctttctgcactgcttagatttccaagcccagtgcttaaacatacttgttattaatattttgtcttcatttagaataaaatgtgagagaaggctcttgttatgactacatgaccttaatagccagtatgattagcagtgttttcatttattggttacataaaacaaagctaatattagaactgctaaacacagacacattaaaagatgtttggaaatgcatttttagtgtagaacaggatttaaacaccaggtgcatattggtatattgttttctgataataactgttctgatcacgaggacttcgtgggactttgggaaccttagttcttttgccctcactttcttgactgaccggaagtgctcctttttgattgctttctcattgctccccagcaatcagaaatacaaatacaagtttgtatttgtaacaagttccttagttgattgttatgctgggacaaagacaaacactgccttccctggcatccatttccaggtttccacgcagagtaggcagagagaaactagccaggtcttgggttttttccccttcactcagaaaggaatgtctttcaactccaggcgtggtggctcacctgtaatcccagcactttgggaggctgaggtgagcagatcgcttgagtccaggagttcaagaccaacctggacaacatgacgaaacctgtctctactaaaaagacaaaaaaatttagctgggtgtggtggcatgcgcctgtagtccccgctatgggagggggcgctgaggcgggaggatcacttgagccccagaagtctaggctgcagtgagccaagatcactacaatcctctggcctggttgacagagcaagacgctttctcaaaaaaaagaggagagaaaggaatgttgtcctgtctgtaatgaaagaggcatttcccatttcctactagatagagctattagttattgtgtttaatgctcgttagtatccagtgagcccttgagcaaccagtgggctcaacagcttgcttctgaaagaattgtacttgaacataaaacacctccacctattctagaaacatttgctcctttcatctgcctcctccaaagttttatcaaacattttcaaatttgaagaaaagttgaaagaattgtacagggaatacacatatacccaccacatagattctatggtggacagtttgctgtattttttttattatgtatcaacccatctgaaacatttccttttaaaaatgattttaaataaaagctaagatggttttatcattatcaaattttatagaaaagcccacgtcatcctatttcgataaactgccaaaagagcagttttttttttaaaacaaaacaaaacaaaacaaacaaacaggattttggtcttgttctgttacccaggctggagtgcaatggcatgatcctggcttagtccatcctcaacctcctgggctcaagcagtcctccctacttagcctctcccaagtagctgagactacaggcatgtgccaccacatctggataaaattttaaaagacagggtcctactttgttgtccaggctggtcttgaactcctggactcaagtgatcctcccaccttggcctcccaaagtgctgggattacaggcatgagcaaccacattctgcctgctttttaagaactattttttattctcctcatttataaaacattatatattaattgtagataatttggaaatgcagaaaaatagagggaaaaaaatcatccataatctacccactctatcctccccctaaaacaagtggtaccaataagcatattttggtgacacttcttcccgcctgtcttctgttaatagatgaacattcacgatgtattctgtatgtatatttagtacaaccatgtcatgtttaaaacatcctgaatatttatcattaaatatgcctctaagcatggtttttattgtatatattgcattgtattacctcctctgggttggatatttatattgttttcaaagtttttgacaccttcaataaggctttagttaatatgcttgtatataaatctttatgcatatctcagattatttccttggcataaaattgaaagtctggtcttgattcttttttgtatatgaaaaagtctgcccttacgctctttgctggtaccagccttgtctgttttgtctgtcttagttcataagctgaatgttcttgtttacctgcctctttgccaacaggttggtcaaagtcactctgtacggatctcagataaaattgtacaacattgaaactgctgtgccatcagtattgaaacctgacctcattgatgtgtaagtctagagtttgatgtttgtgcatttttaggaaagaccttgcccccaatctccaaataatttgattgagaaaaaggaacagtagtggctgccatgaatcagggaaaaactcttaaactgcaaacctagaaagagagagagatttttttgactatatgtctggggcagaggcggttggagaaagtggaattaggtaagtgagagctgggatggagattctatggagtaggcatttcaggaggaaagaacagtacaggctgagacagtcacacaggcaggaggtggctactccatgtagtgcaagaagagactggataggtgtgttgggactaatgggaaacacctcagatgccatcagtctttcctgtagatcattgactaaaactgtaggatactgtaggatgcagaagaatgcttggggaacacatttctcagagattctgattttagcagaatggcataaggccataaggcttgggtatttgcgtattaaacaagaaccccaggttattttgaagcaggacatctagagaccacactctctacctacagaaactctacagataacatgggatgctgttaggaaagtgacatatggaaggacagggacaggagatgggcagtatcccagagatttcactgcccagaagacttgctttagatgagagcagggggttggcaaactatggcctttgccaaatctggcttactgactgcttttgtaaataaagttttattgaaacacagctacattgatttacatacggtctgggagtggttttgcactatagcagcagagtagagtagctgtgacagtgtgtatgtatgccctgcaaatctgaaaatatatacactcgggtttttacagaaaaggtctgccgactcctgctgtagagcattcttgagctgcagattagataaacgatggaaagagaatcttacttactatggtggttttaaacttttaaaaaatatattgctttcccttttgagaatttagagaaagttgtaaagcatctcccaagaaagatgccagtttccttataaatacaacaacttgtacacattttgggagtttcagagcccctcctttcagccttgaggagctctacagatgtgctagattgactgaaattcttactcctaaggctgactttgatgtcctttctctttattttggtatttagaacttaaagggtaatgtgattctaaatataaaataaaattttaaatgtaaaatacaaaataactgtgtggtcactatgaatttcaaactttcagtaactatattttcttactttaaagtactagcacattttcttacccaactgctaattttgaaaaagttcaaacctatagaaaatgggaaaaacaggcgaataagcacccatggacccttagcctagagtaaccaattacaaattggcttttgtttcttgtgccctctctgcacacaatacatgatgatgatgatgatgattattattattattttgctgagccatttgaaaataaactgcatggctgaacgtgatgattcatacctgtaatcccagcattttgggaggccgaggcaggcggatcacttgaggtcaggagttcaagtccagcctgaccaacgtggtgaaaccctgtctctaccaaaaaatataaaaattagccgggcatggtggcacttgcacctgtagtcccaactactcgggaggctgagctgggagagtcgcttgaacccgggaggctgagatcacaccactgctctccagcctgggtgacagagtgagaccctgtctcaaaaaagaaaagaaagaaaagaaattacagacaacatgtcacttcacccgtaaatccttcagtgtgtgtatcctagaaataagttcattcagctctttaactatgatatcattatcaaccctcacataatttaatacatacaataatgtcatctcatatatagtccatattaaaatttcttcagttgtcccaggaatgtttttgtatcttttttttttcttggatccaaggtctaactaatcatgagccacacattaaatgtatttcctatagtctagaacagttcacccaattgtgtttgtatgtctgcatgtgcgtgtgtgtgtgagagtgactgaggaccttttgcagatccagatcttaatttttttaaaagcatgtcctacaatctggatttgtctaattatttccattatattagattcagtttaaacatttttagcaaggttactacataggcaatgatgtgcctttcctcttgcatcatgtcagaaggctcttaatatcaaatttccctgtaattgttgatgctgagtttgcttttaaaatggtgtctaggctggacacactggctcatgtttgtaatcccagcactttgggaggttgaggtgggaagatcgcttgagcccaggagtttgagaggagcctgggcaacatagtgagactctgtccctaccaaaaaaaaaaaaaaaaatagccggacatagtggtgcatgcctgtggccccagccacttagaattgcaagccaggagaattgcttgagcccaggagttggaggctgctgtgagctatgattgtgccactgcactcctgcctgggcaacagagcgagaccctgtttcagcaacataaataagtaaataaagtgatacctgcctatatcctaattctgtctgctgaaagctcctagaaacagtgacaatccagtagcaatcctatccgttttccccaggtcttggtttctcaaatccattctccagagcaccttggagaaaaaagctcaagtctgggggggtgatgttggacaatcttgccaagtcagcaagtaaggaagtgctcagtgactgttgggaacatgtgaagaggatgcaggacccagcttgaaagggttcttcctggtcaaacttgacagttcagtcatcaagaaagaataaggacaataatgaattataccagtttgaatgaaaataatctactcattcaaagtgattaacaggctaggccggtgcagtgcctcacacctgcaatcccagccctttgggaggccaaggcagaaggatcgcttgaagtcaggagtttgagaccagcctggccaacatagaccccatttctacaaaaaatacgacaattagcctggcatggtggcatggacctgtaatcccagctacttgggaggctgaagcaggagaatcacttgagcccagaaggttgaggctgcagtgagccatgatcgtgcccctgcatgccagcctgagcaacagaatatgaccctgtctcaagtaaacaaacagataaacaaaaacccaaagtgattaacaaaataaggatgagaggagggaaagcctctttttagagaagactgccaactaatgaggagaaaaggaaagatagaaaaattaccaattcacaaccaccaatgtaatactgatttaggcaggagtcgttaataaatgcccaaaccatgaggaacactgtctttgtgtcacctcatagtagtaccaccttacaacttactaattattaccgaaaggtaattacatttaggtatgttggaaggcttggtgttttgaagctccgagacaactgtctctccttgtttaagattgattgtttattatatttgatgaattgcatacttttttgatgtatattttgttgcatgtacgatgcagtcagtacagcctttgctgaaaccaaacatagtctttgccgcctcagttattccctagccaggtggaatgtgtggtgcagtggaagcttaaactccaaaatctgacatcaaagctctgtttataaagctgtcacacctggtagttgtctacgctttagtctgcagctaggaatgttaaatttgtactagttctgaagtcaacacatgatcacttaagttctttgattttgcttttataatttacctttctcttaggtgagcatgtgtcacagaaagattgaataagattcagtagacattgactaactgccttctgtgctctagtcagcggtggcaatgtttagatgatgaatatcttagtttttaggttctacgtgaaccggtaaatgatttctatgctgttgcccatgtcttagaacagcaaatgcagtggatgcaattcttacctcctatgaaaatgagttgaacgctaatatattttcaccttaacctttaaaatcacatcttcttttctttctgcaggcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtctcgaaacagcaaagcctacaccttttatctaactctctgtctctccttctgttcctatacccatttactagaaaatctaaatatgacacagagttagacccataaatctttctgctgttatacatctgttttatttcatgttcctttttagttgtagcctacatgcattcagatacaactttacttttttagttatctgagttccacatgaatacatgctcactgtgaaaaagtaaaatatcattcagatttccagactaaaaagttgtgatacctctgaaacattttccttcgcgcggtaagcacagttgggcagtggttgtgcaggcacacctcattttattgcacttccctttattgcgcttcacagagactgtgttttttacaagttgaaggcttatggcaaccctgcatcaagcaaatctgtcagcaccatttttttgacagtatttggtgcttccatgtgttacattttggtaattgttagaatatttcagacttttttgttactatatcttacagcgatttgtgatcagtgatctttaatgttactattgtaattattttggagtgccacaaaccaaagactgcaaacttgattgataaatgtgtgtgttctgactgctccactgattggaggcttccccatcttcctgtctttaggcctccctattccctgagccatttaataaccctacaatgacctttacgtgttcgagtgaaaggaagagtcacatgtctcttactttaaataaaaatctagaaatgattaagcttagtgaggaaggcgtgtcaaaagccaggataggccaaaggctcttttttttttttttttgtcgtttttgttgttgttgagatggagtctcgctctgtcgcccgggctggagtgcagtggcgtgatcttggctcactgcaagctccgtctcccgggttcacgccattctcctgcctcagcctcttgagtagctgggactactggcgcctgccgccttgcctggctaatttttttgtattttttgtagagacggggtttcaccatgttagccaggatggtcttgatctcctgacctcatgatctgcccgccttggcctcccaaagtgctgggattacgggcgtgagccaccgcgcccggcctggccaaaggctcttgagccaaacagccaagttgtgaatgcaaaggaaaagttcttggaggagattaaaatttctgcttcagtgaacacatgagtgatgagaaagtacaacagccttgttgttgatatgaggaaggtttcagtggtttggatagaccaagctagccacaacattcccttaagccaaagccaaatccagatcaggcccttcaattctgtgaaggctgagagaggtgaggaagctacagaagaagagttggaagctaacacaggttggttcatgaggtttaaggaaagaagccatctccaggatgaagcagcaagtgctgatggagaagctgcagcaagttctccagaagttctagatcactgctgaaggtggccatactaaacaacagattttctgtgtagatgagacagctttatactggaagaaggtgccatctgggacttggatagccagagaggaggagtcagtgcctggcttcagaggacaggccaactctcttgtcagggggcaactgcaactggagacttcaggttgaagccagtgctcatgtatcattctgaaaatcctagggcccttaggaattatgctgaatctactttgcctgtctctataaatggaacaacaaagcctgaatgacagcacatctgtttacatcatggtttactgaatattttaagctcattatggagacctgctcagaaaaaaagattcctttcaaaatctgctgattggcaatgcacctggttacctaaggactcagatggagatgttcaaagatattagtttccatagtttccatggctgctcacacaacatccattctgtagttctgtagcccatgggtcaaggggtaattttggctttcaagtcttactgtttcagaaatacgtttcataagactatagctgccatagatggtggttcctccagtggatctgggcaaataaactgaaaaccttctgggaaggattcaccattctagatgccattaaagacattcatgattcatggaagcagatcaaaatatcagcattaatgggagtttggaagaagttggttcccagcctcatagatgactttaaggggttcaggacttcagtaaagaaagtaactgcagatgtggaaataacaggagaactagaggcggagtctgaagatgggatggaattgctgcaatctcaggatcaagcttgaacagatggggacttgcttcttgtaaatgaccaaagaaagtgggtttttgagatggaatcaactggtgaagatgctgtgaacattgttgaaataacagaggattagaataacacataaactcagttgatgaagcagcagcagggtttgagaggactgactccaactttgaaagaagttctactgtgggcaaaatgctatgaaacggcaccgcatgctccagagaaatatttcatgaaaggaagtcaatcgatgcagcaaacttcattgttgtcttattttaagtaattgccacagccaccccaactttgagcaaccaccaccctgttcagtcagcagcagtcactttcaaggaagacccttcaccagcaaaaagattaccgctctgaaggctcagatgattgttagcatttttagcaataaactactttttaactaagatatgtacattgttttcttagacataatgcttattgcacactttatagactatagtgtaaacaaaacatatgcattgggaaacaaaaaaattagtgtgccttgcgttattgcataatttgctttattgtggtggtctggagctgaacctgcagtatctctgaggtatgcctgtatatccttccagacttttttctctttttatgtaataagtaataactaagtttgtagatagctggagatatagctgcttttgcctaacagtatgccttcattttcctttacatatgtacagcaacttcagattgtcaaaatgtccagtggttttttttttttttttttgtgaggatgtataataattttcctattgctagaaatgagttccttttatgtccatcttacatatgctagtgggcctgaaggatagattcctggaagtggaattactgagtcaaaggttatatccatgttaaaactggacagattctattatgttatcctccaagtctgctatattactagagcatatatgtgtttattctttgaatttttttgtagttttagtcatacataacattttatacatttttaaacagtgtattgttttaataacaatgtgttgctttccataaatttatgttgtatttataattataactttgaaaatagtcctatcccatcaggaatatgtttcattattttcctagccattgctggacttctaggctgcctcccttaaaaaataaaaaattataaagaattctgaaatgcacacattcatgaatgtagctttacccttttaggtaatcttcttagagtaagtattataggttataggtaatcttagagtaagggttaaaggttaggaatattttgtgactttgggaaatcatagtaatttttttcccgaagtaattctgcctgccttgactttttggtgtgctgtttttatcttagtcttaccagcattaggtcccatctgtaacacgtttttctcctttgctaatttgaaagcaacagtggtaattgaaccaagtatttgataggcatgctgaagggaaagcagtaggagagactggcctgagtgttaaggcacagaagagtcgggggctcggggagatcttggctctgctggaacaattagtgaggtgaagaattctaggacctggatgacatgccagggagtgtgatttaatagctgatagggagccactgcagactctaagctgagaagtgcctgagttcaaggctgctggtgactgtgaaggaggaacgggaggaggtgataatggctgcggcaggagctgtggacatgacagagaagatgggcttctcttgtagtcatcataggaaaaattcttgagctagatagggcctaggtggtgtaatttggaaaccaagaatgacacatagcttgtggctgcctcagcaaagttcgaatcccagtcttacagggatgtggtgagctgacgtgccctcttccctctgcaggtccaagacaagctgctgctatctgcgtgccacttactggtctcactggccaccaccgtgcggcccgtctttctgatcagcatccctgcagtgcagaaagtattcaacagaatcactgatgcctctgccctgcgacttgtcgataaggtgaggccccagagctcccccggggtccccagggctgtgtgactgagacccaaggaagctgaggaagaagagtctggcctttgattttgtactcagagcttacaggctgtaccagcatagacagatttcttattgtgtggcactgacacagactcagtgattctcatcgtgcccattctaaggcaggcagtcagtgtgctgattgaggcgtggaaaagcacctcccagtgtgcagaaaggttttgctgctttgcagcctggtaatttcggccagtgttgtgagaattctctttgcattctttctgattcaaagcagtctggtttttgttgtcactgttctgtgtgtgttctttggggttgagaagtgccaggcaagtgcattttcttagaatcctcaaaggaggctcaagctagaagtttaaaaaccacctaacaggagggagggcaggaaggtttgaagagggtaccagagggcaccaggatgtgattgcaggatgtgacctggtgctaggggcatggattgtcacggattctcctgcaagtcctgctctaagtagcttctcagaggactcagaagccaccagctgaacaatgcctgagattcagtgtctgcagtgtgatttttccctctctaatacttcaagtatcagattagagaggaaacgagaggttagctctgggttatgctagacctagacatggtgctattacttcatttcatcttcctccctaagttgccttccagttggaccaaaggccttgcccaggttgcaagaaacgagcctgggggctagggttccaggtgtgcagccagcgggtgctgaaggctgtgttgggcatgccgcaccacggtctttggctctgacctctgatggatgcctttggggtctcttgtaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacagtaagtgacccctaggctaggacagctggggaaggaggtaggcaggcattgttctttgtggcagatgagatttgccccggaggctcctgaggtaaattttttttgttcatagtcccacagaggctgagcaggaagtcatacttgggggtgggatcctgctacctttggaattcagttaagacagcagccagacctatttccagaatcaaactgtcccttctcttatttaaaatgtaaaaaatgctggagccctaagaaaaaatggaagacactggtgatggtgccttctgtctataaaatacatcttaaggtggttattgatctatttcagatgcttgtgtaggcaaacaaagcagttcacctctacacgctgggaaaatgcgctcaagaactatttttccagattggtttcaacctttttccaaatacagatcttccagaggttttgaaagagcttagtttcttaaaaaatggcacttgaagtttgcttgtttatattaaagaaagagggaaaaaaatgaataaggaaatatctctttgaaataacaaatagtaccgaaatattttaaaaatacgagctcctttcacaaaaagaaaataatagaacattattagatggtgccatttatggaatgtcagcaaaaatgctttgtgaaatgtcagaaatagtaataaatactatactctttaaaaaacactacttttataactaggaagattaacatatgtgcattgtacaaatacattaaaatagaataatacaaagaaggaaaaagtaactcctaaatctgaccagttttaatattttagaaagtaaccattttaaccatgcttccttcttaccttcccttttctattttaaaatatgcttcatggttacatagctggatgagagtagctgacatattgagggtatactgtgtactaggctcttgccttggtgattctatatccatcgtcaagtctctggctatgccagtatcaactttcaaagtctggtgttggtctcttcctggttctaagtatttttcaaaaatcagtaattcattcagttcttacattagccttatgagttcggtactgttaggatcttgattgatgattagcatgaggaagctgaggtctagaagattaaggaacttgcccagggcttgcatccagctgttgtggagtcatgctttatcacgtgtaatggtctcctttccgcactttatcttacatgggagttatgttggtctgcatgggcgaggatatgctcagtggtaacaaacaactccaaaagtgtagtggcttaatacaagaagaaaaaggatatgttgtttgtactatatgtccagcttgggtcagcagagtggggaggtcacatagggacccaggctgtggaaggctccatttcagtgtgttcactctggaagggattgtggtgaattgcgtagtggttcttaaaggtcttgcctgaaactaacactacttccacctctatttccttggccagagccagctacatggccttggcttaactcagagggcagggaggtgtgatgccactgtgtgctgaaagggtttgcagtgtagtatgtgaatgacgtcttcagtatgctgactgtgtgcaggcactgggttgagcactttgtatacgttatttcatgtaacttcctgtgtaaccctgtaaccctgtgaggtatgtcttatcctcattccacagtgttgaaattaaggttggaaagtttcatttttcttatctcaactttatactttgaaaaaaaaaaattccaaacctacagactagccaaaggaataagaaaatgaacaactgcatctctctcacccagattcactaattgtgaatgttttgccacatttatgcttttttctgcaacacactttttcttaaaagccagctgtttaagttgcagataattgacacttcatctctgactacttaacctttgtatctatatagaacaagatattaaacattggtacaataatgttatttaaaatgtagccatattaacactttccccagttgttaccaaattgttcttttttgcttttaaaaaatccaggatgtaatctaggatagttttattgtgtttggttgttatatctctttagtctcctttgatccagaagagcatgcccagtttttgtctttcgtgacattggcatttttgaagcgtccaggcctgttttcttgtcatatgtctcctagtcttgttttgcctgattgtttccataggttgtggtgtagtggtgcatgttcgtgttcgcatttcctcttgcattgcttctgtttgtcccatccttggtgatgctcagtctggatgcctgttgggagtagggcctgccagtctgtccattgggaaggtgcttggcaggtgtaattgctcaggactgtagagaaagtgggcgaggtcaagagttggacttgggtctgaatggctccagctcctgtgttctgcaccactttgctgcattgcctctttcttcttgaaaacaaaaaaaaaaaaaagaaaagaaaaaaggttttaatggttttataatgtcctgtctcatggaagtataacagttacccaccccattctcctattattatatacttatagtgctttcaatttttgacttgtattttttttaaatacatcttttgtcctcgtttgaatttccttaaatgccagaggtcagattttggtctcttgactgttggttttttgctctaaactgcttcccctgttgcctgtgcgttcttgaggaagtggctgccctgagtgcagtttcctagctgagtagaagtccatgtgcttgtagttgtggacggctccctgctcagcagtgtgggtgagcctttcctttactctccagtgtcactgtgactgggggaccaggaccaggcctgtggcgagaagcgtcttccttcatcctcagccctgtgagtggggcgatgctctctatccacgtgttcagatgaggggcagcagggccaggcctgcctccatctgcctcctgagcatgtcttctttctgccgtaccccttcctcaaagctgcggcagtcccacagaggctgctgagcactggggttcgggggacccagagactgctgccaagtgggaggcagctctcagcccagctctggctcagcctctggtggtcgccagggttgagtctgctaggctcaggctgagccatgggcgtcactttggggaggctggtgggaaactctgcatcttaagagggtgactccactcgcgctgggaacaatggcagcatctccgtcctggaccttcttagatggctggcacactgctagcatcgttcgggaccttgtctctaatccccactgcagcactgccagagtggggttgtcggctctcccagatggatgagggtcctgcccatggcacatagccttcagatggtcacctgtggttcatagccagggctctctgacctctgcctgtttgcggcccactacatctgttttccctgtgtgccatatggagtcaaaagtcatctcagggttagcattatgtattgtcaataacataataacagtaattatatgccttatcaagctacggggctaataggccaaagatggatcaggcaggttgttcttgcagccagcaccattacatgtgcatggcaggtgtttgtgggattactgggctggagtagcatcccactgagtgacaaggtttgagctgcatgtgtccgtcctggcctgtgaccttatgacactcattttctcaccagtctattcaccatcttttagatttgattaaatccaaggcacccaacctgggggtacatttatttatcttttttcttctgtggacttgttgccaatggccagaggcaaaacagaggcaaaaacctgagcaagcaggcaggcaggcatcttctccccaacacacattccaggcttctggagtcctggcagtaataatagtaaaaacaaaaactaaaacataaagagaggagaatttatattgtaatcaagagactgttcctttagtgagactcgtgtgatcatcttcttggtacctttgcaagtttcctccctctcccttgtgtctcctcttaccatgctttctccccagacagcttataacctgcaactcatcttgatttgcagccaaactgattatccaccagacactcagcgtcttagaagatattgtggagaatatctcgggggagtccaccaagtctcgacagatttgctaccagtcgctgcaggaatctgttcaggtctccctggccctctttccagcttttatccatcagtcaggtaggagctggcccagaggccccactggtgggtggtgctaacaagggccagaatacccacttagatctgtagaacacactgagtcggtgcagtacaggccttgacttgttccgtgcaacgaaacccggtactgaggggaaagggcagtgatgtttatttgtggagtctagggccaaggccctttggaaaagtgagcagagctctccatatgggccttggcacctacaagagaaggcaagagagcttttttggcttagttctccttattttgtggcaaggtgcatttgccgagatcgttcccctcacccttgtctgtcactgtcagtgatagagggcctctctagctctgtggatgtacttgcctagctctcatgacagcattatagtagtcttgtcagttttacaagagaaatatcaggcacttctcagtcagcaaatattcattgcctcttgcaagcagattgcgtgcagttagggctgaaacacactacacaagatgattgttgagatctggaagtgaaactgccctatatgtaaccagtattttctgcaattaatccatttaatggaccagggccatgcaacctaaatacaccttcattatccactttcaaccacttaacccctgacccagctgcagggattattagtcatagggggaaatggcttaagcactcaggtgttgacccagttggcattcatcagtgtgggcacaaagtgatccctctccagtgaaactctgaccatcactggatgtcgggcaatgagggagggttcgagatgaccttcatttcctgtagtgagccaccaggtggaggttccctataccagaactattttctcagcatgtccctaatcgttttccactttccatcattggccctgatggtgttggggaaatgtttccagcaggaagctgtagagaaagctgatagtgcagatttcaggagtaggttgatgaagcccagggttctggttctcactgtgtgcaagcctctgacgatatctctgcccctttcctcagatgtgactgatgagatgctgagcttcttcctcactctgtttcgaggccttagagtacagatgggtgtgcctttcactgagcaaatcatacagactttcctcaacatgtttaccaggtaagcacagacccaccatctatagttttcagattcaagggagaagtggtgggtctggcgacaaagtgtggctttttgctcctgttctgcacttgccacagcatgggttttcatgctggcccccagagaaacatgtggttgctcactgtgtggctttctcctctgtagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgaggtaggggctcagacggtcccctgtgcagcaccccccatctccagattgggaagggaatgagatttcacagaaaatgtattgtgttttaaagttcatttgttagtttaatatgcttgtaaagtagtttctcccaaggaagaaggcctttagtggtgtggtacagtgtttttatattgattgagttcattggagctagtctagtgtaagcatggcagttattccacagggtcagttgctaagatcagtctcctgcggcaaattttatacctttaagagactctggttttctatagcaaacattctaacatatgtactttcctattagaaacattcatggtctcgaggatacaaggcaagttcttgaaaccattcaaacaaacctttcagtgttacaggaaagccctttgtccttcttagaaaataggcaggcactcagcataataagacccggaataagtatagatttaatttcagtttttttggtaatagtcgtataaataagagttaatctttaactgtctgaactgagactgggacaggtctggttgctgtgcattacgaaatgcactgggcctatgaggcttcttctgtggatgcttgtggcccctggtgtctatttaattttaatcaaggctgaactgaatatatgtgggccttctaattttgaattctgcagagacatttggaataagggattgggggagttggagtcaatgagaaaacactgctgagcctgacccttctcctctaactcctctcagaatcctggctactgggaaagaggagactggcccagagagcctggctcccaagtgttctttaaaccctccccttctggggagcagaatcgctttaaggcgttgggtctgtctttagcctccgtggttgtgtaagaccaacaggttagtgggacagcattttttatcctgggaaaaggaacaagcaagaagatctgacaggtcgaatagaacaggaaatccatactcctaattgttcatccacttggtagcttttttctagtgtaaaagctgagtgctcatcagaaaaaggggcccttggcactgacccgtgcattctctctcaaatgtgggccatgtctctcctgaagaactcgcggtgtgaaccgccaactccaggggctagatgtcttttgcacaggcagtgacaggactccaggggctggatgtcttttgcgcaggtagtgacaggcatgtggatggagtgttgacactcggcttgctgtcacgaggcgtctcctaggcatctttgctgccctgggcccaggccggagcagctccgcaagctgcaggtctgagcgtctgtgtgtctttgcagcgtccctcccctgatgtgaaggccgagctgtttgagctccttttccggacgctccatcacaactggaggtacttcttcaagtccaccgtgctggccagtgtccagagggggatcgctgaggagcagatggagaatgagccccagttcagtgccatcatgcaggtaacgtgggggcggggttgctgccaggtgacttcctctaacctgaccactgcagcgagtcctgtcttcgaagccccacagtctcgggtctgaagctcagttctgcctgttagtattgatgaagttaattaatttcttggagcctcagtttcttcatctgcaaagtggagctaatgttgcctgggtcacaggtttgttgtgaggttaaatgagatgacatacacaaagtgcatgacacttggagatgcttgataaacgtcagttccgctgacctcatagtgctgtttccccaagtgtaaagagcctgcctatgccagagtcaccgagggccttcttagcggggagctgcctgaatatgagtctccgcaggagggccccagacctgcactgtgattctgactctgaccatactgggagaaacactgccctgggagggagcattcgctttcagggcagatgcagctgtccattggagagagtgcactgtctgggggctaaataccccttgctgtggaagactgggacggcatcacctcgcccagacagccagcctgctctgtggctgtgtcaggcacgctcccagggtctgcactcaagtgtctgacgttctcatctgagtctagctaggggagtctcttttggtattttcagtgcatgcttttcctcatggggaagcaagagggatttccaccctccctccagctccctactagcacacagcatgcacacaggcatgcacgtgcgcatgcgcgcgcacacacacacatactgactcttgtgtggcagttcttttcaggcacgtgcccttgccctggccttcccatccctggcacccaccgaggcctcaggtctgcagtactcaagtgtttgcgcctcccctgcctttctcttgaaccctgtccttgcctggaagacttctttggcacgctggtgcctggtccccactgagggctggtgaaaggcactttggagaatagtttcacagtttggcagtttcttttaaagttaagtgtgtagttactgtatgacctagcagtctcacttctaagtattttacccaagataaatgaaagcatatgttcacacaacctgtacactgatgtttatagaagctgtttcataattgccaaagctggaaacactttgagtatccagcagctgaatggatgaacaggctcgtgcatgcctctaagggactggcactcggcaataagcaagcatggattcttggtacaatcagcagcatagatgagtttcacatgcattctgtcaggtgaaagaagctagatgccaaaggctatgcatggtaggatcccatgccattctatgacattctggaaaaggtagaaccacagggacagataatgagcagtggttgccttaggggtgagggtgtgaggggacgttccaggtgatggaagtgtcctgtcttggttgtgatggtggtggtacaaatccacaggtaggtcagaattcatagaaagataaacctcaaaagtttactctgttatacttccatgaacctaactttaaacagtaaataagtggaaactattggtcatcatggagatctcatccctgctgcagggattacaagatcctcctctggtagcttaggggcccagggacagaatgacaaagcagtcaccacttgttttgtaggggggtcctgcagaccaccggcctccccgactgcccccatggtcactttctattctttctgttggagcagggcactttgtgttggtgtgcggggtgtttctttttgcccctgaactagtaatttttttcttttttctttttttgagataagtcttgctctgttgcctaggctggagtgcagtgagtggtaggatctcagcttactgcaatctctgcctcctggattgaagtgattctcctgcctcagcctcccgagtagctgtgattacaggcgtccgccaccacgcctggctaatttttgtatttttagtagagatggggttttaccgtgttggccaggctggtcttgaactcccacccttcagtgatccgcccacctcggcttcccaaagtgctgggattacaggactgagcttctgtgcctggactgaactagtaacttttacacccaggaattccaaagcagtttaaaaatactttgcttagcccccaggcagaggcttaacctccaggtggaggctccatgaaggagcctgtagggcttgtggcttttgagacgggggatgcaagaaggagggcaagggaggggattgcttggcttgagcaggagcaggcaggcaggctttggtgtctgtctgccaggattgctgagggatttgactagaggtgtgagcttcttgcttcaaagccaggtcctgtgatgggtttctagaggtttgttaaaaaaggtatatatgagaccataataagaagcaaggcccggtggggaaaacatgaactctgagacttaggaggagcgtcgtagaggtctgagctggtgggccagaagcatcaagacaatgggtaccctggccctggcacttgttcttctgacatggggtagatgctccagaagtgcttggtcttgcagtttataaaatggtggtctcatttcctaggctttcggacagtcctttctccagcccgacatccacctttttaaacaaaatctcttctacttggagactctcaacaccaagcagaagctgtaccacaaggtaagtgccccagctcttggaaatattcttccatcaggggcattgtggcctgtgtcccaccctcaggttactcactggagagtgtgacagaaagtggatgggacccgggacaggcccctgggggctggctgctgctcacctggtctctctgcctgcagaagatcttccggactgccatgctgttccagtttgtgaacgtgctgctccaggtcctggtccacaagtcccatgatcttctgcaggaggagattggcatcgccatctacaacatggcctcagtcgactttgatggcttctttgccgccttcctcccagagttcctgaccagctgtgatggtgtggatgccaaccagaaaagtgtgctggggcggaatttcaagatggatcgggtgaggagagaaagaggccgggctaagaggagggcagagtgggcacgcaagcctggcacctgtgcagcaaggagggggcacattgaggcctctgggcgtggtctgtgcccaccctgcagcttggcggcagctcacgagatgcctgctgacctggtgctgtagcctgattgaggggcacagccttttccccagtcttggtgtctgtagcacgtatgttcttagtctcagccatggaggtcccgagttcctggctctgcagcccctccatttgtcttggcatctttgttcatacccaggaccctgccgttctccctcctgggtgatgagccccggtggggccagcattggagtgtgcccaggcttgcattcaggctgagatggttggtgcttgggagctgcacttctgggtccccagggttagaggtgggacccaggttccccggctgtcttgggctctttccagaccagccccagctcagcttgggctgagttgctgccaggtcctgggaggagccctcctagtactcaccctcttgtcccactgctgccacctgtgcagggactgtcaggtgggctgtccccacccgtgcagcacctcggtgggagctgggtgctgctggctcttggtgtccatgaggccatcttgttggagcctgacagtgcctgggacctccttccccatggggctcacctgttctcttcttcctgtgtcaggtgaccaggcctctctcttgcctgataggaacttctgggaacttttccttgtaccgttttatacttgatgaaattaggaaaagaaatcgctttctccctggtcctcttggggttcttgacctgagtcctctgtgaagcagcttgtccacggctccaccgtagtgctcagatgcacacactgctctcactggtgcaaacctggccgcctgctttcctcatttgccacgtgtggcagggaagcttttgcttagactcatcctgttctcctttgtcttggggtcttccttttcttgggacttgttctctcctaagcctcttccagttcacttcagcccctggatatgttttttcctttttctagaggccagatcctaatacttaatgatcagcttctaacgacatcaatatcagtcaactttttgatttaaagctgtggtttcaaaatctagttataggccaggcgcggtgtctcacacctgtaatctcagcactttgggaggccaaggcgggcggatcacttgaggttagggggtttgagaccagcctggccaacatggcgaaaccctgtctctactaaaaataaaaaaaattagtcaggtgtggtggcacacgcctgtaatcccagctgcttgggaggctgaggcacaagaatctcttgaacccgggaggcagaggttgcagtgagcggaggttgtgccactgcactccagcctgggcggcagagtgggactttgtctcaaaaaaaaaaatctagttatatcagaagcacctggggtacttattaaaaatggagaaacagacttctgtgttctacccaggaaattctggtttggcatttgggagccactgatttaaaagacatcccttagttggttttttgagggtaaaataaaagaatcaccaccttccattcagtcacgcactgtgtgtttgaagccagctgcttctcaagccccgggccaggaactggggcaccagtcccagccttcaccaagtctttcatggtagacaggccaatacagcaccctctgtggaccacatagtgccaagcatgtgacatgtcttggctcgagtaagccttctaacaagcctctgaagtgtgggtcctgttactcccccatttcacagatggtgggggctcagaaggtgagcagttcacagaacttggaagtggtagagctgcgaagcaggaggcagacctgggtgttctggccccagagcctgcacacactccccagaagcagattgctcaggacagaggcgctgagctggctgctggggccaggaaataggaggcatctgtgcagactttgggaagaggcaggctttgaatggagttctggaagaggaatagtggttgggcaggaaaatgaacttggtcctgctcatggctctgctggggcttgctgggcctgtttgagtcctcaccgggacctacactgaaaaaaaaagcagggtctcaccgtgtgcatgatggcggaggtcagggcctcacttctggcccagggccttccatggcccacgctgcgcccagtgggacaggccttgggactgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggactcaggagcaagtgtgctggtctcttcagtgtgagctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctag

SEQ ID NO: 37589 - DNA, 11023 bp, Homo sapiens; identical to SEQ ID NO: 37272

SEQ ID NO: 37590 - DNA, 11023 bp, Homo sapiens; identical to SEQ ID NO: 37272

SEQ ID NO: 37591 - DNA, 113319 bp, Homo sapiens
agacccgcccgcccgagccggagttacaagagccgcctccgcgcacgggggcccggccactcggagctgctctgccgcggggactgcaccgcccgccctgccagacccgcccggaacggggctcgtcgccgccagtagccgcagcaccgcagccttgggcctcgcgccggctatggccgtgccctggggctgagccctcaggtaggggcgccaggcgcaccgtggcgccatcggggtccggggcaccaagggcgggtcgcggggaggtgggttgcggtgctccggcagggcgcgttgttgggggtgtcactgtgaggattcaagcagtttggagcaagcggggccacccggggcggcgacgcgtcgctctctgggagcggagttctgcctctggagttggggcgcaagttggttaaagttggaaaatcgctccgaagtgctttgctccactctttatttctccggagggcggactgttggctccactgcaaggcagggcgccccgttccgggcctggtggcctctgtcccacctcctctccctgcatggggcggtggctcgggggctgctccgttcgtatcccatgtttactggaggggaaatttccgagatcgccaccgcggcccccagcgcctccgcgcctccgcgaccccgcaccgtgcgccccctcggctgtccttccgcgctccctgcacctctgcccctaaccgcgtcccgagtcgtccaggccccaccctgttctgtaccaccagcccctcagcctcctccagctgccccgccctagccttgcctctccgcgttccccgctccagaaaaccttcctctcgggccgcggaacctggaagtttgcaatgcgcctcccagcgggatgggtggggagggggacaaaattagggagattcctatgctgaggtgggcgaggaggggggtgcgctgcggcggcccagtcctcgggaccgccccttcccctccggaggcggcgctttccccccgcccaactcccaaacccgtccgggcgggatggcccccgccccagagcctggcccggcgccagcagcctgaggaatgtggtggttggagccggtgactaattcaaaccagaactcagggaggagtggtgaggggcaaaggggaggaggaaggggctgtgtgtgggagttgggggcaggagccgggcttggcgtgggaggagggctaagctgcgctcgctggaaccctgcgctccagcggtgcgcgccaggagagggggcccgaagcgaggtctcgcctagagttggaaaggcagcgtgcttagggtgtgtgcagagctgtgttatgtaaggctttcccatgcaaggggagggggtgtgtgtgtgcagtgtgcgagggcctgggccgtccctggcagggctggtcgccccccagcagtgcccaggccgggatgtgggggcgcagccccttggcggcgctgaccatgagggactccaggggcccaaacagggctggctgtgccccttgctgggaggggtgcggagggggcagatgggtgttctcagctgtagccgaggccccacaacaaggtggggaacggctctggcccctctgcacaatgaggccactgagggttgtgtgcgatgtgtgtgcttgccggtttcgcagggtgtggctcccgccgcggcgaccgtggcagtgaggtgctcccagggagcgtgcggtcgctgcagagtgccctgctctgtggaggggatttgtggaaaggcagtgtgggagcctcccaagtcagtcaggtccttagacctccggagtctccggaggaaaagggaccgagatatctacctctgtgtctccagcacagcgctgggcgctcagtaaatactggtttcgaacccgtcttcattagaatccaacctcggattgcagggctcctgctctctgcttgcccgtcccagcacagcctagtgcatggtaggtgttgggttgattttgtggaatacagtgaggggctgcagcagtgaagctgagagtgggggaaggcgtttaagggcccctgcacctatactggctgtaattcagggtagagatctcgctttcatcccctccccgtgagggaaatcccaggggcagggtgtggcactcacttcctttcagaagctgaatggggggaagcttccttctccagtccttagggacagcggggtcacccaccccccaccgcgtggatagtggcctgtgcagaatggggaggacaggggagcccccaagttaggggcacctctttgctctgagctgtgagctttggggtgagggagggtgggagaggagctagggagggtaagagtggagctaggagaggtcgcagggtttgggggctgtgggaatgtgggttagagggtgtctgagcccctctctaaagcctttgtccctaagaggttatgcacagggacactggtcagagaacagggacacatggggagccacataagtcatgcgggctgatatggaggcccacagcagcgattcaggggtcctggtccgggaactccttgaggagccaacccctcggagctgaggacttgtggcagccagacatggtccagggccaggggtgggacacagggacctgttgagggagaaggtccagcgtcagcccagggtacggagttggctgggggtccccggagtcatcttagccctcaggaagtcctggggaaaggtggcggtgctgccaggctggattcttttgctcgacttggaattggctggtgggtcctggcagagccggtcaccctgagcctgaggagctggtttgaggggttggggcaaagccgtgggggcggaggggtgtgtggggctctggggtgtggtcaccaccttctttagaacttgggaactgcctggagacagacagagagacagaccgggagagctagtcctactccttatgggaacagtgtggctctctcccccaccattcccgaggccccaaagtttctctccccggagctgggctggcaccgtgctgtgcacgcttaggtttgaggaagggtgatggccgctggggaggatttagaatgtgctgcttgggcggtggcagtggcagggatggagggccttctgacttctcttcgtcccccatcgattcatccaggctggcatttccctgggctcaggccatccggtgggactcccaaggcttcctgagcacgagcaatttccagcgttcctgggtgtgcccgagggagtgtggggggcacgtgggtgggccacaagaggattccgaaggaatgaagccccttttcctccctgctggcctcagttcccaccagggctgtggctgagctgtcgctggcagtcttaggtaggtcactgatagcattgcaggtgtcgtcccactgtggctttaggtccttgtgaccaccatgtcacagcttgtctctgagtgagatgtgtgtcattgcctgtgagagagtatcccactggttgtgaatgaaggtcttccccttgtggcgtgcctggatgtgtcacctctgcctgcgttgtcatcgggcttggaggcagaggatggcagtggcattctgctctggtggtggaggtttcctgcgggcccgtaggggttgtaggtaaggactgaagtgagtttctcggtcctggacatgtccgcacgcgcagtttgtgtccagaagcctttgggaggttgaggacagccttgggggtgcaggccccagctgagcaggctaagcaaggcactgcacacggcctgtcagggaggggcatcctgcccggtcccccgggggctggagcggaggttctgggggaaggggaagtgcctggagctgatcccgtctacagctacgtgtcctggcggggctcgggggtagctcttcagcgacagagccggagcggcctggccccacgcccctgcagtagcgtggtccgaccgctggggggagagcaagcagcgccctccccagatcccggccttgggtggggcagacaggcagcttccaaactgtaatctaccccacagggcaagaccaagcgttctgctccaccccctctcctataggacgccaccctcagagttggtgtcttaatcccagtggttctgggtaaaggcccactcttccctgcttctgtgtccaggtgtggggactccccactggatcataggctgtccccagccccctttcacaaggattgcagagtccctcctggccagggagggaagagggaatctccctcgctgctggaagtgagagcttggagcttcagggcttccaagctcactgtagcatgggatggggctgtgcgtggctggggtagagagagatggagaaaggcgtcacagcagagtcagaaagcaaccagctggctgaggttggggtgtaagggctgccctggaagtcagcatgatgtgaggggccaggggaagggggtgatggggaggggagggctggaatgacaaggatggaaaaacttcctcctggtgggagttgtggctgggctggcgcctccctctcctaagggcagggagcagggaggaggccaggcaggtgcacacacacaaggggaggtgcaggctcaagggacacaggtgccaggtaaacaggcatagggacctgcaggacaactgtctattgtgagccggtgaaggctggctggggctgcaggctgccctgggctgtgtagagtggagaatggggctgagggtctccgtgtactaatggtgtgtatgtgtgtgtgtgtgcttgtgtgcctttctttgaaggtgcccaagttgcatgtgttttgcaacatgttcatctaattcttcctggtaattccacctccctaacctgcccctcctccctgcacactgcccagaatcagctaggtgggtttgtaaaagttgttaatgccagcttagactctgagatgtctgcgcacttctgctccggttagaatgtggcataatgttttttcctaaacaagcctggcagctgcatcctcgggggtccattcagagggccaggccctggaagggatgtcacccttgttcctttggaacaagggccttgggggtcagagactcctgggcttgcatttcaactctgtctcacacttgggcaagtcatcttatctcttgggcctgctttcacttctctgaaataaggatattaattcttttgacatagcatcatcatttgggagttgaatgagaccccaggcatgggatgttgccaacacagtccctggcacatcagagcgctctgcagaattctctttctacttgtgtgtggggtttttttttctttcaacatggaactttctgttcctctttgcctcctgttgagtgtttatgagagcagaccatactgtcttctgggtgtgtctctctgaatagcctccctctcctcctggttccgaatgttgggggcttcccctctggtaggggtctctaactctgggcatgagtcattttgttcctgggatgaggactgcttctctttggccttgtgtgtgtggtgggtcgattggcctatgtgcgtgctgccatgctgggcggaagtttcactgtggccggtaccctccctaccacggatggggtgattttcttcccctcggagggttgcctcctgtgtcccgcctgtgctgggtggatgcacagtcatgggcccctgtggtgtgtatcttgtcctcaggtttggtgcatttgggcactgaggcctgtggcctgtctctgggggagtgtgtgtttcaattcctgtcatctccacactgacgctggctgcagggctgtctctagctgctgcagcagttggcccggtttccatcctggctgtctttatactggctcctccggggaaggggcactgttctccgagggcagtggaggaaggaggctcctctggaggtcacccctggcagaggccatctgctggggtcaagaatctgcttcctggagttctgcgtctacttggcgttgtccccagttgcagggtatgggcagagccctgctgctcggcacatcctctttgcagttttgaagtgacaggatgggctgttctcttgctgcttctggcctgaattacagtctgtcccgcagcgtcaggcatacgtgctctcacctttgcagctggagcggcctcgccatctcattcttttctgccctccaagcagtcttctgccttagggggtctccactctggccctgctccttctttttttatttaaaaaaaatacatttttattttttatagagatagggttttgccatgttgcccaggctggtctcaaactcctgggttcaagcgatcagtgtgtcttggcctcccaaagttctgggattacaggcatgagccaccacgcctagctctgtcccgcttcttgctatcacgagggaggctgttgggtggaccaccgggctgtgtgctagcaggctctgggactagggtcccagcacactcccattctctcacctctctggaccttactttctccatccttaagtaacaggcagtgccatcccataaaactctcggcagtgggggaagtgttctgtgtccacgctaatatagtagccagtagctacatgtggctgttgagctcttgaaatgtggctagtgcagccaaagctaaaattttaatttaactgaattttaattgattaagtttaaatagccacatgtggctgctgcgttgggtggcacaactctaggtctctcctagctctgaaggcttatggcacttggctgaatcgtgcagaattccccaaagctccaaagaccttcttttggctagcaacagggcagagccctcagcctccagggaaagcctgacttaacctaacttgtgtgggaggagaagaaaggaccacttgggcttgatacaggctccagaggtggaggagagactgagggctgggacccaaatgcagagaatgggaaacctggctacacagtatcccacgcccctccttcagtattcccttcagtatttccatgcccttccgcggaactgaatggcccaggtcagatgagaggggagtccttccaggctgtgccaggacagcagggccacagccagagcaggcagggtggttggcagccccacctggccgggaagccactgggtgccctgccagggccaacctgcagcttcgggtccaatggctcccgtcctcacgggctattggatcggtgtctacttaggatggtttctcccctcctcaggaaccacgtaggttgcatctgtcctgggcctcaaaagggacttctgccctgggactctgcctgaggccctggcagggaagccaactgcctgtctgcagggcagccctggttcctctggcacctgggggtctggcccaggaggcactttgtccttggggttttaggctcaaccctttgcaggtctggagctgttgcagccagctgcagtgactcactggggcgggagggtggggccgaggtgtgggcgagggtgagctggcccagctagctctttccccctcgctggctgctggcacagcaccaggatgctggggtgagcaaaggggccctgctccaggaggaggacaggggtgtctgggcgatctgaaggagtggcttcagttctgtctgagagatgaagtctggaatctgttttccttccctgcctctgcctggctgcttttctgcagggctggctcctgagcactggacagtgggagagaatgtgccatttaagccccagctttgctgtttcttgctgggaagggtcagagtgatttcctgtcgcagccttctctgcagccggaagggaggaggtgttttcgccagtttgcacctgagcccagaggctcagagtctttgctcaccttgtagccagcacctgtgttgacaaggagacacattgtccacaccgcgttgtcaaacaggaggatggctgtcgggggctggggtctgtgtttctctttcatccgtgttgtgatctgcctgagataggaactgctaagtgcccacgaattcccaagagacatagtctcatcctcagaggtcacctgtagcaccttcaagaccccatgtatatttcatttcccctagaaggctcccaagccttctggaatattctgcggcaaaatcggtcacagctagtgcactttgctcatcatatgtatctgtgacaggaactgagtcttaaatctccctgtctggcacatgggtgcgtgagtgatgtgaggtcaccgtctaacgcagcgtgtaattaggtgctgggcccagctgtgtccatccctggctggttccgtctgtagtgcaaagtatagtgttgggcatatggaggcagccggtatacatgcattgattgactgttgatactttccggatgtaaacggctgtaggcggggctttggcttaggttccccatgacttatagtgtcccccacaccatttcaattggtggctgctgccgccattttgtgctgtggctgtagtccgtggccctatgcagagtcctgcctggtgtctttctagggcacctgcagatgacagctcaccttgtggctggagggcgaatttattactaaatgcttgcacctataagggcctggctcagggcctggtgtggcagccgggaggcctgaactcactgtgggccaaggtgggctcagctgggctctaacctctggggcttgggcggtgcctggtggggccggggcctcctttgttcaggcagctgcctgtggcagggctcccagagctgccagctggtgaggcacccccctggtcctgggtactgggtgagactgggtggcccaagtctctgtctctgagggaggtggaacactgacattcctgcttggaggcagactctgaggaggctcccacctgttacaagcagcagacctggggtggagtaggcaaaagacttacagactcggtcggccgggtgcggtggtcacgcccgtaatcccagcactttgggaggccaaggcgggtggatcacagggtcaggagttcaagacaagcctggctaagatggtgaaaccccatctctactaaaaatacaaaaaattagccgggcatggtggcgggcgcctgtaatcccagctactcgggaggctgaggcaggagaattgcttgaacctgggagggggaggttgcagtgagctgagatcgtgccattgcacaccagcctgggctacaaagtgagattccgtctcaaaaaaaaaaaaaaggagttacagactcgggtccaagcccagcatagttgtgctctcatgtgtaccccgggtaagctgttctctcagagactcagtctctgtctgtgaaattggcacagtaacatctccctcttgaagctgtggttgagaatgtgggtagatgctgggcgtggtggctcctgcttatagtcccagcactttgggattgtttgagcccaggagttccggaccagcctgggcaacatggcaaaaccccatctctccaaaaatacaaaaattagccagttgtggaggcacgtggctgtggtccgagctacttgggtgggtgaggcaggaggatcacttgagcccaggaggtcgaggctgcagtgagtcgtgattgcgcccctgcactccagcctgtgtgacagagccagaccctgtctcaaaaaaataaaaagaggccaggtgcggtggctcacgcctgtaatcccagcactttgggaggccgaggcgggcggatcatgcggtcaggagatcgagatcatcctggctaacacagtgaaaccccatctctactaaaaatacaaaaaattagccgggtgtggtgcatggtggcgggcgcctgtagtcccagctactcgggaggctgaggcaggagactggcgtgaacccgggaggtggagcttgcagcgagccgagatccgctattgcactccagcctgggcaacagaacgagactctgtctcaaaaaaaaaaaaataaataaaataaataaaatacataaataaaaagaatgtggcaagagtgtgcatgtgaagcggctcctgccggccagtgctctattttttctcctttattgcctccattttcacagatgaggaaatggaggttcagaaaactgaagtgtcttggccagggtcccacagctagaaggaggcagagccaggatctgactgcaagtctggctcctctgaagcccctttctgctatgccgggctggagagtcatggacgagtggaattgacggcggtggtgggggtcgggttctgagctggcctgggtagcagaggacctggctatcccttgggtagagacttggagcaagcagactgccgaccggagtgcgagcatcatcgtgaacttttccctaggttgtgaccgagattcccgacgagagagactgaggggaagagaggaaggaggggcgggctcctggcaaggcattcgctcctgagcggaatcctgcaaaggtcagtaggtgggagaggcagagagaggcggaggtgacgggatgtggggagggtgggccctgtgtggatgggaggctggggccgtgggggacagggatgaagggccagctacctccgggtccagttgcctctgctgtctcctttccatcttctttgctgtgccttgggagaacttccacagtggaaggacgtgagacgaattaccccacccccaacacctcacctggcaggtgagccagctgcaggggcaggtgcattgctgagggccccactccctggagttcacagcgccagagattgctagctttcccatgccctcatgtcctcccacccccactgaccccagttccatttcctcacctcattccagatggagaaggaggagacaacccgggagctgctgctgcccaactggcagggtagtggctcccacgggctgaccatcgcccagagggacgacggcgtctttgtgcaggaggtgacgcagaactcccctgcggcccgcactggggtggtcaaggagggtgagtcaccccagggtgtggactgggtgctggtggttggggggtcggtgggggtgttggagggaagggcagggagcaggcagaagtgggtgagtggctgtcgagggcccattcccagtggcatcagggtggttggtacccaagccctgccctcccttggccactctgtgtctgtcacttgtggtcctcaggggaggcagctgtgtggggtagtggacacctggtcctcagatctgactccaccacccactagctctgcagatttgggcaaatgagttggcctttttttttttttttagatggagttttgttcttgttgcccaggctggagtgcaatggcgctatctcagctcactgcaacctccgcctcctgggttcaagcgattcttatgcctcagcttccagggtagctgggattacaggcatgcaccaccacaccagactaattttgcatttttagtagagacggggtttttctatgttggtcaggctggtctcgaactcctgacctcaggcgatccacctgcctcggtctcccaaagtgctgagattacaggtgtgagccactgcacctggcccccacaaattggcctttctaagcctcagtttccgtgtctgtacaatgggtattaccatgcccaccttgcagggtggtcatgagttcaagtcagttcagtgcccagtgtgtggtggctgtgtgcggtttccctgaggctctttgggccttacctgcttcctgctcttccctgctcaggggaccagattgtgggtgccaccatctactttgacaacctgcagtcgggtgaggtgacccagctgctgaacaccatggggcaccacacggtgggcctgaagctgcaccgcaagggggaccgctctcccgagcctggccagacctggacccgtgaagtcttcagctcctgcagctctgaagtggttctggtgagtacctcgccggcccatctgtgccctgagctcccccggccatgccggcctgctgaccccactcctgagccttccatgtgcctccggaccctctctttttgctccttcttctcctctcacctgtcttcactctcttgagcccttggccaccctgtttctttccgctttcgtgtgacatgtggctgtgctccctctaaatgtcttcaatcagtctcttcagagcggccacagtatgggaactgacttgtgcagcccggccctagatgctaggaggaaggtcagctgctttgcaagaatctttgaaatgacttcacaggtgcccagctccacctcacagacaccatttttctctctgcagaggcctgatacattctgtgggtcagacgctgggcagcaaagtgcctgtggggacattggtccttctgatggcttgtttatttaacaaataatgggtcctcaaagtgagactgttaacccaagcacaaccagtctcttaggctcaacgagtgctttcagggtccaagggcctctgagaagattcccctcctgattaaacaaacaagccagtggcttgagagttgggagctgaagggcctggtctcttgggaggtgtccctggcacaggctgatttgaatctctaactgaatggaaatcctcccagtccaagagtatacctcccactccctccccacggtttttgcttagcggtatgacctccagagaatttctgatttcctcctgtgatgtggctgtcagcccctttcttcactcccctgtgctgtgccccaggaggctccatggacctctgttttggtcccagcttctctgggaaacaggcaacgtgttgtcggctgggctgtggccgggcatctgctaactcaggcagactctgctgcaacctctgcccggcgtgtctttctgcagagcggggatgatgaggagtaccagcgcatctacaccacgaagatcaagccacggctgaagtcggaagatggagtggaaggagacctcggggagacccagagccgtaccatcacagtgaccagaagggtcacggcctacactgtggatgtgactggccgggaaggagccaaggacatagacatcagtagccctgaattcaagatcaagattccaagacatgaactgactgaaatctccaatgtggatgtggagacccagtctgggaagaccgtgatcagactgccctcgggctcgggggcagcctctccgacaggctctgctgtggatatccgagcaggggccatttctgcttcaggaccagagctccaaggtgctggccactcgaagctccaggtcaccatgcctgggataaaggtgggaggctcaggtgtcaatgtcaatgcaaagggcttggacttgggtggcagaggaggggtccaagttccagcagtggacatttcatcttctcttgggggtagggcagtagaggtacagggcccatctctggagagtggtgatcatggcaaaattaaatttcccaccatgaaagtgccgaaatttggtgtctcaacagggcgtgagggccagacaccaaaggcagggctgagggtttctgcacctgaagtctctgtggggcacaagggcggcaagccaggcttgactatccaagcccctcagctggaagtcagtgtgccctctgccaatattgagggccttgaggggaagctgaagggcccccaaatcactgggccatcacttgagggtgacctaggcctgaaaggtgccaagccacaggggcacattggggtggatgcctctgctccccaaattgggggtagcatcactggccccagtgtggaagttcaggcccctgacattgatgttcaggggcctgggagcaaactgaatgtgcccaagatgaaagtccccaagttctctgtatcaggtgcaaagggagaggaaactgggattgatgtgacactgcctacaggtgaagtgactgttcctggggtctctggggatgtcagcctgcctgagattgctactggtgggctggaaggaaagatgaaaggtactaaagtgaagactcctgaaatgattattcagaaacctaaaatctccatgcaggatgtggatctgagccttgggtctcctaaactgaaaggagatattaaggtttctgctcctggggtgcaaggtgatgttaaaggccctcaagtggcacttaaaggctccagagtggacatagagacaccaaacctagagggaaccttgacaggccctaggcttggcagtccttccgggaaaaccggaacctgtaggatctctatgtcagaagtagacttaaatgtggccgcacctaaagtgaaagggggtgtagatgtcacactccccagagtagaagggaaagtcaaagtccctgaagttgatgtcagaggccccaaagtggatgtcagtgccccagatgtcgaagcgcatggcccagaatggaacctgaaaatgcccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtgaatattgaaggacctgaaggaaagctgaagggccccaagttcaagatgccagagatgaatatcaaggcccccaagatctccatgcctgatgtggacttgcatatgaaaggtcctaaagtaaagggagaatatgatatgacagtgccaaagctggaaggggacctgaaaggcccaaaagtagatgtcagtgccccagatgttgaaatgcagggtcctgactggaacttgaagatgccaaagattaaaatgcccaaatttagcatgcccagcctcaaaggagaggggccagaatttgatgtgaacctgtccaaagcgaatgtggacatttctgcaccaaaagtagatactaatgctccagatctgagccttgaaggacctgaagggaagttgaaaggcccgaagtttaagatgcctgagatgcacttcagagctcctaagatgtctttgccagatgttgacctggatcttaaaggacccaaaatgaaaggaaatgtagatatctctgcaccaaagatagagggtgaaatgcaggttccagatgtggacatcagaggtcccaaggtagatattaaagcaccagatgtggaaggccaaggcctggactggagcctgaaaatacccaagatgaaaatgcccaagttcagcatgcccagcctcaaaggcgagggcccagaagtggatgtgaacttgcctaaggctgacgttgttgtctcaggacccaaggtggacatcgaagccccagatgtgagcctcgaaggtccagaagggaagctgaagggtcccaagtttaagatgcctgagatgcatttcaagacccccaagatctccatgcctgatgtggacttacacttgaaaggccccaaagtcaaaggggatgtggatgtgtctgtgcccaaggtagaaggtgaaatgaaagtgccagatgttgaaatcaaaggacccaaaatggacattgatgccccagatgtggaggttcaaggcccagactggcacctgaagatgcccaagatgaaaatgcccaagtttagcatgcctggcttcaaaggagagggccgagaagtggatgtgaacctgcccaaggctgacattgatgtctcaggacccaaggtggatgttgaagtcccagatgtgagccttgagggcccggaaggaaagctgaagggccccaagtttaagatgcctgagatgcacttcaaggcccccaagatctccatgcctgatgtggacctgaatcttaaggggccaaaattgaagggagatgtggatgtgtccttgcctgaggtagaaggtgaaatgaaagtgccagatgttgacattaaagggcccaaagttgacattagtgctccagatgtggatgttcatggcccagattggcacctgaagatgcccaaggtgaaaatgcccaagttcagcatgcccggcttcaaaggagagggccctgaagtggatgtgaagctgcccaaagctgacgttgatgtctcaggacccaaaatggatgctgaagttccagatgtgaatattgaaggtccagacgcaaaactaaaaggtcccaaattcaagatgccagaaatgagtataaagcctcagaagatatccataccagatgttggtttgcatttgaaaggtcctaaaatgaaaggagattatgatgtaacagttccaaaagtagaaggagagataaaagctcctgatgttgacatcaaaggccccaaagttgatattaatgcaccagatgtggaggttcatggcccagactggcacctgaagatgcccaaggtaaaaatgcccaagttcagcatgcctggctttaaaggagagggcccagaggtggatatgaacctgcccaaggctgaccttggtgtttcaggacccaaggtggacattgatgttccagatgtgaatcttgaagctccagaggggaaactaaaaggccctaagttcaagatgccaagcatgaatatacagacgcacaaaatctctatgcctgatgttggacttaatttgaaagcccctaaactgaaaactgatgtagatgtttcccttcccaaagtggaaggagacttgaagggtcctgaaattgatgtgaaagcccctaagatggatgtgaatgttggtgatattgatattgaaggtccagaagggaagttgaagggccccaagtttaagatgcctgagatgcatttcaaggcccccaagatctccatgcccgatgtggacttacacttgaaaggccccaaagtcaaaggggatatggatgtgtctgtgcccaaggtagaaggtgaaatgaaagtgccagatgttgacattaaagggcccaaagtggacattgatgccccagatgtggaggttcacgacccagattggcacctgaaaatgcccaagatgaaaatgcccaagttcagtatgcctggcttcaaagcagagggccctgaagtggatgtgaatctgccaaaggctgacattgatgtgtctggacccagtgtggacactgatgctcctgatttggatattgagggaccagaaggaaagttgaaaggctccaaatttaagatgcccaagttgaatataaaagctcccaaggtctccatgccagatgtggacttgaatttgaagggacccaaactgaagggagagatagatgcttctgtgccagaactggaaggtgatctcagagggccgcaagttgatgtcaaaggtccttttgtggaagcggaggtgcccgatgttgatctggagtgtcctgatgcaaagttgaaagggcccaagtttaagatgcctgagatgcacttcaaggcccccaagatctccatgcctgatgtggacttacacctgaaaggccccaaagtcaaaggggatgcggatgtgtcggtgccaaaattggagggagatttaacaggccccagtgtgggtgtggaggtgcctgatgttgagctggagtgtcctgatgcaaagttgaaaggccctaaatttaagatgccagacatgcacttcaaggcccccaagatctccatgcctgatgtggacttacacttgaaaggccccaaagtcaaaggggatgtggatgtgtcggtgccaaaattggagggagatttaacaggtcccagtgtgggtgtggaggtgcctgatgttgagctggagtgtcctgatgcaaagttgaaagggcccaagtttaagatgcctgagatgcacttcaagacccccaagatctccatgcctgatgtggacttacacctgaaaggccccaaagtcaaaggggatatggatgtgtctgtgcccaaggtagaaggtgaaatgaaagtgccagatgttgacatcaaaggacccaaaatggacattgatgccccagatgtggatgttcatggcccagactggcacctgaagatgcccaagatgaaaatgcccaagttcagcatgcctggcttcaaagcagagggcccagaagtggatgtgaacttgcccaaggctgatgttgttgtctcaggacccaaggtggatgttgaagtcccagatgtgagccttgaaggtccagaagggaagctgaagggccccaagcttaagatgcctgagatgcacttcaaggcccccaagatctccatgcctgatgtggacttacacttgaaaggccccaaagtcaaaggggatgtggatgtgtctttgccaaaattggagggagatttaacaggccccagtgtggatgtggaggtgcctgatgttgagctggagtgtcctgatgcaaagttgaaagggcccaagtttaagatgcctgagatgcacttcaagacccccaagatctccatgcctgatgtgaacttaaacttgaaaggccccaaagtcaaaggggatatggatgtgtctgttcccaaggtagaaggtgaaatgaaagtgccagatgttgacatcagagggcccaaagtggacattgatgccccagatgtggatgttcatggcccagactggcacctgaagatgcctaagatgaaaatgcccaagttcagcatgcctggcttcaaaggagagggcccagaagtggatgtgaacttgcccaaggctgacgttgatgtctcaggacccaaggtggatgttgaagtcccagatgtgagccttgaaggtccagaagggaagctgaagggccccaagtttaagatgcctgagatgcacttcaagacccccaagatctccatgcctgatgttgatttcaatttaaagggacccaaaatcaaaggagatgttgatgtttctgccccaaagctggagggagagttaaaaggtccagaattggatgtcaaaggtcccaaattagatgctgacatgccagaagtagctgtggaaggcccaaatggcaagtggaaaactcctaagttcaagatgccagatatgcactttaaagctcccaaaatctctatgccagacctcgatctacacttgaagagccccaaggcaaaaggagaggtggatgtagatgttcccaaattggaaggggaccttaaagggccacatgtggatgtcagtgggccagacattgacattgagggaccagagggcaaattgaaaggccctaagttcaagatgcctgatatgcatttcaaagcccccaatatttctatgcctgatgttgatctaaatctcaaaggacccaaaatcaagggggatgtggatgtgtctgtgcctgaggtagaaggtaaacttgaagtaccagatatgaacatcaggggccccaaagttgatgtaaatgcccccgatgtccaagctccagactggcacctgaagatgcccaagatgaaaatgcccaagttcagcatgcctggcttcaaagcagagggccctgaagtagacgtcaacttgcctaaggctgacgttgacatctcaggacccaaggtggacattgaaggccctgatgttaatattgaaggaccagagggaaagttgaaagggcctaagttaaagatgccagagatgaacatcaaagcccccaagatctccatgcctgactttgatttgcatctgaaaggtcccaaggtgaagggcgatgtggatgtttctctgcccaaagtggaaggtgacctcaagggccccgaagttgacatcaaggggcccaaagtggatattaatgccccagatgtgggtgttcaaggcccagactggcacctgaagatgcccaaggtgaaaatgccaaagttcagcatgcctggcttcaaaggagagggcccagatggggatgtgaagctgcccaaggctgacattgatgtctcaggacccaaagtggacattgaaggccctgatgttaacattgaaggaccagagggaaagttgaaagggcctaagttcaagatgccagagatgaatatcaaagcccccaagatctccatgcctgatattgacttaaacctgaaaggacccaaagtgaagggtgatgtggatgtttcccttcctaaagtggaaggtgacctcaagggcccagaagttgacatcaagggcccaaaagtggacattgacgcacctgatgttgatgttcatggcccagactggcacctaaagatgcccaagataaaaatgcccaagatcagcatgcctggcttcaaaggagaaggtccagatgtggacgtgaacctgcccaaggctgacattgatgtctcaggaccgaaagtggatgttgaatgtcccgatgtgaatatcgaaggacctgaaggaaagtggaaaagtccaaagtttaagatgccagagatgcattttaagactccaaagatatccatgccagatattgacctgaatctcacaggtccaaaaataaaaggagatgtggatgttacaggccctaaggtagagggagatctgaaaggtcctgaagttgacctcaaaggccccaaagtggacattgatgtcccagatgttaatgttcagggtccagactggcacctgaagatgcccaagatgaaaatgcccaagttcagcatgcctggcttcaaagcagagggccctgaagtggatgtgaacctgcccaaggctgacgttgatgtctcaggccccaaagtggacgttgaaggccctgatgttaacattgaaggaccagagggaaagttgaaagggcccaagttcaagatgccagagatgaatatcaaagcccccaagatccccatgcctgactttgatttgcatctgaaaggtcccaaggtgaagggcgatgtggatatttctctgcccaaagtggaaggtgacctcaagggccctgaagttgacatcaggggtccccaagtggacattgatgtcccggatgtgggcgttcaaggcccagactggcacctaaaaatgcccaaagtgaaaatgcccaaattcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaaaatgcctgagatgaacatcaaagcccccaagatctccatgcctgacattgatcttaacctgaaaggtcccaaagtgaagggtgacatggatgtgtctctgccaaaagtggaaggtgacatgaaagttcctgacgtggatattaaaggccccaaagtggatattaatgccccagatgtggatgttcaaggcccagactggcacctgaagatgcctaaaataaaaatgcccaagatcagcatgcctggcttcaaaggagaaggtccagaagtggacgtgaacctgcccaaggctgaccttgacgtctcaggacccaaggtggacgttgatgttccagatgtgaatattgaaggtccagatgcgaaactgaagggccctaaattcaagatgccagagatgaacatcaaagctcctaaaatatcaatgcctgatttggacctcaatcttaaaggccctaaaatgaaaggagaggtggatgtttcacttgcaaatgtagaaggtgatttgaaaggacctgctcttgacataaaaggcccaaagatagatgtagatgctccagatattgacattcatggcccagatgccaaattaaaaggtccaaaactgaagatgcctgacatgcatgtaaacatgcccaagatctccatgccagaaattgacttgaatttgaaaggctcaaagcttaagggagatgttgatgtctctgggcccaagttggaaggtgacattaaagctcccagtttggatataaagggcccagaagtggacgtttccggtcctaagcttaatatcgaaggcaagtcaaagaaatctcgttttaagcttcccaaatttaatttttcgggctctaaagttcagacacctgaagtggatgtcaaaggtaaaaagccagatattgacataacaggtccaaaagttgatattaatgctcctgatgtcgaggtccaaggaaaagtgaaaggatccaagtttaaaatgcctttcctgagtatttcatctcccaaagtttctatgcctgacgtggagctaaatttgaaaagtcccaaagtcaaaggagacttagatattgcaggtcccaatttagaaggtgactttaaaggccccaaagtggatattaaggcaccagaagtcaatcttaatgcacctgatgtggatgttcatggtccagactggaatctgaaaatgcccaagatgaaaatgcccaaattcagtgtgtctggcttaaaagcagaagggccagatgtagctgtggatctaccaaaaggagacatcaacatagagggcccaagtatgaacattgagggcccagatctcaatgtggaaggtccggagggaggcttgaaaggtcccaaattcaagatgcctgacatgaatatcaaagctcccaagatctccatgcctgacattgacttaaacttgaaaggccccaaggtgaaaggtgatgtggatatttctcttcccaaacttgaaggggatctgaaagggccagaggttgatatcaaaggccctaaagtggacatcaatgccccagatgtggatgttcatggtccagactggcatctgaagatgcccaaagtgaaaatgcccaagttcagcatgcctggcttcaaaggagaaggccctgaagtcgatgttaccctccctaaagctgacattgacatttctggtcccaatgtagacgttgatgttccagacgtgaatattgaaggtccagatgcaaagctgaagggccccaagttcaagatgcctgagatgaacatcaaagcccccaagatctccatgcctgactttgacctgaacttgaagggacccaaaatgaagggtgatgtggttgtgtctttgcccaaagtggaaggtgatctaaaaggccctgaggtggacatcaagggccccaaagtggacattgacactcctgacattaacatcgaaggctcagagggtaaattcaagggacccaaatttaagataccagagatgcacctgaaggctcccaaaatatcgatgcctgacattgatttaaacctgaagggccccaaagtcaagggcgatgtggatgtttctctgcccaaaatggaaggtgacctcaagggtcctgaagttgacatcaagggccccaaagtggacattaatgctccagatgttgatgttcaaggcccagactggcacctgaagatgcccaaggtgaaaatgcccaagttcagcatgcctggcttcaaaggagagggcccagatgtggatgtgaacctgcccaaggctgaccttgatgtctcaggacccaaggtggacattgatgttccagatgtgaatatcgaaggcccagagggaaagttgaaaggtcccaaattcaagatgcctgagatgaacatcaaagcccccaagatctccatgcctgacattgatcttaacctgaaaggacccaaagtgaagggtgatatggatgtgtctctgccaaaagtggaaggtgacatgcaagttcctgacttggatattaaaggccccaaagtggatattaatgccccagatgtggatgttcgaggcccagactggcacctgaagatgcctaagataaaaatgcccaagatcagcatgcctggcttcaaaggagaaggtccagaagtggatgtgaacctgcccaaggctgaccttgacgtctcaggacccaaggtggacgttgatgttccagatgtgaatattgaaggtccagatgcgaaactgaagggccctaaattcaagatgccagagatgaacatcaaagcccccaagatctccatgcctgactttgatttgcatctgaaaggccctaaggtgaaaggagatgtggatgtttctctgcctaagatggaaggtgatctaaaggcccctgaagttgacatcaagggccccaaagtggacattgatgccccagatgtggatgttcatggcccagactggcacctgaagatgcccaaggtgaaaatgcccaaattcagcatgccaggatttaaaggagagggcccagaagtggatgttaatttgcccaaagctgacattgatgtctcaggacccaaagtggacattgacactcctgatattgatattcatggtccagaagggaaactgaagggccccaaatttaaaatgcctgacctgcacctcaaggcaccgaagatctctatgcctgaagttgacctgaatctgaaaggtccaaagatgaagggcgacgtggacgtttctctgcccaaagtggaaggcgacctcaagggccctgaagttgacatcaagggccccaaagtggacattgatgtcccagatgtggacgttcaaggcccagactggcacttaaaaatgcccaaagtgaaaatgcccaagttcagcatgcctggcttcaaaggagagggcccagatgtggatgtgaacctgcccaaggctgaccttgacgtctcaggacccaaggtggacattgatgttcctgatgtgaatatcgaaggtccagatgcgaaactaaagggccctaaattcaagatgcctgagatgaacatcaaagcccccaagatctccatgcctgactttgatttgcatctgaaaggtcccaaggtgaagggtgatgtggatgtttcccttcctaaagtggaaggtgacctcaagggcccagaagttgacatcaagggccccaaagtggacatcgatgcccctgatgtagatgttcatggcccagactggcacctgaagatgcccaaggtgaaaatgcccaaattcagcatgccaggattcaaaggagagggcccagatgtggatgttacccttcctaaggctgacattgagatttctggccccaaagtggacattgatgcccctgatgtcagtatcgaaggtccagatgcaaaactcaagggtccaaagttcaagatgccagagatgaacatcaaggcccccaaaatctccatgcctgacattgactttaacttgaagggtcccaaagtgaaaggtgatgtggatgtctctctgcccaaagtggaaggtgatctcaagggccctgaaattgacataaaaggccccagtttggacattgacacacctgatgtcaatattgaaggtccggaaggaaaattgaaggggcccaaatttaagatgcctgagatgaacatcaaagctcccaaaatctctatgcctgactttgatttgcacctgaaaggtcccaaggtgaagggtgatgtggatgtttcactacctaaggtggaaagtgatctgaaagggccagaggtagacattgaaggtcctgaagggaagctcaaaggtcccaagtttaagatgcctgatgtacatttcaaaagcccacaaatctccatgagtgacattgatttgaatttgaaaggacctaagataaaaggagatatggacatttccgttcctaaactggagggagatctgaaaggtcccaaagtggatgtcaaaggccctaaagtgggcattgacactcctgatattgacattcatggtccagaagggaaactgaagggccccaaatttaaaatgcctgacttacacctcaaggcaccgaagatctctatgcctgaagttgacctgaatctgaaaggtccaaaggtgaagggcgacatggacatttctctgcccaaagtggaaggcgacctcaagggccccgaagttgacatcagggaccccaaagtggacattgatgtcccagatgtggacgttcaaggcccagactggcacctaaaaatgcccaaagtgaaaatgcccaagttcagcatgcctggcttcaaaggagagggcccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggcgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacgcaaaactgaagggccccaagttcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttggggcaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttgccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggcatctctactccggggtccgacttgcacgtcaatgccaaggggccacaggtttctggcgaactgaaggggccaggtgtggatgtgaacctgaaagggcctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccagcccatgtgcaaagtcaacagtatttgccttaagatttcatatatatatatttttttgcattgactgctgagagctcctgtttactaagcaagcttttgtgtttattatcctcatttttactgaacattgttagttttggggtaatggaaacccactttttcattgtaatgactttgggggcttttgttagtaagggtgggtggggtgatgggttgcagacggaggtcaggtcttcctctttcctgagactggatctgttcaaacagcaaacgcccacagatggcccagaggtggtggtagtcagggtgtgtgggtgtttttagggttctttagtgttgtttctttcacccaggggtggtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaactgagaatgtaagaaaattgatgctgtacaaggcaaataaagctgtttattaaccttgatgtcttgtgcctttgcattctgtgttgcgggggcgtgaaacctggggaagctgcacagccagctgtgagtgttcagaccggatccatctggtggcattgctagtttcatcagtgactttaagacagtgaccttcgggaggtagtgggagaaaatctttgcttcttgattctcatggtgaggctggttgtgccattgctgagaaatcaagaagaggcttggcctcgggacccactcacctactttgcatcctcacatatgaatatacaattcagaattggttctaaatgggttacagatgtgaacagttaaaaggcctcctggaattaccgaaagggctctgcttgtgaatcaccgctctgccatttattcctgacatggctgcaggtttgctgagtaaccgctgttgcccaggctggagtgcagtggcacaatcttggctcactgcaacctcctcctcctgggttcaagcgattttcctgcctcagcctcccgagtagctgggattacaggcccttgcctctacgcctggctaatttttatatttagtagagacgaagtttcaccatgttggccaggctggtctcaaactcctgacctccagtgatccacccgccttggcctcccaaagtactgggattacaggcatgagccactgcgcccggccagggtgctgatcttgtgtaagttatctctgtggttctttctagtccattttagggctaaacattatggaaaagtcttctgaccaaagtccccttttgatttccagctctgttgacagtatgtgggggtgggggaggagtggttctagtcactggctcctaatgttggtcattgctgggcagagggtgatgctttcttatacttggaccaagcttgtccccctcgccattccttagagatgccccatttctgccagtggaggcagctctgcacctctctggatccccccagaacagagataaaatagctcccaccccatccttccctgtttagtaccagcttgtcagtgggatctcatgccttccctagcttcatctgtcctcaccgtggccagcagagccagtgttctgggggttttggagctcaagggtggcccatggatttggaaagagataggttgggagggaggcccttgatacccggctgcgttttagatgaccgacctacagcttctttcgtgagttggacaggatgcttaacctgcttgaggctcagtttcatcacccttaaaattgggatagcagcattcatagggccagagttcgtccaggtattggggttatgcattgcatgatggcaccacactgaagtgtgcagcatccatgtgacagccagatacatacttatggagagcacaagagttggcatgaaatcctagagagacaggcatgagcccatcttctacagaaaccccctgctgcactgggctacacgcacactccagccgtgagcatgctcaggttcaatgatgcacacaactgcacacatcaccgtctgtcctaactgggcctggggctgtccccggggtgctgctttcactcaaccaaccacagctcaaaacccatctcctgttccttcctcaactctgaagccaagagtgtggggcaggtcagagtgtgcatgccgcttgagataagtagccctggtgtctggagggtggggtaagtgggtgacggtggggtgagtgtgcgacagtggggtgcacttgtgtacacagctagggaggaatgcccattaggatgctggaaagtcctctgaggagaactacccaggctgtccaataatatatcaattaaatttttttttaactttaggaagaagtgatgaaggctagtggtggcccccagtgtccattcaataaatgttttctgagtcccacgtggctagatgtgtcccagtcccactgatctcagattcctcttctgaggatctccacagagtgaatgatgtgatgggtgtgaaaaactggaatgccttgagccctggcaataaacccgtggaaatcatgcatgtaccagggatggcgaggccagtgatctcattgggtgggacagtcagtgggtggtgggtaggatggagaagggacaaggcaactagctgtacaaacttgagagtcttctagccaccttcttctcaatgtcaggtctgggctggaggcagtggccacagaacatgaacgctgcttcccgcagtgatggttaccacagcagcgacggcatgggaggagacacgggcttatgtggtgtgtggagggcgcaccccagctccctcgccctgcccatgcaccttacccctgccctccctcagttcctgatggggtggtccaagttatcccctaaagtctttttttttttttatttttgagacagagtctcgctcttgttgcccaggctggagtgcaatggtgtgaatttggctcactgcaaactccgcctcccgggttcaagagattcttctgcctcagcctcctgagtagctgggattaaaggcgcctgccaccatacctggctaatttttgtatttttagtagagatggggttttgccatgttggccatgctggtctcgaactcctgacctcgtgatctgcctaccttggtctcccaaagtgttgggattacaggcgtgagccatggcgcccggcctatcccctaaagtcttgcaggaaccagccttgcaaggtctgacactctaaggtcctggttcctgcactcgagggtgagagcagcgtcaggagactgggaaggggctggactctgtgatgttctttcccagagttcagcaaggagcaattgcaaggactgcagtctcaaggtcagcctcgctttaggcagtgtgactgtgtgtggacagtggtgtagttaagggggcatctgggaaaacagaattattttgaattacaccatgggctcacaaatggcagggaatagtgaacagttcctcctttccttccttcctccctccctcccttccttccttcctcccttgccttcttccttcccttcctccctccctccctccctccctcccttccttccttcttcctaacaggatcttgctctgtcacccaggctggagtgcagtggcacgttctcagctcattgcaacctccacctctcaagctcaaccaccacaccgggctaatttttgtattttttgtagagacggggtttcaccatgttgcccaggctagtctcaaactcctgagctcaatcaatcactccctccttggcctcccaaagtgctgggattacaagcatgagccaccgcgcttagcccagggaataattttcataaactcacactcatttctctatctgtcaggttccctctcgcaaacttagttccatttgaagatagttcaatcagagagacctaataaagagacagtttatggagtagtgggcaggggcaaaggaggccacaaggggtggtgagacccccaggggcagtaggaagctggtactatccctggccctgaaggatatgaggaagaagtggtgttcctgaagtccagcgtgcactggaggtagaggaggaatcctcagtggggactatagccatagaggaccagcatctgccagaactgcctgccgtgtgaagcagggaggaacaccctgacccctctctccactggagggcacgggagcccaggtgttgcagctgatccacctcctggggcacagagtcgggcagagaagcaggagcaggggtctgaaggtggagggaacagatagagaataaccaggacaaggccaggtgcagtggctcacgcctgtaatcctaacacgttgggaggccgaggcaggtggattgcctgggctcgggagtttgagaccagcctgggcaacatggtgaaatcccatctctactaaaatacaaaattagctgggcgtggtggtgcgcacctgtaatcccagttacttgggaggctgaggcaggagaattgcttgaacccgggaggtggaggttgcagtgaaccaagattgtgccacggcactccagcctgggtgacagagcaagactccatctcagaaaagaaacaaactagcccggtgtggcactcgcctgtagtcccagctactcaggaggctgaggcaggagaatcacttaagcctgcattccagcctggcagacaaagcaagactctgtctctcgttttttctgtttgataagtttgaatttttatacatcgaggtttcttaaactagaatttaaggtatgatcataaagtaatgctacagttttttcttaaagaagcacacatatgtcccaatggcaattctgctttcagtggtcacctcgggaagctctacacttacttctgtaaaaaatctactgctgggccggacgcggtggctcatgcctataatcccagcactttgggaggtcgaggtgggtggatcacttgaggtcaggagtttgagaccagcctggccaacatggcgataccccgtctctactaaaaaatatataaaaattagctggacgtggtggcacatgcctgtaattccagctactctggtggctgaggcaggagaatcatttgaacctgggagacagaggctgcagtgagctgagatcatgctactgcagtccagcctgggggacagagcgagactcgtctcaaaacaaacaaacaagcaaaaaaaaaaaaacaaaaaacaagcctggttaattaggtgggtgggttgtttggggtcaaaagcaaggcgtgattatgtgtgtgactaactttcctgtgtggttgggaagttgtctcaaatgttttgagcaaaggctgcactgttgaaatattgctatgtctccagcaccccaaagcaaaagtgcatcacccatgaggactttgcatgttgcttatatacatgtcctgcttcagagtgccaccttagctctttggtattttgcattagctgtgacattaaaaaacattatgtgggagatgcagctaattgtgtacctgaaatttctttttttttaaagtgtatttattttgaatgcaaatctaccgagaagttgcaagaataatacaatgaatattcatatagctttcagttggattcaccaattgctaacatttactttgtttgctttaatctctctctgtctctctacatatacatatatatatatatggtttttttgtttgtttgtttgggacagaatctcattctgttgcccaggctggagtgaagtggcatactcttggctcaccacaacctccacctcctgggctcaagcaattctcctgtctcagcctcccaagtagctgggattacaggtttgtgccatcatgcctgcctaatttttgtatttttagtagagacagggtttcaccatgttagccaggctggactcgaactcctgacctcaggtaatccacctgccttggcctcccaaagtgctgggattacaggcatgagccaccgcacctggctcatataggtgttatcattacttttgctgaatcatttgagagtaaattacagacatcatgatcctttacccataaatacttcagcatgtatgggcattcttttatataactccaatagagggcgggcgcagtggctcacgcctgtaattccagcactttgggaggctgaggcgggtggatcttgaggtcaggaagttccagaccagcctggccaacatagtgaaaccccatctctactaaaaatacaaaaaattagccgggtgtggtggcagctactcaggaggctgaggcaggagaatctcttgaacccgggggaggtggaggttgcagtgagctgagactgtgccattgcactccagcctgggcgacagagtgagactccgtctcaaacaaacaaacaaacaaacaaacaaacaaaactccaatacaataattaaattcaggaaacaaaacattgacatattatctaatatgtagtatatctttaaatttcaccagttgccccagtaactgtctttacagtaatgtctttttttgtttgttttgagtcagagtcttgctctgtctgccaggttggagtgtagtggtgcgatcttagctcactgcaacctccacctcctaggttcaggcgattctcctgtcttagcctcctgagtggctgggattactagcgcccgccaccacacctggctaatttttgtattttttagtagagacggggtttcgccatgttggccaggctggtcttgagctcctggcctcaagggacctgcctgcctcagcctcccaaagtgctgggatttgcgaccatgcccggcgacaatgtctttttttcctctttggggttcaattgttgatgacctcacatgatgtttagttgtcttggtctctttctttctttcttttttttttgagacggagtttcactcttgtcacccaggctggagtgcaatggtgtgatctcgactcactgcaacctctgcctcccgagttcaagtgattctcctgcctcagcctcctgaatagctgggattacaggcacctgccaccacacccagctaattttttgtatttttagtagagacagggctggtctcgaactcctgacctcaagtgatccacccaccttggcctcccaaagtgctggaattacaggcgtgagccaccgtgcccggctgtttatttctttaatctgtaatagtttctcagttttttttttgtcatgcatggcactgatatttttgaagtgtgtgggaccagttttctagaaatgtccctcaatctgggtttgtctgatgatatttcctcatgattgggttcaggttatacattttggggcaggaattccacagaagtgatattgggtcctttttggtgcctcgtgtcaggaggcacatgatgggtatgttaatttcaattccttggttaagtaggagattgctaagtttctccattgtaacgttgccatgactcctcattggaattaacaaggaaacccaagttttcaagataaaagtccaagtttgggcaagtttatctcacaagcacactttaaggggttggtggcatgcttagccttggcgtgatctcgggctgggagttttgaaagtggagttctggctttgagctttgcagcacagagcagctctctgtctttcctcacgaggacaaagaattccatgcatgaatgcctgccacgggccgggaatgccatgtgctgtttaccagcctctgaattgccccgtggcgtcaggcagccgctggtgcttcctaaggctgaaggcgcccagcagaggcgctgccatgggccacagcaaatgtgtagggaacattctgctgaggagggcagtttcatttccctttaaatgcctctgttattttccaccacacgcttgaggcttggccctaatggaaaaacttcccagtagtggggccaaggatgggaaagggttacgaatgaaaaggccttctctttggacagggcgttctagtccacagagtgctttatctcttgagatctcacactgcgttctcagctccgcccaggcaagcaggcagctctggcatttgctgaccctatcttacaaaccagaaaggtgaggctcggaaaagcgaagcgattggtctcaactcatagagttgggaagaggtgacttggccaaaatcgatccaagctttctgattaaaaaaagaattttttttttcttccctgtgatgtcactgccgtttccctgaagaagctgggaatttcttttctgggggaattttaggaaatagaggatgcctcttgaaatttgcagggacttgaactcggactttttaacattgtcgaaagtagttattaaagttattatggcccagcacaatagctcactcctgtaatcccaatgctttgggaggccgaggcaggaggatcacttgaggccaggaattcaaggctgcagtgagctgtgattgtgccattgcactccagtcagaatgacagagcgagacccagtctcaaaaaacaaattaaaaaacccccattattatgtgcaaagcccctttcttcaatgagcctaccatccagtaggggaataataataatatcagttatcagttctgctatttcctagctgcgtgaccttgggcaagttatcaaacctcattgtgcctcagttttttgttttttgttttttatttttttgagacggagtctctgtcgcccagtctggagtgcagtggtgccatctcagcttactgcaacctctgcctcctggattctcctgcctcggcttcctgagtagctgggactacaggcgtgcccaccacgcccagctaatttttgtatttttagtagagacggggttttgccatgttggtcaggctggtctcaaactcctgacctcaagtgatctgcccgccttggcctcccaaagtgctgggattacaggtgtgagcccgcatccccagccctgttttttaaatctataaaacagggatgatatggttcttctctcacagctttgttgggaggatgatttaaattaacataatgtggtcagcatatagtaaatactgtgttagctattcttatatactcttagtttgtgtgaggcattgtgtatgtattttacatgctttctctcttttcatttccacaacaaccacatgaggtgggtattatttttttcatttaacagacaaagaaactgaggctcagagaagttaagcaggatgtccaaggtcacacagctagcaaacagcagagtcaggattcacacgggggtctgtgctgactgaaaagcccatgcttttaatagcattctgcttgctctggtaccaggaagactgttaataacagtgtataactatttcaaggtttggagaggagtggggggagggaattccaggcagaaggaccggggaataaaagtgtggaagtggagatgtgtgcgtgggaggtttagcagggtcaggccagggagcaagagaagggggacgaactcagaatgaaacctgaaagccaggcagcttggctggtttcaggtccagccatgaaaggaaaaaactgggacatacacccatttgcccattttggggaggagggagtagggtttagggttcaggctcagcctcctggctgctgtcagtccctcccgaggctctcctgccccgggccaccctgggtccttcctctcctgagtcttcactcttccactataataataaacaagggagaaactatgatcaaatcatctgaattgtaacgagccccacccactggtcccagaccacccggcccacacagcctggaaggcccccagccctggctaagcccatggcgtcctgctgccctgcagctaggaaaatgcaggccaggcacaaccctctggccagctggggccctgaggggctgagcctcctgtctggggggagaacctgaaaatgcaagggggctgcagggaggaattttgggtggaacaaagttgctcctgcccctgacagtttcccctgtatctcctcacctgccggccctgcttggctgcagggcgaggctgattttagcccgaagtgagaacctgccaacaatctgtggtgtgagtagaaggatctcagtcttcctggcctcctgggtgggatgcagcagctcccccgaccccacaaaccccgacacccttccaaggggaaggaactcgggcgtcctcaagctcagaccactggctcttttttttttaatatttatttatttacttattattatttatttatttttagacagggtctcgctctgttgcccaggctggagtgctgtggcgtgatcatggctcaccacagcctggacatcctgggctcaagccatcctcccacctcagcctaccgagtagctggaactaccggcgtgcgccaccatgcccagcttgttaaccatccccccacccccgcctttttttttttttttttttttttggtagagacagggggtcttgctattttgcccaggctgggctccagcgatcctcctgccttggcctgcggaagtgccgggattacagacatgagccaccgcacccggcccggaccgcttgctcttcattccggagattatggggagctggagaagaagaaagcaagcagaaaactaaggggggaaacgagagaaagagcccgggatgggcagaggctgacagtgtggccaggggtcctgctgggggcgggtggagagtagggggaggtgtgtcgggggaggcagcaggggaggagcaaagccctaggtcgagggggagggaagggcggcggcttgcaatgagcggcagggagcgttgaagggcgtggagcgggaaggaaagaaaaagagggagaggactcacagggagaaaggacagtgccaaagggtgacttcgaggggactttagccccgctccctgtctccataaatccctcctggcactccaaacaaacctacaatcgaagtaaagcagcgcgctttcaatagcgaggcaaggtcccttgctccaaccagaaacgggatgatacctggtgaacccccatccagcaagcccggggccctcagaatcaagggcatgagaccctggtctctagagagcatctgtggccacaccccattggccgaactgtcaatcgccaggccatatttgggcctcatgacccgttgctaggcagatttttatcccctggggttgctgtgagccatgtgcccgcagactgggttggaggcgtgggacacagaggggagcaaagacggggcgagcaagtgggaaagaagaccctggggggctgtcgggaagctgctgagaccaggtatacacctcccaaggggtggccacgggacctcaccccttaccctagtgggtccccaatgcccaaacactggcctttcattgcgcgctttcccctttatccagacttccttcaaatgacagctttgtaccctgagaaactaaggtcctggagagtgtcagcgtcatatatgttattgcttttgaaactttacatttaaaaagagagcttttagaccctgagggatgggtctctcacgtggttatttcaggcccatcagcaggccagcttagggcattttgaaacggcagagccttttagcccatcctcacaaacagcgtggtaccgccttgctttctcctctgggagctcctgacatcctctggatgctgggctgcagggggcagggtagggggtggggcaggggcgcttgacccctatgtggaggagttttggccttaaggttccccagccccagccaggtgaaaggggaggcttttgacaaccttgggtctttccagccagtgtttacctaggtgtgtggtctcctcaagggcgcgtggctgccaaccacgcctctgtcctctgtcttcggtggccaggcggtggggagggctggaatgtgagcaggcaggcaagaataacgccagggcattttctatttgtaagattgcaagttcggctcacaacttgaatttcaagtgggcccttcagccagatagggaagtcagatgagagagtggaggcagccagtgcggattgtctaaattcctagaaaaattcctagaaaataaattctaggaatttagctgcaggagggaggagccccaggtgggataagctctgggtaaatttgctggggggcctggcagggatgctaggctttttgtccttcacgctatttaaacatcatgtttttccaaaaattgcgtgtctcttgaatcatatctaagactctctttctttctctctctctctttctttctttctttttctttctctctctctctctttctgtttttgagatagagtcttgttctgttgcctaggttggagtgcagtggtgtgatcttggctcactgcaacctccacctcctgagttcaagcaattctcctgcctcaacctccctagtagctgggattacaggtgcgcaccaccatgcctggctaatttttgtatttttagtagagatggggtttcaccatgttggccaggctggtctggaactcctgacctcaggtgatccacccgcctcggcctcccaaagtgcaggcattacaggcataagccaccacgcccggcctggaggcagggactttaaaagaagttattttttaaactgagctgctgccctcttatgaaggaaaaccactccctctaagtactgattttggtgactgctcttagtttgaagtaattattgtgtctaaaaatggaaaatcacatgttactgtttatcaaaaggaaataaacaccttggattaatcgggttcttgccactggatggtgagtccagaccttgccggcaacccaggtaaaaaggccactctgcatgttctgcaaacactcactttttttttctttttcttttttttttttgagatggagtcttgctttgttgtccaggctggagtgcaatgacacggtcttggctcactgcaacctctgcctcctgggttcaggtgattctcctgcctcagcctcttgaatagctgagattacaggcgcccgccaccatgcccggctaatttttcttttagtagagacagggtttcaccatgttggccaggctggtctcgaactccttacccaggatccccccgccttggcctcccaaagtgctgggattacaggcgtgagccaccgtgcccagcccactttcgttgttttacagtttccgaaggggaagtggtcagatcctgtgtgtccgctgaggcttacttgccatgcctggttatgtaatcgtggacaacctttgattgggctttgctggtggcagaaataaggacaggaaaaaacatgggagtcagggcgtgtcccccactcactctactctgacatggattggactgttgattgttttgtatttatgagcatttgctgaactctcacggaatatggagaattaaaagttggacagaaatgcttcagtaagccagcgtgaactgtacataggttcacacagggaaaaaaaggtcttggaggtggctccgaacactacatgtctcagccttttcatactccagccaatgcccagggagcacttggtggtctctgcttttgacttagctactgtcagcctctgcagtctcaagccggcctctgcagccacactcagctcttcccagtactcttttaacatactcttctctttccagcacctggctttcatgcaggcttttcttcctcatcctttgggtttcagctcagaggtcatttcctcctggaagccttcctggatactccccatcttccccagctatctcacgcattcatgttgctctgtacttttttgttcttagcactattcatattaaaatattagtggccaatggcttgtctgtctgcctcttgctccggactgtcagctctgtgagtgagaagtagtatgcttgtccatcattatgtctccagcacacggccaggcacatggcacgtggcagaaacttgataagccatcttatcactaaccgatcacttcatacacttcccctcagcgactggtgctccaattttccttctgtcaattactgtttagtttcttgatctctcaggttttagcctgtacttagggtaaaaacaaacaaaagttaaagaacaaaacaaaataaacattctctaataaacggttgctgaagttttgcactttggctgctttccttgagctgctgagtgtgaattcagctaaattctgtgccctgttggctggcaaacttctcaaattgacaccattccagcccccaggactgccctgctggggtgggaaaggaggcagaggaaaagcttggagactctgaagtcgaggacctgaagcccaagaaaggtggggtggcaagaacggcaaaaagggtgttgcttggggcaggaagttgaggaagagggagtgaaggagtgctcgggtgtggaagaggagaagacaccccaaatctgcccagtttggtccgaaatgggtggctggcatctgaaacgtctctcactgcttaagtctaggaagtgtggcttttgattattcttttgttctccttcccttccttcctagagaattttttgacctggaaagcctggctgggatgtggagggttgtgtttcccacctgcagcaatgcggggctggctttgtctttgcagcgaactgccccatgccccctgcctgccccaccgctctctttgagcctgacagacacagcaacagtggctccgtggccagcgtccagcgctgcagaatgagacaaagccctgtgtatttgctgggcagcacttggctgtgatatattgacatgtgagcgcagtagagtatttgtggcatctggagagcaaagtgctcacatcatgctggggtttggcaagtgcatttatttctctcagggtttgacaaagttcttttattttatttttttgagatggagttttgctttgtcatcaggctgaagtgcagtggcgcgatctcggctcactgcaacctccacctcccgggttcaagcaattcccctgcctcagcctcctgagtagctgggactacaagtatgcactaccctgcctggctaattttttgtattttagtagagatggaatttcatcacgttggccaggatggtctcaatctcctgacctcatgatccacccactttggcctccccaagtgttgggattacaggcgtgagccaccgtgcctggcaggcaaagttcttctagaatgtagaatttgaggcattgagactggaaatccctttgaaaggcagggataaaattgttttttttttttggatggggtctcactctgacccccaggctggaaagcagtggtgccatctgccactccaccttctgggctcaagaaatcctcccacctcaacctcccaagtgccaccacgcctgactaatttgttttgtgtttttgatttttttttgtagagatggtgtttcactatgttgcccaggctggtctcgaactcttgggttcaagcaattctcccatctcagcctcccaaagtgttaggattacagatgtgagccactgtgcctggccagaattgtatgttttaatgtgatacagtatgtctgagcaatgtccacatccagttgtcaagggggaaaaaacttgatagtgagcattcccagctcaacgctgccttgttcaaaactcagctgacatagaggcttctgctggttccctgtccacacagagtaagctcttcccagccaaaggggagatgaaaggattatttactatgtaaagtggtgaggcagaaatctcccagtttgttcacttagctcaaagtgggagaaaaaaaatgatgttgaggcggttctatagctcgatttctggtatgatcaactgggagcagcaatttaaaacccacttggattttttaagtcactggggaggttcggagccacataccacgccctgtgtgtcatcatcgggctctctgagggacagcacgtaggtttgggaggaacaggttcaaacctgactctgatcgttaacgaaggtagtgttctgtagcacacatgactctctgggccaatcagattaccccagccttctagcacctgtgtgaactgacatagctgggaagctggctaggctgggctcaggtggggcagccaggtacctttatagtatgatttgaaggcctcaggtgaggctgccctagcctgaaatatctcccctactggcttgtcaaggatgtctgaatttcgctactattgagtcattcctttgcgtttactacggtcctcgttttgtgagtgcagattgatctggaatacaggatccttaaccttcccatcttaattgcgtggatacaactagactatgtttaatctcttgggtaagccacaaactaagttccactttttcatgccaggcctgtcttgaggcatttcacctgccctcttctctattctgttcagcttagacaagaagcaagctggagccaggtagtctggtgtgggggacagaggagcagaggactggaaagtgagggcacccaggagcagcaggctctccttcctggcttctggctttccagcacagaaaagcttggctgagccttggtctggtgtcagatgacgcctgaagggagatgtgatctccccattttggcccagatggagcacagttagctcttacatggacttccttccacttactcactttccctttaccagctatcctctgtcctcctactgctgcactctcagccatcatcattctacgtggcctcatgccagaagggaagtctcattggcatcccagaggagccaggagctcctaagccccaccagcactcggccacacccctttcccctttgtggcttggttcacagtctccaggagatggaggagtggctaggagctgcgcagctgccgacagctcaacttgtgcggctggttttttgtttttttgagatggagtcttgctctgttgcccaggctggagtgctgtggtgcgatcttggctcactacaacctccgcctcccgggttcaagcgattctcttgcctcagtctcccgaatagctgagattacaggcacacgataccatgcccagttaatttttttgtatttttagtagagactgggtttcgccatgttggtcaggctggtctcgaactcccgacctcaggtgatccacccgcctcggcctcccaaagtgctgggattacaggcataagccactgcgcctggcaggtttgaacagatacagaggatgtttagtgagaggccagtcggatgctatgggtctgcactaaagccttaaaccctttctatcttttcctctttcccaggcctagaagacatggtcagagttcatctacgtcatgcccctgcctccgggcatattttatctccccatgcccatgcctgtcttccagagaccactcccaccaaaggaagtgggagaagcgaggcggaagagaggccataaagtccgctggaatataggctccatgaaggcagggatttttaatatatccccagagtctagaacagtgcctggcccacagtagatgctcaataaatatttgttgaataatgaacctccccttgttgaagtaatcacagctggtaaagtactttcaatcctaatgaatattctgttggacaggtggaaatttttagagccaacatttccaaagatctatttattttgttttttgtttttattttattttttttagagaagggccttgctctgtcactcaggctggagtgcactggcatgatcacagctcactgcaaccttgaactcctggactcaagagatcctcccacctcagctttctgagtagctcttactaaaggcacagcttccatgcccagctaataaaaaaaaatttcttttttttttttttttagagtgagtctgggttcactatgttgctcacgtgctgctctcaaacttctggcctcaagcgatcctcccaccttggccttctaaagcactgggattataggcatgagccactatgtctggccccaaagattcaatttttaattacaccatatagtgtaattataattacactatatagtgtaattataattacatttagtgtaatcttagtatgccattcattttgtaaaaaattaaaacaatacaagagaaattccccttgttccaaacacacttgcgtgctccttcttagtgataaccattagcttcatcttggcatgtgccctgtagactttgctcaatgcatttggacaagtctgtatgttaacatagaagcctagagttttgtgggttagcaacgacacaacaaccacaacaacaaaacccataaaaccataaataagattggactgtgctgttttgcagtttcctttttcccctcttaacgttttggagatgttccatgtaggtgaaaacagacctacctcgttcttttcattgtgaaatattgtgcagcatagatatattgcatatttgacaattcctctattgatggacttttaagtcatttccagtgtttactttttttttttttgagatgaagtctcccctctgtcacccaggctggagtgcagtggctcagtctcggctcactgcaacctctgcttcccaggttcaagcgattctcctgcctcagcctcctgagtagctgggattacaggggcgtgccaccacgcctggcaaaattgttttgtatttttactagagatggagtttcgtcattttggcccagctggtcttgaactcctcacctcaggttatctgcctgcctcagcctcccgaagtgctgggattacaggtgtgaaccaccgcgcctggcctattaccagtttctatgatcttgttagaataaaaatttcagctctctcttggacaggaaattgtgagtgattcacactagtaacataatcagatatgtcgtaatgatgctatttaatgctatgtcttctgttacttagtaactgttttacataaagggcgtaatcatgtctccaccttttttgataggaatggttgtgtatcacttttctccacccatttcaccatgacttttagatatgaaatgggagagtctggggccttggagggcctcaggggagtgacctcccccttcccttccttatcctctgttttcttgagtggcttcaaggagttgtttggtgccatagcctgcccttctgccacatcctttcctgccacatagtggtcatgtcctggaatgacgagatgacaatgccaatcattcagtcccaggctgcatggtgcactggcctttggattcctcctttgatcagctcagaacactttagcagttgttggttttgacctgtgcttggctttgatgatatcaggcccatcttcaaaccttttccttgtacctcaggaatgataccgcagtctggatccagccttaatcttttcaaggcccacgcatcactcagtataatattttccacagataagtacattttaaaaggaaaagctttaagaacactttatattttataccatttaattccttggcaattttcttctcccacccacaccttaatgtcatttgctcttctatttttctcaacctctgttttcttttctttctttctttccttccttccttccctccctcccttcttccttccttttccttcctttcttccttccttcctttctttcttctttttctttctttctttctttcttgagatggagtctccctccctctgctgctcaggctggagtgcagtgatgcgatctcggctcactgcaactgccgcctcccgggttcaagcaattctcctgcctcagcctaccgagtagctgggactacaggcacgcgccaccacgcccggctaacttttgtacttttagtagagacagggtttcactatgttgatcaggctggtctcgaactcctgaccttgtgatctgcccgcctcggcctcccaaagtgctgggattacaggtgtgagccaccgctcccggccaacctgctttcaagattacatcagagtggtggctgtggaagaatttttctccctgagaattttctctaggcatagttctttgttactaacaagattttccttctccctgcttgatgatttccgtacagtttagactcatagagtatcttaatattaatctctagtgattgaattgcaacagcacctaggatggctagatttcataatggctttttcctgaagttcacttttcagagggagcctaggacttttaaggcagtgtgacttgttttaatggtttcagattaattttgtatttgtatcagaaaaccatttacttaatgatttgattgtttcattttctaaagtgaatagtaactgaactcgtttcctactcctttatttagtccagctactatagaatctttgttttgcttgcttttagtaatattaacgttatttctttctttcttctttttttttttttgagacaggatctggctctgtcacccatgctggagtgcagtggcgcaatcttggctcactgcagcctccgcctcctgggatcaagtgatcctcctgctacagcctcctgagtagctgggattacaggcatataccaccatgcctggctaatttttctatttttagtagagacgaggtttcatcatgttggccaggctggtctcgaacttctggcctcaaataattcaaccgccttggcttcccaaagttctgggattacaggcatgagccactgcgcctggcatattactgctattttttttttttttttttgagacggagtctcgctctgtccccatgctggagtgcagtggcgtgatctcggctcactgcaacctctgcctcccaggttcaagtgattctcctacctcagcttcccaagtagctgggactacaggtgcatgccttcatgcccagctaatgtttttttttttgtatttttagaagagactgggtttcaccacgttggccaggctggtctcgatctcctgacctcgtaatctgcctgcctcggcctcccaaagtgctgggattataggcatgagtcactgtccccggcctattactgttatttctaaagcactctagttttggcaatgaattacaacaggacactgtgaggtaatctacatgtttaggtgaaagccatgctttctataggataacttcttatcttgaatatactggcaactttggcttggattttttttccttctttcatatttcctaatatatgctatgaaacatgaatggatggtttagtgtttagagtgtgggtttatgaaccaggtagtttggattcaaatctcagctctgccactttctttttttttgcccgggttgggggaggtggtctcactctgtcacctaggctagagtgcagtggtgtgatcacagctcactgtagccttgacttccctgagatcaggtgattgtcccacctcagcctcctgagtagctgggaccacaggcgtgtaccaccatgcctggctacttttttttttttttttgagatggagtttcattcttgttgcccagattggagtgcaatggctcaatcttggctcactgcaacctccgccttctgggttcaagcgattctcgtgcctcagcctcctgagtagctgagattacaggcgcccgccatcacgccatgctaatttttgtattttagtagagaccatgttggtcaggctggtcttgaactcctgacttcaggtgatccacctgctttggcctcctaaagtgctgggattataggcgtgagccactgcgcccggcggtcctggctaatttttgaattctttgtggagacaaggtttcgccatgttgcccaggctgattttgaactcctgggctcaagccatttgcctaccttggcctctcgaagtgctgggattacaggtgtgagccattgtgcctgaccagctctggctctttctagctgtaccatctagggcaagttatttaagctctctgtacttcagtttcttcttgtgtaaaacggggtagtagtagtacttgtctccagagttgatgtaaggagttgacataagggtaaaaatcgtttggcatgtggtaagcgccaatgtgtttgccattattattcaatctttgtttctaaattaaaaaaaaattccttccttctgtggttatttggacttattctgagtttcattttataactagaaactgaacaattgaaataaaaagaagagtcatcacatgctgaatttctcaaccaaactttttctgggaaagacaggattgtttttgtaaaataatttatatctgattattattagaattttaaaaatttgtgaagaaagaagaatcagtgagatgggattaatctatgtgcagtttttaagaaccttggaaattttcatgccatcgattgttagagaaatgcaaatatcattcagttgaaagactcttacaccattcattcatttattcaccactcattcattcatttattcaccactcattcattctttcatcactcatcattcatctatccaagccacaaacatttccagaatgcctgggacactgctaagctctcggagacaaagacaaataatttattgtctcagcatctagaaaactctaatgaagaatttgcttcattatggggaggaaaaatttaagtggccccaacagtcctcctgaaagctcggaacagggaagatagttcacctgtaagaaggaaggatgaataagaaatttcaccatttggcccggccaggtgggtcacacctgtaatcctaacactttgggaggtggagatgggaggatcacttgagcccaggagttcaagaccagcctggtcaacatagtgggaccccccccatctcttaaaaaataaaaaaaaggctgggcacggtggctcacgcctgtaatcctagcactttgggaggccgaggtgagtggataacctgaggtcaggagtttgagaccagcttggccaagatagtgaaaccccgtctctactaaaaataagcttagccacacacttagctggtgtggtggcacatgcctataatcccagctacttgggaggctgaggcaggagaattgcttgaacccgggaggcagaggttgcagtgagattgtgccactgcactccagcctgggcaacagagcgagagtctgtcaaaaaaaaaaaaaaaaaagaaagaaagaaagaaaacaggccgagcatgatgtcttacacttgtaatcccagcactttgtgaggctgaggtgggtggatcatctgaggtcaggagttcgagaccagcctggccaacatggtgaaaccctgtctctactaaaaatactaaaaattagctgggcatggtgacacacgcctgtaatcccagctacttgggaggctgaggcaggagaatcccttgaacctgggaggctggaggttgtggtgagctgagatctggccactgccctccagcctgggacacacagtgagactctgtctcaaaaaaaaaaaaaaaaaagaaaagaaaagaaaacagtagaaagaaaataaaaaagaaatttaatctgtttgaaactgaaggtcccgattcaatcctttcatgtaacctttgggttactatcccctggggaagagcaatctccctttttttttgagacagggtctcactctgtcgccccggctggagtgcagtggtgtgatcatggctcactgtagccttgacctcctggactcaggcagtcctcctgcctcagcctcctgagtagctgggactacggttgtgtgccaccacacctggctaattttgtttattttttattttttgtagaggtgggggtctcactatattgcccaggctggtgtgggactcctaggctcaggtgatcctcttgcctcagcctctgaaagtgctaggattacaggtgtgagccactgcatcctgctgggaagagtaatttcctgggatggtgttagacttgggcaaacacatgaaaagagtaacccgttgaaaacactgatggcaaccatagttctccacgaactggtttcagtgttgctgccagacggaatcctgctattggtcagggaatcccatggccaggtgggctctccttcttgatgggaacactccccttccccacagatggtagcgacctctgattggagatctactgtgtaaggcatcaggaactctgagtggagctgaatctagtgatcggaacccctgccccgcagtatccagcttaatgctgttggagaaaagatacccagagggcagtaaccgatgagtgctgtggtcccacaataaaaccctcctttcttacacattgttcctcagtgttcagttgtaccttatctctctccttctgtccttgcaaagcccttgaggagaatgactgggtctggtgggtggatgaaccggagatagcattgtcccctttgtgtgagattccccgggctttcacaaagggctgtccttcagcttaggccagttgtcttctaaagattctctgttatcttctctacagctagagattccaggcaatggtggagcttgggctgggttggggtgtgttggggggtggtagtggtaaacgtggggtctctggtattttatacacccatagtaggcatttgaaaagtgctcattgattggatgatttgatgagtgacctggtgataatctttatccttgttagaacacaccacagccatcagcactggaatgcaaagaccagaacaaacagaaggaagccagcagccaagccggggcagtttcagtctccaccccaaatgcaggtgagagaagtgatggggactgaaagacggatgaccttgattatgataatgataccctttatcacagatgggcatgcctgcctgggctgtggaagccacacgtggaaggatatggctcaggaccccaggagcccagcccctctttctcctgggcctggaaattcaaaccctactcttctttcagctttgtgagaagcccataggaaatgcacttactacagaaggattacgtactccttcagaaggagtctcaagcgtttcttcatagggagggctgccgtggaatatccacattcttttaagacagtacctattaaacccagaagccagggtggggcagaaaccaaagactcagaattaaagggttggaatctactcctagtggaagatctaccagagtgtagaaaaagtctttttgatcctctaaaggaaagtctttttcaggcctcctaggagggagatgcccacatggagggtgagctggaggggaagaagtgagtgactgtgggctatggaaatcctgggtcatagggagctacgtggaggggtcattggctcagtgtgggccgtagccatgtttctggcctgtaccaaaatgaaactgttttttggaggtaattgcaaacatttaagaatcaggagactggctgggcatggtggctcatggttgtaatccaacactttgggaggccgaggcaggcggatcacttgaggtcaggagttcaagaccagcctagccaacatagtgaaaccctgtctctactagaaatataaaaattagccgggtatggtggcaggcacctgtaatcccagctactcgggaggctgagacaggagaattgcttgaacccaggaggcagaggttgccgtgagttgagattgcaccactgcactccagcctgggcgacgacagagtgatattccgtcccaaaaaaacaaaacaaaacaataaacaaaaatatggaatgtatggcctctcaacattttgtcatgttcactgagcccacattcccacatggcaatgtcagctggagaggactgactgccgtgtcactgggcaaagggagctccgcttccttctatccgctcctgtggaccctccttcctccatctgagccccattttctcctctcacctcttccttgcccagcgctccacccatagcctggggtgaatgtccgttcagcatataaacagggacatactccacctcctttaaagaaagcctcccagcctggtgcggtggctgacgcctgtaatcccagcattttggaaggcggaggagcaggaggatcacgaggtcaggagttcgagaccagcctggccaaaacggtgaaaccctgtctctaccaaaaatacaaaattagccgggcgtggtggcgcacgcctgtaatcccagctactcaggaggctgaggcagaagaatcgcttaaacccgggaggcggaggttgcagtgagctgagatcaggccactgcactctagcctgggtgacagagcaagactctgtctcaaaaaaaaaaaaaaaaaaaaaagaaaaagaaaagaaagaaagcctccctcaagcccgaacccctcttgctgtggtgctattctttgagagccaactggaaagcattgcctgttccattcctgtcgcctcttcctcatcttcccttcactccagtccccccacttcccgttcccaggcttccaccctgccactcaatactgctcttgctgattccacttcattgatatgagtgcccagggaaatctctgggcacttggtgctgtgccctctccttccatgaaacaccctgccccctctgattggtgatatcgccttcatgttgacgtctgtttggttaggatgactttgccctcccttcctaggccctttatgggctcccctcttcccacaacctcgaaagtggcagaatttcccaaggacctgtcatgggtttttgtttttctcactcgggactctctctccgggcaacctcttggggctctgtggctctcaggcctgcttctcttccgagctccagggctgcacatctgggctcccctccactccccctctccctgtctctccatccccgtccttaccgtctctggtcagctctgctaaccatctggctaccacaccagtcacccaccttcttaacatttccaatgtttttggtttgtattatttgctacaatcgcctcctaactgtctgcctgtcttagctcttttcctccatggatagactgagcttaaatagtggttagtttaaaataaaagaatcaaatcatgttactcccctccttgaaattcttcagtggctgctcatggctctcggggtgaagttcacatccttggctcagcacccaaagatgccatggctcagctcttggctcagcccgcaccacttcccatgtgggcttttcactccagcaacaccctagtgctggtccccacatccatgatgccggtctatgctcctatgtcttttttttttttttttgagatggagtctcactctgtgacccaggctggaatgcagtggcgtgatatcaactcactgcaacctccacctcccgcgttcaagcaatcctcctgcctcagcctcctgagtaattgggattacaggcatgcaccacaatgtccagctaatttttttgtatttttagtagagatgaggtttcaccatattggccaggctggtcttgaactcctgaccttgtgatccacccgcctgggcctcccaaagtgctgggattacaggtgtgagccaccgcgctgggccgctcctgtgtctttattgtgctcttccaaacccctctgccccctgtcttcctgggcctttgaaccaccactccaggcccacctgagcctccaagtctgggctcagggccccttctctgtgctctcccatgctgcccaggcatccctgttttggctcccctggtgctgggcctccactagacttcacactcagtagggcccaggaggatctacagcacagtctgcatggaatataaactagacagatgggctgggcactgtggctcatacctgtaatcccagcactttgggaggccgaggtgggtggatcacctgaggccaggaggttgagagcagcctggccaacacagcaaaatcctgtctctactgaaaatacaaaaaaaaaaaaaaaaaattagctgggcatggtgggcgcctgtaatcccagctaatcaggaggctgaggcaggagaattgcttgaacccagggggcggaggctgcagtgaactgggatcgcgccattgcactccagcctgggcaacaggagcgaaactccgtcttggaaaaaaaaaaaaaagctagacagatgatggcaagctccgctggctggcttcccagtgcttacatggtggccatttctctattgctctttggggactgggttctagtgtttgtgttgccaaatgcagcactttttgttgtacactttacttcaacattgattaaattaaatgtctcgggatttcaagggaattgggatttgaccccttttctcaaaggacttgtacactgggtgcataatgtctgttcattcaatgaacgtttatttactgagcacctttgcagagccaggcacggaaggtggcagaattaaagcagccagtcacagggattcagagaaagtctgtggagcttagaggaacttccgtggcttttcatcttctcatgccttggtttaaagtacaggagaaagattatagttctccttgccagagacgcctctttcccctgatcatggatgtttccttagaaaccaacttgcgtgtcccccactttcatgggctttgaagctggagtcttgtgtaaacatcacttcacgggcatgtgagaaacaagcctttcctgtccccgccgtgagcctccagctttctctaagtcgacttctcaagggggtactgctgtttcttttaatatcaaaaaacccgtttgaacattacatggttttctcacggtaacacttcagtcagctgcatacagggtcattttggtaaataagtggaaaatcagagaagtattgctggacttgaagacaagtctgtgcagttgagagcagcagagcttttgaatcaagacatcatgggaggttgaggcaggtgaatcgcttgaacccgggagggggaggttgcagtgagccgagactgcgccaccggcgacagtgcgagactccgtctcaaaaaaaaaagacacttacgctgtgtcctaaatgttgaaggcggttttgaggggtgaggtgctggagagttgaagctacaaacagaaacctataaactcattgtgttggatgtcatactgtcctgccttacgccacataccctcatggttaggagctctgctcagaaactggactgcctgggttcaaatcctgtctttgctactctacgttggggcatgttccagtttttctttcatctgtgagatcaggatgataacatcccttagatggtggttgtgaagataaagcgaactattgcctgggcagcgtttatagtggtgcctgacatacagtaagtgcttaataaacgttagctgttgtaattatacccctttatcagcttcacactggactggtcacctaagctgtcaccagacgtcccgcaccactggtggtccacaatgtttctgttctgttgtttcaaaccccttagctcattttgcttctctgaccatcttattccagtcctctcctctttcacgatgttctctggtctggaataggcgtctatttggagtctgccgctccttactcagtgaaccctctctctctattctgaagccctcttggtgggatgggggcagatattcctgtactcacagctaaccatgggaaaactctagggtaatttttcatttgagcttgtgtttataaacctctaaaacctcataggacccttgccagtgggcccatctgtgagttctccatctatgtaaagaaaaaaaaaaactggtggtaaaatagacataacataaaattgaccattttaaccatttttaggtgtacagctcagtggtatacagtacatctacattacggtggaaccatctccactgtgcagctccagaactttctcatcttccccaattgaaacgctgtagccattcaacactaattctccagcccccggcaaccaccatgctccctccctccctccctccctcccttccttccttccttctttcctttcttccttccttcctttcttcttttctttcttttttttgagacagagtttcggagtttagctcttgttgcccaggctggagtaaaatggcacaatcttggctcaccgcaacgtccgcctcctgggttcaagcgattctcctgcctcagcctcccaagtagctgggattacaggcatgtgctaccccgcctgctaattttgtatttttagtagagatggggtttctccatgttggtcaggctggtctcgaactcctgaccgcaggtgatccacccacctcggcctcccaaagtgctgggattacaggcgtgagccaccatgcctggctgctactttctgactgtatgaatttgactactctaggtacctcatataagtggaatgacacagtatttgtcctcttctgtctagcttacttcactttcagggttcatctatgttatattttgtgttagaatttcatttcatttctctctctctctttttttttttttttttttgagacaaagtcttgctttgtcacccaggctggagtgcagtggtgcaatctcggctcactgcaacctccgcctcccaggttcaagtgattcccctgcctcagcctcctgagtagttgggactacaggtatatgtcacaatgtctggctaattttttgttattttttagcagagatgaggatttcactatgttggccaggctggtcttgaattcctgacctcaggtgtcaccacctgccttggcctcccaaaatgctgagattacaggcatgagccaccactcccggccttctgttattctttttttttttttttttttttgagatggagtcttgctgtattgcccaggctggagtgcagtggtgcaatctcggctcactgtaacctctgcctcccaggtttgagcgattctcctgcctcagcctcctgagtagctgggactacaggctcctgccaccatgcccagctaattttttgtatttttagtagagacggggtttcaccgtgttagccaggatggtctcgatctcctgaccttgtgatccgcccgcctcggactcccaaagtgctgggattataggtgtgagccaccgcgcccagcaagattgatcctttttgttttgttttgtttttgacagggtctcactctgtgacccaagctggagtatactgttgggattacgtctcactgtagcctcaaactcctgggctcaagcactcctcccacctcagccgccccagtacaggcatgcatcaccatgcctgactaatttttaaaattatttgtaaataggcagggtctcactatggtgcccagactggtcttgaattcctaggctcaaacgatcctcccgctttggcctctcaaagtgctggggttacagatgtgagccactgctcccggccaattaatctttttgaaacctaagtcaaaggccaggcacggtggctcacgcctgtaatcccagcactttgggaggccgaggcaggcagatcacctgaggtcaggagttcgagaccagcctggccaacatggagaaaccccgtctctactaaaaatacaaaattagccgggtgtggtggcgcgtgcctgtaatcccagctaccctggaggctgaggcaagagaatcgcctgaacccgggaggcggaggttgtggtgagctgagatcacgcaattgcactccagcctgggcaacaagagcgaaactctgtctcaaaaacaaaacaaaacaaaacagaacaaaacaaaacaaaacctaagtcaagtattgccatgcctcactcatgaccttccgtggctccccatctcactcggaagcatgcttaagtgctcgtggtagcgtagaggcttccataccacctggccctcactgctcttcagaccccatcttttcctccctcatggagctctggccacaggggctccttgctgttccttgatctggcagccaagcttccatcccagggtttttgtatttgctgtgaactatgcttggaatgttcttccccttgacaaagtcttccccttataatgtcacctcgcaagagatcttctctgacaccttacataaagtagcaagccctccttcccctgacctatggcgtctctcttgttatttatttatttatttattcagagacagggtctcactctgtcacccaggctgtagtgtggtggcatgatcatagctcactgcagcctccaactcttgggctcaagtgatcctcctgcctcagcctccagagtagctaagactacctaccggtgtgtgctaccatgcccagctaattaaaaaaaaattttttttgtagaaatggggtttcactacgtttttcagactggtcttgagctcttggtctcaagtgatcctcctgcctcagcctcccaaagcattgggattatgggtgtgagccattgcacccagccatcccttcttttgaacactgctctatgcatgccctttcttttttttttttttttttttgagatggagtctcgctctgttgcccaggctggagtgcagtggtgcgatctcggctcactgcaagctccacctcctgggttcacaccattctcctgcctcagcctccggagtagctgggactacaggcgcccgccaccgcgcctggctaattttttgtagtttgtttttttttttttttgagatggagtcttgctctgtcgcccaggctggagtgcagtggcacaatcttggctcactgcaagctctgcctcccaggttcacgccattctcctgcctcagcctctggagtagctgggactacaggtgccagccaccacgcctggctattttttttgtatttttagtagagacagggtttcaccgtgttagccaggatggtctcgatctcctgacctcatgatccgcctgcctcggcctcccaaagcgctgggattacaggcgtgagccaccgcgcctggctgtagttttttttttagtagagacggggtttcaccgtgttagccaggatggtctcgatctcctgacctcgtgatccgcccgcctcggcctcccagagtgctgggattacaggcgcgagccaccgcgcccggcccgccctttcttgatctatgtagagagtgttgtgtagatcattttggcacaggacagaatttcagaactggatgatttgttagtgatcctctgtttccaccagttctcttcaaattaaagctgaaggaatggaggccagaaaaggctgagtggcccccgactcccgtatcatcctgagctctgaactgattgattcatgagcctgcagcattcttctggtaaagcagaaggcctgcagcccaccctaccccgatgctgttgccacgtagcgtcccttgggccctgggccttcggggtcttctgtcactcggctgctgttcactttcaggaggaacagatgctggtggagtttcccacctctgaccaggtcactctccaggcagtgcttcttggtgtgaaaccatgtcgttcaaatgattgtccttttggtgttcaaatgaccatcctgtggacgtttttgtgtgtctttgtgttcctgatagtttgccctgtctttttcctcctaggcctcttaagggttaaattataccaggaggaagcagggccagttctcctgcttattctgcacattacgaatgaggaatattttacattcatgaataagctattgcttatcgatgctacgattacagataaaatgttcctgttcctctttgctacacatgaaattgcagtgagcagtacaagatgaatttgacaggtgtggtctctaccatgctagatggagacattctggggaaaagagtatgagggagggatggcatgctcaggtaacagtaagcactcaccctctgaggtgctttctatgtgtcgggcatggcgtaaatgctttatgtgatgtcatttatttcatcctcacggtagctctcgtgagtaggtgcaattatatcccgatttggcagtggaggaatctgaggcacagaaggattaggtaatttgcccaaagtcattgagagaacggaagggcaaagccagtatttgaacccaggggggctccagagtcctttctgttaaatactacatttttttttttgagacagtctcgctctgtcacttaggctggagtgcagtggcgcgatctcagctcactgcaacctttgcctcctgggctcaaatgattctcctgcctcagcttcctgagtagctggaactacaggcacgcaccaccacgcccggataaattttgtatttttagtagagatggggtttccccatgttggccaggatggtctcgaactccgggcctcaagtgagcagtccgccttgggctcccaaagtgctgggattacagatgtgagccactgcacccggcctaaatacatcttgatgaaggtttcatggaggaagagagatatgagctgggccttgaaggagagctccacatgtagacaacatgagtgacgggccagggatggagtgagcatggctgacccagcagggaagagagactgacctcacccgacacagggcatgcattggggaatggtgggggagatggggcaagagggcggagatggatcgtaaaaggtcttaacatcaaggcagagggttgaagaactcagactttaaagagtattgaagggccaggcgcggtggttcacgcctgtaatcccagcactttgggaggccgaggtgggtcgatcacgaggtcaggagatcgagaccacggtgaaaccccgtctctactaaaaatacaaaaaattagccaggcatggtggtgggcacttgtagtcccagctactcaagaggctgaggcaggagaatggcataaacccgggaggcggagcttgcagtgagccaagatcgtgtcactgcactccagcctaggagaaagagcgagactcagtctctaaataaataaataaataaataaataaaaaataaagagtattgaagggtgacttgctagaagctgaggtctagggaggtttttgggtagcaatggtaggtttgagggtgggaggtgtggaggcagggacgagaccctgagggtccagacaaagatggtgcaagggaaatggaagaaaggggaagcccaaggccaggtacagtggctcactcctgtagtcccagcactctgggaggccgaggtgggtggattacctgagatcaggagttcaggaccagcctggccaaaatggtgaaactctgtctctactaaaaaatacaaaaattagctgggtgcagtggtgggcacctgtaatcccagctactcgggaggttgagacaggagaactgcttgaactcgggaggcagaggttgcagtgagccgtgactgcgccactgcactccagtctgggcaacaagtgcgaaactctgtctcaaaaaaacaaaaaaaaaaccaaaaaaaaaaaaaccaaaaaaagaaaagagaagcccatagcaccttccttctcatccaagtcatctcctggagagggatcagcccaggagctacaggagcgcctcgggtttcatcggttactcacaggaggcagcctctgggcttttgggggaaggtcgaggacattatttactgaggtctgttttcctgtggatggctgttcctgcctaggcaacgagcatttcttcacgctgcgcattccaacttggtcagaccagaaggcagcaaatccaggttttttttttttttttttttttttaactgcacgcagaattccttgcatagcagagagctcaggaaggaaggccctgtttggggacagaggtcagggtttcagagtccaggaccactgagaaagagtcaggcctttcttttttttcttttcttttcttttctttttttgagatagagtcttgctctgtcacccaggctggagtgcaatggcgcaatctcggctcactgcaacctccacctcccgggttcaagcgattctcctgcttcaacctcccacgtagctgggattacaggcacccgccaccgtgcccggctaatttttgtattttttagtagagacggggtttcaccatcttggccaggcggatcttgaactcccgaccttgtgatccacccacctcggcctcccaaagtgctgggattacaggcgtgagtcactgtgcctggcaaagtcaggcctttctctgttaatctcaggtttgcctgattagcctctgaatggatgtacctggagtgaactctgtcacaagcagaaatttaatttaacccttgagatttatttcctcccacccctaaagtatcaactgctaaagggatttagaaaggatccgaggcaagattggcagggctgagggttctgtggctgtcactgtccaggacagctggccactgggtccagcctgctcccagcagtgggcacaggcaggggagcagggccctgaccttcctggcaggtggcagggtccgggtgaggcttcccaagctctgcctgctaccctcctgcttgaaatcaggggtgaggggtgtgaggccctcctataaatccggcagaacccagccagaaggagcactgggacctcatctccctcccctctggattccagctccccggaatgggccaagtttgccttaactttttattgaagtgaaaaacagtcaagatatgaatattccctaaagccactttggaatactttcaagaatagtttcacagttaaacaggcaaaaggacaagattgcatgcaggaatggatcacccacttggagagccggttctggaaagagagctttgatttcatgccttatctgtttcgtgcgtcgtggaagaagggaatggaaggcatttggttggggagatggagacctgctgcttgtatggggtattcccctctgcatggtgacaggttcttagggaaacatcttaatagaaggcttatgagcagtctggcaaacttcccaccctccttgtacccaagacaaaaatgttggcctgacaaaaatattcaggtaattttctagtatttttagcacttcgcagaccccaaactacccaagtaatggctctcttaaaaaaaaaaaaggggctgggcagggtagctcacgcccgtaatcccagtactttgggaggctgaggtagacggatcacctgaggtcaggagttcgagatcagcctgaccaacgtggagaaaccctgtctccattaaaaatacaaaattagccagacgtggtggtgcatgcctgtaatcccagctactcgggaggccgaggcaggaaaatcacttgaacctgggaggcagaggttgcagtgagccgagatcgtgccattgtaccccaacctgggtaacaagagggaaactccgtatcaaaaaaaaaaaaaaaaagaaaaaagaaaaaaaaagaaaagaaagcaaagctcttagaaaagttgtcctactatcttattacaataagtgctgaagtagacagactctgtcatcttaactgtgtcaacattaatgaaaagaaattagccgagcgcagtggcatgtgtctgtagttccagctactcaggaggctgaggcaggagaatcacttgaatccaggaggcggaggttgtagtgagctgagattgcgccactgtactccagcctgggagacagagcaagactctgttttagaaacaaacaaacaaacaaaaaaaattagtgaaacagtgtcatcaaaggcctaggagggatttttttaatggtgtattaatggtgtacattttcctcttttgctcttttcttttctctctctttttttttttttttttttttgaggcagggtctcattctgtcacccaggctggagtgcagtggtatgatcacggctcactgcaggaggatcgatctcctgggttcaagcgatcctcgcacctcagtctcctgagtagctaggaccacaggcgtgtgccaccatgcccagctaatttttgtcgttgttgttgtagagatgaggtcttgccgtgttgcctaggttggtcaggaactcctgggctcaagcaatctccatctccaagccccaaccttggcctcccaaactgctgggattgcaggagtgagccaccggcacccggcaccctgtcctgttttctaggcattgctaggggcaataatttgggagaagtaaaggacaagaacaaaatcaaagaagaggcattcttgtatcattgctctcctgaatttgttggggagccctggggtgagccctgtcaggggctggagggtccagtcttagtgtgaaaagacctcaggggctcagccccagctcctgcttagcccctgggccctagctgagaagaagagcgaatgtgtgtgctgaccagacctgaccagatctgctgggtgaggctgcgggtggtggtgagaggccattctaagaaaccacctggaatagtgggggaggagatgggaggccaggggctctgctcttaagatagcactgagtcctgcggagaggaattcctgggaggattttgagtccacctgacttccctttgctcttggtgtacaggtcccgggcttcaccaccctggccttctttcgcttcctcaaatgttccagaggcctctgtacctatacacatgttactccttggccaggaaggccccccatcccctaagccaattatcttccaggtttctgcacaaccatcaccacctctggaaagccttggcccagggcttgactgggatccccctgctttttataacttttttttttttttgagatggagtttcactcttttgcctaggctggagtgcagtggcgcggtctcagctcactgcaacctccgcctcccgggttcaagtgattctcctgcctcagcctccctagtagctgggactacaggcgccggccaccatgcctggctaatttttgttatttttagtacagaggggtttcaccatgttggccaggctggtctcgaactcctgacctgtgatctgcccgccttggcctcccaaagtgctgggattacaggcgtgagccacggcacttgccctataacttttattttaggttcgggggtgcatgtgaatgtttgctacataggtacactcatgacacggggcttgttgtacaggttatttcatcacccaggaattaagttcagtacccaatagttatcttttctgcttctctctctcctcctcccaccctccaccctcaagtattggtgcaaaaataattgcggcttcagaccatgtatttgaaatcattataactaggctcaaacacatctttattaaccaaaataggaagcgttacaatcaacacatttttgctaatgagaaataagttttttcattcctgtagcatataaatccatgcttcgggattcgacgaactcttagaaagcattttctgcatcctgctggttgtggaagcgttttccctgcaaaaagttgtcgagatgcctgaagaagtggtagtcagttggcgagaggtcaagtgaatatggcagaggaggcaaaacttcgtagtacaattcgttcaacttttgaagtgttgtgtgacatgcggtcgggcattgtcatggagaagaattgggtgatttctgcaaccaatgccggctgcaggcattgcagtttttggtgcatctcatcaatttgctgagcatatatcttaaatgtaatggttttgccaggattcagaaagctgtagtggatcagactggcagcagaccaccagtgaccatgaccttcttttggtacaagcttggctttgggaagtgctttggagcttctttctcttggtccaaccaccggtcatcgacagttgtcgtttaaaatccactttttgtctcacgtcacaatctgatcgagaaatggttcattgttgttgcgtagaataagagaagacatttcaaaatgatgtttttttttgtttgttttgttttaatttttgctcagctcatgaggcacccacttataaagctttttcacctttccaatttgcttcaaatgctgaacgaccgtccaatgtccatgttgagttcttcgggaacttctcgtgtaggtttaagagggtctttgattatttctctcaattggtcattgtcaacttctaatggctggcgccacgacgctcctcatcttcaaggctcttgtctcctttgcaaaacttttttttgagacggagtcttgctctgtcgcccaggcagggtggagagcagtggtgcaatctcggctcattacaacctctgcctgccaggttcaagtgattctcctgcctcagcctagcaagtagctggaattatagccatgcgccaccatgcccagctaatttttgtatttttagtagagatgggagtttcgccatgttggccaggctgatctcgaactcctgacctcaggtgatccggctgcctcagccgtccggccagaacttgtaccaccactgcactgtatgctcattagcggttcctgggccgaatgcattgatgttgccagttgtctctgctgctttacaacccattttgaacttgaataagaaaatagcttgaatttgctttggtctaacataatttccatagtctaaaataaacataaaataaacagcaagtaataagtcattagcaaaaaaacttaaggcgagaaatgcgccttcaagtgatatatagccgggggcggtggctcacacctgtaatcccagcactttgggagactgaggcgggcggatcacctgaggtcaggagctcgagacgagcctggccaacatggtgaaacctcgtctctactaaaaatacaaaaattagctgggtgtgatggcgggcgcctgtaatcccagctacttgggaggctggggcaggagaatcacctgagaccagaaggcagaggtttcggtgagctgagatcgcgccactgcactctggcctgggtgacagagtgagactctgtctaaaaaaaaaaaaaaaaaaaaagtataacataaccacatttatttaagaatatattccaatatcaaacgcaaatttcaacaatgcaaaagtgcagttacttttgcaccaacccaatagacctcagtgtcagttgctcccttctttgtgtttatgagtgctcatcatttagctcccacttataagtgagaacatgccatatttggttttctgttcctgtgttagtttgctgaggataatggcctccacctccatccacgttcccacaaaagacaggatcttgttcattttgatggctgcaggggtccccccaccttttttttgagacaaagtctcgctctattgccccaggttggagtgcaatggtgcgatctcggctcactgcaacctctgcctcttgggtttgagcaattctcctgtttcagcctcctgagtagctgggactacaggcacctgccactatgcctggctaatttttgtatttttagtagagacagggtttcaccttgttggtcaggttggtctcgaactcctgacctcaggtgatccgcccacctctgcctcccaaagtgttgggattacgggcgtgagccaccgtgcccggcccagggtccccttttaagtgccctgatgaccctctgcacctcgcctctgtcactgtccctgccagtgcagcggcttctcctgggtccctcttcctcaccagcctctgaggtcaggatcctccctacctgttgccagatgttcctttccagcaggtagcttttcagaggcctgaaggtgggagaaggaagacaccccactgtcttcaagcaccaggatgttgggacattgtttgctcactctcctatttccaggacccagcacggggtgctcagtgtatgtccgcaaactgactaaatgtccagctcacttttgtcaaccagctgtcagtccctggctctttatattccttatctcatgtgactctcacaagatccttgtgaggaaggcctcgtgtccattcgcaggtggggaaattgaggctgcagagttttggcaacttggccgagcttacgcagctaagaagcggcagcaattctcagttcttccacttaaggtgcataagaatcactggggagctggttaaagatgtaggtttctgagggccgggtgtggtggctgatgcctgtaatcccagcactttgggaggctgagggcagatcacgaggtcagcagttcgaggaccagcctgactaacgtggtgaaaccccgtctctactaaatatataaaaattagctgggcgtggtggcatgcacctgtaatcccagctactcaggaggctgaggcaggagaatcacttgaacctgggaggtggaggttgcagtgagccaagatcgtgccactgcactccagcctgggcaacagagcgagactctgtttcaaaaaaaaaaaaaaagatgtaggtttctgggccccctcccaagatttctgatttgtcattgcatttctaatttttaaattattttatttataaattattactattatttttgattgacatatttgatatatgtatacaatgtacagtgattaaatcaagctcattaacatgtctgtcacctcacttacctattttttttttttgagacagggtatcactctgtcatccaggctggagtgtagtggtttgatcatggctcactgcagcctcaacctccaagcctccagtgatcctcctaccttagcctcccgagtagctgagactacaggcacacatcaccatgtccagctaattttgtttattttttttgtagaggtgggggtctcaccatgttgtccaggctggtctggaactcctgggctcaagcaatcctccagcctcagcctcctaaagtgctgggattatagcgtgacctgagcctggttcctatcattgttttatacagcttttttttttttgagacggagtcttgctctgtcgcccaggctggagtgcagtgacacaaacttggctcactgcaagctctgcctcccaggttcacgccagtctcctgtctcagcctcctgagtaactgggactacaggcgcctgccaccacgcccgactaattgtttttgtatttttaggagagacggggtttcaccttggtctcgatctcctgaccttgtggtccacccgccttggcctcccaaagtgctgggattacaggcgtgagccaccgcacccagcctttttttttttttttttttttttttagatggagtctcgaccttttgcccaagctggagtgcaatggcatgatctcggctcactgcaacctctgagttcaagcgattctcctgcctcagcccctcaagtagctgggattacaggtgcccgccaccatgcccggctaatttttttgtgtctttagtagagacagggtttcaccatgttgaccaggctggtctcgaactcctgaccttgtgatccacccgctttggcttcccaaactgttgggattacagacatgagccaccgcacctggccttttttttttttttttttttttttttttttgagatggagtcttgctctgttgcccagggtggagtatagtggtgtgaacttggctcactgcaacctctgcctcctgggttcaagtgattcttgtgcctcagcctcccgagtagctgggttacaggcatgcaccactgtttcggctaatttttgtatttttagtagagacaagttttcactatgttggccaggctggtcttgacctcctgacctcaagcgatccacccgccttggcctctcaaattgctgggattacaggcatgagtcactgcacctagccctactttgtttcgtgaattttactactgcaggtacctcagataagtggagttatacagcatttgtctttttgtgtctggcttatttcactgtcacagtattttaagcaaagggccctggtagttctcatgtaggagtctggaccattctttgagaatttataggagaggatggtggcagggggtgggggctgtgctgtcctggcacagggtttgagggttgacttcatagggatggtgagggctggatgatgactcatcagtgagtgtgggctgagaggcgggaaggaggagatttgggtaagggtgacagtggggccttgggattggggtggtttctggcaggcattgctgagggctggggtgttgacaaaagcctaagaactcagagtggaaggacagtagaagaacagttgtgaggactggcccatgcagggagggtcagtgagccatgggtcagaggggaaggcaaggagctgataaaggaaggccagcagtggggagggtctgggtcaggtgggtgtctggctgtgcggtctacagagggtgagaggagtcgggtgagagccacagaggtcaatccaagtggaggccggggctgggcccactctaggtctagaggcaggtggtgtgacggcatgggaagtcagtgaaggcaaggaggccagagatgtgggaaagggggcctgtgggcacagggaaggactgatacggagccagccctctgcctcaacaagggggctgtgcgtgcttcctcctgaggaggacccgggtcatgggcagcctcctggctccaaggggagatgacccagaccctggggcgagtggtcgtagcagcccttaagtcacccagggattgggcagatgggccttcctctatctctccacccctctccctgtccatctcacctctccctttcttcatttgtgctcttcttgcttttctcagatccctttctctctgccattctctttctcctaactgccagtgtgcggggctgaggggtgcctgtgggtacccgcatcccggccagtctcccacacccaggcctcagggcatgtccggcttcacctgccatgggctgcctggcccccaagcaggcctttactgggctctgaacctcaccttccccatttgcaacatgtacagtgatagtgcaggttgagcatccctaatccaaaaatccgaaatccaaaatgtcccaaaacccaaacttttttgagtgctgacatgatgccacaaatggaaaattccacacctgacctcatgtgacaggtcacagtcaaaattctgtttaatgcacaaaattatttaaaacattgtataaaattggtcaggcatggtggcttatgcctgtaatcccagcactttgggaggctgaggtgggcggatcacctgaggtcaggagttcaagaccagcctggccaacatggcgaaactccgtctctactaaaaatacaaaaattagcctggcgtgccttctgcccactggatgccagtggaagccccccctagttgcgacaaccaaagcccccctagtagcctcaacatcctgcaacatacaggacggcctcccacagcaaagaatcctttggcccaaaatgtcaaaggcgtcactattaagaaactctgctccagggtagcttggactgtgtttgcagtcagaaaaagactcctctgaggtgtgccacctccccatgggccatcatccctgcagctggatgcaggaggctgaagctcttgcctgacaaaagtttctccccaaagccttctttcgtattggtataaataaaatctgacgttctttcagcttgcaggggttgaccccaggtggatgaggcatctgagttgtccagcagggacggtcaggtctcgggggactggaacaggcccagcatcttgtattatttagttcttctattgaagttcagcagctgggtaagcactggattattgtgaacaatgtggctgtttagaagttttggtttttttttttccctgaaagaaaaaagaggtgacagatggaggttggtgggagatgatgatctggtggaagtcatcattgaaattgatgttgcccacctgggatgatcactgtcggactctttaatcagcacccaagccccactctgtggctgcattaatgagcatctggatgatgggttttaaactcagctttttgttttttgttttttgttttttgagacagtctctcactgtcgcccaggctggagtgcagtggcgcgatctcggctcactgcaatctccgcctcccgggttcaagcgattctcctgtctcagcctcccgagtagctaggactataggcgtgtgtcaccacgcccagctaatttttttttttttgagacagagtcttgctgtcacccaggctggagtgcagtggtacaatcttagctcactgcaacctccacctcccgggttcaagcgattctcttgcctcaacctcctgagtagctgggattacaggcgcatgccaccatgcctggctaatttttgtatttttagtagagacagagtttcaccatgttggtcaggctggtctcaaactcctgaccttgtgatctgcccacctcagcttcccaaagtgctgggattacaggcgtgagccactgcacctggccacacacggctaatttttgtatttttagtagagatggggtttcactatgttggccaggatggtctcgatctcttgactttgtgatccgcccaccttggcctcccaaagtgctgggattacgggcgtgagcactgcacgtggccaacttttgtggttttgatagctaggggccagagctctagttatgagagttattctctaaaccctatgaggtttttcatgtgatttttggtttatgattgagtacacacattgatgaactgtgctttttgtttttcctatcttgtccactttgtgaactcaatcagtttcacaggttactttctctgtttctgacacctctccccctggtggaattacctattgctatatctggtcaaaagacaaaaattacacgtaggccccacgtagtggctcacacctataatcccagcactttgggaggttgaggtgggcagatcacgtgaggccaggagttcaagaccagcctggccaacacagtgaaaccccatctctactaaaaatacaaaaaaatttatctgggtgtagtggcaaatacctgtaattccagctactagggaggctgaggcacgacaattgcttgaacctgggaggcggaggttacagtgagctgacattgcataactgcactccagcctgggtgatggagtgagactctgtctcgaacaaacaaacaaacaaacaaaaattacaacatgtttagttagttaaagatcctaattggggctggacgcagtagttcacgcctgtaatcccagcactttgggaggctgaggcaggtggatcacttgaggacaggaattcaagaccagcctggccaacatggtgaaacatcctctttactaaaaatataaaaattagatgggtgtggtggcatgcacctgtagtcctaggtactctggaggctgaggcagtaggatctcttgaatccaggaggcagagtttgcagtaagccaagaccacaccactgcactccagcctgggcaacagaacaagactccgactcaaaaaaagaaaaaggaaatcaggagatcccaattgggccgggctaagtggctcacaccaagctaggaggcagaggtgggaggatcgcttgagacctgcctgggcaaaatagtgagacctcgttctccatatacacaaaaaagaacaaaccaattggctgttatttgcagttctagaatcatgcagtgtcttattctacaaaatgaaatgaatgttccaagaagctgagcagaggaggttaactttaaagacagaaaagagctgaggaaagcagaaacagagaacaaaaagcagatgggtcgtctcagagttactgtccttataaagggtttaatttttttgtttgttttaagctagagatggggtctcactatgttgcccaggctggtgtgcagtgactcttcacaggcacagtcccactactgatcagcatgggaagtttgacctccttgtaaaggctaaagcagaggacacttccttatcatgctggctgaaactggcctttttgaggattcggctgttatccctctttctcctgatttctcagaaggtcagatgaacagttttggcttggtggtgtggaacttgagcatgaataattccattttggtttgatctgttgggcctagggcaggagctcagtccaaaccaatggcctcctataattttatttagcaacctgtacacacatgcccatacattatgcaccccaaccctagctcttactgtagtctgtctctgtgaataaaatccccatatatatatatattttttttttttttcttttttttgggagacagagtctcgctttgtcacccaggctggagtgcaatggggccatctcagctcactgcaacctccacctcccaggttcaagcgattctcctgcctcaacctcccaagtagctaggactacaggcgcgtgccatcacacctggctaagtttttgtattttagtagagacggagtcttgccatgttgcctaggcagtctcaaactcctgacctcaagtgataacgcccatttcggcctcccaaagtgctaggattacaggcatgagccactgtgcccagccaaatcaccatgtaattaatataactaatatcatcatccctcaatggaagaagattctagaggacagggaccttgtgttgtttactcatctttgagcccttgaccccggcactgtgtctgacctgagataaggcttcaggaagtactttgtgagctgaactgaacttcaaagaagtgaatgatatgcagccatttgtctgagaaaatgacattttgggccactgaatatatactgaagagatgtgttgctgaaagttttagtagggtgttgggagttgcctgagagtgtccctctcttttttccaaaccaatcacagctaagatgatttccttggtgtcaaaaggcttgactgtttcaagaggcattttgttgttgttgtttgagacggagtctcactctgttgcccaggctggagggcagtggtgtgatcttggctcactgcaacctccgcctcccgggttcaagcaattctcctgcctcagtctcccgagtagcgggaattacaggcgcgcgctaccatgcccggctaatgtttgtattttcagtagagatgagatttccccatgttgaccaggctggtctcaaactcctgacctcaggtgatccgtctgcctcggcctcccaaagtgctgggattacaggcgtgagccactgcgccaagcctcaagagggatttttggaatgctaggcgaggtagagactacagacaccaagaatttaaggcatttatagggtatactttctaatgtgatcactgcaaaagtttgaattgtagaatttgttttcttttaaagaagtacaattatattactttcaaggatatactatttttctaagtttttttttttttttttaagacaggatctcactttgtcacccacactggagtgcagcgtcatgaacatggtttactatagcctttgcctctctgcctcctgggctcaagtgatcctcccacctcagcccctcaagtagctgggactacaggcatgcgcctccaggcctggctaagttttggatataatttaaatgtattgaaataagctgcaaggaatgatctaggctttgcataaccaagtaaaccaggtcttttaaaagagatacttagggatcataatgagtatacaaataattaacaggtatgttgtttataaacagtttattattctacatagttaaaatgcttccttatcttagttatgttgttaatttgcattgtagcctatgtttaaatgatcacaaattctctatcaggggaatgtttgcattaataaggttttacttcactgatctaacaaatatttactggatatctatcatatcccaggcctgggagatagcagtgattaagtaagttcttgtcttcctgaaataaactagtgaggcaagatgcgatgatggctggcagaagaaacagcttgaatgcacagctgatggaaattgctgataaattagatatgtaggaggcaggggtgagagacaaatcaaggatgacttctaagtttttggacttgacagctggctaaatggccttgtcatttactgagttgggagaaatgagaagagagtctggtaaaaaaaaaaaaaaaaaaaaaatcaaaactttacttttggatacgttaagtttgggatccttaacagacagccaagaagagaggccaggtgtgtagctggctatatacaactctggtgttcaggggagcagtacaagctagagatataattaaaaacaaaaattttttttttgagacagagtcttgctctgttgcccaggctggagtgcggtggcgtgatctcggctcactgcaacctccaactcccgggttcaagtgattctcctgcctcagcctcctgactagctgggactacaggtgtgtgccaccattcttagctaatttttgtatttttagtagagacgggatttcgccatgttggccaggctgatctcgaactcctggccttgagtgatccactcgcctcggcctcccaaagtgctgggattacaggtatgagccaccacacccggcccaggctagagatataaattgagggttgtattagtttcttttggttgctataattatcacaaactgagtggctttgaacaacagccacttattgttctggaggctattgtcttccagttctggaggacagaagcccaaaattacagtgctagcagggtcatgttccctctgaaaggttctagggaagaatcctcctttgcctctttctagctgctggtgctcagaatccttggtgtttcttggcttagagcagcataactccaatttctgcccccatctccatgtggctgcctttatctgtgtctctgtgtttcctcttataaggacaccagtcattagatcagggctgactctaattcaatatgacctcatggtaaaatttttttaattttaattttaatttttatttatttatttatttattttgagacggagtctcactctgttacccaagctggagtgcaatggcacgatcttggctcactgcaacctccgcctcctgggttcaagtgattctcctgcctcaacctcctgagtagctgggattacaggcgcctgccacaacgcccagctaatttttgtatttttagtagagacggggtttcaccatgttggtcaggctggtctcaaactcctgacctcatgatccacccacctcggcctcccaaagtgctgggattacaggcgtgagccaccatgcccagcgaccgcacggtaaaatttgatcacatctgcaaagaccgtgtttccaaataagattccattcacaggtactgggggttaggagttcaacatatctttcgagggggggacagaactctatccaccgcaagggccatcagtgtgtaggtgatatttacagccaagagactgcttggcaccaactgggagaggatggagtaagaacagagaggaccaagggctgagacttggggctctccaacatctgggatctaggaaaaggaaaaggaagaggatgcagcaaaggaaacgggaggaacagcaagtgtgagaggaggaaagccaggaggatgtgggatctagaggaaagctcttcaaaaggggttcccgactgtgtctgtccaggagctgtttgttactgctccacaaggaaacaccttatagaaactgagaccaggtgttctgcaacttttacagcaacctgacgctgccagatcacccaagcgtgtacttctttttctttttttgagtcaaggtctccctctgtcgcccaggctggagtgcagtggcaccatcacagctcactgtagcctcgacctcctgggctcaagggatccacctacctcagcctctcaaatagctgggactacaggtacatgccaccatacttggctaattttttttttttttgagacggaatcttggtctgttgcccagactggagtacagtggcacgatctcaactcactgcaacctccgcctcctgggttcaagtgattctcctgcctcagcctcctgagtagctgggactacaggtgcgtggcaccacgcccggctaatttttgtatttttagtagagacaggatttcgccatgttggtcaggctggtctcaaactcctgacctcaggtgatccacccgcttcagcctcccaaagtgctgggattacaggcgtgagccaggtgcccagctgaaaatccaattttaaaatagcaagttcaggctgggtgcggtggctcctgcctgtaaccccagcactttgggaggctgaggcaggaggctcactctagcccaggagtttgagaccagccggatcaacatagtaagagtctgtctctacaccgccccgcccccaaaaaagaaaaagattagcagattagcagattagcagggtatggtggcccgttcctgtggtttctgctacttgggaggctgaggagagaggatcacttgggccagggtggttgaggctgcaatgatgacacaggaagatcctattaaaaaaaaaactcatcgggcacggtagctcaagcctgtaatcccagcactttgggaggctgaggcgggcggatcacgagatcaggagattgagaccatcctggccaacatggtgaagccccatctctactaaaaatacaaaaaaaaaaattagccgggcgtggtggcgggcgcctgtaattccagctacttgggagactgaggcaggagaattgtttgaacctgggaggcggaggttgcagtgagccgagatcgtaccattgcactccagcctgggggatagagcaagactctgtctcccaaaaaaacaaaaacaaaaacaaaacccaaaacaaaccaaccaaccaaccaaacaaacaaaaaaacaaccaaaaccaaaaacccagcaagttccataccccaggaaccccctcagttccaggcaaaccaggacagtcggtcaccctgtcagcagaacaggcctgacagcacgcacagtgggatgtagggaaatggaagtgttgatggagggaagatgagctagctcttgatcatggcttaatttttcttggtgcacaaggcaaaatcatgaactgaaagcaagacgggagggaggctggaggctggaggctggaggctggaggatggaggagaggagcggagcagtcatcttgaaaaagggacaggcgaatttgctaagaaatgcagcagcatttccgggcagtgctgggtggcaacttgagatctgtggtcacaaatttaaagtgacgccagtttgcgtgagtgtggggtgtgtactctctgcaaagagccaaactgccagcatcctgttataatcaacttattggaacagaagacactgcttgttgtcctggaatatggttaaaatggatacattgttagaaacacattcctggtctgtaggactggcagatggagatagcagaagccaactcttttttttttttttttttttttgagactgagtctggctctgtcgcccaggctggagtgcaggggcacgatctcgcctcactgcaacctctgcttcctgggttcaagtgattctcctgcctcagcctcccgagtagctgggattacaggcaccacgcccggctaatttttgtatttttagtagagacggggtttctccatgttgaccaggctggtctcaaactcctgacctcaggtgactggcctgcctcagcctcccaaagtgctgggatcataggcgtgagccaccgcacccggcctgaagccaactcttctgaaactaaattaacaaagctcctccatcctcatctatttcttctactaagggctattaacaatgacatccagaccagtcacattgtcgaaaccctttgtaaccagataatcaactgtcactccttctgcccattttctgggcgattttagataactgatccttaagattaggtgattcaagaagtagcaacgtgtgtggatttagcgttagaagatctggattaagttatctatctaccgtttatcaaccaggtgccccttcaaagctcatctaacctgtaaaacttagtttcgtcataaaaatgtggctaaaaccacctgtgcttggctgcttttgagggtgtaaggacttcataaaatatgtaaatcaagtgtcctgtggcaaaggaacgttgcctgttgctgtaattatccacagcctggttctgggacagtcttcagtagtttccagttctgtagctttcacaaatagagacagaaaactgctgatccactgggtgtggccgctgagctttgaataactgtcagtgctaaagagggctgaggcaggaccagagagttgagatgagatgggagggcggaggtcaggtggcggaggcccagcgggtggagggtgggcgttggggtggggggactgtggtgagagagggaaagttgggaaggtaagacgctgacaagaggagttccaggtgccagcaggctctagggtgccaccttaaaaatgagattgctgaaataatgtgccttgtgctgtgttttaaaatgcaggggccaagaggccattttagaaggacttctatttaaaagtttaaatgcccatctcataaaggtttcaccttcagctattcaggaaattcttccctataaaatgactcatttattccccaaggattccacatggccatggtatttttttcctgggccaaccacaaagacatcagttcctggaagattgttcccattttgccgtgaactatcctgtggaaggttgtttttttttttttttttgagatgtcgtttcgctctgttgcccaggctggagtgcaatggcgccatctcggctcaccgcaacctccgcctcccgggttcaagtgattctcctgcctcagcctcccgagtagctgggattacaggcatacaccaccatacacagctactcttcatatttttagtagagatggggtttcagtatgctggccaggctggttatggaggtaatatttttgaattctcaattatggagaatttaaaatcctttttaggaattacttctaaaatccttaggcttggcccttctctaactattgactctgacaaatggaaatgttttatgatctctagattgattaaatttagatttcttcttaatttacttaaaaaggcaacttgggccgggcgcagtggctcacgcctgtaatcccagcactttgggaggccgaggtgggcagatcacaaggtcaagagatcgagaccatcctgggcaacatggtgaaaccccatctgtactaaaaatacaaaaattagctgggtgtggtggcacatgcctgtcatcccagctacttgggaggctggggcaggagaatcacttgaacctgggaggtggaggttgcagtgagctgagatggtgccattgcattccagcttggtgacagggtgagactctgtctcaaaaaaaaaaaaaaaaaaaaaggggaatttggccgggcgtggtggcccacgcctgtaatcccaacactttgggaggccgaggcgggcggatcacgaggtcaggagattgagaccatcctggctaacacagtgaaaccctgtctctactaaaatacaaaaaaaaaaaaaaaaaaaaaattagccaggcctggtggcaggcgcctgtagtcgcagctactcgggaggctgaggcaggagaatggcgtgaacccgggaggcggagcttgcagtgagccgagatcggccactgcactccagcctgggtgacagagcgagactctgagacgccatctcaaaaataaaaaggctacttgaagtcccactctaccacatgacagccacctcgtctccaggatacctgagaccactttatctctgggtcctaggggtcttttgttctttttcctggatctcagcagttgattccaccatccttatctgtctgctttccaaaactcacggcttgctctccttctcttctgtcacaatctgctcaagaaaggtatttttccctctttaatcatttttgtaaagatatcacaaaattaaaaattttaatcaattatttcatacaacccaaaagctgtttgaaagtgaaaagtgaaggtcaccccagccgccccctgctactatcaagtcacgccaactgggcctgatgtccacactgcctcttggggagctcccccaggctgaaggcttccaattttgtctgtggatcagggtctccagtccatctcctggtgctctcatcctcccttcctgtggacatggtcatgaaagtctctcatctcagatgcagcgtgtctccggatctggtttttgtttgtttgtttatttttgagacatggtttcactctgtcacccaggctggagtgcagtggtgtgatcttggctcactgcaacctctgcctccccagttcaagcgagtctcgtgcctcagcctcccgagtagctgggattacaggcgtgtgccaccacgcccagctcttttttttttttttttctttgagacggagttttgctcttgttgcccaggctggagtgcaatggtgcgatctcagctcaccactacctccgcctcctgggttcaagcgattctcctgcctcagcctcccgaatagctatgcccagctaatttttgtattattagtagagataaggtttcaccatgtagacaaggctggccttgaactcctgacctcaggtgatccgcccgcctccgcctcccaaagtgctgggattacaggtgtgagccaccatgtctggccaagagttgttggtggtacacacgtctaaagccactatggacagaccctaaatgacctgtaagagggatttcctatatgtcgtcttgggaaagatatttgacctctgtgtgtctcagtttcttcatctgtgacatgcaggagattaggggaccatgatgccttaaggctcttttgttttgactattctacgcatctggcctccttctcaatgaatatttctgggctttttcctgctcctgtcattttctgcccagcagaggggcttgtgtggaggtgtggaggtcaggagaggggcattcatctctgggctggctggctgtgtgcctctccatcactgggcccttctggactttagttttctcttctgagaaatgaggggccagggctgtgtgagctccaggagagtgtctggtcctgacatcccatgattttcatgacttcctcgtccccagggatgaccctctgatgctgaaggaacagtcagcttagggtaagtgatggctgctttcagtgtagactgaaggttttgggcaggggagaggctggagaagcaggatccatttccagtgccctgagtcagttccctgtggtctgatttgattttttcatgtgaagtgttgtgaaatctcaaaatatcacccatgtccacattcaactgtgagtacatttgtggtgcattccactaccaagtatgagtgctttggggaccctcttacctgtgagcttgggaacccctgctccttgcccttgtgtggggagtttggagaggtgctggggtgaccagccatcccagtttgccctgtaaactgtcctgcttttagcaccccaagaggctcatcccaggaaatccctcagtccaaaccaagacaggtggcaatcctacctagttccacaccagggcctggccagctttcttagtgggacaggccacagttaaacatagaatccagcagagcagtggactttgaaacagctggggtacttggggcaaattcctaggtcccaccctagagtgtctgattcagtaaatctggagcagggaccaggaattcacattgaataagccctccaggtgagtctggtgcaggtggttcaggatctacaccttgaggaaacagaaccagctcctgtccttgggagcagtggaggaaacagagctagctcctgtccacaagaggtttataacacaggcagaagaagccaggtagggaactaatgaaccctgacacagagtgaaatgaaagctataatgagtactggccaatttttctgccctcctcccaccctccaaagtaatttagtacttacaaagcttggctttgttgattataaggggtgacttggcattttccagcagaagagttgtagggagggtgagttagttgcagaaagtgactgtccactccagcttacaccagactctcccgtctcagaaccgtggtgcactctgtactgtatcctgtggcccctctggtgaggggatcaagtgggaccgtccctaaggcccactgaagctctgaccttctgacgtggggatgaagaagtggtcctgttcttattcttggtggacagctatcagttctgttgcttatgaactaagtattttctttctctctttttaaaaaaatttcagcttttcaggcccagtgcagtggctcacgcctataatcccagcactttgggaggccaaggcgggtggatcatgaggtcaggagtttgagaccagcctggtcaacatggtgaaaccctgtctctactaaaaatacaaaaaaaaaaattagacaggcatgttgccgggcacctgtaatcccagctactcgggaggctgaggcaggagaatcgctggaaaccgggaggtggaggttgcagtgagctgagatcgcgccactgcgctccagcctgcgcaacaagagtaagactccatctcaaaaaaaaaaaaaaaaaaaaaattcagcttctcttttagatacagaggtacatgcgtaggattgtcacatgggtatattggacccaagtggtgagcatagtaccaccagtaggtagttttcggcccatgtccccattcctccctcctctctctggtggtgacagtatctcttgttcccatgtttatgtctatgtgtgctcagcatttagctcccacttataagtgagaaatgtggtatttggctttctgttttcatgttaatttgctgaactaagccttttcgttcctttttttttgtttttgagatggagtcttgctctgtcacccagactggagtgtggtggcttgatcttggctcactgcaacctccgcctctgggttcaagctattcccctgcctcagcctcctgagtagctgggattacaggcttgtggcaccatgcccagctaattttcatattttgttttgtctttttttttttttgaaaaggagtctcggtctgtcacccaggctggagtgcagtggcaacatctcgactcacttcaacctctgcctcccgggttcaagcgattctcctgcctcagccttccgagtagctgggactacaggtgtgtgccaccacgcctggctaatttttttgtacttttagcagagatggggttttaccatgttagccaggatagtcttgatctcctgacctcatgatccacctgcctcagcctcccaaagtgccgggattacaccgtgcccggcatactttttgtatttttagtagagggtattcttttgtatatttagtagaagatttcgccatgttggctaggctagtcttgaactcctgacctcaggtgatcctcccgcctcggcctcccaaagtgctgggattacaggcataagccaccgtgcccatcctgaactaagacttttctaaggtgaatcaatgagctagagtccttagggcacttcattactgagatgatttgaagagttcctgaggtcaggtgactgcaggtaaagggcttgtttgttccctgggctcattcctgctgacaaaggacaaagagctggaggcatccctaggagaagaaaggaaaggaatgatgactctctgaaccacctgctccagactcagccgtaggcggtggcaggggtggggcttataagtgtgaaatcctagtctctgatccagatctactaagtgatctacaggccttcagaggaggcagggctctgctgtgggacatgaagttgatgggctcgtggggtgacatgccaccactgagattctagggagaccagccttgaatggcagcctggagctatggggccaagcctcacacctggccagggagtgtccaccagggtcaaactggtctgagagccaacccagccaactgggttgaaatctcagtcatgtatctgctgggtgctcttgggcaagttattaacctctctgagtgtcagtttccccctttgtaaaatggggtaataatgttccctatgttgtcagtagattgaatgaaataagcgtgcaaactgcctaaagcataaagaccgcctagcacagtgcttgacctgtactaaggttaacctttattatcattatcagccacagaaagtggcaaaggccaatgatgagggctgtattttttgctcaggctgctgtaacataaataatacagtctgagtggcttcaacaacatatacttattttgtcaccattctggaggctggaagtccaagatcaaggtgtctgcagggttagcttcccgagaggcctctctcggcttgcagatgctgtcttttccctgcgtcctcacatgcttttgcctctgtgcttgtgtacccctggtgtctctttgtgtgtctgactttcctcttttgttttttttggagacagtttcgctcttgttgcccagcctggagtgcagtggcgtgatcttggctcactgcaacttacgcctcccaggttcaagtgattctcctgcctcagcctctcaagtagctgggattacaggcacccgccaccacagctagttaattttgtatagtttttttttttttggggggatggagatttgctcgttacccaggctggagtgcaatggtgcgatcttggctcactgcaacctccgcctcccaggttcaagcgattctcctgcctcagcctccctagtagctgggattacaagtgcccgccaccatgcccagctaatttttcttttgagatggagtttcgctcttgttgcccaggttggagtgcaatggcgccatctcagctcaccgcaacttccacctcccaggttcaagtgattctcctgcctcagcctcctgagtagctgggattataggcatgcgccaccactcctggctaattttgtatttttagtagagacagggtttctccatgttggccaggctggtctcaaactgccgacctcaggagatccgcccgccttgacctcccaatgtgctgggattacaggcgtgagccaccacgcccggccacatttcttaaggaatgtggcttgggaggaataaaatgaaaggcaaaatgggggagccagcactgcgctgccagtcagcccagccttcatgggatcaggagactctcttaagggggccaattcctttaagtgtcctgaagccatttcaggccttctagcggagctagttggtgcatttccttaagaaatgtggccgggtgcggtggctcatgcctgtaatcccagcactttgggaggctgaggcaggtggatcacctgaggtcaggagttggacaccagcctgaccaatgtggcaaaaccctgtctctactaaaaatacaaaaattagtcaagcatggtggcgtacgtctgtaatcccaactactggggaggctaaggcaggagaatcgcttgaacccacggggcggaggttgcagtgaatgagctgagattatgccacttcactccagcctgggcaaaagagcaaaactccatctcaaaaaaaaaaaaaaaataaataaataaaaagaaatgcaaatctgagccttcagtggagatcacttaaggaaggtgtgggttctcaacttcttggagccgtttgaggaggggctggagcagacatgggggcaggcatttcagttccctgcatatcccatgacgagtgtggggagatcactcattaaatgcctctcactcctttctccctcttcttcctcttctcctccccctcccactcttctccccatcgccctggcagatctatccctgtgaaccctgaaaggctgggggtttctgggcttgacatctccttaccccataattttggctaaaggagcgggtccccagggtggcatcctgcgaaaatattgctggaatgagggtcagaagttccagctctcattatgaaacatttcagttccttcaccttcttattcacattttgtgttgttatttagattggtttttcataacttcttgaagatgggagggattcttagttcttttcttttcttttcttttttttttttttttgagatggagtctcgctctgtcgcccaagctggagttcagtggcaggatctcggctcactgcaagctccgcctcccgggttcacgccattctcctgcctcggcctcccgggtagctgggactacaggcgcccgccaccacgcccggctaattttttgtattttcagtagagaccgggtttcaccatgttagccaggatggtctagatctcctgacctcgtgatccgcccgcctccgcctcccaaagtgctgggattataggcatgagccaccgtacccagccaattttctttcttttttttttttttgagacagagattcgctctgttgcccaggctgcagtgcagtggcgccatctcggctcactgcaacctccgcctcccgggttcaacagattctcctgcctcagcctccagagtagctgggattacaggcacatgccaccatgcctggctaatttttgtatttttagtagagacggggtttcaccatgttggtcaggctgttccttgtgatccgcctgcctcgacctcccaaagtgctggaattacaggcgtgagccaccgcgcccggccagatgggaaggattcttttcaaattcttgggcagctttgggaagtaatttagaatttctgactgtgcacacggcagcatgtgttgacacaatcctcttgttgagatgtgttcctagaacatagcccgctaaattcagacctagaattcaaactctacctttgacttccagaggctcctcaagtcacccaccccttttggtggactgagacagccttgaatgctcttgcagctcttacagacaccagactggagccttcttgcaaggcagtggtgcagtgccaagttcaggtcctgggttcgaatcctggttctgctgttgactagctgggtctcctggggtgtttctaagcctcagtttccttatctctgagttgtcatgttcctgacacacagtaagtacccaataaattatagctaaattattattcttattattgttaccactcatttgacttccacaatccaaatggggctgaatgtcatggtttctccttgaaccaggatgaggtggaagagattacccttgagctgaagtcgtcatcagggaagctgatgacgagttaggcaagagcagtaatgattagctttaaggcattgatgatgaaagatcagtctgcattgtgggataaagcagacacattccttccgacgtgccatggaggtgatggtgtccattcctccgttaatgaagtatatagatgggggtggggtttggaggtgggatgctcctgggacatacgactttgttttgggcagcagatgggtgtagggtggtcatattattcttgcaaaatttgctgaaacaccttttttgttgaaacagagtctcgctctgttgcccactggagtgcagtggcttgatcttggtttactgcaacttccacctcctgggttcaagcgattcttgtgccttagcttcttaagtggctgggactacaggtgcgtgccaccacgactggctaattttttaatttttagtaaagagaaggtttcaccgtgttggccaggctggtctccaactcctgacctcaagtgatctgcccgccttggcctcccaaagtgttgggattacaggtgcggtaagccaccgcgcccggcctgaaacaccttttaccatctcacctgtcccattgtgtgagcccaggaagagctcagactcagggtgcagaggttgctgaagatgcctgctgtcatcaatctgggtcatccctaagcatgagaagacttagataaaggccaagataaaaatatggcatgaacatgaaggcttgaatgaggccgtccctgggtgactgctctgacaactccttcctattctgcctccaatcacccatccgtccacacaaccaataatagcagctcgtaagaaaccacaggaatccaacagacctctcagcccttgacctgtggaatcacagcatagaccctctctgcagacaatgcaatggaataggctgagtagcacgagttccagagcgggacggcctgcatccagttctggctttctcactgactgggtgcacttccttagcctcagtttccctcttgctgcaaatggagatagtaagccatgtacatcacagtatttctataaggataacatgagattacaaatgtaaactgcctgacataaaggaagtacttaacaaatgtatctgttattgtcattactctctttggggtgggatttgtgccctgccaggcaggcttcttaagattagtttgcaggctgggtgcggtggctcacgcctgtaatcccagcactttgggaggccgaggcaggtggatcacgaggtcaggagatcgagaccatcctggctaacacggtgaaacccagtttctactaaaaaaaaaaatacaaaaattagccaggcttggtggcgggtgcctgtaatcccagatactcgggaggctgaggcaggagaatggcgtgaacctgggaggcggagcttgcagtgaggcgagatcctgccactgaactccagcttgggtgacagagcaagactctgtccaaaaaaaaaaaaaaaaaattagtttgctagttgttacgagctctgaagtgccatctatcctatgagattaatttttttttttttttttttgagacggagtctcgctctgtcacccaggctggagtgcaatggtgcaatctcagctaagtgcaacctccaccttctggttcaagcaattctcctgcctcagcctcctgagtagctgggattacaggctcacgccactatgcctggatgatttttgtatttctagtagagacggggttttatcatgttgtccaggctggtcttgaactcctgacctcaagttatctgcccgccttggcctcccaaaatgctgggattacagacatgagccatcgcgcctggccaattttttttttagatggaagattttttatctttgagataatcctattaagcaaccatttcaaacaattactggcagccatcctgccaggctgtcagctgggaagggcctagagtggacatagggcgagtgtctgagaatgaggagggtcctggatgggaagcggggctggaggagggcctttctctgacccgacattttgctctggtcttgggttcctaaacacattatgttgttggttttctttaaactgaagtcttgttacaaggattgctttgaagccaggaggcggaagttgcagtgagctgagattgtaccactgcactctagcctgagtgacagactgagactcggtatcaaaaaaaaaaaaaaagattccaggaagaaccaacatctgagcctgccccctgcctagctttgggtcagtgacatcatctccatgtaccaaagatgggtctccgtctcatctcttctcctcccgccttggcctcccaaagtgccgcgattacaggcgtgagccaccacgtccagcctcttcctggaatcttgaactgagcttgccacccaccttctctgctcgttaaaaatgtaacaaccttttaatatttctgccatcagcacctattgtctggtgctgtgctagatgcccagaacgcaaaggcgagagaggcgtcccagtctgaaagtccaatgggcctagggctattggctgttgactgctctgctgatgacttcctctctctggtggagaagctcaaggagggtattgcaggcaagggagacggtgggagcagaggcttggaggtctgacggtgcatggcacttgcaggaaatggtgagggacacggcacagctggagctgtagtttgcatgggctggctgatggtgaagtcttatgtctgggggcagggagctgctggagatttttaaattttaaattctctattatttattttaaaatagaggccaagggtggtggctcacacctttaatcccagtactttggggggccaaggcagttggatcatctgaggtcaggagcttgagaccagcctggccaacatggtgaaaccctatctctactaaaaatacaaataaataaacaacaacaacaacaacaaatacaaaaaaaatagccgggcgtggtggtgggtgcctgtaatctcagctacttgggaggctgaggcaggagaattgcttgaacccaggaggcagaggttgccgtgtgccgtgagatcacaccattgcactgcagcctggatgacaagagtgaaactctgtctcaataaaataaataaagtaaataaataaaataaataaaataaaataaaataataaaataaaataaaataaaacaaaagaaaacaaaataaaataaaaaacagggtctcgctatgctgcccaggctggtcttgaactcctgggcccaagcgatccacctacctcagcctcccaaagcactgggattacagatgtgaaccactgcgctctgcctccactggagattttcacgcaggaaaaagacacgagttgacttttgttttaatcataatcatattcacagcaattatacctttcagtattgagcattttctttgtgctaggcatcagctaagatactttatcgtgagtcaactcattgaatcccacattacagatgaggctaggagagttcaccaagcccagtcacatagtggagccgggacgaaccaccacattggaagagttcaataaacgttagtcattgttatttttgccagtatttgttttcacgagcgtcccctggcatgccaggtgttgggtggtagctttagctttgaaactgcctgggttggtgccagtgagctggactaataaagccatttcatcagactagggtgaagaatagggtgcactaccagcctctgcccctgctctccccggttgctgtggttataagctgggcacctggttctctcttggtcgctggcccctctccagctcaggcctgggtgaccctgatcccgcctggtgttgccccacagctggctctctgaggttgcctcctgcctccctctctggtttcagcttttctacagctgagcagggggcagaccccacaggtggcagggtgcaggtgagctggagagaccaaggccagatagttatgaaaagtctccaggggaggcaaggtgaaggctggaagggccccagccagggaacggaaggagagagcatagctgtcagaaatacactggatttagacttgatagcctgtggcaaactcacaccatgagaagagagagcaagaagtgaaaaataaacgctacttgtagctcaaatgacctgatggctctgcgtggtgagccttacccattcccagaactttattattattattattatctttgagacagagtctcgctctgtcacccaggctggagtgcagtggcgcagtctcggctcacttcagcctctgcctccggggttcacaccattctcctgcctcagcctcccgagtagctgagactacatgtgcccaccaccacgcctggctaatttttgtatttttaatagaaatggggtttcactgtgttagccaggatggtctctatctcctgaccttgtgatccgcccacctcggcctcccaaagtgctgggattataggcgtgagccactgtgcccggccttcccagaactttaaataccatctgtaggttgacaattcccaactccttgggctccagccttgaacactgagctgcccctttcttcttcacttggatgtctctcaagcatttcaagctcagcatttcccaaatggaactcaaagtggagctccaaaatgatttgcctcccccacccctgaacctgcttctccatctcaacaaatagtatcagcccgcctgccttcaaactagaaaacttgagtgttatcctcaatgcctccctcttcctcagccctcacatccccttgtcagcaagtcctataatttccacattggaaagacatcacaaaggtggccacctctctccatctctaccgccaccactgcaggtagtgtggcgagtcaccaccatctcacctggacggctgtgagtccgcatggtccatgatctttcctcttccatccagctccacatttcagccacagggatcttttagtaacacacatttgattgtgaatcctcatatccgatgacttccagccacactcagcataacaaccaccatcttcctgtggcttacaaggttctacgccagatcccagcttcacctgatgtcccctctcctcatcactcttgtccctctagcctcactggcttccttttggtccccacacgccatgtctttccttcctcaggtcttcatccagggttcaccatcgtcgccactgttgggaatgctcgtccttgcctttgcgtggctggctccttcccattcttcaaacttcaagctaaatgtcccctctcaggtcactgcccacgacctgagagggctccacaggccctctcagcatcctctttagccagtcatttcattcagagcatacactgatcacaacttggaattttttagttgttcatcttatttattgtttctctcccccactagagtgtcaactctaccatacctattggaacatagaaggtgctgacaggtattcactgagttgacaaacaggtagatgatgagggcatgaacttcagaggtccacgggggcagagggccaggagaacactgagattcaagaggtgggcagaggggctgtcaagcggacttgataaggagggacagagggaggaggcagtaaccgagggaggagggctatgtcagcttgggaggcttttcactgtgggtaacagcaaagttgtccaggtgattagatgaaagggttgatttttctcacagtctgggtgttcagcagcaaagctctgtgtcagtgtcaccgaggccctcttgcctttctcctagccttgggcattacatcctcacatgatgcgttcaaaggcaggagatagcaacagcgtggaacagacgttctcctcatgcctcttttattggtgggatgtggggtggtgatgatggagggatcgtccccagaagattcctgctaatctccccctagatcccactgggcagaaggacacatgcttgctttggaccaggggctgtgcctgtcttggtgaaatcaaaaaatctctttcctgtccttgaacaaacaggattcttccagccaaggggagggaaatgccttttgagtaaggagggaatagcgcttgccattagcacatttcataaggaagagtttttctgctgggttaattgatgcagggaggtcgagtgggatgggtgctgagaagtagcccctagatgtgacacttagtggactatgtgtggcccttgagagggctgtttccatagaacggctgggcttgattgcacattttggcaggggagggggtgcttaggaattactgggagaagtttaggagattaagggggactaccaggaagcctagtgttgaaggtaagaggagaggtggcaccatcactgggtgcaggaggcagacatagggagatcttttcagtttgggggagacttgatgtttataggctgagcaaaaggagctggtgagagagagggtaaagattttgaagcaagatgggataatggatccccacgtcctgaaggaggcatggaggtggcatcgagtgcccaggaggtggtggttgtcactggatcaagcaggaaggcttttctgagaagattctggtgccttttgagacaggagggcaggaaggtggatgacaaaacatgaagatgcccggccaggacagatccccctcattttcctttgtgtgacagtgggctcatttagagattgaatccatgaccttcacctctcctgcatctttgttttaatcatctgatataatagactctttagaaaaccccagtccacatctgcgtggttgtgccctgggaagtcccgggacaaagctcactccttgggttttcttgtttggacgaacggaaccacccagtatatagtcatgggtgtggctattatgggatgcaatccagagggagcaggtcacttaacaaacagcacagagccaccagatcctgcagagtcaggtggggagccaggtggagggggagagccctgagctgggaagagaggacttgagtttcaggttccaggttcaggtcctggtcaagcacttacaggctaggcttctttggcgccctccgagcctgtgacctcatctgcagaggggtgggttggcagctcttcttctcccttccctgcccatagttataaaatgtgctgactccttgtaggaaattaatgaaatgccttcctgcccctcctgcatccctccctggggagcctgcccctgctctgtaccacccagaataggatgatatttttgttttggtttgcttgtttgtttgttttgagacagtgtcttgctctgttgcccaggctggagtgcagtggtgtgatcttgcaacctccgcctcctgggttcaagtgattctcctgcctcagcctcctgagtagttgggactacaggcacccgctaccacgcccagctaactttgtatttttagtagagacaggatttcactatgttggccaggttggtcgggaactcctaacctcaggtgatttggctgcctcagcctcccaaagtgctggaattataggcatgaaccactgcgcccggactgttttttggtgttttgagacagggtcttgctctgttgcccaggctggagtgcagaggtacaatcgtgggtcactatagccttgaccttccgtgctcaagtgatcctccccattcagcctcccaaagtgctgggattacaggcctgagccactgtgcctggccaggatgttgtttttcttcaccattacccctgttctctcacttctggcatctttcctcctttgttttggggaatgatggcatggggcccagggagtaggattgggagccaaacctttctcctttatttattcaaatcgtagctatggatgcagcaaaaagcaaacagaagtttgactagatatatgagctcagtattccacaacatttaaagctggtgtgtacttacgtaggaggcttaaaacataacattaggttaaaatgaataatagccccaacagaaaaaaaaatagtgcattctaaagaagttcttagcgggaatgttcagaagcttggttggtttgattgacaatagctctgtatgtctccttctcggtagctccttaatgcagatctctgttgctccctgacttctccactgggtcacgtgtggccaggtgtcatgagcataatatccctatcatcgctgtctggcagggtgagagttcagaaggagtcatatttgcttttaggtcaccctctttatttatccagcacgtggggtaggactgtgaccgaaggagggctccatgcacgtctcctgtgttgttggaggaggtagtgttggtaatgggcgaggaacagagtcgtttggtcccagcaaagctgcttccatcagatcggtcctgccccttggctgggctgcctggacttcacttcatcatctctaaaatgagattaaagattgtttctccctcatgggaaggctccgggattcagtgagcttatgcctgtttaggaaagtgtctggcacagggtcactgcccttgtgccatcacatctgcccagatgaaatcaggtaatcagctgacgcacccggagtgcccatcgcgcatgcgtgctgtgccccatgggaaaggggcgtcagatgtgactctgccctcaaggaatccgcatctagcaggagaaagaaaaccggacactttggagataaatagagagctagaaggccagcgggacccccgcttccccacggcgcggacatcctggagggcgagcagctgccgggcggggcacgctgtcagccaaccctgcctaatctcctggcagacagagctgagagaaagcagaatctggtattcattgtgcggttgtttctaatttccttctgctttcgagatcctcttctaagggagaacaatgccctgaatgatggggcacaagcttccttggctgggcacccacccagctgtggcagaggccgggcactcacagggccggtggtgtttgattctggcctctgagaagctcctccgacagtgggttttggtggctggtttgagtcccagcccatagaacaagtccccccaggctcacttatgagtattatctttaaaatttccctatctgccaaagaagaacgccttttgtgttatcgccagggttgttacgaggccgggtgggtggagggggcactgaacctcagaactctctgtaggatccacatctggagccaagaggccgctctgtgccaccacactccccggagtgtccatcgtgcattggagggggacggtgttggcctcaagtgctgccctcgcagctcccgttcacagaccatgactgagaggactctcagcagaggaccctggggtgacatttctactgctggtgcctcataaggctggccaggggcaggaggcccagggctgagtccaaggaatggggtggggtttcctcattccttgctgtcttcatacttggccttctatttgtagatttcagtaatttatcagcctttctaggttcctctttcatcaccagaagcagaatgaacctaacatgagaaacccacatgcataaagggctgagagaggctgaggggcatttgatgatgactttcaagtctatggggctgtatcgaggaagatgctatggcagtggcaggtgagagggtgagtgaggggctgcacagccccaagaggccctggcagggttagctgtcttcaagatgagcaagacccagccgggcgcggtggctcaagcctgtaatcctagaacttggggaggccgaggcaggcagatcacctgaggttgggagttcgagaccagcctgaccaacatggagaaaccccatctctactaaaaatacaaaataagccaggcgtggtggtgcatgcctgtaatcctagctactcaggaggctgaggcaggagaatcgcttgaaccctggaggcggaggttgcggtgagctgagatcgcaccattgcactccagcctgggcaataacagcgaaactctgtctcaaaaaaaaaaaaaaggccgggtgcagtggctcacacctgtaatcccagcactttgggaggccgaggcaggtggatcatgaagccaggagttcgagacaagcctggccaatatggtgaaaccccatcactactaaaaaatacaaaaattagccgggagtgaagtggtggcatgtgcctgtagtcccagctacttgggaggctgaggcaggagaatcgctgcaatctgggaggcggaggttgcagtgagccaagatcacgccaccgcactccagcctgggtgacagagcgagactctgtctcaaaaaaaaaagaaagatgtgcaagactcgagccaggtctcccaggcttaggtcacccaggtgcatcctcatccacatgccattctcactacaatttgtttaatattttccttttttttttgagatggagtcttgctctgtcttgcccaggctggagtgcagtggcacaatctcggcttactgcaacctctgcctcctgggtcaagcaattctcctgtctcagcctcccaagtagctgggactacaggtgtgcgccaccacacccggttaattttgtattcttagtacagatgggtttcgccatgttggccaggctggtctggaactcctgacctcaggtgatccgcctgccttggcctctcaaagtgctgggattacacgcgtgagccactgcacctgggcaaatatttttctctaaatagatttattgattatttatttttgagataggatctcactctgtcacccaggctggagtgcagtggcacaatcacggctcaccacagccttgacttcccggcctcaggtgatcctcctgtctcagtctcctaagtagctgggactacaggcacataccaccatgcctggctaatttttgtatttttcatagagataggattttgccatgctgcccaagatggtcttgaactcctgggctcaagcaatctgcccgcttcagcctcccacaaagcgctgggattacaggtgtgagctgctgtgcccggccctaaagagatttattttgaaaaccttaatcatttaattaaaaagaaacatttatgtcactactgtaaatgaaacccagcattttgctgacagacattgaaataagtacagacggaactgttaaaactactcattctgtccctttgatataatcttgaacaccacccattgctttgtataaggtctcagtgtataaatctttctgtatgatggcagctccatgtgtgtctgatggagatgttgcaggggagcttgatgttgtcaaggagtagggtgatttgcgccgacttgtgaccccaccaaagatgctgggggtgacagccctgctgcctgaccaagggcttgctggccccatattagcatctctaacaggggaggacgacagtggctgcttcagagggctcggtgagggtgaactgagctcctggaggatttatttatttatgtatttatttatttttgaggctaggctcggtggcacatgcctgtaatcccagcattttgggaggccgaggtgggtggattacttgaggtcgggaatttgaaaccagcctggccaacatggtgaaaccccatctctactgaaaatacaaaagttagctgggcgtgatggcatgctcttgtaatcccagctactcgggaggctaaggcaggagaattgcttgaacccaggaggtttaggttgcagtgagccaagatcgtgccactgcactccagcctgggtggcagagtgagacaccatctcaaacaaaaataaaataatataaaatataaaataaaatatttatttttgagacaggttctgactctgtcacgtaggttggagggcagtggctccatcacaggtcactgcagcctctacttcctgggctcaagtgatcctcctgcctcagcctcctgagtagctgggatcacaggtgtacacggtaccatgccaggctaattttaaaaattttctgtagaggccggacgtggtggctcacacctgtaatcccagcactttgggaggccaaggtgggcagatcacttgaggtcaggagttcgagactagcctggccaacatgatgaaccctcatctctactaaaaatacaaaaatttagccgggcgtggtggcacacacttgtaatcccagctactcaggagactgaggcaggagaattgcttgaactcaggaggcggaggttgcagtgagctgagatgatgccactgcactccagcctgggcaacagagtgaaactcttgtctcaaaaaaaaaaaaaattatacagacgggtatctctatgttgtccaggctagtcttgaactcctgagctcaagagatccacctgtcttcgcctcacaaagtgctgggattacaggcatgagccactgtgcccagccaccctatagtatttataaagtgtttagaaatagtgtctggcacatagtaagcacttagcagatgtgaacccccactataacttgggagattttggctgagggccctcaactgtcctggggatctgcctttgtggagacggggctgggatggacgctgccaggctccctctggctctctgcagatctctgttgttccctgacttctccatttggtcaggtgtggccaggcagcataagcatcatttcccccctgattatagggttaaactaagaagtgatcatgacaggcgtcatcatgaaatatccccactgcaatcggtggccatctctgtccactagaggctcagaaacgggctcccagggatggacactggcgtgcactcctgggggcttgtgggatctgtgtctgccgttccctctggccagccacgggttgtttctggaatggggctcgtggctgggagggaggaaggagctgtgggaagcaatcccaggttccttggtgggattggaaactctgcctcaagccctggaattttgacttcctgtttggcctggcacttgttccctaacattttcggctctgacacatcctctccctccccctctcagtgtcgtttcctcatcgtaaaatgagggggttgcactagatcatatctaaggcccctgtgagcttgagaaagccacgattctacctcccggccaccccctcacttttccctcagggcccttgattggcagtgagtggagaggtgggaagaaggagagaaatcgcaatagctgtgcatcaggccacacgcaggatggccccgtggcaaggaactgtccagtccaaaatgtgaatagtgccaaggtggagaaaccctgttttagggaaggaaagacagaagagaggagagacttaaaagacaaatgcggccgggcacagtggctcacgcctacaatcctagcactgtgggaggcggaggcgggcggatcactggaggtcaggagatcgagaccagcctggctaacatggcaaaacctcatctccactaaaaatacaagaattagtcaggtgtggtggtgggtgcctatagtcccacctactcgggaggctgaggcaggaaaatcacttgaacccgggaggcggaggttgcagtgagctgagatcgcgccactacactccagcctggatgctagtgtgagactccatctcaaaaaaaaaaaaaaaaaaaatcacacaaaaatccaaaacaaaccaaaaagaaagacagatgcacacatgcactacaaataataaatggttagacaaatgataatgaaaaggaacatttagggataaacaaaatgcataggaaaagggtttatgaaggagattggacaaagttgccaggataggaaggatgtgtttgcaaagtggccatagctgggctgggtcgagtttaaggtgctagccctagagtactaaccagcattcactttacagatgagaaaaatagggaaactgcccaggcgcggtggctcacgcctgtaatcccagcactttgggaggccgaggtgggcggatcacaaggtcaggagttcgagaccatcctgactaaaacagcgaaaccccgtgtctactaaaaatacaaaaaaaattagctaggcgtggtggcgggcgcttgtaatcccagctactcgggaggctgaggcaggagaatggcatgaacccgggtggtcagagcttgcagtgagcggagatcacgccattgcactccagcctgggtgacagagcgagactccatctcaaaaaaaaaaaaaaaaaaaaaatagggaaactgagagggatgggtgtccatccctctccttcctggttcactttggaagatgccacctctgttaagggccgctcctgtgggatttcagcaatgcagccaggtcagcagtggtacctgttgatgctacacagcaaccttaggatggcaggctgcatagtccaaaggcccaggaagtcattatcatatgagcattctcatgtgagccggtcatgattagtttttctatgagacctttgctcctcattgaaataacaacaaatcagttgtctccacgccagaggaagataccacataaagcaagactaaaaggagcagagaacagagaaggtcttcctggccttagggatgggcaaacatttctaaaacagaatgcaaacagcactaaccacagaagaaaaatcgatgaattggactttatcaaaattaaatcctctcttcatccaagggcaccattaaaaaaatgaaaaggcaagcctcagacctggagaagatatatatctgcaatacatatgtctgataaagtattcgtttctaaaatatttgaagtactgcagatcaataagaaaactaaaaatgacccaattaaaaaaatgagaaaaagaggccaggtgcgatggctcatgcctgtaatctcagcactgtgggaggccgaggcaggtggatcacctgtcaggagttcgagaccagcctgataaacacggtgaaaccctgtctctactaaaaatacaaaaattagctggacgtggtggcaggcacctgtaatcccagctactcgggagtccgaggcaggagaattgcttgaacccgggaggcagagttgcagtgagccgagatcacaccactgcactccagcctgggagacagaacaaaactcagtctcaggaaaaaaaaaaaaaaaaagagagaaagaaaaagacttgaccaggcactaacaaaagaggatacccagatggccaaatacactgtgaaaaggtgctcaacatcattattcatcagaaaatgcaaatgcgctgggaaattagctgagcctggtggcacaagcctgtagtcccagttatttgggagactgaggtgggaggatcatttgagcctaggagtttgaggctgcagtgagctatgatcatgccactgcactctggccttggtgacagaatgcaaaagaaaaaaaaagaacaacatagacacacaaaactcccacaaaaagatactactacacacccaccataatagctaaaatgaaaagactgacaataccaagtgttgctgagaatatggaacaactagaactattgcatattgctgtggggagtgtggaagaggtacagccactgggaacattgtttggcagattatattaaagctatagatatgcctgctgtacaacccagaaattctactcctaagtatttgggtaagggatttgggctgggcgtggtggttcacacctgtaatcccagcactttgggaggccaaggtgggtggataacctgaggtcaggagttcgagaccagccttgccaatatggtgaaaccccgtctctactaaaaatacaaaaaaaattagctgagtgtggcagatgagtgcctgtaatcctaggtactcaggaggctgaggcaggagaatcacttgaacccaggaggcagatgttgcagtggctgagattgcaccattgcactccagcctggcagacagagtgagactccgtctcaaaacaaaacaaaacaaagctgaggggtttgagtgcctatgctgacaataatgtatgtacaaaaatgttcaaagaagtttctccaaacctgaaacaccccaaattcccatcaacagaagattggagaaataaattggtgatctattcatataagagtactatgcaatgatgaaaagattatatgctctgattccattaatatatggttcagaaagaggcaaagctgatctataatgagtcaaatcatgattctgtctggtggggatatggattgggagggtgcatgagggaacgttttggggtgctggaaatattccttatgtggcctggagtggtggttatagaaatgcctatttatgaaaatgattatcaagctgtccattgtgtgctttatgtactctgatgaatgtatgttatacttctttttttttttttgagacagagtcttgctcagtcacccaggctggagtgcagtggcgcgatcttggctcactgcaagctccgcctcctgggttcacgccattctcctgcctcagtttcccgagtagctgggactacaggcgcccgccaccatgcccggctaatttttttttgtatttttggtagagactgggtttcaccgtgttagccaggatggtctcgatctcctgacctcgtgatccacccaccttggcctcccaaagtgctgggattacaggcgtgagccactgcgcccggcctatactttttttttttttttaatgaaaagaaatgcagattttcatgtccaagagaagtaataacaataataatttatggagcacccaatatgtgcctggttgctttatagagattatttgccttaatctatccaaaccacctgtcaaaatgatattcttttcttgttagagaggaggaaactgaagcttagagagggacaatagcttgtctgagtatcacagctggtaagtgtgggagttagacttgaatgccatattctgcactgttgccacttggcttgggatgttgagagtgaatcttggtacagcatcaaagctctctgtgttgcctgctactcccccggagcatcagatgttgcagacaccattctttaaagagaacttcattgtgtgaaccccaagttcccccaccttcttcaaaacaaaaacatgaattgggaagcccagcccctttatgaaccctttccatgaatttgttccaatcaggaaaagagcctgcaacttcctccccaccctgttcatcctaactgttctgtgttgtgaattcgctgagaatgaaaggggatgggctagagctgtcaatactgtgagccaggcttgaactccagctctgctccttttaaacagtgaggctcttgggtagttatttaacttctcaaagcctttgtttcctggtctgtgaaaagtgacagtggtacttcccttctagtctcactgtgagagttaaatgcggtcatatgtaagaagtgctcagctcagcgacaggttcatagcaagtgtgcaataaaaggtagtgtagaaatgtcaaaactggctgggtgcggccagcctgcaatcccagcactttgggaggtcaaggcaggaggattgcttgagtccaggagttcaaggccagcctgagcaatatagtaagaccccatctcttaaaaagataaataaataggccgggtgcggtggctcaagcctgtaatcccagcactttgggaggccgaggtgggcggatcacgaggtcaggagatcgagaccatcctgtctaacacggtgaaaccccgtctgtactaaaaatacaaaaaaattagccgggcgaggtgacgggcgcctgtagtccccagctactcgggaggctgaggcaggagaatggcgggaaccccggggggcggagcctgcagtgagccaagatcgcgccactgcattccagcctgggcaacagcgagactccgtctcaaaaagaaaaaaaaaagataaataaataaataaagctttcactttcctggtgcctaattccttccaagcctcttaaagaggcttagcacctttgccctctaaataattcaacacacatttggaagaaagaagttatgtgaatggtttcttcacaaagtgtaacatatagtgaataaatggggcagaattgcaggacttcagcaaggaaaggggggcattttgaactagagtggtcagatggtggtattatttggctgagtcttcaaaaatgggtaggatttagtcacagagagaagaccaggaaggtcattctcaattagggggagggcaggaggtagtttttaggagccaaggtaaagtttgggaagggtgagcaggtgattttggttggtgcttgaaacttgtgtagggactagtagaagataaagtaggaaaggaggcctggttccagatgaggtcccattaagaaagctggcttttttttttttttttttttttgagacagggtcttgccatgttgtccaggctgaagtgcagtgacaggatcttggatcactgtgcaacctctgcctcccggattcaagtgattcttctgccttagtttcctgagtagctgggattacagtgtgtgccaccacacccggctaatttttgtatttctttttagtagaggcagggtttcaccatgttggtcagcctggtcttgaactcctgaccttaggaggtccgcctgcctcggcctcccaaagtgctgggattacaggcgtgagccactgcgcctggcccgaaagctggatttgtttctgttggaaaaggagttgctgaactttcttgagcgcaggaggtgtaagatgaagcctggggcatgcaggcccacgtgggaggtgagagagaccaggccaggaggcccatgagaggacaacctgcgcattcatgggagtccgatggggatgagttgggtgtgactcggggaggaggcactgggctgggacagaagatgtagtagttaggctctgggagacgacagggagggaaggtgaagggccatgaagtctcaaagccagttgcttgggttcatgaagcagaaagggttcatgaagaggaaagggaagagagaaagtcagtttggagatgataatgaaagggatttcttaatggctgaggctggaggtggcagctgttttcacggttcctaccttcctctgttatttgaatgttcttgggaacacactgtcctcttctggtctcgggcttgtatggggggcaccaaaaggacagactcgggctttatgcaagcttcctttccacccttgccgcacagaaaccacacagagggaggcgtggcaagaccaaaagagacccaacagcaggatcctttccaaatctatcccttccagaggcaagcatttgtttggatgccctagcaaggagtggggggaccttctttcagttggtgcaaagttaacgaaccatcttctgattttatggagagatgcaaatagtgtgttgaatataaatctctttgttgttgttttacaggactgtagaagcggccaggaagaaaaccaccccctcttaaggttgtttttgtgaccgttctttggagcattgttctaaaaatgggaaattacatattgctgtgccaagggcaacaaacacctgcagttaaaggaataccttccgcgaggcggcttttcggagcatgcatgtttatagctccagccaggccagaccgagggctgctgcataagccctgcttggtgcatttctttacttgcaaggggacagagtgtgggcttaggtttgggactagagggggctttggcaactatggtgctcaggtgattatccttcgctcgtttatccaataaacatttatcaagcatctg

SEQ ID NO: 37592 - DNA, 20789 bp, Homo sapiens
tggcttagaaacctgggacgattacaccctaaaagcgcttggaaaaactgcagaactcgtgctgattttcgccaaagctactcccccgccgtgagggcaggaagccctgcgaggcgcctgcgaggacgcaaacgccgcgaagcaagtcctccacgcctccatcccaggtttagtgaagtgtagactctgacccacagcctaaaggaaagcaagaccggagtcggggagggcccctccaggagcgggctcagcgggagtctggccgaactgcttgctgccacagtggttccgcggcctcgcgctgagcgccatccgccgtctcccaccgcggcccccaccgcccctccgcaaggctcggcacctcccgccacttcctcggtcgctgcggcggctccggctcctcacagccgctaaacccaggcctattctgtgttaggtcgggcctcctcggccctcttcgccgtgacgaatcagcgcccggctgggaaagtatcaaaattcggggagttttgaggatccaatgggtcctgaaaaaaatccctgagtgtgctaagcatcaccgcatcttcactagaaggttagtttttctaaagagggtcgggtggggcccggaaaaaaaaaaaaattaagaagagtgtggaaagtgcgagtgcggaagctccggacgcgaggggcggggcgagcgcgggacaaagggaagcgaagccggagctgcgggcgctttttctgcccgcgggtgagtgtttccaagtgggacggaccgggtcggtgggtgcaagtcgtggtgtccccgcttggctagaccccgagttcccgggggttgctggggttcagccttggccgtggggccagagccaggagccggttgaggcctccttgaggcctagcagagcgagggttgggagggagtcccatctggggccccctccttggaggcaaggccagtcccccgaaattggtcaaagcacctgtgaataccccgttttaggggagttgctagtaaagtacattctccaagacaaagagagcgacctcaggaagccgtgggcaaggcaggtccgtggttcaccccccacccgggcagaaggttcccccattggttcaggcagcgacttgaggacgagcagagctctgaaatagtttggcctgggtttgaaacccaactttggcacttcctggctgcatatggcttcagacaagttgtttaaactttccgagactcccttgtttcatctgtaaaatggggatagctgtacatataaagtacttgtgagtgttaagcgaaatagtgtcataagcgtaccccgtataaagtatttcttgaacaaatatttatcgggtatttatttttatgccaggcaccaaagatggatccaacggtggacaaatgtacaagcccactcttaaattttgtattctagcaaaagagagcaataattttaaagtattaacaatgaagtataacgtacagggagcttatgttagttgtcagggtcccctgcagcgaggcctgctggatgttgacagctcccttaatgtgagcagaaaggaaatctacaccagagtcaaaggtttctggctgttctttaagagggaaagactcaggttggaccattgagaaaatgagctgtttctttccacaccaggactcattccttatgctccagggaatttccttaaaattaataatagaagcgaaaaatcagatctattccacatgtttggttgcaaatacctccaatagtcatagaagtttatttgccttctttccaaagatgaatttttgtctttttgtacctcactatttgtgatgtatgttgatgtaaagaacaagctcacatgtgcctggttatgttgtgagctggtaatactaggaaaaaatttcctaagaattgagctaggtcctgacatggtccctctttccaagtagcatacaatctagccatattgataagttaaaaaaaagttataataatatagatctgtgtaaactgtataggaatacagatgggggagcagttaattctgcccaggtaatgtatcaagaaagttcccttgaggagaaaaattttgaaatgggctgtgaatgatgaataaaagtttttcaggtagactctcaaaatttattcccagcatttatgaagctatttaccattataagagaatgtgaagttcattgtcataccaattaccttttgcactgcttccaggaataaaatgctgcctaattttaataaaaattgttatcccaaaagcatgatacagttgctgatcagggagctgtcagtatctggtaggccttgttgcgttggaccctgataatacatcactttctattctcatccttgtatcagtctgatgaaatgtttacatggcgtcagcaaaatgttttccatacaagaggtagcttagtatcacaagaaaaaacctgaaagtacatttctaaatatccccagtactttattttagtcatttaattctaatcaaccaaatgacctataagaactagttaaaatacacaaaaggcttaattactaggaattaaggtgaagtaattttactcagaaataccaattaaattaccctattcattaggaaaacattctcgtatgcttgctgagttttgattctcttttttttttccttttttttttattttagtgtctcagattcattcttaaggaactgagaacttaatcttccaaaatgtcaagtaagtttcaatttttatatttatcaatctatgttaataagagactaatgccctagcaagtgggaattccaaaatactctcatttttttttcttcaaaacaggaccattggtagttttgttgcatagtattatatctcagttgtttacaagaagttatttattttctttcaaacagaaagaccatcttatgccccacctcccaccccagctcctgcaacagtaagttttaattttcttgttaatgtaatagccaactctggccttgatacaaaaacccagatgtcttccagtgacagtcactcaatcatcacagcaacaggatgaaattcagcttaaaagaaaaaaaaaaaagcacttcctactaaataaaataattatttgcatctttccttgaaccaaccccaacatttaaagaaacagtactgtaaaactccaacctcctgtgctcagtttgttttgttttttctttgtaaatgggaaataagtgaaagttttaccatttctttcttattaatcttcactattaagagtctttaagttgttactgagtgaatgctcattctggctattttgttaaacctaaccttcaactggttatgtttttctctcctttcttgtctctctctaaaattttcatattaaacaataaagcttctgaaactactcattgtaaatattttcaagctgttcaagtaaagatttcattatctatggggcagatcttgctattgaatcttattccactccataaattatattttattggtttggaagtatatatgttttaagtagttgtgaacgtgttttttcacccaggaagctctggcccagcttggtcagcatgtaaaataattttccaacccacaaaacagatttagcagtaactgttcaggtcttgctgaaatggcttccttgttggttttttgggagggggggttttgtttgtttttaaaaaaacactgttagcatgaccaaattctacaaaattagttctttaatattaatccttccttccatacccccaccacctaaatttcaggctagtctacttttcactactaattaggtccttgtgtaacttagttttctccgctaaaaaactactcatatttactaaccctcagatacatattttagttacatttatcaacaatttgtttttctttagtgagatactttagaaaagagataccgtaccatatgttctcatttcaatttatgtcatatacaggctctaaagttaattccagtagactataaagtcctatgcttgctttgttttctttcttaaatcgaagaacatttgttatgaccatctccatggcattctgctagtggctatacaggtggagctgaacaattgagattctgacctcaaagagctaaccatgtacttcagctttggaaatggtataattataatgttttgctttccatttttttttttttagttcccttatttttataacattattgcctcataatgttgaacagtgattcttattatttatgctacctttgaaggtgtcattttgacaaaaatactgcctctgacaatgcatcatcttgacaaacttgattttttgagattaaaatatttcaaaaaccaagtgtccccttataatttattatgcataaaaaggaattttttttgcctttctttagttatatttttgtgtcattatagtttcacattaacacacaaaatatagaagactagggattaaaacatccaacagaatggatactaaatgaattattcttcttccttttttctttccattacttctaccaccaccaccaccatcaccaccactaccaacactatcaccactatcacctctgccacccaaatgtaccgctgcaagtaatatacacttctttcatgcctttgatacttcaactgtgttttgcctacttaaatatgctttatttgcgtcttttctaactgtatagactagaaattgatcagccgttctcttttctcctaaagagtatcaaatgtaatatctgcttaaatgtctttcttttgggtactaaggatatgtgcagcggcatgttttaggaaattgtgtttattttgtaacagctacagcttagttggaatgtgttaagtgtattttacattatacaattaaggaccgatattgttaattgcatgtaaaaatgaaattgtcacatattttgattgaattttacaaggtaaaataccctaattttggtctctctctactatattctttctatgcattatgccttggttctcatgaacattgagtgtcattgtattagccccaaggctactgctatataagagcccatttgtgattacatcaacacataattcacaaaaaccaagggttctgttgctgaaatgagcagttgtattttgaaagggtgagagctatcaggaaactagatgaaaaaagaagtctataaactagaaaagtagttcacattgagacaaaatgcagaaatgttttcatgattgaccagtggaagatggatcaaagaagaaatggaagagaaatcctataaaagaatgactgggttaaaaagatcagatagtaccccagaatgaaatccatgcatttcttacaagtctttgttttaaatcatgtatgtgacatccatcaaatccaacatatgttcttttcaattgacaaatcctggcttcccgatttgagtctctactcatttctcacattatataaaatgatttaaaactgtcgttgaaatcagatccatttcttttttttgtttttagtagataaatacattggtggcatccacatgtcaaataaattgtattttgttttgcatgtagtgttttcagagttctagttgatcacacttcaagccttcctatttcagtcttcatatattgctaagttgttttatcctattgttgaccataaagtaatcctgaatgttttaaacacttcagtgtgttgcttacctcaaaaaacaaaacacacattcacagtcacacaaacacccccagcccctgcaaaaaagaaagagaaaaacaaccaaaagacactgcagacaggtttctcaatgaaagaaaaatatttaatttcctcagtggaaaaaaagaacaattacaacacatcattgcttgtttaaattcaggttgcttttgcatgccatatgcagatcatttttcatttctgtgttttcctcgtttgagctcatttctcattcgtgtttttgtctcatttgtttccatcagcaaatgcccagcacaccagggtttgtgggatacaatccatacagtcatctcgcctacaacaactacaggctgggagggaacccgggcaccaacagccgggtcacggtaggagaatcaactattacagcatccggcaaacaactggaattgaccagaaatgccttcagaattaggtctttttgaatcataagcacagccatttaaaaaaaattttttaacctagctttttgagtattttcaacattcgttgtagcatctcacactgaaaaaataaatagtgagatctggaatgtatatagaagaaaagaaaaatccattctgtttggtggttggtagggttaaagccttgagcacttgatgcttatactgtatgtaaacaaacagaatttcttaaggtaaaaatatcctttttgacataaagagtatttttcatttttataaggtgattggcattagtctcaaggattgagtttctagtagaggctggtctttcagacctggctttttcagggctggaaagcttttggctggtacaccagtttgaatcgctacccatagttatttgtcttttggatttagtagttgaccttctaactaagactcatttctctacagtgaaaaagagaaaaacgttttaatgtcacctcaaagaaatgcagagtgaaggttgaatgaaattaatttgaagtatcagactagatatgtacaacgagaagtgcatttctaatccttagtataagagataggatttctgaaacttagcatgtttcatttaagtgatcagcctaagatatcaaaattggatgatacacttcaaatcttttagtttagaatcatcttaaatttcattcaaaaaagtttaagcaccaaaaaatgccaataattataaaaatgacttactaaagataaaaaatccaaaagtcaaatactacattggaatgtagtgttggtgagaatttatacaacccagaatggctgtaaagtttttaatacctggtttttgtttgctgtattcataaataacaagtgccttctattaatgtaacttcaaaaaagccctctcaccctgtagtcaagctggaactgaaagcttgtagctatcaaatgaatgtctatcttgataagcatattgcttagcttgataggttttgtttgtctaaatttttcattgtttctgcataatatgtacttcataagcatatcaagttttatgtgccatgcatatttcatggtatctgaaaaagaattctgacaaagtgtgtgtatgtatgcatttcacaatgcatacaatttttatgtgcatcaatacatgtttttccctggcctaaacatgttgtttcacaagtgtaatggatggcaaggttttcaaatgataaagaacatttcagtttaaacaatgaacggaatcaatcatggatcttaatgttaatgcagcaattttttcacgggcagtaaacaagaatgattgcatttaatagctctatacagtcacctcttgattatctatgttaatggaatagaaatgataactataatattacagtaatttgtcttttggttttgtgtaagtattttgctcttaacttggatgtagctgtgggggattctcagttaaaaaagtgagattgttcgatggagactaggaagagaaagtgtactccctatctgaagtcactcatctgtttcttcccattccttcttggcgaatgttaagaactgaacatttggcgtggacactagctacatagtagattaattatagagagttgttggacatggaaaatttggtgttttggtcctttgtggacatttactttgtattattgtcctcttaacaccaaattgaagtataatcaaactgctatatgaagaagggcctagaaaatgtggaggttttacactacttgccctgctttctatatctagtttaagctgttaggactcaatggctctgattttgaccataataaaagcattttgattttactatgaccctagttatgcattacttttgggggtgaggggaagctcctgtatggtattgttgtgcgcagattgcattagtggttttcaaggaacgaatctgtgaagccctgtccagtagcttgtggtaggctgtagagaacattgggtttccctgatgactccagtatacttgggtagttctcagacagtaaatactttgtatagcatgtcgagaccttttggagtgcttatgatagctacaagatggaattcactcctagtcagttcttcattcagatgatgattaacattctcttaagtacaggtgtgaaaacacattgagacaaaaatgtctttaaaaacagcctatttctgtacattaatagaaattctgccccagaagaaagctcttaaataagttcttgctagagaaacagctgagaattgcaaaagaaacaacaacaaaaaactgagtaaccaagataaatttcacaaaaccatgaactttattcataggagatttcctaggaccttgctcttctgtaagcacagttctacccgcctccccattggaaattgaaagcagaaaattggaaagagagttgctgctagaggtgggtttcctgatagtagcaaggaaagaaacagttcaaaaatggaaacacattctccaaaagcatagcccctaggccgttgaaagagtcaacaacagattttgacatctgacagagggttacagcacagcaaaacagtggttgtttctaattgaatcttatccagaaagggtctaaagtatgttcagctttttttaaagaaatgtttaagacattgtagaaagatgtctgtctgagacgttaaataaattggaggtgtgtaatgatataaatctttactatcctgaaaaccatctggaatttaactttattattgttttggggtgtttttttagtttgggtttttgttgttgttgttgtaagttgactggtctcaatatacagatgatttgtgtacctttctttgggagaaaggaggggaaatagcaattccattaatataaaatgtgattctttgaaaaatatcaaagagcaaatactactgtgtttttaaagtgttttaattcatattaaagctcggaagcataggcattttagaattctttacctctttaatttcaaaaaattttgacagtggtcttaccacctcagttatgggcacaattccaactttatttgtaatccatttcatggaattctgaaggtttgtgttggatatgagttggaaatactttctagtaactttatgtgtgaagaagcagacttgtgtgtgtctgttcctctgaatccataaggttagtcttataggaattctctttccccttgaaagaactatagaccctgatacaggtttccctgtattggctgcccatcctaccacttttgacagtttccatgcccctggccatctcactctcttacccactgctggccaaaaacagtgtctgtctacctgggcactagcatgaggtgtgacaagaatgcatgggaggaatggaaagagaggaaatactgcttccaaggcgaaatgctttgaagaagtagagttatagggatggagagagacccttgtaggaagaggaaacatttcttgatcatagtggaaaaggacacaaacatgctaatccctgagccctcaaatgaaaaataaggttatgattggggtcccagcccagagtggaggagtatctctggggttttatcatagcaacaacagaaggggaagcgaacaaaatgttactttagttttcctataaggatttgccaatcctgtctttcgataattaaaataaagccaacacttcatttctccagcctagcagggagagtcaatatcagagatctcctgaaaatttgcaaattgtctgaaatagcaatgatttttcttattctgggtctttaatcaaatgcagtcatgtatattaacaggagactaaaaagttcagaaatagatacttttagatgggtgttatctgggtggtctaccagaggctgtctggaatctcacctagactttaagccacaggaaaaactgatcactttatctttctctttccttctttttttattttttctttcacctatttttgctttacctttttaaaaaatatttttcagtcttccctccgcctccttttcttctgtctctcttttcctgtacatcacatctttccttttcctctgtctttcccataaaactgaacatttttaatggaatggagcttcttgatataagacctcaaaaataacgtaatcaggcccgatatctgccacttctctgttcctgataaacttgtttgcttttacactgtgattaggactcaggacaaaacaatgtgtgacttttaattcacacttctcattcccctttacaagaaaaccactaggtaacagacagaaccttaagagaaataaaatctctagcctggcaaaggaggtaaggtggtttgttatttcactaattgtttttgtttttgaacctgggaagttgtttttgtggtggtgttgggagtacattcctagtgctaataggttaaggcccctgtagacagtgtgagaatggtaagtgttaagggttcagatcctgctgcagataatcaagtgttgactgtatgtgtaatggtaattgagcagaataagagggtaccaggtaatgtcctgaacttgagacggttgatatataaccatatattttcaatgtatgggttactgtgtaatattttatttgttcttgcagccaggttgtcaaagcattggcaataaactgctaagtaaaacatttaaaaattatgtgcttaaagtcattttcttttgaacatttctgaatttgcagtgatagctattttcagtgaagaaaatatttggacgaatagaagaaaggcgcattagaattttttaagggactctcttttcagtttgccagtgaactccttacagttgaataatgaatgtatttaactctttcgtaggcatcctctggtatcacgattccaaaacccccaaagccaccagataagccgctgatgccctacatgaggtacagcagaaaggtaggtgcttaggacctggtaaggagtgaggacactgtctttgctgcttctttgcttaacatccaactttagatcggcttagccagcttttctgtgcatattcagaggaaaggtccaaaaaaatacggtttttaaagcaattagttctgatttcaaaattccagaactaaaatccaacaagaggagcgtgattaaataaactgttaaaatccttaagatagaatgttctatagccattaaagtcatttcttttggagaatatttaatgacgtgaggaaaatgttaagtgaaggaggactgcaagactacatgaattaatatctcatttttataaaaataatagcaaccacatgttagtttgaagggggaaaacacagaagacaataattatctctaagcagtaagcttatggtagtttttattttcttttcctcaagttttcctttttttttttttttttttggtgatgagcctacattactcttaaaataaaaaaagtagccaatatctttattaaaaggcagagcattataaccactatctagaaatgttaaaccttttgatcttgactattatatttgtatttgataatatgatgtaccgtgttatgcaaattaagcacttttcttctaaattcacatgaacttttagagacgtagactatgttattgaagtaactcatcctaagtgtctgtagtgattggagatattcttgcttatcaaattgaagtatttataagtgagtgacgtgatgtctgagatctatcttaaagtaatccagtagggcaaagataacttgagattggccagttcttgataatttttgaagtaggctgatgagtacctagaaatttgatactgttttctctgctttgtatgttgaaaagtttccacattaaaaactatttttaaaggtctatacgtttagacatcagtattaacatttcatctgttttctttttaaggtctgggaccaagtaaaggcttccaaccctgacctaaagttgtgggagattggcaagattattggtggcatgtggcgagatctcactgatgaagaaaaacaagaatatttaaacgaatacgaagcagaaaaggtagggtaggggctcacagtgggatagataatgtgtaaagtacataaaacattggcttactatttataaaagtaacataagatttggtcagaacactgatgcagtactgaggctctgtctacctgagtcaagtcagtttctcaaggcctcagatttcttgcctgtaaaaaggagataattatcccaacaccctgtttacatcatatcttttgatattcaagtgagataacataggtctgcattataacctgcaaaatgttaattataaaaccaaaaaacatttgaatttcagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatggtaaaagaaaaaaagtggggttttgtttatgctttctctgtgagttaagatatgagaaatctcttaagtataagtttttatttcttatcctaaatggaaaagaaagtataatttaagtatcgtcttagtattttggttatattgagtaagatttgtatgtgaatttcccacaagaaaaagaaatatccttttcagtgcagaaaatagcaaaaattattgattgtttatcaaaatctttgtactcaaaatgcacgaaaggtttttaaatcacaatcaggattttgcctcatctgcttttaaaaagctaaatgcattctaattatatcttgttttcttattggttcactaaattcgctgaattaaaggctcttaagggagaagctaatgagtatgtggaaacatgaagtttcctttccatttaattcagaaatccaataagaatgtataaatatagctcatgctactatttgtatgggtgtacatgagggtatacccatacaaattgtatacatgcacacgaatggcagagcttcctaattgccattctgtatgagtagttagcaggtgttctgattgttctggtcttgtgcagccaggcagggtctgaagctgcgaggagacccagagatagccacctgcagtgtgaacacactcaaccacatatctagtgtgctgtataaacattaatagtttctctgtatactgctatgatgtgcaaaaggttagaagctttagctgcaagcgacaagaacatcaggaaaatgatttaagatcccatcttaaagtagcagtaacaaagaggaaggctataagaactttaaagacaatatcaatgagggaggaagcaataatagtacctgaagacaagaataagttgataaaagtggggaaaaacagaagtcatttttaaaaataatgtactggaatattgtcaaatgttctcataaatacagacagtggaatgtaatactatagagaatagaatatggaatagaaacagtattgaatgttaagcagaatcagcagtgctaaagacacactagcatcctcacactttaattactcaaatggggtgattaatgcaagagaaacatacagaactaaaaatcagaagacaatccagtctacagatattgggaggatggaggtcagtacaagaggaaacaaaggctagcaacgtaagtagaaaataactaaagctttcattaacaccatgaacactgagaaggactaaagagattcactcagaaacagtctgaaacttgggcctatgatgtttttaactttcagattgggtcttaaagttgctagtaaattcaggtagcaattaagatgccaatatgagaatgtctttagcataccagtacgaaaatgattagaaagaggaatacttgggaggtggaaatgtatgtcaaatgtacataacagaaaggtggcatctgcatgaagtacaacagctactgacttctttaacagaggactatcaaaagatagacattgccaggcgccatggctcacgcctgtaatcccaatactttgggaaactgaagcaggaggatcgtttgtggccaagagtttgagaccagcctgggcaacacagcaagaccttatctctacaggatacttaaaaattagctgggcatggcggcttgtgcctgtagtcccagctactccagctgaggctgaggtaggaggatcagttgagcccaggagttcaaggctgcagtgagctatgatcatgccactgtcctccatcctggatgacagggcaataaccagtctcaaaaaaaagaaaaaaaaaagagggcatgtgcaattatccacacaagacaatgaaggcttttattcagtgagagcctcttcatcataggataaatagctgttcaattagatcataaccagagaagccattcccccaaaaaaggaagcagacgactaacatgcaaagaagaacaagcccaaattgcttagaccttatgtccccatctgtggtcaacactggggccatataaatgaaagaagaaaacaaaagctaacaacaaaaacagataacttagacagatgtagcacagatgtaccatatataaccctaaaggtgaaaaactcttaaaaagtagaaaggttacagagttttaaaaaaactgtatcttacccagtagttttaatttcagaagtttatttcctaaagaaattactcaaaaggaaacaaaagtaatttttttaactttttacaaaaacaacagtttttagctgtagtatttataataatgagaattttaggaactacttaagtgccagacaataagggaggtgctaaactgacatagcagcgcaacataggcctctgtaacagggtttcccctgtaacaaggttttcttaagtgtggttcctccctgtctggtgggtcactgaggtgattaagtggttcagagaggagcgtttgttttaatatgtattactaaagagaaagctctttttttttttaagtgagttagtttaaagaaaaatattaagtaaacgatagtacaggctgttagtagatatatgaaaaactatgaaggtgatagagcaaagactgagattaaggaaacactagatagctattaaaaataagcctgtagtgtgtgtgcagtggctcacacctgtaatcccagcgctttgggaggccaggatgggcagatcacatggggtcaggagttcaagaccaccctagccaacatggtgaaatcccatctctactaaaaatacaaaaattggccgggcgtggtgtcatgcgcctgtaattcctgctacttgggaggccgaggcacaagaatcacttgaacctggcaggtggaggttgcagtgagctgagactgggccactgtactccagcctgggtaacaagagggagattctgtctcaaaacgaaacagaagcatataaaccagacccatactgtatgaacttgggtcataccattacacactgacaacagctggctaagtgtaaactgacaaaaattaaatttggaatcagacatttatttttcttctataaaattacttgagggcctgggaaactgaatattgttagaggtgatgtattctctgctgtcataattttacaaatgggcattttcattcatttttaaagtgctacaagtgacaaagtcactgcccagttcatatgttgttcattagttgttaaatgccttaagttactaccaagagagtgaaacattgggcagaatttcaattactgccatcacatacagccttcacattgattccgaagccagaagagacatgttgtatctcgtttatgttttagccaaatccttctcagacacaacattatcacttaaagactgtgagataaattactaccttggccaatgaacacattacgtcctctgtatggtttttatcaagtaactgccccagtgctcccatgacgctgggcaggtccacttgttaggccagtgagggccatagttcgttggtaattaagtgttaacattgttacactcctttttatggttactggtgacctgatttccagaacaatttgttcactccagattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcaggtaaagtcataaaacattcatttcaataagatgtgcctataccacaaatcccaggtgatatgattcctacaccatgcctaaatctacctgttaaatatgtcaatctaacctgttcctgatttggagaagaggtttaaggaagtggacctttcccagatgtttaataagtttgtcattaaaaactataatatagaaccttgtaatggaaagtatattcgttaagaaatacgtgtgaacttaagaattttgaggcatcctatcaatctttactgctatgctaaatattttttcccaaggaattgctcaggcctgaaacagtattctttaacatttacctattgatcataatcatttctttgtgctgcattttgtattttttaaatcttagctagactcatgtgataaatgatctaaagttcaaaacattatttggtacactgtttgaaagtatggaccattaaaaaatgagacacaattatgaagcctgatcctgtcttgcagcgaaaactagaagctgaacttcttcaaatagaggaacgacaccaggagaagaagaggaaattcctggaaagcacagattcatttaacaatgaacttaaaagggtatctgtttaatatgttaactatacttttatcactatacctgttactttatttttcctcattcttttttccaaaatagtgtttttattgaatgttgttcactttgaaacagggctaactttattataaacctgtaggatcctttttttataagattgttcccattctctggcaaaattgcaataaatttgaaatatcatagagtatacacatatcttctaggcctgtaaatgctagagccctctgatatgttaaactcccatacagtcattaattactttcattttattgtgatttattcatcaaatgtcgtcattaaatgtaatttataatttgcactttgcattcagacaaggaaatctagttggtagcccaaaatgtaaaacggaagccttatgtataccccagaactttcactattttgcctcaccagctgctctggaatatcctatattatacaactgctagagctgctgttttttcttgtagacccaagagtttcagagaagacctagaaccacatttttttggcacacacacacacacatacaggtgtatagatatatatatatagtttataggcaagaaaaccaacttttgaaagaatatatctggctcaaaaattataaggaaaaaacattacggagttctgtttttttctgattagttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacaggtaacccactagcaacaaacgcagaggcagtgccaagactttgtacggctgtctttaatttaggtttttctttctaagtgcaagtattctggtacctgccactgagggtgattcccagtactaaatttgacatgatattgacattcagtattttaacctttaaatgcttacattatttatcaagatgtggttattaccgttaagattaattgtctttggtgtcctaggacagcattctgcaaagtaatacctgtaagccaatcctgcccaccacttgtttttgtaaataaaactggaacacagccacacttgtttgtttacatactgtctgtggctgctttggggataaaacagtatagttgagtagttgcaacaacaactgcctggcctgcgaagtctaaaatattttctatctggctctttacagaaaaaaattgccagctctgtcctagaaaaacccttacttctaggtatactgattttcctgattaaaagcatccctcaaggtaaaaaataataataataacttgtataaataaaacttacataaagtactgattacattgatcgtcacttgtaattttgagatcaccttacctcatggcactgttttaacactgcctagtacactgtgtaaacaggactaagctaaaagtagttatggaaaacaaaaccaaaggcttcctggagcatcgttgcaagaagtgggagggacagtagtcatacttggtactcagatgacaaccatctggaaaacatgtaatggaatatagatatctttaccaggtatttctgcaaaatttaatccagcagattaacatttgaaatggtcatattttaagtttcagtatctgagtctctttctgttttgtatgaatgtgttttttattgtaatgaatttggagcatgagcacatttttgtggttaaaacgagcttgaaaattaaaataactgatttttgctaattttgcaactagacaaacactcagtcctttgcctctgttttggcatctatgaatggggcatgtcttatgcttaaggtttgcaggtctttactcagattctgtcctagttcaaggaaaaaacctgaagaaaatcgtttgagactattagagctaaaacctcatgcttttaatttcttacaggaaacagcccagcatgactttaaacaaagtgtctaaaagaccaaccttatattatttctacaactgctttctcctcgtttaatccatagcactacagactaactctcattcactgtccaacagaaataaaatgcaagtcacgtgaaattttatattttctactagtgacatatttttaaaagttaagcaaaacaagtgttttaacaatatgttttatttaattcaacatatcctaaataaaattatttcaacacagaaggaacatttttaaaatcagctttcctttttttaaacagtctttatacacatctcaattcagaagctaaattttcatcggaagtatttgatctgcatttatttaataaatttcattcatttacagctaaaaagtagattttcatacccaaattgttccaacattcttaaaagttctttagtcacactggttcatttcaggggtttaataaccacatgtggctagtggcttctatattggacagcacagctgtatactgtcagcataactagagtaaaatttcatcttggaactgacagtgacaaatgtgtgattacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaa

SEQ ID NO: 37593 - DNA, 8585 bp, Homo sapiens
gctcacagtcatcaattatagaccccacaacatgcgccctgaagacagaatgttccatatcagagctgtgatcttgagagccctctccttggctttcctgctgagtctccgaggagctggggccatcaagggtgagtgctcaggaggacgcaggagcgtcggggtgagtgatggggtggttcacatcaattgctgcttcagggatcacagattttaggggctcattgatctatctggtcctcatagtctatgttccctctggccctcataataataacagcaataacagccagaatttatgagactcctgcatagtttctttccccatttacatctcacaggaatcttcaatgaagataatattccattcatttagaaattattccttttatttagaaattattttgaaaaaactgaagctcaaaaagatgaataagttttccaaggttacacagcagatcaacgagccaagtttgaagtccagacccagctctgagggtcatacactgccttccccagattcctgcacacagtgacctactatcagggccctcctatctctctgggatccccagcctctatcttttgtggctgctttacaggaactccgagctatggactctgcattaggagacgaagtgcaaagagtgtttctgtatcctccctctcttctaggaccctagggctcttcctgggtctttgtgggtggtcacaagctttcctctctcaagacagcagggttgcatggtcttgatagccttgtgattcgggttctgagagattcaggactgcaagggaggcctagacttttgatagctgcaaggactcagccagagatggaccgtagtgaatgctcctttttcctgtagctgaaatcagggagaatgacatcaagcctgtgcatgatgctgtcattccaaaatctagtgatggggaaggttagaatccataacgtacaagatgcacactggcttcagacagttttatttaagatgtgtagaataaagaggaggtcaggctgggtagaaccagaagtatctattgccctgttcgcggtcacctgagttatttctaatgttatgttataataaacaccacaataggcttctcttcatagatgcaaatactttttagtattcttggtagaaattcctaatgagctcagctgtctcttcagggcttccctgcccagtctcttaacatttaaacatgtcatttaccttaaaaacataagtgcaaaccaactgataaaaaacaaccttgccttcagtctgcatcctgtcccagagacactttctttgtgtcctcacacgtggagctaagcttctgacttgtctctggtacatccctgaggatcctctcatcttggccatcaggaacctctacagaaggtcaaattcagtgggttcttctcagtgcctctgacttgagttactaataacatttgcactataatccacttctttctgatgaactaccctgtccttatttttctcctgtttacctggatcctccttatcatcttttaaaccacctcttaactatcatgttctctcattataccctgagatctcggcaattctgatttttggcactcttcctggaaaatcttatttaacctgcacctgccactaatgactctcagttctatggcctaaattcctctcctgagaccacccataatccacaaatatctatgtattatttctccttagatgactttcaggtcttctaagtgcaatagccccacagtaaactcagtatcttctcccggtcaggctgtcttccctgagagaagtggcttttgccctgttttctgaatgcctacattgaagccatctgttccccaggaagccttccctgatgtgctgtttggtcgcatcttgtgtatacctacgtatctgcacttatccttctgaacctgctgttgtcctgtcacttgtgtttccttctgtgacttatacgcgtctgcagaacaggacgtatgtattatttttatttgggtatttagcatctaacagtgtttgacatatagtagtcttttaatacatatttttgtctgaatggaaatgatattttgaagaaaaataatctgttccatagctggctgatctttggactgcagaacttgtgaaagtgttttttaaaaagcattttaaaaagtacaagggacattcatgtattaagaagatgagtttccaataactgctagaggactttgtgtctttttattttaccctctttttcctgatgagtcctttgagtcctttaaactgaggagcaagctaagtttcctagtgaaatacctataggatttgttttgtttagtttcaaataccactctttgcttggccacttactgtgtcagggagtcattctcagtgaaaaataagacacaggtcataccctctagacacttacaattacagtggcaaggagtcattctcctgtcactgtaagtggccaagcacagactgggtccccacatgtcagggctgaaaactcacagggaaatctgtgagttgggaggtgagagcagaagagtcccgtagttccttctcactctgatgcatttatcattctaaacccagactttcacatacacattcatcgttttctttcatgataatagttgcttttatcctcttatctttgctaattcttacaaactaataaagactaagaaacaaaataaattaaatcctacaggtgttccaaactcagcaataatttctagttggcctctaaaacaaaaatcaaaatataaatgtaagaaaagtttagaatgcttagtacctgtgtgatgaaataatctgtacactaaacccccaagtcatgagtttacctatacaacaaacctgcacatgtactcctgaacataaaataaatgttgaaatatttttaaaaaggaaacaaaagtttggaacaaatgccaaaataactgtactgtacttttgaatttatatgccccaaatgaaaaatattatcaacaaagctatacattctacagtttcatgttcataaactaagacagaaactttaaaactgtcaagagccctaaaatttgaaggatattttcttcttcctctcaattttgtatttttttctaccttttctataataagaaaaagaaaatgtccattcccccacccccatgactctaaaaacaattttacatctgtgtcatagaaaaattaagatcttaatgggagagaaaacctctctactagttccgccagtagccgtatgaccttagcaagttattaatatgtaacttccctgcatttccttacctgtaaaatgtatgatatgtatttgcttcatagggttattgtgacaattcagcgagtgaaatatgtaaagtatttagaaggatgcctggcacaagtaagtgctcaacaaatgttagctgtcattgttactattactattgtgtagggtcaggatgcccagactttcaaagaccaggaagcagcttgacttatcagtgataaacttttcattttgttctttgctcctttctttttataactgctcatctgctctgtattatttcctttatggtgttgctccttcttcttccccatatgtccttcctttgacctcttaccttcttcctttttatattcataagtctttattcattctctagctttgaccacttgcatattcaaactgacattttgtcgtgtttttctctactgtctttatgcagcggaccatgtgtcaacttatgccgcgtttgtacagacgcatagaccaacaggggagtttatgtttgaatttgatgaagatgagatgttctatgtggatctggacaagaaggagaccgtctggcatctggaggagtttggccaagccttttcctttgaggctcagggcgggctggctaacattgctatattgaacaacaacttgaataccttgatccagcgttccaaccacactcaggccaccaacggtacgccctatctttgcctcttcctctgtagcccaactggaagggatgagagggcctctctgccaccctcagactaggaagcctaagtgccccctgctgtgtgatcctcttcccctagtggccatgggctgatcccactacagcaagggcttgcatcctctcttctcaggagagagaaaggtgagcagagtgaggctggtcagtggtgtgatacccctctctgtgattcagagctgccataaaatctaaggctgaggtagaggaccaccctcccctaagaggtggagcctttgtgattcatcccagaagaggggcctaacctggtgctgtctccttccagatccccctgaggtgaccgtgtttcccaaggagcctgtggagctgggccagcccaacaccctcatctgccacattgacaagttcttcccaccagtgctcaacgtcacgtggctgtgcaacggggagctggtcactgagggtgtcgctgagagcctcttcctgcccagaacagattacagcttccacaagttccattacctgacctttgtgccctcagcagaggacttctatgactgcagggtggagcactggggcttggaccagccgctcctcaagcactggggtatgcaactgcttttctctccataatctcctggcatcctctattccaaagacctggtgtcctctgcaccagctttccgcactggctgggtctcagtcctctcctcgtcctaacatccaattaactggtccataaccttcaattcccacaaccatcccaggccatcaccaccctcactgcacctcctgaccctatctcttcattcttcccccagaggcccaagagccaatccagatgcctgagacaacggagactgtgctctgtgccctgggcctggtgctgggcctagtcggcatcatcgtgggcaccgtcctcatcataaagtctctgcgttctggccatgacccccgggcccaggggaccctgtgaaatactgtaaaggtgggaatgtaaagaggaggccctaggatttgtagaatgtaaggaagggaggaaaaattcaatctgataagtgttcattgatcttctaatgggttaaaagcattcagccacataacaacaacaacaccgataactaactgagtagttaatatggtcaggcgctattctgaggatttacatttattaactcactttattctcacacatagtctttgaggtaggtactattattttcactatttcacatgagagatacttacatctttttacatacacagagactttaagcactttgatcaagttcccacagctatgaagtagtagggctagcttccaatccagaaagtctggatccaagactgtttatccactgtcctattcaccctattttgtgaaggaaaagaccaagttcaaattctccagagtccattgccaaataatggagtcagatctatatttctatacataattacaacacagtgtggtgggtgcctgtaactacttactgtctctacttggactcattccatggcaatgttcacacaaaaaatgcccctccagagatcttacaggtttctatttatcataacactcaccatgctttatatttttatatgttttgggaattctcttagcattagacagtgaacttccatgcagatgaccacatctaattcattattattattgttattcatgctggacctcaggtacaaaaggttaagaacttctcagttcattatatgatcatcattggtgcctccgagctctctctctctcccttgatttatttggtcccttttatctccagtccttactcccatatctaacctcttacccctacctcataggtaaacattttaatgaatttgatgtttccttttatttgcatagatcctctgtaatatgtagtagtgtccagtgtacatgtatttttaattaaccaaaatggcattaaattatagatctaattttgtacatccagtttgtttcttccaaatcttccatagtattttactttatatgtccatgcattagtccattttgcattgctataaaggaatatctgaagttacctaatttacgaagaaaagagctttaaatggctcacagatctgcaggctgtacgcgaaacatggcactagcatctgcttctgttgggggattctggaagcttttactcatggtggaaggcaagtggagccagtgcatcacatggtcatagagggagaaagagacatagaaagaggtgccagcctctttttaacaaccaggtttcatgtgcactaatagagtgagaactcactcattacccggagaggggacaaagccattcatgagggtctcctccatgattcaaatacctcccaccaggccccacctgcaacactggggatcaattttcaacatgagacttggaagtgacaaatatccaaatcatattaatccacatatctacattgctcctgggatacctggatcattcctggttctctactattgcaagcaatgcttgtatctcacatggaactgcatatacatgtgggcctgacctgcatccctggaatgtatgtatcctagaaaggggttgcagggttgctggagatgcagctccttaatttgactaaacactgctcatcttctcatcagaatggctgtactcatctgaacttcctttgtcagtactctaattgtcctgcaactcctaaatggacttcaacactggacattatccagttttctaacttttgccaatttcatgtgcataaagaaatatgctgttttattttgcatttctttaattactaataattggggctataattaggactgattagccacttgggggttccttttctataaattgcctgttcacattcattgtccatttttgtactatgtgcttccatcattttcttattgatttgcaggtgatccttatatagtcctgctagtagtcccttgtcagttttaggcattgcaaatgttttcctctaatctgacttctggcaactgtctccttggtttcctttattgaagagaaatccttaatattttgtaatgaagtccatcaactgtatttttgtttgtgtgtcttttttaaaagaagtcttccctatactgagatatcaaagatactcttaaaacatctcctacagttttaaatttcacatttactactttaattcatctgggattcatctttgtgtttgatggggatcatgttttatttttctttatataatgggccagtgtgttcccacaactactaaatagttcaccttttccccataggttagtagtgtctcctttgctatactgaaagctcccattataggtgggcctgtgtctgagttccatcttgttccactgttctgtttgtctcttcttgtgccagtgtcctagtattttgattactatgacattgtagtgtgtgttagtatccagtaggacaaattcttgtttatttttcttagttcacacacatttataattatatctataatgatttgtaacagagtgaagtgaatgtagaatgtcagatgttaagaggaagaatggaaaagagggctgggactagggtgatgtaggggatgcacctggcttaggtgcaaaatttgggggataccaaaagaactcagtaataaatcatattttaatgaaatatcttgaaaaggcaaaattaatgcaaagatacatgattaacaaaacatccaaagaggagtatttaacaaaaatggagaagcagagaagcagaagaattaggagaatatgctgtcacatgagccaaggaattaaagaattcaggaaggaggaagtactgctgtcagatgttcaacagaggtcattttagaaaatttaccttggtttttgaaatcctttcaaagagcagtatacacaatgtgagcaagtatccttcgttcattgccgtcattgatatggtttggatatttgtcccttccaattctcattccagggttaagcttcttctctgccctcagtaatgtggcccttccccttgtctgtatattttggagacatgaagcatgtgggatggcctcacagtcagctggggtttgagggtgaaattcaatgactttcgtgaactccttggctcctatgtgctcttcacctggaggaccagggcatgtgcagggatgaccaccttctccctgggacctgaacagggcagagaaatgggaagctcgggtgcaaagggagtggggaagatgggtccgggcttacagtactgaacccaggaatgacaataactgtgtgtgttgctgcaggtgacaaaatatctgaacagaagaggacttaggagagatctgaactccagctgccctacaaactccatctcagcttttcttctcacttcatgtgaaaactactccagtggctgactgaattgctgacccttcaagctctgtccttatccattacctcaaagcagtcattccttagtaaagtttccaacaaatagaaattaatgacactttggtagcactaatatggagattatcctttcattgagccttttatcctctgttctcctttgaagaacccctcactgtcaccttcccgagaataccctaagaccaataaatacttcagtatttc

SEQ ID NO: 37594 - DNA, 8585 bp, Homo sapiens; identical to SEQ ID NO: 37593

SEQ ID NO: 37595 - DNA, 29145 bp, Homo sapiens
gggggtgggggaggagggaaagcggcgagtaagatggaagatgaggaggtcgctgagagctgggaagaggcggcagacagcggggtaaggaggagccgccgtcccatggcagggccgggcgagacctggcgtgaggggagcctccggggagcgggtctggagatagttctccccaaggaagggccccatacgccgggctgggggtggtggagaggcccccagttcctgagcgccgtgaaggcctcttaaaggggccgcgatccatttctctcctttcctttgcctggtgcgcctccctccgcccactaacgcgcgcgtcacccggggcgccccacccgccacccggggcctcctttcctgaccccccgcgcccacttgctggccgtgggcctctgtgactctttccgatgagccttgtggcccgaggcaccattttaaagttcttgtgctctgaccgggacggacacaccatgtgggtggtggtggggcttgcgcggaccaaggaggcatgtccggcttcgcaggaaagcgggaggaggcagccgagggcggggggaaattgaatcctctttgggctactcaactctgctaaaatcccccaccatccgtcacggtggacgagtcgggttttttttctctttcacttttactccaagaagagtttgtgggcaggcaggcaggtctcacggggactctgccaaagcaaccgaaagctctgcggggcagctcctctgccactcagcgatccgaggccccgggaaggtctaggagttcgcttgtcggagtccagggtgtgatatgtaaaacagccacattcttgggagaggagtggggagatggaccgttcgacttgtttttggagtttttgtttgcctccagaaactgtaggaaaatagtttatctcaaagaggatctgtcaattctcttagatttgtgaataatttggtcttttcagagtttgtctgtggtgacccttgtgaatatggggagatgctttttttgtctccccgtgttcgcgtctgttcaatgctggctgcactgacatccaccttaaaggtttacgtgtgcgaggagtcgagcgtaccagggtagagtaggcgctgggttttttttcctaagcgctttttgggggtgcttatgagctctggaagaggccgggaaattgaccctggcagcagtcagtgggtgtatctagctctacgggaatgttgaaacttggctttgaagttttttccgctggttcagcatttctctcaacggttgtttatgtttttccatttagcataattgagaatttgaaggattcgttcgttcagaggatatttagtagagttcttaatgtgacaaccatctttcttgagttttggcttaagaaagttaaagattttatagggagtaacaggtgtcagttggctccttgttcattcaaccagcatttttgagtgtctgctatatgctaggcagtgtgcttatcagtgactttgtgccagaaaatgcaacattttcggtacaggcgtttattgcctaccactaatctgagtgaatcatccagacatccctataaaaaagcttggcttacaactttaatatcatgcaaatgatacgtttcttgggcatcttggcctttctttggttttcctcacctgtttcaaagggtcataaatccctcatgttagagaagttggaggcaaatgaacaaaaatgaataggattcagcagaaattggggcttactttagtttttcagaatgggtaagtcaattagaaatagctagtacagtcccccatttaacagctgaataagcctagagatgtgagatttagagacttaggtctttctgacgcttgtcgcgtgttctttcttttttcttttggttcccaagttttattgaaaaacttatacaaaatattccagataaatgaaatttaatcctcatcttcctcctctttgtcctggttaatctggaagtaacataatttgtagctatctttgctgttagtaactaggagcaaccaatcacgtaaattattcttcatatatgttttggtgagatatttgaaataccttttggagaaaggcacctcggatgtcacgttgatcttgctcttactcctttcaatggtcgccatccctccaccaaggttctcagcttttccgttcactttgatcctttcttgcaaaaactgctcaaaattggcagcatccatgattccatcttctacggggtgagtgcattcaagagtgaacttcagaacctgcttcttttttttgccccccttcaccacaggctttttcacagaagccatggcagcagcggaggcagaaagccagagttctttctgctatcccttactttagtaatatcctttaaaaatgtaccgcggccaggtgctgtggctcacgcctgtaatcccagcactgtgggaggctgaggtgggtggataacctgaggttaggagttccagaccagcctggccaacatggtgaaaccccatctctactaaaaatacaaaaattagctggaccctatggtacatacctgtaatcctagctacttgggaggctgagccaggagaattgcttgaacctaggaggcggaggttgcagtgagccgagatcatgccattgcactccagcctgggcaacaagagtgaaactccatcaaaaaaaaaaacaaaaaaaaaaaactacagaggtggaacacaaaccttgccttattgacatcatgaacacttctgccaaaatgcaggttctctaatatattttatttaattgaatccttgaaacaacctgttgaggcattgtcccccttttatagacaaggaaacggaggtttcgagagtaacctgttttgcgcaagatcacacagctgggggaagctgggatttgatcccaagcatgtctgacttcaaggctgggctttttttctctagcattttgctgctacctctctacctggggacatgtggaaaatttgggaattgggtgttctttcttttccttttttttttttttgtttgagagaaggtcttactccattgcccaggctggagtgcagtggctcaatctcatctcactgcaacctctacctcccaggttcaagcgattctcgtgcctcagcctcccgagtagctgggattacaaggcgcatgctaccacgcccagctaatttttgtatttttagtagagacggggtttcaccatgttggccacgctgatctcgaactcctggcctcaagtgatcctcctgccttaggctcccaaagtgctgggattacaggcatgagccgctgcacctggcctttttttttttaattttttttttattttttgagatgagattgcccaggctgggcctcccagtagattataggcatgtgccactatgcctggcagctttcattaaaaaaaaaaatatttatttattttagatacagggtctcatttggtttcccaggctgaagtgcagtggcataatcatagcttactgcaaccttgaattcttgggctctagcagtcctcctgcctcagcctcccagagttctgggattataggcatgagccactgccctcagccagctttcatttttaatagtttgtctgggcttatatttgaacgctgtcttgaatttgattcccttttcaaatttcacaaaggttcttgtaaatatgcacttttgaaagaggggagccagggagatgttatgtccacatcactgggaaaccaatggactgcaggctatacatgtctttcatatataggcaattgcgtaaaagtcttggcttcaggttatcccctcttcctactggtaatgagctttgaataccctactccaaaacagcaaaaactgggtgaagactaataacctaaatgggaaaattgaaactacacaaaaatccagcggcagttctaatccttggaagtaaaggattttggagatccctgccctccaacaccacaagaaaatttttgtcttttttctttgagacagggtcttgctctgttgcccaggctggggtgcagtggggaacactcactgcagtctcaggcaatttctgtctcaggcaatctccacccgcctcagcctcccaaggtgctgggattacaggcatgagccatcatgcccagccaaaaattttttgacatcatgtagaatttctcccctcccctcccctccctctgctcccatccctctgctcccccctctcccttccttttttttcctttttttttttccccttttttttttttcccgagatggagtcttgctctgtcgcccaggctggagtgcagtggcgcaatctcggctcattgcaagctccgcctcccgggttcacaccattctcctgcctcagcctcccgagtagctgggactacaggcacccaccaccacgcctggctaattttttgtatttttagtagagatggggtttcactgtgttagccaggatggtctcgatctcctgacctcgtgatccgcccgcctcggcctcccaaagtgctgggattacaggcgtgagctgctgcgcctggcccctttcttaagacagaagggtcttgctctgttgccaaggttggagtgcagtggtcggaatacagctcactgcagcctcagcctcctgagtagctgggcccacaggcgtgtaccactatgtgcctggctaatttaaaaagaaaatttttttgtagagacagggtcttgccatattgcccagactggaagaatttttgtgtgtgtgagtcatctgaggtcattgtttcctgtatagcttccgaattcttagtatcaagtcctattgtgtcatttggagaaagactgactttgagaagtccctcacatattctgtgaatagactttttgcttttagttagtatggcaaacacttttttctttttctttttcttttttttttgagacagggtttcgtcctatatccccaattgtttaagacaatcaataaaatatgccaggcgtggtggctcacgcctgtaatcccaacactttgggaggctgaggcgggcagatcacctgaggtcacgagttcaagaccagcgtggccaacatggtgaaaccccgtctctattaaaaatacaaaaatgagcttggcatggtggcaggtgcctgtaatcccagctactccggaggctgaggcaggagaatctcttgaacctgggaggcagaggttgcagtgagcagagatcgcaccactgcattccagcctgggtgacagagtgagactctgtctcaaaaaaaaagagttcatagtgttggtaatgagctaacccagctaggggaaggcagcagatgatataaaaatgtaattggaccagtggttattataaagcactgacaacctctctgatttccctgtatcttgcaagtttccttttattctttttctccaggtcaaggcatgcagctagtgggaagaaaatgcatcttgaataagttaaaggatgactggtgttctggattaagaattgaaatttatgtttactttctacccccatgagccagttatccaaacattgccccatcagtgatgctggatggtgtatgagtccataggaaggtgtcattaaacattaaataactattgcataccaggcatggaggccctgtttagtgggggagtcagacaggtccggcagcaccttcaggaagaggcataagtggggtaccatggctggatcagagaaagtcttgtaaagaagacgatgcctaagttaagatttgaaagatcagttgaattaagcagtggtaagtctgggagaggcaggtagagtgtagggccaaagcaggcatggatgaggaggccgagagacaaatacacagcattgggagggctacaagtatttccttctggctgaaggggagagggttggcagggttgagtggaaagagatgagaccacagaggtatgtaggggccagattgggaaaggcttccttgtacttggttctggaagcttgaactttgtcctgaaagtgcaaggagctttgaagttttttttttttttttaagcagaagagtgatatagctagatttatttatttatgttttaaattttttgccggacacgatggctcatgcctgtaatgccagcactttgggaggctgaggcaggtggatcacctgaggtcaggagttcgagaccagcttgaccaacatggagaaaccctgtctctactaaaaatacaaaattagccaggtgtggtggtgcctgcttgtaatcccagctactcgggaggccaaggcaggagaatcgcttgaacctgggaggtggaggttgcggtgagccgagattgcaccattgcactccagcctgggcaacaagagtggaactccgtctcaaaaaaaaaaaaaaaacaaaacacgttttttttttttgagacagggtctcactctgtcacccaggctgagcgcagtggtgcaatgatgacttactgctgtctcgacctcccaggctcaagtgatcctcccacttcagcctcaacctcccgagtagctgggactacaggcatgcgccaccacacctgactatttttgatttttttgtagagacagggtctcaccatgttgcccatgttggtctcgaatgcctgaacataagtgatcctcccgtttcagcctcccggagtgctgggattgcaggcgtgagccaccacacccggcccatagttagattaaattcaggagatcagaactttgattttcttctctttctttggagaagaggccattctccccaaagtgtgactgccgcttcactctggggtccccaatgctttgtgtagctgctgtcattttggaacatgtacaacaaaacaacaaaaaaaggctatgggtagtgggaaaaaagagatcaattagtttggggctatctggtgctgatttctttatgtctgtccctgcagtaaaaagaaggcatttaagatttgtggtatcacagaaagcacagttccagatacaccatgcctaaaggggccacctctcagttggtgctagtctttctggaaaggttgagccttatggactgtgatgtcctcagaaggggctttctgtgaagcagttgggcagtttaggcatgattctgctgagcagtctgtccctgggactctggaaaaaggttggtttcactgtggcttcaaagaaaggaggataatgagcttttcactagtaacttctcagcccttttttcattggctgcatgggagggcctgttcccagcgtgctctgggtatcaagagagctgccatggttgccgtgggctagaaattccagcaatcacaggccttcttgtttttacttctatgacaggagaggatttagtgcgtctttctaaaactgttggtgcagtcctgcagagaaaagtcacagttgtctaggtctgatgactgaaaacattccaggggccagccctttccagtttccacctctccactgctgttggccccgacagctagcatcagtttctggctgtatcaggtagctagcctctacaaggtgtgttctgtcaggaaaactactgacctgttggtttcctaggagaaggttgagtttagctacttaaatctgtggccaaagtataaaataaaataaaaaaattttaatgtagtatccatagagatttctcttcttgagtgtttttgttttgttttgtttttttgagacggagtctagctctgtcgccgaggctggagtgcagtggcgcaatctcagctcgctgcaacctctgcctcccgggttcgagcgattctcctgcctcagcctcccaagtagctgggattacaggtgctcgccactacacccagccaatttttgtatttttagtagagatggggtttcactgtgttggctaggccggtctcaaactcgtgacctcgtgatccgcccgcctcggcctcccaaaatgctgggattacaagcgtgagccaccacgcctggcctttgagtgtttttcttaaaaccgtttgctcctaccaagcatccttctctttaacatctagctctgtgcaggatattaaggtaaaaccatgccccacagaaattagcaacaaaccccaatagtctgtatggagacagataatttttttttcttttttttgagaaggagtttctctctgtcacccaggctagagtgcagtggcgcaatttctgctcactgaacctctgccttccgggttcaagcaattctcatgcctcaccctcccaagtagctgggactacaggctcatgtcaccatgcccgactcatgttttgtattttagtagagacgggttcaccatgttgcccaagctggtctggaactcctgagctcaggcagtctgcccacatcggcctcccaaagtgttaggattacaggcgtgagccaccgcgcccggtccgagacagagaatcttgtccttgacggtgagacatttcaaaatgcccatcacagtaagccagcccctccccccaacaaactcgttcccttataaaaggaacacaggaaataacagtcattcctttctaaaaggaataataaatatgtacagctaaaattgcattcttcaggggccatggcgattagatgagattgtatagaaggaaagtatgacttgagtctggaaaggtcaggactgtcaccactcttcactgaccttgagaacaattcccagcccagcccttcctagcttataaaaacatttgtgaccttccatatgtcagtagtgtttctgctatctagttgttcatctcactggcgaacaagcgcgcagcctgtgggaagctcccaagttcctcgggccctttttggaagagcttctaagatatatgttgtatggctgcctacagcccagggggagtgcatttttacaatcattagcagtgaccttgtgaggtgtaggtgctattattcctggtccggggaggaaatcatgtggtcggtccagccctggctgttaggcctgagcccacactctgagggaccttttttggagcaatttgtttacatttgcttctcaccagataattaactagttaagtgctttaggatgcttagttactagctcctttgaagcatttcatttgttttcacctgggattgacctcctgcctctgtagcctgcatgagctcataaactgcatctgagaaatttgaactcagtgctgaagagccaagcgataatcctgctctcagttataatgctaagaacagtgactacaagtgagatgctggtcgaaatcttgatcataaatgagaaataactttttaacatttggccaagtggaaaaagataacataaataattattgggcagggcgcattgggtcacgcctgtaatcccagcactttggggggccgaggcaggcggatcacttgaggtcaggagttccagatcagcctggccaacatggtgaaaccttgtctctactgaaaatacaaaaattagccaggtgtggtggcaggtgcctgtaacccaagctacctgggaggctgaggcaggagaatcgcttgaacttgggaggcagaggttgcaatgagctgagattgtgtcactgcactccagcctgggcgacacagcgagactctgtctcaaaaaaaaaaaaaaaaaaacgttgctcaggatttttaaatggagggggcggtggtcttgccttgttacccagactgatctgaactcagatcgcttcaagtgatactcccacctcagcctcctcctgagtagctcagagtacaggtgcgtgagccactgcacctagccggcaggatttttaaatattgaacttgaatgcctttaccggctgttggctgctctctgctgtcctctcctctgctctcccctgcaatcctcctttacctgttgttacctcttgtgttccattctgcctgctttagccatttgggcttggaggcattgtgtttgccacccctgctgagtgctggcgattctaactgggatttgatgagggcacccttgggtgttaaagtgaaatctggtggatgagggttaatagtgtctttgtttcatcctccaaagtcagtaatgcctggtatttcctttgggagaggagccttgcagtcattataaaaggtagcaagagtggcttacacctgtaatcccagcactttgggaagtcaaggcgggtggattgcctgaggtcaagagttcaagaccagtctggccaacatggtgaaaccctgtcactactaaaaatacaaaaaaatgagcgggacgtggtcgtgtgcacctgtaatcccagctactcaggaggctgaggcaggggaattgcttgaactagggaggtggaggttgcagttagccaagatcatgacagagacagactctgtctcaaaaaaaaaaaaaaaaaaagcaagaaaggataggttctctctgccagttaacggcctacttttctccattaatggcaataggtcagaagactgggatttaaatgcctggtctgatttttggacaaatcactacctacccttctgtccacatcaatctcttaatttgtaaaactgaattaatagaatttgccttgcctggtagtgagagttaaaacacttagtaaagcgtcattcacaggtggatgtgggagccgagagtgccattgctctgagtgtgaaggcattgttcccggctctccagccactcacagtgtagcctctatctggtttgggttcaggattcctaagactggctgaagggtcactttcttgctgcccctgaggactaatatactctcctccgagaattgtattgcttagtgttgtacgaaaatcaacagggagaagcagttacagaaacacagagaaagcaggagccccattagattcgaccccattttatttccagggcaagactcttcaccattacatctgcctatcccgttactttcaggtatagggctgagtgtatccctccggcatggagaccctttgaggaggcactcaaaacaatacattgtctcaagatggcatctacaaagtttttgaggctttctagcctgggatacatctaaactgctaggcctggttgctgctgaagaattatttctgtttggcaacttcttttttttttttttttttgagatggagtcttgctctgtcgcccaggctggagtgcagtggtgtgatcagctcactgcaacctccgcctcccaggtttgagcaaattctcctgcctcagcctcccgagtagctggaattacaggcacctgccaccgtgacacctggctaatttttgtatttttattagagacagggtttcaccatgttggccggtctggtcttgaactcttgacctcaggtgatccacccacatcggcctcgcaaagtgttgggattacaggtttgagccaccgtgcttttggcaacttatttatagctttaagatcggggccttgggagtcagctgtttttgtctgttactgctataggccttaggaaacctgggcttgcactgacctggcctgaggtgtagcagcaggctgggatgttgttatctgtcagcccttatcctactttatttatttattttgagacggagtcttgcaggctggagtgcagtggtgcagtctcggctcattacaacctccaccctctgggttcaagtgattctcctgcctgagcctcccgagtagctgggattacaggcacgtgccaccacgcccggctaatttttgtatttttggtggagaggaggttttgccattttgaccaggctggtctcgagctcctgacctcaggggatccacccgcctcggcctcccaaagtgctggggttacaggtgtgagccactgtgcccgacctccttatatcctactttattagctcctgatgccacctgcctgccagtgtcctgaacatttttgcttccccttcttgagatttagggttcagttgtgttttgttttgtttttgagatggagtctcgctctgtcgcccaggctggagtgcagtggcacgatcttggctcactgcaagctccgcctctgggattcacgccattctcctgcctcagcctcccaagtagctgggactacatgtgcctgccaccacgcccggctaattttttgtttttagtagagacggggttttaccatgttagccagaatggcctcgtgatccgcccgcctcgtcctcccaaagtgctgggattacaggcgtgagccactacgccctgccttagggttcagttctgtcacttactagttgtgcatagttgtgcagtcagaggcaaatcacttaacttccgggtatgcagcaaggctgctggacgctccacaggttgtagcgaagataagaggtggtaaagggaggacgtaatacctgttttttgccaagaaatgcctaaggcagcctgagctcttattttgaatatggatagtgtcatttgtcaactggatccagatagatccagttcaaattctggctccacttcatactagctgtggaaccatggtcaaattatataacctatctgaattgattcctcttcatttgtaaaatcaagatatatctataaaatcctgttgatttggggttttttttttttttttttgagacgaagtctcgctctgttgcccaggctggagtgcagtggcgcagtcttggctcactgcaacctttgcctctcgggttcaagcaattctcctgcctcagcctcccaagtaggtgggattacaggcgccagccaccacaccccgctaattttttgtatttttagtagagacagggcttcaccatgttggccaggctggtgattgttctttaattcgtgtgttgggtactattttagacattggacaaatgcagtgaatgaagtttctgctctcataaggcttactttctactggggaaagatggacaataaacagtaagtgttttatataccactcagtaaagaaaagtaaaacagattaagggttttagaaagtgactgtggtggaattgccatcttacaaaaaatggtcagaggcaggcaaggtggtgcgcggctgtattcccatctacttgggaggctgaggcaggaggatcgcttgagggcaggagtttgagaccagcctgagcaacatagagagacgctcgtctctttatttatttttgagctggagtctcaccctgtctcccaggctggagtgcagtggcatgatctcagctcactgctgagatcctcccaggttcaagcaatcctcctgcctcagcctcccaagcagctggaattacaagcatgtgccaccatgcctggcttttatttttttttttgagatggagtttctctcttgctgcccaggctactggagtgcagtggcgtgatcgcggttcaccacagcctccacctcccgggttcaagcgattctcccacctcagcctcccgagtagctggaattacaggcatgtgccatcacgcctggctaattttgtattttccgtagagacggggtttctccatgttggtcaggctggtctcaaactcctgacctcaggtgatctgcctgcctcgggctcccaaagtgctgggattacagacgtgagccaccgtgcgtggccacctgataatttttgtatttgtagagatgggattttgccattttggccaggctggtctcgaactcctgagctcaagcaatccacttgccttggccttccaaagtgctgagattacagatgtgagccactgcacccagcccctcatcttttttttttttttaaagaaaaaaatagctgggcatagtggcatgtgcttgtaatcccagctgctcaggaggctgaggcagatcgcttgagtccaggaaatcaaggctacagtgagctatgattgcatcactgcactccagcctgggcaacagagcaagaccctggctcgttaaaaaaaaaaaaaaaaaaactagccaggtgtggtggcacatgcctataatcccagctgctcaggaggccgaggccgaaggatcacttgagtccaggagtgtgaggctgcagtgagctgtgattgtaccattgcactgtagtttgaacaacagagcaagaacttgtttcttaaaaaaataaataaaaaataatgttgggcatggtggctcacacctgtaatcccagcactttggaaggccgaggtgggtggatcacttgaagtcaggagtttgacagcctggccagcatggtgaaaccccatctctgtagaaatacaaaaaaattagccaggtgtggtggcacacgcctgtaatcccagctacttgggaggctgagacaggagaatcgcttgaacccctgaggtggaggttgcagtgagctgagatcgtgccattgcactccagcctgggcgacagcgagacttcatctcaaaaaaaaaaaaaaaaagatcagagaaggtctcttaaagataggtagagagatttaaaagaagtgcagcaacaagctgcttagaagctcgttgaaggccgagtgcggtggctcacccatgtaatctcagcactttgggaggctgaagcaggcggatcacctaaggtcaggagttcaagaccagcctgggcaacatggtgaagctctgtctctactaaaaatacaaaaattagccgggtgtggtggcaggcgcctgtaatcccagctactcagaaggttgaggcaggtttgaacccaggaggtggaggttgcagtgagctgagatcgtgccactgcactccagcctgggcgacagagcaagactccattgcaaaacaaaaccaaaaagaaagaagctggttgaagtgcgttctaggcagagggaacagcaaatgctaaggcccagaggctggagcatgattgttttgtcttgaacagtggggccaatgtggtggccatgcttgataggggagagtggtaggagatgaggtcagaggtagtggacagccagatttagtagagacccgtaggccaagatggatatcacctcaaaatagcaccaggagagggtgctgagcaggggctagcatgggtgggttttttttttcttttttgagatggagtcttgtctgtcgcccaggctggagtgcagtggcccgatctcagctcactgcagcctccgcctcccgggttcaagcgattctcctgcctcagcctcctgagtagctgggactacaggtgcacgccactgtgcccagctgatttttatgtttttagtagaaatagggtttcaccatgttggccaggctggtctggaactcctgatctcaggtgatccgcccacttcggcctcccaaaatgctgggattacaggcatgaaccactgcgcctggccacatggtttttttttttgtttttttttaatggagtctcactctgtcacccaggctggagtgcagtgacacaatctcagctcaccgcaacctccccctcccgagttcaagcgattctcctgcctcagtctcccgagcagctgggattacaggcatgcgccatcacacctggctaatttttgcacttttggtggagacagggtttcaccatgttggctatgctggtcttaaactcctgacctcaggtgatccgccagcctcggcactcccagagttctgggattacaggcgtgagccactgtgccgagtcgggacccatcttctaaggttagactctaaagcagtgttgtccaacagaaggtacaatgtgagccacatggataattttttttttttttgagacggagtctcactctctcccccctgctagagtacaatggtgcaatctcagcttactgcaacctccgcctcccgggttctagcgattctcctgcctcagcctcctgagtagctggaattacaggtgcccgccaccacgtccggctaatttttgtatttttagaagggacagggtttcaccatattgctcaggctggtctggaactcctgacctcaggtgatgcacccacctcggcctcccaaagacacatgggtaattttatattttctttttcttttctttctttctttctctccttccttccttccttccttcttgcttgcttctttccttttttttttcttttctttcgaggtggggccccactctgtcatgcacctggagtgcaatggcacaatcatagctcactgctgcctcaaactcttggacttaagcaatcctcccacttcagcagcctcccaagtagctgggactacaggtgtgtgccaccatgcccagctaattttttattttttgtagagttgaggtcttactttcttgtccaggctggtcttgaactcctggtttcaagcaattctcctctttcagcctcccaaagtgttgggattacaggcatgagccactgcctcagccttaattttatattttctagaagcaacattttaaaagtacaaagaaacagatgaaattaattttaatttttttctttttttttcttttctttctttctttttttcctttttttttttttttagacagagtcttgctctgttgcccaggctggagtgcagtggtgcaatctcagctcactgcaacctctgcctcctgggttcaagcgattctcctgcctcagcctcctgagtagctgggattacaggcatgcgccaccacgcctggctaatttttgtatttttagtagagatagggtttcaccatgttggccaggctggtctggaactcctgacctcgtgatccgcccgcctgggcctctcaaagtgctgggattacaggcgtgagccaccgcggctggccagttttaatatttttaatttaactcagtatgtccaaaatagtataattgtaacatgattattattttaaaatacgtgaattgtttaaaaatatgtgaagcatccctgtaaaatcaaacctggggtgataggacttggggtgtgtccctctctgggattagtcaggggaagtagaataattacaggagcattggaggtggccagtcctagtcataccaggccaggacactgtcactgctatgctactgatggaaacaaggcagagacgaaacagaattaaatcaacatggaggttgtttggagaagtccatggattgtacatctgaacttgaaatggccagtggccaggcacagtggctcacacataatcccagtactttgggagagtgaggtgggaggatcacttgagcccacagttcaagagcagcctggagaacatagcaagaccccgtctccaccaaaaaaaaaaaaaaaagggaaaaagaaatggctaatgatgcgggagacatttttatctgatagttttagaccagattttgctgttgtagattgcttctacctgtgaattctttgactgtattcccaagtgaaattgggaattctgattcccaaggaatcagaatcccatccatatttgtggtatgggaaacaagaccccttgcaggggagactggtccaccaggagaccctgtagcccagggacctgggcgccagtgtccctcccaaggcctgaagacataaggctagcatgggccgtggctggctgtgtgggagttcagggccggaacaggttggaaggtagtctcgcctgctatcccttatttcttctctttgcttttttctttgccctttgctttttgtgttactcagggcctgtgggaccctgattctgggagaaatctgttgtgctctccaggttcctgtctcttcttcagatctccccgggtccacttgtagacttgtgcaccctgattcaggatgagaccagaggaccctgtggggcagcgattcatagggagctcaaggccagttgttattctttgaatttgagagaaacattggaaatgtcatcttctgaaatgaaaactaacagagaaaggcaaatcatttgggaaaagttacttaaatggtaaccttgttgccaataaaagagtattttctaattcaaagtccaaagcaagggtccctcttagatctctgttcaatataagattgctctatttcttgggagtcgtgttggtgacactggagaccagaggattccggttctcagagagagggatgctgtgatggagtaggacagtacagtcttttggcttgtatactgaggcacagagtggggaggcctgctgtccttggggagtgggtagcagcagatcaggcaccagaaagggtgagacaccccctctgacccttgtagtgtaacaggtgtgagtttgttcactttgtctcttgtgagcttggctagttcgaatcagtcccccagggcatcatcaccccaggctgttgtgtaaacattcgtacctgagaaggtacaactgtaatggtgcttatacttgctgtgctttacactaagacccagaatagcctatttcttcctctcctctgcctttctcacctttcttttttccttgtcatcgacctcttaacgttacaggagtaaacctaccactgtaatctgcttcaccttacagacacatccctatcttttgtcacctttgttccttttgtagcttgtgacagtaacaaactgggttgtttgaggtgaccccttccctgctctcctccttgggaatgatcttatccgcattgtactcctaggtcccataccctaacttttcagccagaggcacatttatagcaaggttaagggcatcagcagccagtgaagctgagcttcctcctctggtgagttaaaattgcaaatgttgacatctgatcccattcaccttgtggttgtggctctcctttacctcccataaaggaccagccctgtcgagaaccaccttcctccccactgtgcttcttcatgatttcctgcctccgctctttccttctggctttgcttgttctctgagaccgagaagcttgtgtcccatttctgtagatgtgtagcctcataggacaagtgatgtcaaggtttggcaacagtagatcttttgcttaggatttggacccggaacacagaatgtcaccttctgtgggctgcttggtgctacttggctgaagagcctttccaggagcaggagccataggagatcactttcctggccaccgccctgtgtggtatgcttgtgccctagcacttgccttgtgcccactcacagcagtcacagcgatggttttctttgactagcgatggaggtcaggcctctaacacaggagcctagaccttgggcaggactctgcatccttgtctaaagagagggttcccttaggtagtacgattccttatttcaggcctgcatctagatgcttccccacacaagttctgaggcctgtttaattccattgggctattgcatctctgggggagatgcacattttccttgtaatacaccctgtaggaaagttttgacttggtccagcttttcagagcatgagtctgagagcagattgattgcaaggccttgtctgagaagagaatagactgactcatgatacctggacagactccagagggagatgcgatgccctctccagctgctggcagagcattccttctcctgcttgggcgcctctgagcatgctggcgtccagctggccatctaaagatgaccaggatccactttccaccaaagctgcttgggtttccatcccattctgtaatcttatggaagaatccctctccagctctgataaagctcttctgcctttcacagtggagttggatgagagttgtagttcttggcatgccagggagcagtgtggaattgggggagatgaccaatatctaatggtttatactggcatttccaggggatttgagcaattgtcgggggagggtggtatgtcagcataggggcctcaaaaggcgaattctagggctgtctctgtggtttactaccttgtgaccttgggtaagttccctaaccctcatctgacagaaggataaaagctactttgtctgccaaacagggctggtgtgagcagaaaatgaatgtctggggaagaatgttgacagccataatacattatatcgatataaggtattattttaaaagctattagtattatattacatgccaagtatgttaatcatgttctagtttggggacagaggcgcatttactcagacatggcctacgatgtcctcttgaagcgcttttcttccacccaggctccttgtgctggaactgggcagatggtccatcttccttaaaccctagaggaagaaggaagcagtttgctttcctcagaggagacctggatgggacttctcaaattcactctaatgtgtgaggcccatttctctctctgtcttatttggctctcgcagcgatatgaaagtgaaagttcacatagtgaagttggaaaattcagtgcattgccataaaaatactgatttggtttcttctgcgctagatctggccctgtctgccaaagcttgttggccgtcattaggcagggcaagtgctctttggtgccctgcagccccttcacttccccaggtatgctccgtgcgagtggagtttggctgcttgcctggtctatgaaggcatttggtctcaaccctcaaaggcttctaaattctacagctgtcaaggctctgtttatgatggagaaactcgaataggcagtcttgtatttagagtggagcgaaatgatacagtatgaaactttaaaacaagaagttacttgtgagaagcccttaaaaggtaataggcaatagactaatatgagctgtagtacttactcaggtaataacactggtattaatagaattaatacaattccatcaatacagtcattttcaggacagagtacgtagtggacatagattctgtgtgagtgtctgtgtttgtcagttcacagaaaacatccaggtcgttctcttattattggtgtaccttttccattcagtcattcagcattctttggcaccaactgtgttccaagctggagcgagaggtttccattttagtgcctttctggcccctccagagatttgatggtgcctcagaatacaataaattacatatatatatatattttgagacagagtcatgctctattgcccaggcaggagtgcagtggcataatctcggctcactgcaacctccgtctcccaggttcaagagattctcctgcctcagcctcctgagtagctgggataccacgcccagctaatttttgtatttttagtagagacggggtttcaccttgttgaccaggctggtcttgaactcctgacctcaagtgattcacccacctcggcctcccaaagtcaaagtgctaggattgtaggcgtgagctaccatgcccagccaaatatataaatatattttaaacacaagttagtaccaatcaggataggtgtcagtgttagactagatttaaatctagtttcatatggttaatctagttcatactgtttacaagagatgcaaataaggacatggaaaggtgagaaaaactatgttctaggaaatactgaccaaaagaaagctggccaactttattaatatgaaacaatacattataaggcaaaaaagatcacatcataatgatacactgtttaacttactagaaagaataagtctttttttttttttttttttttttttgagacagagtcttgccctgtcgcccaggctggagtgcagtggtgtgatctccactcactgcagcctccctagtagctgggattacatgtgcgcaccaccacgcctggataattgttgaatttttaaatagaaacaggttttcaccctgttgccaaactggtcacaaactcctgaccccaagtgatccgcctgcctcagcctcccaaaatgttgggattacaggcataagccactgtcactgtgcctggccaataattcttaattctttacctggtcagtagatcaaatgagtcagtaagaatttacaagattagaacaatatagctaaccagcttgaactttgaactgcacccatcaactggagaatagttatttcctttttttttttttttttttttgagacagagtctcgctctgtcgcccaggctggagtgcagtggcacgatctcagctcactgcaagctccacctcccaggttcacgccatcctcctgcctcagcctcccgagtagctgggactacaggcacccaccaccacgcccggctaattttttgtatttttttgagggggggtggggggggggcagagtcttgctctgtcgcccaggctggagtgcagtggcgccatctcggctcactgcaagcttcgcctcccgggttcacgccattctcctgcctcagccttctgagtagctgggactacaggcgtcctgcctcagccttctgagtagctgggactacaggcgcccgccacaacgcctggctaattttttttttttttgtatgtttagtagagatggggtttccactgtgttagccaggatggtctcgatctcctgacctcgtgatccgcccacctcggcctcccaaagtgctggcattgcaggcgtgagccaccgtgcctggccaattttttgtatttttattagagacggggtttcaccgcgttagccaggatggtctcaatctcctgccctcgtgatccgcccgcctcggcctcccaaagtgctgggattataggcgtgagccaccgcgctgggctgagaatagttattttcagaacatacagagcacttacgaaaatggcctacatgctgagccatggggcagatctcaccaaatttcaaagtctccacactacggctgtggttcttcacattttgcaagtgatggacttctttgaaaatcccagtctaataaattaaggttgcccagacttagcactgttgacttttggggttaaatagttctttgtgtggggctgtcctgtacactgtaggacatttagcatttccccaatagtggcaaccaaaaatggcttgacattgtccagtgtcccctgagggacagaatcttatctggttgagaaccaccattagagatcttgtctctagaaaaacacagaattttgcatacagtttcttccatctccattagagctagttgatcttgtcctcactgaggatggctgagggagtgggactttttctaagaaaggccgtagggcagccaagcagcctgggggtttggtctttgttctgtgcacggcctctccccacacccctgtcctggatatagatgctcacacgcgtgtgtggaggtgtcataggcatgctggtgctgatgggctgagggctcagactgccatgagcccaatgtcctgctcagggcttgaagagatgaggccagggcgtgttggaaggcagtcctgcctgctcctccttctcagcctctttcttctctctgcttttctctaaaatggtggtgttgttttaatcaagacctgtcaggctctggttctgagagaaatacttgctgcactctcaggtgtcttgtctcttcctcaggttccccatgttcacttgtagaccatggacctccaaagccacaaacataaggcataggttttactctaagcctttcggtaggtgccagtcacagagagttcaagtccgtaacagtaaaaaatacattattaaaatattagatatgaccataaaggaatgtaaaagggagagtttattctgaggaccaggtgatgcaccatgctggtgggatcagaggagactttataaaggagaggtagacatccaggctgggttgtgcaggatcaatgggagtttgcaaggggaggggacattgcaggcaggtggaacagcatgctgagttctgggggctagtgatagcaaaacagagacagaaggtaaaagaaggtatgggtgaggcatgctcagaagctttgactaggtctgcaagcagttgaagggtttaaagtagggaagtgacatgatcagatttatgtttaattttttttccaactctttatttcataaaatagagtaagtgttcctaagtttaggtttagaagttgatatgagtggctctgtgaaagacagattacaggtcagaaaactggttggaggctatgcaaagaacccagctgaacaatgaggtttagaactgtcatggcggccatggggctagaagggagatggacctgcagagggtatcaggtccccaaaccccaaaatctagtccacatttgttatgttgaaggacacagtcatgtccctggctagagaaaggacactgcccttagctccaaaaataaagactaagtttttatttgagagagattttttcctctttttatatacatttttttcctctaggaaatagacagacggttggaaaaaaaactgaagatcacacaaaaagagaggtaaggctgctgtctggtctgagggctcatgctctctgtggtttgagagccgggcagtcagtggtgttctccagctggccattaggattagcaggtcctagcaggtcaggctctggggcagcaaacccttccctccaaattggagaccaggacgtggtggcttgaggctttagggttgaggctggggtgttgcacctgcctctgaccttcgtgggctccctgtgtgaggtcatctgatgcaatgtgaggaagtgacaagttggaagacttgagttttaggcctggcagtgccccagttgctctgaggtctggggcaagtcatttcccagatctggacatcagtttctttctctgtggcatgaggagtgtgggcagatgatttctctgggtccccagtgacttggtggtctagggtattatgagggtatcctggaagaaaacattctaggaaattcttgaaaaaacctttaaaaatagctttgttttccacctagacgacagaggagggtgtttccagagtaggtgaaagttgacttcggctttctgcttttgggcttagggaacctgttggttttccataggtacaagggacaggaaggaggatagggcccctctggatttgctcacggggctgcacagtcattccccaggaaactctgggtgctctgcccgcccgctagttttcctggctccctgcctctttgatcagattgctggctccttgtctgtctgctcatctcagcaaccacgctaaccctgggttacagtcctcgttccataccatttgtgtcctacccgagacttgtttccatccaccctggctcagttcctccaatcccgactcctcctgacagccaaggctctggaagcaggcttgtttggttctgaagagaagctggttgactgctctgggtagggtcctggtggctgttgtcgggtggtcattcctgcctgggttcctgtctcctcctgtggcttttgtttctttcccttcctgtgttgttgtccctctttgttttttgtcattccacctctccctgtggacacatcgccttgatgtacgcgtccaccagccttggacaatgcttttcttttgagcattgccaagcactgtttctaggagcatccttcactccagccccgccgctgtccaaaagaccagggagccctggcaagggaggtttctctgttcagaagctttttgaagaggattcagttgtctggtgtagcttgtctctgggaggcacaggtcactctcactagaaggtggcttggtaaatcttgatgccaggcagggatggcgtagtgggctcctttgtagtgtttgtctggtttgagcatgtgatggaagatttggctgagtgaacactgctgacccccaagttcaaaggctcccaccccaccagccagtcctactctgatctgcgtagagaagctgggatcttaactgacgtcattcaattctggacataaactgttttgctgcagggccaaatagtggttgatgtggctgtggtgaacatggggatagaagtgccagaatgaggtggcgttccagcccctgtggccaggggttagggctgaggagcagttcctgtggcctgtcagagctggtcgcaagcttacttttttgggacacccttcttgaggagtggaaattttgctgtctggtcagaggccagagaatcatgcatgggtagaattagggagggagaggaaagtgatgagaggtgggtgtgggacatggacagggcctccttagtcaggagcatgatttgtgaagctgtgtttgctctttgtcagcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggtgagtgtggctggcagggccggccagtgatggctgtcccagtccacccgggaagaggagagcatcctggctgcgtgtagagtagtgagaagcaagcagagtcagggtaggaaccatgcagctccacttgctgatcccagcctgctggcactagttcactgtgccgcattggctggagagggctctgaaagccttgccagggaggaggtggcagtttgctggcatgctccctctgcggttggtagtcaccgggggcactgttgtgtagagagtgaaggcacagatgagcttgtgtcaaaatctgcctcttacctcttctttagaacgacttgacctctctgggccttagttttctcatctgaaaaaatgggataataatagtaccaaccttatcaaggtgttgtgcaattcagtgagtaaatgagcataggatgtggagagcctgggctggcagagtggaaagtaccccagataagtgctttgatgatattttctgggtctccagtatgcccactgtgatgtttttgtgaattttctaaattcctttttactcttaacatttttttctctgcagtattaaaggttgcatcatataagtttatcactttcgaatcaaacagtattcattaagatggcctccttctaactttgaggggctgctatggtttggtattctgggacttgaagaaaaaatctgcgtaccttctttctagctcttcataattttgaagagatacctgttctttttgttgtttctcctctaagtcttcacctttccagggtggaaaaatagtcatatgagtcaaccgttaaccgcagagtttggagaggagtgggagggaagaattggggggcgggggatgtgtccctctgctgagctcttgattccagttctttactttggcctaacactctggagattccaaatggttctgcggagcatgtgctatccatggtcactgcctctgggcagagtgggccctcaagcactccccctgcctacaagtgcatgatggcagctgagcagggggaaaggatgctgtagctgctagaggtgaatgtgcaccaccgaccctgcctgctcacaggggcctctcaacttggaggtgccctgagtcagcttcccaaagaagcaggcttgcggagccagagtgacgtgggcccagctatatggacagttgattttaagatgggggacatctaggccaggtgcagtaatcccagtactttgagaggccgaggtggacggatcacttgaggtcaggagttcaagaccagcctggccgacatggtgaaaccccatctctactaaaattacaaaaattagctgggtgtggtagcatatgcctgtagtcccagctactcggtaggctgaggtaggaggatcacttgaactcaggaggtgggggttgcagtgagcggagatcgtgccactgcactccaatctaggtgacagaatgagactccgtctcaaaaataaataaaaaataaagaaatgatgggggacatctattatatccttcttcaggccttcctctgcttttcttcctttcaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaac

SEQ ID NO: 37596 - DNA, 29145 bp, Homo sapiens; identical to SEQ ID NO: 37595

SEQ ID NO: 37597 - DNA, 43281 bp, Homo sapiens
cgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgaaggaggcaggggttcgagaggcggccgggacacccctccggcctaccttcatcctcttgtatacctcagccgccggcccgccctccccgagacgcgggctcctgtcggctcgcacaattgccactactaccccgcgccccagggacggctgcgactccgccgccagatcccccagaggggccatgcagaccctcagcgccctgctccttcaggccccgggcgcccccagcctttcctcagtgtctgcgaggcccgggctgccggcccgtggctgttcagcgcctccccggttcgtttgagatacagtgggcctggccccaccgctgcgtctcccggcagccgggccggaggcaccgtctggccctggtctccaaagcgccccgaggcccgccgaaatctccccgctcggggcgacggacgcggccagcaggccccagccgcccagccccgctcgtcgccccgagcctctcccctgcgcagccagacccccgcgaccctctccctgacgtccctctctgtcaccaaggaccctctttgtgctgcttgaacgcccgtttcgttactgctgtttagatggaggtaggaacgggccattaggcaagcagttgggttgtaattagttgtggactgtcgggaagaaagctgtgtcatcgataagcaacaaagagaaaccacctgatgttcacggttactggtgttagtacgttcctgaaacgtaaacttttgagctgaatagaggtttaatttttctttatggcagtcttggtaggggatctagtgtgaaataatgtaagtttaaaaaaaatccattagtttcaaagaaaatagacgttcagtccttggtttcttccctttgttgtcttcttaggctaaaatctacacgactttgagaacgtttattaactcatatattctctgttgctctaggctattttgctccatattctcctgttttattactgaaatcttgtagatttacagtgaactccctgcctctacggttctgctcatactcattacatggaccaaatcaatgtttgtggctgttgttaatttgaggtgtatttcttcaactatttgtgtttaataacggtttattcataattaactcgtcttttaatagctctataactttatgcactgcagtgaagaacgaattactgaaatgtgaatgtcatttagcattaaatttggaatttataattgttttgttacgccaagtttttagctcaatgctgtttattagaagagcttgaatagtttagattctgtgatgctgtctgggggttatattatactttacataaattaattctgtaatcccgtaaggaaaaaaatggattgaaaatgaaaggaaaagtaaatgacactatgcttattgtgtacattagtaggtttttgacattttaaattgtttttctcctaatatctcagttgatccttgcagtaaatagaacaggtttaattatccccattttatagatgaggcacttaggtcagcagtcataaagtgacttgcactagggccacaaaaaggatttacatgtcttaacagtcaaattttttagtagcttcaaaaaaactggcttttttgtttcttaaggaaaaaactgaacaatttgtaaattggtgatttaaattggtatagaaatcagaaatttggattatggtagtcatgtttttgaacaaatgtccaaacattcctagaaggcactcttgaggtaaatcagttaatttaaaaaaagaaacgagagatttttattaacaaatattaatatttggaaactctagtacaaattattggaatagttaaataaagttataggtcttgcctttcggggttttgtgtatatatatatactttcttcaattaagtttttactgatgagcatgtattacatgtatttagaatataatgactcttgaatgtttgcaggaagactgttagcaatctcacaaaggagtctctgtctgtcccttgacctgttccaaaatccagctagcttttttagagctttagccagttaatccccaagactaagtaggattagtgtcactctaggagtatgtagatactggactcatgaaaccaaaacacttacagattgcttagagctttcttcataactctgaagtcagaacttgtgattttcttaggtctaagatctcagtaataatataccaacttaatggaaaatttgaaagatgtctttatagttggaagacgtgatctcaagagtacactttggttcatagaactgttcaagtgggaaacgttttaggcaagtggtctttagttagtgacattttcatggatgaattaaagaatattgtagagttgatgttaggagacgagagattactactacttcagctaacaaattaatatgattttcaaagtattgtggctgtgtaaagtaagtgaaacaaaacgatattcatttaatacttgggaaggtagaataatctgacgagactgaagtaaaggtatctgttcactggctaatgttgctaggtaggtaggccaaactttgttaatgatagacgccattttctgccttttttggtgaatgtagaccacagaagcctttaggttttgagcagttgagatttattttacatcggaaagactggctgtatgagggtctgcaactctttgcttctgagttcgtgttgctctctttaagtgccttcgcttaggatactgccgatacaaaggatatgctgttttctcctaaaatcttaggcccacctaactttatagttgataatttgattaaaaataagaaatgaaagataccagagttagcaatcagtcatcccactcagtagtattaggaaagttgtcattaagcattgagtaattccattcagctttccaccactgctgttcaagcagctgctgccaccactaggctgagtctaggacagacactgccagtagggttgagacatctgggaccctaatcacatggtacagtataggtgagggagtgatgcaccagcctcacaagaagcaagatttatactttcagctacttacgtgatatcactgtttagatcctcccaggattctcaagcctaaacgtgtaagtgctgcctaaacctgtgtttctcccagtgttctgcatctgattggcactaccatacatctggttggataaaccataaatatgagagtcatctttgactcttaactcttcagtctcttcttgagctccggattgttcacaacattccaaatcacataggcctttccctacacacgtattccttctgcgtggtgaactcttctggctgttggcatggctgagctctcttatcctttagattttagcttaactgtcacctcagagagggcttctctgaccattataaagagttctcttgttattttctctcatagatttctttttagtagcatttattactgtaattacgtatagtgtctatttgtttaaaaattttgtataccattagattttaagctctgttgaaggcagacaatgtctcatttggtttatatttagtatacagttcaatgcctagaacaaaataaatgcaataaaatagtgaacatataaaagaatgaatggaaaggatttctcattcttcacagccttctctgagaagggttcgtagtaagaatattctcatatacttatttttctttggtaggtgagtcatttatttggaatcttaatctctcctcatcagatggtttctgaagatgcatttagagtgatctcacttgcaaatagtaacttctcgttattttgcatcttcaacatctaggagtctgctaatggagcattcttaatggagcatttggtctgtggatgcattctagtcccgtttactttttttttttttttttttttgagatggagtctcactctgccgccaggctggagtacagtggtgcaatctcggctcactacaacctccacttccctggttcaagcgattctcctgcctcagcctcctgagtagctgggactacaggtgtgtgtcaccacgcacagctaatttttgtatttttagtagagacggggtttcaccgtgttggccgggatgatctagatctcttgacctcgtgatccgtccgcctaagcctcacaaagtgagccaccgtgcccgaccccgtttacttttccatggtcaaatttctcaaactcctatttctggtattcctgaatctcatctcacaaaatatatgcaaataaacagcattagagtcaattattataggcatgccatcatacttactatattaggcatttagctattccacagagtacttattgggtgcctactatgttttgtagagattttagtcttgtcagtaaataaaatggaaccaatccttgccttcatggaaccttcattctagttaggggagacagatactagtaaacataattaaaaatgcatagtatattggaaggtgaaagtaatacagaaaaacaacaggagataagggagctttgggaatgtctcaagagtgtaattttaaagtaagtgagtaggagagttgtaatattaaagtgggtgattaagtatcagctttattgagctgatatttgagcaaagttttaagggagttggaagttaaccatgtagttatctgggggaagaacattccaggcagaggaaacaactagtacaaagaccttatggctgaagtgtctttcatatttgaggaatagaaggaaaaagaatagcaagaaaggaaaaaggaatgaggtcacagaggtagttggagtcctgatgtatggggccttcaagcgccctgtaaggactttggcttttactttgaggaaaatggggagccattgtgtgatctaagcagagggttgatgtgatctttttttttttagagaaagttgctgtgttaagaatagacttagcaggaagaccaatttggaggcttttactaggcttccaggtgagatgtgatagcttggatcagggtagttagtagtggaagtggtaagaaagttacattcttgatttattttggagctggagtcagttacaatcaaggaaaactagttttttggcctgagaactggaaggatggagttaccataaacgaataactgcaatgaggaaggccaaagtggattaaattgtcctggccaacatagtgaaaccccatctctactaaaaatacaaaaaaattagctgggcgtggtggcgggcacctgtaattccagctgctcaggaggctgaggcaggagaatcgcttgaacccgggaggcagagattgcaatgagccaagattgcaccattgcactacaacctgagcgacaagagtgaaactccatctcaaaaaaaaaaaaaaaaaaaaaaaagatacagaacgttttcagcattccagaaggctccttcatgctctatcaaggtagccactatactgaattctatcaccatagattagttataggttagcataccttttataattagcatacctacaataaaaggcaagtctaaaattgcaaacagaattgtacctgcctctgtctaccttggattaattttggagtataaatgctgtggagtggagatgttgaactcaacagaaaggtgccacataaaggacagatatcaaactttttatttttctctctctctagacggtctcactgtgtcacccaggctggagtgcagtggtgcaatctccgctcactgcaacttccaccttccgagtgcaagcaattctcctgcctcagcctcctatgtaggtgggattacaggcatgcgccaccacacctggctaagtagagatggggttttaccgtgttggccagtctggtctcgaattcctggcctcaggtgatctacccgcctcagcctcccaaagtgctgagattataggcgtgagccaccgagcccagcccacaacttttattttaataaaatcttatgtacaaaagcccaaataggcactgcaccgatgactgcttattattgtggtactttgcgcatcataatttagatggcttcttttatgaaatattttgtatcatttaaatagtccagtgtagtttgttttcattgctcttcatgatgtgaactgtgtatgcagtcacacttttcatttagtggaaaattcagttttcaaatttggcagaaagtggtataggtgggattatattttatttgaggtttccgttttccaggggaaaagagtttgcaatcagcagatcccagcctggtataagaatttttgaaatgttttacaggtgatgatgaacagtctacacagatggctgcaagttgggaagatgataaagttacagaagcatcttcaaacagttttgttgctattaaaatcgataccaaaaggtttgtttatgttttaatattttattaattttaaaatttataagtattgtctttgatttatagtgatactcttggactagaagaatgttgatgttgggctgggcactcccagcactttgggagactgaggtgggaggatcgcttgagcccaggagttagaggctagcctgggcaacatagtgagaccctgtctctataaaaaataataataaaattaggagtgtggtgtgtgcctttggtcctgctacttgggaggctgaggggaggatcacttgatccctgaagactggggctacagtgagctgtgatcatgccactgcactccagcctgggtgacagagtcaaactctgtctcaaaaaaaaaaaaaaaagaatataggccaggcacagtggctcatgcctgtaatcccagaactttgggaggccaagacaggcggatcacttgaggtcaggagtttgagaccagtctgggcaacacagtgagaccttgtctctactaaaaaaaaaaatacaaaaattagccgggtgtggtggcacacgcctgtaatcccagctactcggggggctgaggtaagaggatcacttgagcccaggaggttgaagttgaggctgcagttagcagtgactgcaccactgcactatagcctgggcgagagagcaagactatctcaaaaaaaaaaaaagaatgtttatgctatgtttttgggtatctaaggcatattaggaacttaaattctgactgccgtttgctaaattcatcatgaatcctgctgaaaaaactttaagctttcctactctaccaagcagccatctaacatgtaccaggaatgcaaaaagaacagtcatctccagcttctaaaaacttggaagtaatggtaaatcatacattgaatatctctgagaggttgatcacttactgtcttgaatcctatttttgggaatggagtcatttaatcagtggaaataaggacatttataggttcctcaaagtacctgatgtccacaagtctattttgtttctccgttcctcctccccatcttttaaaaaaatttttgttataggaagtttcaaacatatatgaaagtaatgtaacagtgtaatgtaccccatgtacttgtctactagctttggtaattaactcatggtcagtcttgtttcatctatacctccacccatttccactcaatccaaataattttgaaacaaatcacagtcactgtatcacttcatctataaatattttagtatgtctctgaagtataagtattgttaattttttaagcataactataatattaatacttcacaaactaataataattctttaatatcaaataaccagccagtgttcgacttttcagttgtctcatcaaagtcatagttttattactttattgcagttttttagttcaaaattattcaagggccacacattaggaagcattgatttctctcagtatgtaggcttctcctccaactcccctgctccttggaatttatattttaaagacaccaggtcatttgttctatacatttgttctgtggtttcctacagtatggattttgttgactgcaatgtgttagtgtcaagttggttctttcctgttttctgtattgataggtagattcaggtttgtttcccctcccctcatcctgtcctaagactacttcataggtagtgatgtgtcttccatcagaagacagataataccctgttttctctctttatgatgttagcagctatcagtgatcattacctaaaaacattattatttatttttttctttgaagcaggatttcactatgttgcccaggctggtcttaaaatattggactgaagagatcctcccatgtcagcctcccaaatagctgtagttacaggcatgcttcactgtgcctggtgctgaaaacattaattcattagcacttacaaagtggtattcctgtctttttgatattgatactatcagaatgaataatgtgtttgaaaatcactgtcaagattaaagcattcagaaatttctactcgggaggctgaggcaggagaatgctgtgaacccgggaggcagagcttgcagtgagccgagattgcaccactgcactccagcctgggcaacagagcaagactccgtctcaaaaaaaataaaaataaaaataaaaaaataaattcagaaatttgcctataagtttgtaaactttatgtaaaaattttctgtgtttacaaaaacatcaagtcgtagtatagcctgtctcacaacagttactgaactatgtatttactgagtagtttttaaaaaacagaatctgtcaatttaagtatatctttttttttttattgttcatcaccttcctgaagcacctttgagagttggcagtggcaagaagaatatagggatttatagggaatgtgcaatacatgagaattccagaattcttgagattgtatacagactgatgtgtctggcttttttttttttttttttttttttttttttttttttttgagacggagtcttgctctgtcgcccaggctggagtgcagtggcgtgatctcggctcactgcaagctccgcctcccgggttcacgccattctcctgcctcagcctcccgagtagctgggactgcaggtgcccgccaccatgcccggctaattttttttttttttttgtatttttagtagagacggggtttcaccatggtctcgatctcctgacctcgtgatccgcccgcctcagcctcccaaagtgctgggattacaggtatgagccactgtgcccggccgtgtctggcatttttaaaaataaattacttttttttattttttattttttttgagacggagtctcgctctgtagcccaggctggagtgcagtaacgtgatcttggctcactgcaagctccgcctcccgggctcacggcattctcctgcctcagcctcccaagtagctgggactataggcgcccaccaccatgcctggctaatttttaaaatagttttagtagagatggggtttcacagtgttagccaggatggtctcgatctcctgacctcgtgatccacctgccccggcctcccaaagtgctgggattacaggtgtgagccatcgtgcctggccttaaaaacaaatttctattagcagatgcagggatacctgcatatagtgatggttcatgtttgtttcactgtagactgcatgctgatagaatctagtgtgcctttaaattatggaaaataaattttcttcatttcataataactaagtcacccaatgttttgggatcattttagtgtgtatgtatttttggagatagcgtgcattgaaaatagattagtaggaaatgcgtaaaaagtttacaattatttctgaaatggtaggattttgggtaattttttttcttgattttttactatgtttttaaatgtttttatgataataatgctttatatttgagggaaaaaagcaaattctagttcttagaagcatttgtttgattattggaagcatctacattgatgagtatctcttactaatcttataaattctctctcccatccctgaccactcagctcccttctctggagggaaccaaatcaagaaaatatatttatgtttgttttccttccatgttttacaaaaatagtattaatagcattttgacatacttttctatacctttttcttttcttttttttgagacagagtctcacattgtaccctgagctggagtgcaatggcatgatctcggctcactgcaacctccgcctcctgggttcatgcagttctcctgtgtcagcctcccgagtagctgggattacaggtgcacaccaccacacccagctaattttttgtattttcagtagagagggagtttcactatgttggccagactggactcgaactcctgacctcataatccacttgcctcggcctcccaaagtgctgggattacaggcgtgagccaccacgccaggccaatttttgtatttttagtagagacagggtttcgccatgttggccaggctggtcacgaactcctgacctcgtgtccacctgccttgacctcccaaattgctgggattacagatgtgatccacagtgctggcctgcctttttttgtgattgcataattattcagtttttattggtatatagattgcttttaatcctttgttattatagagtattacattatcacatgcctaagtaagtcgtaggccttatgtcttcgtgttccaggttaagatattgtattcaggtatacttgtctgctgaggaagcagcatggcagataccaaattaattttttagctaccagatgcagccactagcttgtgggttgtaagagcaaatagttctttctcttttgagatgaagtctcactctgttgcccaggctggagtgcagtggcgcgatcttggctcactgcaacctctgcctaccaggttcaagcgattctcttgcctcagcctcctgagtagccgggattacaggtgtgtgccaccacgccgagctaatttttgcatttttagtagagaccagatttcaccatgttggccaggctggtctcaactactgactttgtgattcacccgccttggcctcccaaagtgcttggattatacctgtgagctaccacgcccggcctttttttttttttttttttttttgagacagagttttgctcttgttgcccaggctggagtgcaatggtgcaatcttggctcactgaaacttccacctcctgggttcaagcgattctcctgcctcagcctcccaagtagctgggattacaggcacttgccacaatgcccagctaatttttgtatttttagtagagacggggtttcgccatgttggccaggctggtctcgaactcttgatctcaagtgatctgcctgcctcggcctcccaaaatgctgggattacaggcatgagccaccatgccaagccacaaataattctttcatttgaaaattataaaacaaaccagaaaaagtcttaatgaaataagaattatatttttctccttcaacctgattgctgtgaaagaaactggtagttgcaggaaaatacttgtgattggtacagtaaattttattaaaacaactcagtatttagaaaatacttgcattcatctagtgattttgtttgattttgttttacagtgaagcctgcctacagttttcacaaatctgtatcctttcagtaaagaatggcttatatatatacatttatttaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagctaaagataggatagggagtttttaaaatgtgaatatctgaaaaacaatatagatcagttgggttggaatgttacaagtagcttgcaagaggcagctggcagcaagatggatagaaaaggaagttatgatagaggagaatgtagtagattcttcactagaatatacctcataaattaacatgtcacatgtattaatactacaggtataatgatgcagtacttgaaattatttaataaatgttagattatattgtgaaaatcacaaagatcatttgttttcctttgttaccaatagtgtttcgtaaaactatcctttcgtttcacatgaattgttagacttcattaaactgtacagatcctgtagtgtgtgttccatccagtttctttattggagacagtggaattcccttggaagtaatagcaggaagtgtttctgcagatgaacttgttacaagaattcacaaggtccgacaggtaagaaggaacagaactgttgtttccgtaaatggtacgtcaggaattggatttttttttttgagatggagtctcgttctgtcgcccaggctggagtgcagtggtgtgatctcagctcaagtgcagcctccgcctcccaggttcaagtgattctcctgccccagcctcccaagtagctgggattacaggcacctgccaccacactgagctgatttttgtatttttagtagagacagggtttcaccatgttggccaggctggtctcaaactcctgacctcaggtgatctgcccgcctcggcctcccaaagtgctgagattacaggtgtgagccaccgcacccttcctaacattggaatatttttggagcccctctgtatattcaggaaactgccatgccaaaaatcttaaaaggtagtaagtactgtctttgtcacctgtttttgtaaatagcatgaagttacaggtgccagtagccagtacctaatacttgactgacttctttacctttctttatttttttatttttttgagatggagtctctgttgcccaggctggagtgcagtggactgatctcagctcactgcaatctctacctcccgggttcgagcgatttttctgcctcagcctccccagtggtgggattacaggcgcatgccaccatgcccagctaatttttgcatttttagtagagacggaattttgccatgttggccaggctggtcttgaactcctgacctcaagtgatctgcccgccttgacctcccaaagtgctgggattacaggcatgagccaccacacctagccatcttttaccccagtctcaacacataatgaatatcaccataactttgttgaaagagaaagttgctgtcatattaaggctctaactatatattgcttaatatattttaaggacgttatactcaataattaatcatttctgtctactttggacaaatggctggtagaagtttgtaacttttttctttgaattctaatttgagggaaaatcaatagtgtgctttaacaaatgtttttatggtcttgccagcttgcaggtaaattccataatgtgattatatcatacttaggattatacattttggattcatctatttatgagcatttcgtatttctctttttatagagtataaatcaacctgtattttggtctctactgccatggtaagtttagattcttatctattaattaaaatccaatttattttctgcctagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggtaacttttaatgtacctttttgagtgcaatagaagctccttcactacattttaatatttaaatattaatattttaaaaatatattgtatgtatttttcttcacatttatttaacttaaaatttaagagtcatattaaatacacatgtgtcatttagtggcagaagacaataaagtcagtgaatgtcagctcaactcccaaatagtcaacaatccagagcaattgatttataatttctgctattgcgctgcatgcttcaaggaatgtcatgacactgagcagttttataaatctcttactagcctagagaatttggaaagtttcaaatgaactaaagtattatatttggaattgtttctataacatgtaaaaagctatataaatttaagagaatagtgttatatatattttttttgattagaggtaaaagataattatgaaatagagcttgtagaagtaagaggtgtgactgtaaactcattgatagaaaaggcaaaagagaaatttttgggattgtggttggagttgtttggtgtaatatagctttgtattaggcaaccgaggggtaaataaatcaagatgttaggatattagtgtcctaaaagatgaatctactccagcatcccacacaaataatcatcaagcttctatttgaatgcattcaatgatgggaagctcattaccttgctaggaagcctgttctgttgttgaacagctctagtttttagaaagagtcttccttatattgagctgaaatttgatgccccataacttcctgttaacattaatgctgccttgtggagttacacatgacaggttttgaatatttgaaatacagctatttgtctcattttgaggttttacatcggatggatcattcaacttctggatgtgtacggaacggggggactctattatggatgttcatttaggtctacgacagaataattactttaattgtatttacctggatatatatcatttccaaaattcttcattccattttgaagatagacacatgtttccctctggtataatattctttcagcctgaaaattttcctttagcattacttattgtacaggtctggagttttctttatgtgaaatgactttgttttatcttcattctggaaggatatttttgctggatataaaaatttttgtttacagttacaggtattgtccaccgtcttctggtcttcatagtgttctaatgagaagtctccacaaattctgattgttcccccctgtaaggagtatgttgcttttctctggctgctttcaggatttctttctttctttggtttttagcaatttgactgtgatatgcctaagtgtatttttctttgtatttatcctgtgtttggtttgcctagtttcttacatctgtaaatgtgtgactttcaccaagtttgggaattttggtccatatatcttgctggaatgaattacatgtatattaggcttcatggtattgtcccacaggtttattttttcacacttattttttcttctttggattggataattctgttgatctgcaagttcactgactctttatcatctccattctgatgttaagcccatccagtgaattttttattttagataaaattatgttatacattttttagttgtaggatttctatttctttctctcttattataactttttattttgaaatagtttgactcataagttacagaagttgtgcagaatgagtactcttcatctacgttttattcttttaattcatttcaagtgtatttcccttttcctcatttgagttataatggctgctttaaagtctttgtctgacagtttcaatatctagctcatctgaggattggcttgtgttgatcacctttaccctttagaatgggtcacattttcttgtttgttcatatgtcaaaaaatgctggattgtatcttgtacattgttgtagacactctggatttcattatattcctgcaaagagtgttgtttttgttttagtagacaattaacttggctagactaaaactgcaagctctggcttacctgaggtgagtagcagctctaatctcagtttttttttagcttaaaaaaaatttttttttttttttggtcaggtgtggttgttcacacctataatcccagcactttgagaggccaaggtgggcagattgcttaagcccaggagtttgagacccgcctggacaacacggcaaaactctgtctctacaaaaatgtgtctgcagggtctggctctgtcacccaggctggagtgcagtggcacaaacatagctcactataatctccaactcctggcccacgtgatctcctgcttcagccacctgagtagctaggactacaggtgtgcaccaccacacctggctaattttttttttttttttgagatggaattttggtcttgttgcccaagctggagtgcaatggcacaatcttggctcaccacaacctccatctcctaggttcaagcgattctcctgcctcagcctgctgagtagctgggattacaggcatgcgccaccatgcctggctaattttgtatttttagtagggacggggtttctccatgttgatcaggctggtctcaatctcctgacctcaggtgatctgcttgccttggcctcccaaagtgctgggattataggtatgagccaccacgcccagcctaattttttaattatattctttgcagagatggggtctcactatgttgcttaggctgtctcaaactcctgtcctccagtaatcctcctgccttgccctctgaaagtgctgggattacaggcatgagtcattggatccaggcctgtagctttttaaaactatttattatggaaaatttcaaacatacatagaagtagaaaaaaatagtataagaaaaccccattaatccattgcctagcttcatggccaatattctcatctgtgccctccactcctcttctttttcaacttatttagaacaaatctcaggtaaaatatttcaatatgtatctctaaaatataagaaaggaatataaatcttttaagattatatatagttgccttttaaaataattttttttttttgagacagagtctcactttgttggccaggctgcagtgcagtggcgtgatctcggctcactgcaacctccacttcccaggttcaagtgattctcctgtctcagcctcccgagtagctgggactacaggcgtgcaccaccatgcccggctaatttttgtatttttagtagagacggggtttcaccatgttggccaggctggcctcgaactcctgacctcaggtgatacgcctgcctcagctcccaaagtgctgggattgtaggcgtaagccactgcgcccagccaaaataaattttaattatggaaatttgcaagcatattctaaagtagagagaacagaataacgaactcgaggtactcatcatcctgcgtcagtgattcccattatttgctcggtttttgttatctgtctccctatatgaccacccttccaggttattttgaagcaaatctcaggcatttgtatgatttcatcttttaaaatatcaatatctaaaagataagaaatttttaaaaataacaacaatactattatcaaagccagaaagcttaatagtaatcctttttgtcatcaattatctaggcaatatttatattatactttttttcagtttgagttacagttcgatatattgctattggttgatgtgtttttaaatttaatatatagatttctgctctccctggtagtttttcctatagttttccacagtctggattttactgcatccccatggaattgtgtaagatgttcctctatcccctttattcctctaaattggtaaagctacagacttgatcaagtcagcttcattattctttttgacaagactactttgtagatgatgatgtatatttctctcaggagatacattatgcctgttattccagttggctttttaagcctaaaggcggaacttctcaatacatttttattatatttggatttttatcagttgttttagcttattgaggtgttttttcaatccagaattttttttttttttttttttttgagacagtctcgctctgtctcccaggctggagtgcagtggcgctatcttggctcactgcagcctccacctcccaaattcaagtgattcttctacctcagccttccaagtagccgggattataggcacccgcaaccatgcccagctgattttgtatttttagtagtgatgaggtttcaccatgttggccagactggtctcaaactcctgacctcaaatgatccacctgcctcggcctcccaaagtgctgggactacaggtgtgagccaccatacccgacctagaatttttcatttaggaattagcagttaaatatgagtgttaataagctatttcacacaattttgggtcacccataaagttacacatgggccaggtacaatggctcatgcctgtgatcccagtactttaggaggccaagatcagttgagctcaggagttcgagaccagcctcggcagtgtgacaaaacccagtctccatacaaaatacaaaaattagccaggcatggtagcgtgcactggtggccccagctactagggagggtgaagtaggaagatggcttgatcccaggaggcggaggttgcagtgagccaagatcatgccactgctctccagcctgggcaacaaagctagaccatgtctcaaaaaaaaaaagttacaaatttatattttacatcttcaagtcatttatgaaataccaaaggcagagaactctgtgacatacaattggaaatcttcctctatatgacatctttccatttctctttaattatgagtcatagattcacctaactgtactcttattcaacacttttcccccagcttgtccacaggttatcttcataagatgttaaatttttgctgataataagacatgtcctcagcatttattttatttgctaaagaaaggtggttaatttcctattgagcctctactggctgctagtggttaccacttcttatccaagagttgcattcagtgatacactggtaaacatttatcagaaggatctgtggaagcaaaggcccatatttgtagtatttgctaatttcccaggtgtaaatactcccactttgttgatttcaagctacctaggttatgcccctgaatggggagggagaagagatatgcaccatcgtctctacttagtcatactaattatttttactactactgtagtaacgaaaatgcttaccatgtgccagtctcagttaagttctaagcattttacttgtattaacacgtatttcttataacaaccgtgtgaggttactatccccattttactgatgagatacagaggtattaaggaacttactgaaatgactgtgtggctccagagtccttgttcgccaaagactgtaaagaagaatcaggttggtggcaagttgtaaggaagggaatgacagaggtcttgtagaataggctaggacaaaagtctatctttcaggaaatccttcaaagaaaactagcataaagaggctctctaaggaaccactctggtcagcagaagcagattccttggaccagtgtaagtccagagccatacccaggatcaaacctggcctgtattgctcactgctcaatagccacagccacattttaattaaaattaattacaactaaaatttgtccctcacttggcagtaacctcattttagatgttcaacagccgcttgtctagtggctgctgtgttagacagtatagatattggagggcactgctctagagtgaaggctacccatagccaggcatgcctcctgccagattgttattcatgttttacatctgacctttaccttggtgattttaactcggtaactgctttatttctatttgtgaacaattttatccacgtctaaactttaggattagtaatagcatatttagctccttctccatttttagggaaaatatataatgcttaagatataaaattattaacagatgctataatctgaaagatttattcctttaaaaagttgcattaaatgcagtattcttatttctttttatttaataattaaggaggagaaagtgcaggccatgccacttcctctcaggagcctagtggatgctcagatcagagacctgcagaggacctcaacatccgagtggaaaggtttgctcttctttttgcaaatagcattttgtttaaaaagacagtggttttcagttatttcattaatttgaattaaagctaaagttatacaaatgaagttttagaattctgagttgaaatttttgatcacctaactaatttgtatccataaacattacactctaagtgtaaagttttcatgtatgtctgaagtcaccagtcagcttttggtctgatcattctaagaatcccctttttaatggtattttggtacatgggtgtttccatctgtcacttctgcttttatctctatgccataaggataataagctccagatgggcaagaacttcagcttatttcatgactatgtactgagcttaagttctgcataagtgggtgtctactaagtggcatttttcattagttggtctaataatcagatacaaatttctggctctttgtagtttctagtatttttaatgatacagtaattgtcaaatcatagtcttttatgctgtgattcctacatgagttaataattagtggttaagcgggaatattttaaaccctgatttaaacccctttagcgttagttatatggaagtttaaaaaaattccttagcatttaaaaatttttttaaaaaaaccttccttagagagacttgatattttcttgttcacatagatgcttcggggaaacagggttcaaagtgattgctgatattgtctttgagtttgcttgtgactcagtaaagatcagcttcttttcagcaaaacctagattctgattgttctttgtaggggaaggggcagtgcccagaccttgaggtgaaaagcaggctggacctcacagtggtgaggaaagtggtataagcctagaagaatagcagcaggaaacttaagttcccaagggttcatcctgttttgcttctttctgatttgctaacaccaggcccactactctgtacctttatttgcaccactctgggctgaagtgaaaataaaaaatctggaaaagggtttggagacttggggcaaaaacctgaattacatcaggtagccctttattttgaggtggggtcaggcgctatttagttatactggaaaaagtttttaatagcctccattcttatgtaggggaatgtcagctagtgtctgcctgtgtcatagtactaattaattcacaagctgagatcctgcattttattcatctgcgttcatgccaaattaggaatcttgttccttttgtggaatctgattcattgacaatgacaataactaataacaccagcgtatgtaatattcccattccaaatgtccacttagctcattatttataccctaagagttgccatcgttctcaccatcccctgccatagactgtgaagctcttgtgccctcaactaactcatcccctgccatcttttgcagggtattgaactgtgaaactactagtttccctgtctctctgaactgaagtgctttttctcagcctggttaagttggacccatcagtccctgttgtgtaatctgatattttagaattatatgaagttctataaagcaaaattcatgcatttttctctgaccttgatggtattttaaaatctatttcatacaaattaaaaattcagagttaaaatttggcaggggctgtgagtggtggctcacgcctgtaatcccagcactttgggaggctgagacaggtggtttgcttgagcccagaaaatagagaccagcctgggcaacatggcaaaaccccatctctacaaaaaaatacaaaaattaattgggtgaggtggtgcacacctgtagtcccagctactcaggaggctgaggtgggaggatcacctgagcccaggaggtcaaggctgcagtgagccatgatcacaccactgtactccagcctgagtgacagagcaagactctgtctcaaaaagtaaataaataagaccaggcatggtggatcacgcctgtagtcccagcactttgagaggctgagatgggtggatcatttgaggccgggagttcaagaccagcctggccaacgtggcgaaaccctgtctctactagaaaaatacaaaaattagctgggcatggcacgcatctgtagtcccagctactcaggaggttgaggcaggaaaattgcttgaacccgggatgcagaggttgcagtgagccaaggtcatgccactacactccagcctgggtgacagagtgctactccgtctcaaaataaataaaataaaataaaataaaaaataaagcaggatggattagcaaatgtaagattcttactttcctctcaggctacagttgaaactgagatctatttccaaagaccatgtttttggaaaactaattactgtagttgactttaagtcttaggcttttttctcatctagcttcaaagaaaactaattttgttaagggaaagggtgactaaatcaaattgacattagtgagaaattcatcctatcttgtacataagaacatagtccttcaatcttgagctgcattttgtcaagtaaacataattaaaaaaaaacggattggtgatttgaaattgtgagatctaagtttttatttttaatattaatggatatacaatggttatttatttatttatgaggcagagtcttgccctgttgcccaggctggagtgcagtggcatgatcttggctcactgtagcctctgactcccgggttccagcgattctcctgcctcagcctcccaagtagctgggattacaggcatgcaccaccacacccggctaatttttaaaatatttttagtagcaacagggtttcgccatgttggctgggctggtcttgaacttctgacttcaggtcatctgctcaccttggcctcccaaagtgctgggattacaggtgtgagccacagcacctcgcctgtgatggttttttgtttgtttgtttttgagatgaagtctggctctgttgccaggctggagtgcagtgacatgatctcggctcactgcaacctcctccacccagttcaagtggtcctcgtacctcagcttcctgagtatctgggattacaggtatgcgccaccatgactggctaatttttgtatttttagtagagacaggggtttgccatgttggccaggctggtctcgaactcctggcctcaaataatccacccgccttggcttcttcaagtgctgagattacaggcttgagccaccacgtctggccaggatatacaatgtttcactaaagtaacagatgtgaaataggaatcttttagcgaatctttagttaaaatgcattattttgtttatttcattatgttttttttttttttccctgagatggagttttgctcttgtcgcccaagctggggtgcaatggcacaatctcggctcactgcaacctccacctcccagattcaagcgattctcctgcctcagcctcccgagtagctgggattacaggtgcccaccaccacacccggctaatttttatatttttagtagaggcaggggtttcaccatgttggtcaagctggtctcgaactcctgacctcaggtgatctgcccgcctcggcctcccaaagtgctggaattacgggcatgagccaccacacccagccatgtcattatgtttaaaatgggcagaattatctggcaaagataatatatactaccatgaattctagtctttttatttgaataagtttcaaacctcaacgttgaaaaaatagtgtaatggccatcttttaatttttttctttttttttttcttctgattcatttgaaagttgcagacataatttcacttcatgcctagatacctcagcatgcagctcctaggaagacattggctgagggtctgtgggctttgagcagggactccatcctaggccaggatctggggatctgtgctcacagacccatgtcctgcccccttctggcacccaagcaggcatagtgaccattaagaagtagatgccagcccggcacagtggctcatgcctgtaatcccagcactttgggaggccgaggtaggtggatcaactgaggtcaggagttcgagaccagcctgagcaacatggtgaaaccctgtctctactaaaaatacaaaaattacccggacgtagtggtgggtacctgtaatctcagctatttgggaggctgaggcaggaaaattgcttgaacccaggacgtagagattgcagtgagctgagattatgccattgcactccagcgtgggcaataagagagaaaagccatctcaaaaaaaaaaaaaagtcgaagcccaaatgtagaagttatggaacagtcaatttgttattaaattagatgcagtgtagcttttcacccaaattaaaacaaacttgcgtttgtatttctcagaagaaaattctacagatggtctataaatacgtttatacaccattttcagatggtgtatattttcagatacaagcacgataccattatcatactcaagaaattctcaattgatacagtaagattatctaatttgtccgtattcagatttcccagttgctccaataatggcccttttaacttttcttcccttgattcaagatccagtcaaggattgttcattgcatttagtttaggctctgaatccaagacacttcttgtttgcatttttcatgatttagacattttgaagagtctaggttagttgtttctacaatgtcctttgatctgctccctgttctatcattagattcaggttaaactctgataagaacattaccaagataatgttttgtcctttccattactcatatcaggagacaagtaatatgagatgtatgcattattggagctgtaaagtttaattatttggttaggatgttgtctgttgggtacccttttcattttctaatatataagttgtctatggggtgattcaaatggtaaatatcctactgcttaaaaacttcacccggtggtttcagcattcattgatttttgctgtaatcacctatttcattgatgtttaaaaattgtggtatttttctcattctgtttttttctacatttatcagctagcattcttctgtagagaaatgctttgatctaccccctctactttccatctgcccacccccgccccctttttccagtaaactacttattggacaccagcacccagatgaaggaatagaaaattaccagtgctagtctggcatggtggctcacgcctgtaatcccagcactttgggaggccaaggtgggcgggtcacctgaggtcaggagttcaagaccagccttgccaacacagtgcaaccttgtctctattaaaaatacaaaaattagctgggcgtgggggtgtgcatctgtagtcccagccactgaggagcctgaggtagaagaatcacttgaacccgggaggcagaggttgcagtgagccgagatcgtgccactgcactccagcctgggcgacaaagtgagaccttgtctcggaaaaaaaaaatgaaagaaagaaaattaacagtgcctaataagctttcctaatgccccttcccaattatggattccctccataagatgatcactatcctgaatcgaacactgtaggttagttgtctgtttgtgaactttgtgatggaatcatgcaacgtgtatttttgtgtttgatctcctttgttcagctttgtattttgaggcttatccgtgttgcatgtcacagtaattggtgcactctcattgctttatagtattctgtttgactctaccttgatttattaatccattctactgttggtggacattaggattgttttcagtttggggctatttgaatagaactgctatgaggaatattcttgtatatgtcttggtgaacatgtgtacacatttcttttgggcatatatatgaagaagcgggaatttctgggttatacatagtgatcaaacagctttccaaagtggttaggccaatttacagttccccttagcagttaagacatgtcacagatgcttttttttctctcatgtgttactatccatttctctattctttttggtgcacaaattgccccaaatttgacttgttggaatccccttcatattgggtcttctggctttttgacagtactcactcccttgattgctggcacacattgttcagtttggtatacaccaaacacttttagagaaaataccattttcatttaaaaaaatgaaatataattcactaccatgaaattgaaagtgtacaattcagtgagttttagtatattcacaaggttgtgcatccactaccactgtctaatttcagaatcattattttattttttaaatttttttatttttttgagatggagtctcactttgtttcccaggctggagtgcagtttcaccatctcggctcactgcaacctccgccccccaggttcaagcgattctcctggctcagcctcctgagtagctgggattacaggcgcatgccaccacacctggctaatttttgtatttttagtggaaacagggtttcaccatgttggtcaggctggtctcaaactcctgacctcgtgatctgcccacctcggcctcccaaagtggtgggattacaggcatgagccaccgtgcctggccgattttattagtttttgagatggggtttcattacgttgcattacactaccatgctcagctgattttatattattatttttttttcctgaggcggagtctcactctcgcccaggctggagtacggtgacatgatctcggctcactgcaacttccgcctcccaggttcaagcgattctcctgtctcagcctcccgagtagctgggtttacaggcgctcaccaccacgcccagatgtttttctatttttagtagagacagcgtttcgccgtgttggccaggctagtctcaaactcctgacctcaattgatccgcctgcctcggcctcccaaagtgctgggattgattacaggtttgagccaccgtgcccagcctgattttttattttttgtaaagatggggtctcaagttgttacccagactggtttcgaactccagggcttaggctatcctcctgcctcagcctcctgcagtgctgagattacacatgtgagccaccacacccagcctccatttgtttgtttatttcagacagggtctccctttgtcacccaggctggaatgcagtaacgcgaacgtgactcgctgcagcctcgacctcccggctcaagcaattctgttaccttagcccctaaagtagctggaactacaggcacacgccaccatgcctggctaatttttgtgttttctgtagagacagagttttgccatgttgctcaagctggtctttagctcaagagatccaccaacctcagccctcccaaagtgctgggattacaggcatgagccactgtgcccagcctccattcatttttaactgatgaacttcttacagttgagaatcaagttggtgttagtaatttggtattaataatttgctggccttaagtttttatttttacaggttttttttttttttaccatagtgctgtttagttttatataaggagtagagcatttataagtcactgatttatgtatttgtttgaaaatgtatttgtagattttaaagtcaatatcaggtaaatcagaaaaaaagggaaactaatcataagtgggaagtgaggcatttagaatgaagctaggcttctgatgggctctcgttgactccaggatttctgtaggggcctgaagccaggcagataaatagttgcttgctttttgtttgtttgtttctttatttctccaattgttttagctaaatccatctcctaaatgtgttttatattaatatgatgtgtctcaattagtggtggtttttttttttttaatacagactaacaaaaaaacttgaagaaaggagagaagagaaaagaaaagaggaagaacaggtaaagttcatgcagttagcattgttttgtcctctcattaactgaggttgtgattgattattctattcagtgtggcaggcctagggtgacttcatagttttagttcagtgttgcagcactatgaagataattcctgttttctctagtagagtcatagtatatacattttttgtgttcttttcgtaaattactatgaataaattagaccatgctttttccctctgcaatgatttttttttacactaagaataaagggacttgagctaaaatgtttggcttgaggttgaacaaagttttagttcatttttgtgaaaaaatgtatagacattttgctgaatttttcctctcctgttaagcattctagcacatggttcatttttctcaccatgtatacctaactgtgtagcatgtctttggagttctaatataggaaggttaccatttcattcaagccaaatacgtgactgccatgttgtccctgaagggtaatatatttaccctcatgactaaagacctgtaattatgcttgccttcaaattacactgactacattattatcttaacagaccattggcaatgatttatagattgatagacatttgaccattaaccatgccattaataaactcgtctagacttacattttatgaagttttattcttttaactgcagttttcgttgcattcaaaataatatctggggcagattatcaagtttttggatcataaaactttttctttaattcagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggtaagtcttaagtttccagacattcgtgaaactgtttttctgtgcacagtagctttagattactaccagactgtgcacacaaaaatagattttagtgactcatagactaccaatcctgagcttccttttattagaaattgtaaatgaattaaaatagttaagattaaaattgagttgatttttttgaagtgatttttattcatattttgttaatttatgacttttatcagcattcaaaaagcagcttttaaagattccctagaaaataagctaagtactagtacctactactagtactaagtacctactagtagtaactactagtactaagtacctagtagttcttctgtagtcacaggcacacttttttgcaacattgaaaggatttaggcacatcataaagcttagtttgcaacaattgcttttataattcatcagctgcaatacatattaaaaccatcccgccaggtgtggctcacgcctgtaatcccagcactttgggaggctaaggagggcggatcacctcaggtcgggagttcaagacttgcctggccgacatggtgaaacgccatctctactaaaaatacaaaaattaatcgggtgtggtggtgggcgcctataatcctgctacttgggaggctgaggcaggagaatcacttgaacctaggaggtggaagttgcagtaggctgacatggtgccattgcactccagcctgggcgacaaaaagcgaaactccatctcaaaaaaaagaaagaaagaaaaaaagccatccctaccttaatatttttgttcatttggtcagtcaacaagtatttgttgagcatttattatttatttatttttgagatggagttttagtcttgttgctcaggctagagtgcagtggcgcaatcttggctcactgcaacttccacctcccgagttcaagcaattctcctgtcccaggctgccaagtagctgaggttacaggtgcatgccaacatgcccagctaatttttgtatttttagtagagacgggatttcatcacattggtcaggctggtctggaactcctgacctcaggtgatccacccacctcggcctcccaaagtgctgggactacaggcgtgagccaccacacccaggcttgttgagcatttattatgtaccagaccttgttccaggctttggagatacagtagtgagcaaattcatttccttgtttccttaataataattctggtctccgacagttgataaaactaaaaaataacagttccagaatgttaaagttcacatatggtgttagacaatttcaggcagcaaaggcacagtggctcacaactgtaatcccagaattttgggaggctgaggtgggaggattgcttgaagccaggagtataagatcagcctgggcaacaaagtgagaccccacctctacaagaaaagaaaaaaaattagctgggcatggtggcacacacctgtagtcccagctactctggaagctgaggtgggaggattgcttgagcccaggtgttcagaggctgcagtgagctatgattgtgccactgcactccagccttgatgacacagcaagaccctgtctcttaataaaaaaaaaaaattccatgcatatttgtttggaattgtgtgaattaaccattctggcagtaaaggtaattggtatttaatgatgttttaaaggaccgtgcagagagagctgctcgttttgcaaagacaaaggaagaagtagaggctgccaaagctgctgccttgctagcaaaacaggcagaaatggaagtcaagagggaatcttatgcaagagaaagaaggtactatatttcatgctgaaacatctctgtgcacataggggctgaggagaatgattataagctggtttttaacactgatgtatactgtggttataagcagtccattccagagggacatattaatttgacagctcccaatggtatctctcatttcgtgtgagtgtacactaaaaaagtactacataaataactttaaaagagggcccaatagccgggcgcggtggctcacgcctgtaatcccagcactttgggaggccgagacgggcggatcacgaggtcaggagatcgagaccatcctggctaacatggtgaaaccccgtctctactaaaaatacaaaaattagctgggcatggtggcgggcgcctgtagtcccagctacgcgggaggctgaggcaggagaatggcgtgaacccgggaggcggagcttgcagtgagccgagattgcgccactgcactccagcctgggcgacagagcgagactccgtccccaaaaaaaaaaaaaaaaaaaaagagggcccaataaatacctgttttccaaagacagaaatgatttgtaaccaaatgaatataatgtttatctcatacgtattaggattctttatttttcagaatcccctatccgataggattaagcaaaagaggaaatacattggctctgcagttcagaaatccaagggtgaatttggttaggcatagctgtgtccagcaatctaaaggataccattacaatttctctctctctttttaattcttggtttcttctgttttagcttcattcttagagaaactctccaaatggtgtcaggagagcccagcacctcctggcactttcaggaccttgaattcacgatcccagacagaagagattaaccttttctctctcatgcctgtatcagtcactgagaattctgactgcccctgtttggatcatgtggccaccttcagagtagtcagtgtccacatgtgtgggccctctggttggaggaggtgacatgcccaatcttgtggtgaaggaggtgggggaaatgttattgataattataccagaacgaatgacacatagcagggtaagaaggcagttcccaaaacaaaaatatgttgaaaagacaaaaaaagtttagatttctagtacaccttgctaattggattatggttaatacttattgtcttctctgtgccttttcatatttccatattggacagttaacaagtagtattttgtaatcagaaaaatttttaaaaataattttccaaaaataatgaagtaataaatttaacaaaaatgtaagatttgtgtgctaaaaatgacaaaacattgttgaaagatttaagacctaaatacctggaaagtatcctatgttcatggataagaatacttaacattgttaagatgataatcctccctaaactgatctaactgatctatagattcaacactcctatcaaaattccagctggcttttttccataaattataaacctaaaattcatatggaaatgcaagaaacacaatagttaaaacaaactggaaaatgaagatagatgactcatacttcctgattttcaaacttactgcaaagctatacagtgatgtaatggtataagatgaacatacaggtcattgtaatagaatggagtctctagaaataaacccttacatttatgaactgtttatttttgaaaagggtaccaagactattcagtgggaaagaagaatcttttcaacaaaaggtgcttggacaactgaatatctacatgcaaaataatgaatttggacctttacctcacaccatgtacaaaattaacttaatggatcatctaccaaaaagtaaaactataaaatatatattcttagaggaaaaaagaggaatatatttttgtgatctaggagtagccaatggattgttagacatggcactaaaagcacaggaacaaaatttaaaaataggtaaatcgcacttccaaaatttaaaactttcgtgctttgaaggatatcatcaagaaagtgcaaagaagctgggcatggtagctcacacctataatcccagcactttggaagactgaggcaggcggatcacttacggccaggagttcaaaaccagcctcgccaacgtggcaaaaaaccgtccctactaaaaatacaaaaattaactaggcatggtggtgcacaccagtaatcccagctactcaggaggctgaagcatgagaatcgcttgaaccagggaggcggaggttgtagtgaaccgagattgcgccactgcactccagcctgggcgacagagtgggactctgtctcaaaaaaaaaaaaaaatgcaaagaacaacccatagaattggagaaaatatttgcaaatcatatatttgatgagagacttgtgtctagaatataaaaagaacctgtgactcaattataaagacacccagttcaaatatgtggaaaggatttgaatagacatttctccaaagaagataaacaaatggccagtaagcacatgaaaagatgttcaacatcattagtcattagggaaatcaagtcagaaccacaatgagataccatttcacacccactaagtatgcctaaatgtaaagagaaagtaataagtgtttgtgaggatgtggagaatttggaacctttctgtgttactggtgggattgtaaaatgatgtagccaccttggaaaacagtttgccagtaacgcaaaatgttaaacatagtgttatcataggacccaggagttctacagcagcagtttatacagcagtttatatccaagagaattgaaaacgtcaacacaaaaacctgtacatgagtatagcagcattagtcaaaatagctaaaatgtggtaataacccaaatgtccagcaactgaagaatgtgtaaactgtatctcatacaacaatgtttttcagcaataggaataagaactgatacctgcaacaacatggatgaaccttgaaaatacaatttccatgaaaaaagcaagttacaaaggtcacatactgtatgattctattacacaacatgcccaaaatagacaaatccgtagagatagtagattagtggttgccagggtctggaggagggagggatggggagtgactgctgatggggttggagttcctttttggcatgatgaaaatgttctggaattagataatgttgatagttgcacaattctgaatatatttaaaaatcactgaactgtacactttaaaaggcttaatttttgtttgtttgagatggagtctcgctctattgcctaggctggagtgcggtggcatgatctcggcttactgcaacctacacctcccgggttcaagccattctccctgccttagcttcctgagtagctgggattacaggcatacaccaccatgcccagctaatttttgtattttttagtagagacagggtttcaccacgttggcccggctggtcttgaactcctgacctcaggtgatccgcccgccttggcctcccaaagtgctgggattacaggcgtgagccaccacacccagcctaaaagagttaattttttatatgaatctcagtaaagcagttattaacaaacaaaaagatctgatatggtagaaaaaactattgtcattgcacatttccacttccattttctctaacttaatgatattgttagagaatatatagaggtgaagattgtgactttaattttcttttttcatagcactgttgcaagaattcaattccgtcttcctgatggttcttcctttacaaatcagttcccttctgatgctcctctagaagaggcaaggcagtttgctgcacaggtaaatttatgtcttgagttgtagtaaaaatagatgtgtaggttactaaattataggaagggaaaatttcaaagcagaagttgaatgtgagtgaattgtgacctctccaggagggaggcacaagacgcctctgagatattgtggaaattctgtcgggtgttagtgcatatgggagtaacatatctgctttgtgtgcagaagtaggaatttgctgatattgtataataggtcctgggaacttttcttttttaaaattttttgagacaggatctcactgtgtcgcctaggctggagtgcagtggtgcgatcacagctccctgcagcctcgacctcctgggctcaagcgaccctcccacctcagcctcctaagtagctggaacttacaggcatgtactgccatgcccggctaatttttgtactttttgtagagacagggtttcaccatgtagccgggctggtcttgaactcctgggctcaagcattcctcccacctcagcctcgcagtgcgttgggattacaggcgtgagccacccagcccagccactgggaacttttttcactgattagtagactcattgaaggagtgacaggcaagtgatttcccgaaggtctgatgtgagggaattgtcccactcccctgaaatggaagcagtttttctcactcctctctccatttcctacagattgcttaggggctggtcattttcctacgatttaccttttggctaaggaaaaagaggcagtaaactttatttgacaatagtatcttcttcaggaatttacttccaaaaggtggccttactcagaatctgaatggagtatatatcttgagatatgagtagttttcaatttatttttattccctgattgattccttattcaaaacggattctgagcatcagatgtcctttgggttctaggctcattatatgtatcagtatttttttcatatatataatttcaaggttaaaattagggatttgggttcagatctttccgccagaccttttctccacatttggtcgtcttcttgcactcgtgaactaggctggacaatgtaaacgtttattttaaaaactgtttccccctaagctttatagtagaaacagtcccaaataggtgctttcattcttcttttgtcttggagcctcccacaatgtgtcccctgtcctgagtttcactgcttttgccacaggtaaatggagaagggactacatctttgattgcatgtgtcctattaaaactccacctcaggccaggcatggtggctcacgcctgtaatcccagcattttgggaggccgaggtgggtggatcacaaggtcaggagtttgagaccaggctgaccaacatggtgaccccatctattctaaaaatacaaaaattagccgggcgtggtggtgggcgcctgtaatcccagcttctcgggaggctgaggcaggagaatcgcttgaacccaggaggcagaggttgcagtgagctgagattgcgccactgtactccagtctgtgcaacagagcaagactccatctcaaaaaaaacaacaggctgggcgcagtggctcacgcctgtaatcccagcactttgggaggctgaggtgggtggatcacgaggtcaggagattgagaccatcctggctaacacggtgaaaccccgtctctactaaaaatacaaaaaattagccaggcgtggtggcgggcgtctgtagtcccagctactcgagaggctgaggcaggagaatggtgtgaacccgggaggtggagcttgcagtgagccaagatcgcgccactgcactccagcctgggcgacagagcaagactgtctcaaaaaaaaaaaaaacaaaaaaaaacccaaaaaacaaaaattccacctcagtacagttatcaagttttgtattttgtgtatctttagaacagtgaggggtatgtgtgatctacagtaaaaaaaaaaaaatacgaaaaacaagttagtctccttctttggaatcttctagggaaagatacacagatgtctaagattttacaagtgatttttgtatatagaggacttaaaattgtgagggtgacttacagtgctgtccattgtacgttcctggatctggtattgtgtgtatcatgtaggttgattatggaccatttatgccttgagacaaggaggaggctacacttcctgaaggtatatatgagggaaatactggtctagtccaaattcttaatagggattacctgtaatccaaatgtgtgttcatgagacattaagtttgccaaaggatagtgaaaacctaatgatgaactgcaacagtacttaaaggagatacacaattgtccatttttactcaatttatttgtgtgtttttaggaactatattttgctattttgtggtcatctttgagttacagaagcttttaaaaactatttggatttgatagcttttcagctgcttaggggctggaagcacaattttatacctttttttgagtttacatgtaatgaacttttaaaattaaggcaatgttaattaaagcatcattttggattcatctgagtaatatcttacttttaaaggcactctttaagtttttaaaacttattttacagactgttggcaacacttacggtaatttttcgttagcaaccatgtttcccaggagggaatttaccaaagaagattataaaaagaagttactggatttggaacttgccccaagcgcttcggtggtactgttgccagtatgtatatacagatgcatttttttctcttcttattgttttctgtttatcatactcttcatttcttataattaggggaaaggaagtgcacagatatactgaaggtaattaaaattcaagtgatccaataattagatgaatttataattccattatcctgtgctttatttgtattgctgatattacttgtgagacatgaaacagtttaatttttaacttttttcttcacatatttttgtgtacaaaaaaaatgaccaataggagaagacagtaagaaatgcagattatctgtctaatccacacacttagtgtcttttatttatatatgctctactgtttgccaaaaataacatgaatattcaaacagattatcccatttgatctgcacaacaatattttaatctctggtgaagaaaagaagctcagacagcttaaatgactgctgccgtaactgggatgagagcctgggtcttctgtgtcctggttaacatagttttccttgctctatactagacgtgccctccaccccaaaacagttagctctccagtaatcaggatttcattgtttgaacctttttttttaaatcagcaagaaagactcttcttataaaagtttaatattcttaaaaaatagttggctcatttcactgagaactactttctagtttgtatattacaatttctcttaaacacagctccaaatattataacataaaattacaattgtatatataatatacaatattatacaattatatacaattattatataaaataattatataaaataattttataattataatatattatataaaatataatatatataatatataaaataattgtatactatacaattatacagttattatacaattatatacaattgtataatattgtatatttatctttaaaaacttctgggagtcttcagaagtttatatatacgtgaaaaacagcaaaagatatcattttaccctcttgaagtaaactaaaattggtaggacctccttttccagataaaagtttcatctggaaccttgggcgtgatgtgattgtgctaacgtagtctttatctaggtttgtttattaatttctaggcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaaggtatctgtgtgtgttttccccatttataaaatatgtaagtcatgcccagtatcttttttaagtaaaaagttgagtactttgcctttctgtatatgtcctctccagttcccacggtggaggagaaaaactccgatgctctgaaactttattacatcatctctactgcagagctcactacctgcgttttctcagccagctttataaaaccaattttttggaaagcagcttcacctctactggtttattgtttcattcattgaagtttctttaccccataactatcaaggcagatttttttttctagtaacctctttcttgctaaccatgtttgcttgacaagatagttcattgcattaatcgttcagggtcatcttgcataattactgtaggtgaactactctgttttgatcattttaaccctgttggttcttttatctaccggctgacagccttgtctggatcattcagagaaggaccaaattgtggaaacaggttattgctttgaaaattctctctcagagaattattttggactaatcccttaaccaagagaccagggcctgatgcagtggctcacgcctgtaatcccagcactttgggaggctgaggcgagagaattacttgagcttatgcattcaagactagcctgggcaatatagtgagaccttgtctgtacaaaaacaatttaaaaatttgccaggcacatgtctgtggtcccagctacttgggaggctgagatgggaagatcacttgagcccgggagattgaggctgcagtgagccaagattgtgccattgcactccagcctgggtgacagagtaagagtgagatcctgtctcaaaacaaaaacaaaacaacttttatagcagatagcatgcaatggttagcatagtaatacaacactgacaattttaactcctatctttgttaagattttatatacttgaaacaggttaatgggaagtattttcctagaaagtaagtttatgcccctttctaataattacataataatgtaacttactgaaatggacaccgctgttaagcactctatgaggccttttataggcattataacaaatcttcatgccagtcctatgtgataagtaatagaaattcttttttctctgccctcagtatggagaagccctagtcatgtgtttatggattccataggtaatgacatataagtattgtgattgggctgctttgtcctttatcttatttcataactgttaggcaggaagaccagttacctactaagtacgttactgtagtgaggacagagggaagctcaaacaaggctgaatcttaaaactcttactgagcaatgggtgggagcatttaatactgaattactgtaatataggagagctcgttgtatggatttttaaaacttttttcaggctgggtgtggtacctcatacttgtaatcccagctctttgggaagctgaggtgcaaggatcacttgaggccagaagtttgagaccagcctgggcaacatagtgaggctccatctctacaaaaaaaacttttagtgagctgtgtgtgatagcgtgtgcctatagtttcagctgcctgggaagctggggcaggaggattgtgtgagctccagagttttgaggctgtagtgaaccgtgatcgtgccactgcactctagcctgggcaacagaggggacaccctgtctcaaaaaagaacaaaaaacaacacttttttcaaataagagaaaggtcttagattagagcaaaggatggaataaaaggtgtgtcaaagagagggtgaagctttgtgttccaccattatttttccttttttctctcccctctagagttataaaagtctgttggcttaaattttatccttatacctttgtattttcagaataggaagtcctcttcattcttaattgtttataaataagtcattcttgaagattttgcgaaggatttaaaattgaccctttctgtcaagctgactggagctttggatagtctctagggtgctaagttacaaatgttttagtagataatgtcggcttgcataaataacaaaggaaagattagttggcaaatggtcacactcctctaatgcttattaagtcactaagaaacacaatggaaatggaatatatgatttggctggctggcttgacttagagatcagatgaagctaaactaccaaagactgctaaagtctagtactgtgttagtagatataatggtctcccatggactttccttactttagatggcattaaaagtaaaacttagttgcctgtactgatggaagttggaaacagcttgtattactattgtttttattttatgacatcttccccttgctccctctttttcgtatcagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattat

SEQ ID NO: 37598 - DNA, 43281 bp, Homo sapiens; identical to SEQ ID NO: 37597

SEQ ID NO: 37599 - DNA, 19272 bp, Homo sapiens
gaattcccctcggccctacaggaccaaacgaccggcgcgctgagaaagggtgtgcggttccactgaggacgcccaagcgggacagccgggcccgccgcggtgagatccccggcctgtccagcccaagcccaagcgccctcgcggtcacgtggcatttccggaacattcagaacctaacagccaggaggcaggagggccgggccgaggccggagcgctggacaacgcgggtagctggcgctcgagggacaggcagctcccaccggctaggacccccatcccgatgcgcgggcgaagggctggggccctgtgccgctggcgatcccggggaccgcctggaactcgcggcactcgggagcgagagggaaagcaacccagaggccccgcagccgccggcgacacagctacagaccccgactgcagccggtactcccatatatcaggggcggggcgaaacccggccttttgaagggcagcgatttaaaccaatcagcgcaaagagttggcaaccctccgcccaattggaatcgctctcattctgaaggcggttccgacatggagtccggcagcccaatgggagaggtggaaatttccagaacgatcagaaccaatgggcgcggccagcgcggctacgattggcagtgcaaaagaccaatccgtgtcgcagaagttcgctcctccctccattcgtggagcctgagatgggtgggtttatagaggagcgcccaatcctgaggtgcgggggaggcagggttgagggaattactccccgctgtccaatgagaaggaagtggagatgatgggctggacctcaagccaatagtagagcagcacagacattccccctagaagaactcgaccagtgagcaggcgaggaaggggcgggagccggggtcccggtagcttctagtaggttccagaaggcggcgcgtgcggttgggaacgcggagcggacggattcgattcaacggggttccggaccgcgctgcgctatggagcaggtgaagggggaggggcgggctgaggccccgagcctgctcggggaccggcggtggccaggccgcggtaggggggcggggcgggcgccggatccaggagaccggagctcggcgctggggccggacggggcggcggcggggaggtgagggccgcgggcggcgggcgggagcgggatctttagcgaggccggccgcggggagcgcccatcgccccctggttgggcgaggagggcccggcggaggccacagcttgggtgagtccggccggcggcgggaagaggggtcgcgaccgggccctgaaggcgtcccgagggggcggctgcgggccatgttggggagggtgcgggccgcagggggcggggtggaggtgggccgggggccggggtccgcacccgcgaggtagccctccgggagatctcagacggccgacggagaaaccgctcgggacttagccacgaggaacttggacggatccagggagcggggacggggatacactgggagtagccgaggatcttagcagcctgggatgcagttggggcaaatgttactcttctacatctgagaaggtcagggtgggagagcgttgagcgggggtctgaggagcgacagaccgactctacctgatgcgggaaagggaagggtgccgcaaaagtccttgggacgaattccatctctgacagtgttttacaaatgtattgcggcccctccccctctttttgtatgcttgtgtgtgtgattgtcgagtgaccgaggaccaacacttccgaaaggtgggtctgaaagatgggtttctgacgacccgggggtggttgtagacaatttacagagatcaaccgctggaagttatgggcctctactgagcatttgaggggccgagtttgaagcggttgctgcttcctttcagtgacttggttatgtcctcagtagcttgcggttatgaaaggcctagaggttttgttcgatttgaagctgtcattgagctgtaatgattcatcggaagaaaaaggacaaaacaacctccaagaaacctctaccaacctccgagaaatcatcctcccgctcgggagtactactgtcttcgctccgggcccataacacttgggggtgacaattctgaaactatacctggtatctggttcttacttcagggccataaaactaagatcgcccacactctccccttaaataagacatctcgatggactagtgactaccatcctttttttggtgtgagctacagagctgagcctttggtctcttgtagcagttgctgctttaggcaaagctcgagcttccttgctgtattaaaaagagtggaaatgaagttagtaaacttttttgtgcccatataatatttcagttgtatctagggttaaatgggctgtagtataggtgaggaaaagatttctggaataagacgttgctcttttacctttaagaaaggatctggggccgggcaccgtggctcagcctgtaatcccagcactttgggaggccgaggcaggcggatcacgaggtcaggagatcgagaccatcctggctagcacagtgaaaccccgtctctactaaaaatacagaagaaaaattagccgggcgtggtggcgggagcctgtagtcccagctactcgggaggctgaggcaggagaatgacgtgaaccctgggggcagcttgcagtgagccgagattgcgccactgcactccagcctgggccatagagcgagactccgtctccctccagcctgggccacagagcgagactccgtctcaaaaaaaaaaaaaaaaaaaaggatctcggctgggcgcagtggctcacgcttataatcctagcactttgggaggccaaggtgggcgaatcacctgaggtcaggagttctacaccagcctggccaacatggtgaaaccccctctctactaaaagtacaaaaattagcgggtcatggcgcaggcctgtaatcccagctattggagaggctgagataggagaattgcttcaacccgggaggcgtaggttgcagtgagctgtgatcacgccactgcactctagcctgggtgacagagtgagactccatctcaaaaaaaaaaaaaaaagaaaagaaacgatttctgttaccaaatttattttgtattttttttagagacagggtctggttctgtggcccaggctgaagtgccctggtgggatcatagctcactgcagcctcaagttcctggcctcaagcgatcctcctgcctcactctcctgagtagctgggcacaccaccacaactggctaattttaacattttttgtagagacggggctcttgctgtttcccaggctggtctcgaatttctaggctcaagcaatcctctagccttggcctcccacttcattagcactaggattacaggcgtgagtcaccttgcctggtcttaaaatgtttgtttttaaattaccactactggtgatagaagtgtatgtacaggtaggtagatggtgaatgaatatttgacttaggacagcaaactggcatggcagctgtacagatgacctggcatttaatcccaggtgtgtttgagcccaccatctggaagccattcctgaaaacaaacacgatttctctaccttttgttttcattttcaactgtgaggtttgtatttcagtttagaaaatactcaagttgggccgggtgcagtggctcacacttgtaatcccagcactttgggaggccgaggtgggcggatcatgaggtcaggagtttgagaccaacctgtccagcatggtgaaaccccgtctctagtaaaaatacaaaagaaaaaagaaaaactgggccgggcgtgctggctcacgcctgtaatcccaacactttgggaggttgaggcgggtggatcacgaggtcaggagctcaagaccagcctggccaatatggtgaaaccctgtctctattaaaaatacaaaaattagctggatgtggtggcacgcgcctgtagtcccggctacttgggaggctgaggcaggagaatcgcttgaacccgggaggcggaccttgaagtgagccgagattgcgccactgcactccagactgggtaacagcgagactccgtctcaaaaaaaaaaaataaataaataagcggacattgtggtgcgcgcctgtggtcccagctacgtgggaggctgaggcaggacaattgcttgaacctggctggtcgaggttgcagtgagccaagattgcgccactgccctccagcctgaatgacagcgaaactgcatctccaaaaaaaaaaagttggacagattttgaatgttcaggcttttttttttcaataggggcctttcaaatcccacaatgatacacttcttacatttaacccaacacaggcgtacagccatgtaacacattcagcaaaacagtatttactgttatgtgcactgtgtgctggtatttttttgtcccatttggtctcttaaaatgctggtcatgacctacaaaattgatttcctgacccactgttgatcagtactctgtttgaaaaatgcttttctaaagcataggcaggaacttcaccagctgcctcttgacaccacttgagttttgttaactcttcgtcttctggcctccatcttgggctctaggattttttatcccttgtttgcttaatttggcaggttccttctgcccttgcctctgtaaggtctctgattgatggaagttcctgatctctctatttgaggattccaaaatcatttctctcttttttttttttttccaaatagagtctcactctgtcctccaggtgagaatgcagtggtgcaatctcggctcactgcagcctccgactcccaggttcagatgattctcctgcctcagcctgctgagtagctgggactacaggcatgcaccaccacatccgggcaatttatttatttatttatttttttgagactgagtttcgctcttgttgcccaggctggagtgcaatgacgcaatctcagcttactgcaacctccgcctcccaggttctagcaattttcctgcctcagcctcccaagtagctgggattacaggcatgcaccaccacgcccggctaattttttttgtatttttagtagagacggggtttctccatgttgaggctggtctcgaactcctgacctcaggtgatctgcccaccttggcctcccaaagtgctgggattacaggcgtgagccactgcacccggcagcagctaatttttgtatttgtagtagagacggggtttcaccatgttggccaggctggtctcgaactcctgacctcagttaatctacccgcctcagcttcccaaagtgctgagattacagcctaaaatcatttctcttgacaaaactatttcttgcatcaatttactgggtcgtgggtggataatacatagaatgagttagtaacttcggtgacaactctatctcacagaacgtttacctcttaaaagtgtattttggcctggtgtggtggttcacctttgggagactgaggcaggagggttgctttaggccaagagtttgagacaagcctgggcaatatggtgagacaccatttctaccacaaaaagaaaaaaacatttagccaggcatggtgacacacacttgtagtcccagctacttaaaaggctgagttggccgggcgcagtggctcataccagtaatcccagcactttgggaggccaaggcaggcagatcacctgaggccaggagttcaagaccagcctgaccaacatggagaaaccccgtctctactaaaaatacaaaattagacggatgtggtagtgcgtgtctgtaatcccagctactcaggaggctgaggcaggagaatcgcttgaacctgggaggcagaggttgtggtgaggcaagattgtgctattgcactccagcctgggcaaccagagtgaaactctgtctcaaaaaaaaaaaaaaaaaagggctgagtcaggaggattgcttgagcccaggagctcaaggttacagtcagctgtgatcatgccactgcactccaggctggtaacagagtgagatgccatctttaaaaaaaaataaatatggccaggcgcggtggctcacgcctgtaatcccagcactttgggaggctgagatgggtggattaagaggtcaggagttcgagaccagcctggccaacatggtgaaactccatctctactaaaaatacaaaaattagctgggcgtggtggcgggtgactgtaatcccagctactcaggaggctgaggcaggagaatcgcttgaacctaggaggcggaggttgccgtgaggcaagattgtgccactacactccagtctggggacagagcaagactctgtctcaaaaaataataataataaatacaatgagcttctcaaggggttgcctgccctcaggtaggctgctgtggggcacctgaccttttgtggggcagctcagtaaggagaaaccctttagtgaggacactgttctgacagggccaaggcctgcctcactttttttttttttttaatgaaaaagtaaaatttaatgtggaaaatgcaaacttggggagggcagaaagatcacacacaaggctgtcacttcacacttggagggttgcacagtggcccaacagaggcacacctcacttgccagacggtggggcaggtgggcagaggtgctcctctctccccagtcagttgggtggccgggcagaggcgctcctcacttcccagtcggtggggcggccaggcagagctgcctcactttttaaaactgctgtatcccaccgggcgcggtggctcacacctgtaatcccagcactttgggaggccaaggcgtgtggatcacctgaggtcaggagttttaagaccagcctgaccaatatggtgaaaccccgtctctactaaaattacaaaaattagccaagtgtgggggtgtgcgcctgtagtcccagctacttgggaggctgaggcaggagaatcgcttgaacctgggaggcggaggttgcagtgagccgagatcgtgccactgcactccagcctgggtgacagagtgagactctgtctcaaaaaacacaacaaaacaaaaccccgctgtatccttacttcttgcactttatatgtttgagaagggagaggtttaaaccacagtagcatttcttcatcctccatcccctttgtaatgtaatatttaagaatggcaggaatcaatttggggagctagcttgactgttacccattaatgaacatttatctatcctgtggtgacatgttgccacaccaggaaatggagactggttcttccctgatgggaggagatgacaactatgccataggcaagcatcttgccgctcccaagaaagagaagtctccgctgccatcccacagcctttgggtcactggagcatgtatcagtgccactccgcccaccttcttcctgtgaggggtgactagggctgtgctctgtttgtcatttggatgctttggaaatctgtggcaaatgaattgacttttccatggaaggagcatgtggcacattctggagtggcttcgtgagctccatgtggagaccggaagagtggcagagccctcgttcgtcacatgggggccagcgtggagtgcagcctgggctctttgcccctgcttattttttctttgctggctccttagggaaggtgtgagaaattaaataaatgaaccggttttctctcttctgatctgtaaagtcacctatttatttgttggtaactacatgaaagaatgagtgttgtctttaaagcttgggattaaatgggcacatcatagagaagctgtgtgttcctttcccctcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaaggtcagctgtgggcagtggagggagagaggcccttcagacccttccagaaatgccttttggtggcctgaggtttacctgtcctgatacactgatagttacctacccacctccctgtttgagtatcctcctcagaaatggcatttttcatcaaatctaaggtagccattagttgtaatacaggctttatttttggtactaagaaggaagaggccagggctgggcgcggtgacgcacgcctgtgatcccaacactttgggaggctgaggtgggcggatcacttgaggtcaggagttcaagaccagcctggccaacatggtgaaaccctgtctgtactaaaaatgcaaaaaaatttagccaggcatggtggcatgtgcttgtagtcccatctactcaggagactaaggcaggaggatcacctgagcctggcaagcggaggttgcagtgagctgaaatcgtgccactgcatccagcccaggtgacacggcaagaccctgtctcaaaaaaaaaggaagaggcccggtacagtggctcacgcctataatcccagcactttgggaggttgaggcaggaggattactggagcccaaaggtttgggaccagcctgggtaacataaggagtccctgtctttaccaaaaaaataagggaaaaagtgttgccaaagaaactgaccacagtcgatcagaggtgaacaaggcggggcggatgtgcctctgctatttggatggatccttacagtagcagccttggcctcgtagcctactcctctcctttttttctctttggccttcatgtgaatactcatttttcccccataaaagtagaattgttcttttttgagttcgtcttctagatttacctctgggtgttctctattttgtgtctgtctttggtggtttaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcaggtaggtaccacgcacagttttctttcttattattaatgtgattaattttgagtcttcacccctgagaaatgtcagtctggtagggtatgggacacagtaattctagtgaactcatttcatagtgatgtgctttcctttatttggacagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgtaagtggacgccgctcactgaggttctggaaatcggggaatgttatgctttcttcctgtaacctcacagcagagggttccctggtctaaactgcagagtttttgcctttgcttattctctgcagagcagtaggtggtggtcgtttatttgtaattatagaaagggtcaggggagcatatttcacagtaatctagaatgttctttgtcatctgtatacacctctctcctgctcttctagaactctgatctagcgtcaaccccatcctttccatctacttaggccctactttctctgttggtatatcagagtggaaacagggttgaagttcatgtgtaaagatgtgtctaaatcttgtactggtattcatctctatcaatcctctggctcctgagatcagctacggaagtatacctaaaacaactcattcctctgtgtatctgctaaccttgaggaataaacttgacctctgtgacttcattttattttattttattttattttattttttcaagatggagtctcgctctgtcccctaggctggagtgcagtggtgtgatctcagttcgctgcaacttccacctcctgggttcaagcgattctcctgcctcagcctcctgagtagctgggattacaggtgtacgccaccacgcccagctaatttttgtatgtttagtagtagcggtgggtttcaccatgttggctaggctggtctcaaactcctgacctcaagtggtctgcccgcctcggcctcccaaagtgctgggattacaggtgtgagccaccgtgctccgctatctgtgacttcattttatttgtttttgttgactctattttagatagtgttttgacggtttgagtatttctcaattgtaactcatgagtggtgcaaaatctagccatcttttgatgggtgaggagcttctaaacacaagaatctgactttagtagtaagtgggagttaaaagactaattgtggggaggagtaattacaatttttctttatttttttaaatcaatactaggaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataaacaactagaaatctttatgttgaatggggacatctgttgaccttgattgaccatgattattatggtttttttagagacggagtcttgctgtgtttcccaggttggtcttgaacttctggcctcaagcgatgctcctgcttcagctaggattacagtcacgagccactgtgcccacctaaaactattttgagtgctttagtatgcgctaagcttatggctattattcattagaatggccagcatgttaaaaaatcagcttcaggccaggcacggtggctcatgcctataatcccagcacttttggaggccaaggtgggcagatcacctgaggtcaggagttcaagaccagtctggccaacatggtgaaacctcatcttcactaaaaacacaaaaattagccaggtgtcatggtgggcgcctgtagtcccagctactcgggaggctgaggcagaagaatcgcttgaactcgggaggcagaggttgcaataagctgagagctcatcactacactccaggctgggtgacagagcgagactccatctcaaaaaaaaaaaaaaaaaaagcttcacaagagcattcctaggagtaatgtgtagcaaagagtgagctgcgggagttgcccttcccgtggtcaccacagcggcttcattgctgccagtgtgaatgttggtcctagcaagactggaaagttgagagtaattcacgtccttgtcgtgatccgaagaatgttgtccacatcaatccctaggcctttgcttcctggctggacatggtgtgtggttgggagtgtccgctaagcagcactcttttagagcagaaggcatgtgcctcaacgatttcatttccctccttgtaaactggaacagcagattgttgccaaatttagcaccttgaaatgggtaagcgttggttgtttagggtgtctcagctggaaaaaggccctccagtgtgggcggtagtgagctttgctgaagactcgtgccactcagccgcttctcatcctctcaccaccccctctgctatggttccctgacaactaagaccctgaggcaaccacaagactgacaccagatctgctgcagcctcagaataaagcctggtccaaaactctgctgtcctcaccggttgcttcaagtcgaagggatttcctctcccctaaagaagcgctctgcttcctgacaaagatctaggagagtaggtggaaaagggggagtttcagagcaagcaaagatgaagttagttttcattctaacggctgatactttattgtctatagctgactgatgaagaggccttcaggagaacttgatagaattctattcatgttagttgcatttcagaacttgtgacagatcatagattcttgctttgtcacctgagttagatttgctcagcactcacttctaaacctcatctaggcactgaaagaaaaagagctggggaacgatgcctacaagaagaaagactttgacacagccttgaagcattacgacaaagccaaggagctggaccccactaacatgacttacattaccaatcaagcaggtgaggcccagaaacaaggggcaagggaattgttgggtgtctctgagggaggaagcaaagactgactgttccttcttaaccatcctgcctggcagcggtatactttgaaaagggcgactacaataagtgccgggagctttgtgagaaggccattgaagtggggagagaaaaccgagaagactatcgacagattgccaagtaggctcaaccttccagaataccttgagtagcgcggagggtttgctgtccaagacttaagtttctctgcatggggaggagggctgctggccatagaatctgctgtgttaagaaagggctggcaagaaggtcaccagagacaagacaaaaggtgttgaaggcagtgatgcgggcctttctagctgcaggtgtgtttttctgcaggagctgactttatctctctgtcctaagcagtccttgtccctctttctttatcagagcatatgctcgaattggcaactcctacttcaaagaagaaaagtacaaggatgccatccatttctataacaagtctctggcagagcaccgaaccccagatgtgctcaagaaatgccagcaggtgcgtaggaaaagaataggggtattttcttgttttcctaataattgagccattgtttcttactgttttatttaataatgaacttgacttttttttttttttgagatagggtctcactctttcacccaggctgaaagacagtggcacaatcgtggctcactgcagcctcaacctcctgggcttcagtgatcttcccacctcagcctgagtagctaggattacaggcacgtgccaccacgtccagctaattttttttttgagatggagtctgtttgtcacccaggctggagtgcagtggcatggtgtctgctcactgcaacctccgcctcccaggttcaagcaattctcctgcctcagcctcccgaattgctaagactacaggtgcacgccactatgcccggctaatttttgtatttttagtagagatggggtttcattatatggaccaggctggtctcaaactcctgacctcatgatccacccacctcaacctcccaaagtcctgggattacaggccactgcgcctggccacgtccagctaatttttttatttgtagagaaggggtctcactgtgttgcccaggttggtcttgaactcctgaactcaagtgatccgccctcctcagcctcccaaagtgctggaattataggcgtaagccactatgcctggctgaacctgatctttttttaggtagtggctttggtcatcttacatgattctttctctgtcatttaacagtgacaacatgtaggaagtgatctggtgtttttttttgtggtttttttttttttttttttgcagtttttggtattggccaagatttcaaccctaaatgtgttaatattgagggcctgtgcattgagaatgttaatagttcttgtaacataacattttgactattttataaagactgtaaatttcttttaaaatcttgccagcaatagccgggtgcagtggctcacgcctgtaatcccagcactttgggaggctgaggtgggtggatcacaaggtcaggagttcaagaccagcctggccaggatggtgaaaccccgtctctactaaaaatacgaaaaaattagctgggcgcagtggcaggcgcctgtaatcccaattactcaggaggatgaggcaggagaatcgcttgaactcagtggggcggaggttgcagtgagccgagatcatgccactgcactccagcctgggtgagagtgagactccatctcaaaaaaaaaaatcttgccagcaatagccagtcgcagtggctcacgcctgcgatcccagcactttgggaggccgaggtgggcggatcaagaggtcaggagatcgagaccatcctggctaacacggtgaaactctgtctctactaaataaataaaaaaaattagcctggtatggtggtgggcgcctgcagtcccagctactcgggaggctgaggcaggagaatggcgttgaacccgggaggcagagcttgcagtgagccgagatcgcgccactgcactccagcctgggcgacagagcgagactctatctcaaaaaaaaaaaagaaaaaaatcttgccagcaatactctgaaaattaaaatcctaatctgattttttttttttttgagatggagtctcgctctgtcacccaggctggagtgcagtggcgcgatctcggctcactgcaagcttccgcctcccgggttcacgccattctcctgcctcagtctcccgagtagctgggactacaggctcccgccaccacaccaggctaattttttatatttttagtagagacagggtttcaccatgttagccaggatggtctcgatctcctgacctcgtgatccacccgcctcggcctcccaaagtgctgggatcacaggcgtgagccaccgcgcccggcccctaatgtgatttttaagcccaatatttagatgattatgagcgtttaaattattatttcaagaattatgttttgtaggcagagaaaatcctgaaggagcaagagcggctggcctacataaaccccgacctggctttggaggagaagaacaaaggcaacgagtgttttcagaaaggtactgcctgcagctgggggattgggggagcagtgctgggtgtgcctcccgtgcctggctgtggggtaaatggccggctacacatgggggctttttgctttttaaaagacagtctttgtttttcttccccaggggactatccccaggccatgaagcattatacagaagccatcaaaaggaacccgaaagatgccaaattatacagcaatcgagctgcctgctacaccaaactcctggagttccagctggcactcaaggtgacgagacctgtgggggcggccattactgaaagcctgcacatgaggagtgggttttctctctctctcctcatcaacattgagttgatgatgatcatgatgtttgagacagtgtctcactctgtcctgcctcagcctcctgaggagctaggaccacaggctcatgcctccacatcctgctacattttttattttttttgtagagttggggtcttgctgtgttgcccagatttataggggtgtgtgtgtgtatgtgtgtgtgcgtgtgtaaaatatgggacctgtatctaactggtcgtgtgtgtgtgtgtgtgtgtgtgtgtgtgtgtgtgtgtaaaatatgggacctgtatctatctaactggtcctggtccatggagtcactactggttggcagtacattggaaggtgggtcctttcacccctgtaaccttcctcttttttctttgtttttgcctttttaaccatttttaagaagtggaattgctgggtcatgtggtgtctgtgtttactttttttgttggtttgtttgagacagtctcactcagctgcccacactggagtgccgtggcacaatctcggctcactgcaaccaccatctcccgggtattttagtagaaacggggttttaccatgttggccaggctggccttgaattcctgacttcaggtgatccacccgcctcagcctcccaaagtgctaggattacaagcgtgaaccaccacgcttggccccctttttttaaaaaaaaaaaaaaaaaaagacaaggtctggctctatcgcccaggctggctggagtacagtggcacaatctcagctcactgcaacctctacttccctggcttaaaccatcctcccacctcagcctcctgagtagctgggactacaggtgtgcaccactgtacccagctaatttttgtattttttatagagacagggtttcaccatgttttcccaggctggtctcaaactcctgggctcaagcgagcctcctgccttggactcccaaagtgctgggattacaggcatgagccactgcgcccggcctatgttttatttttgaggaaccaccatatgtttttcagcagctgtaccatccttgcttgcttttctgttttgctcagctaggtaggtctgctgttctcagtcatatcaagttaggtcaaatacaattgtttgacactgtggagttcccataatcctctcgaatctcagccaccctgcctctatcagcagttttttttgactgttctctagctgacaaacctggaccgtattgtgggaaggtgacaaagtgtgacctgtctagaaacagccatacctgggtttgtgttggtttttatattttgtgccactgtcttctgggtctgtgtcttggcctagagacatcatttctactagtaggattgtgcaagagtcatgtcaaaagcatattgatttgtgaggcaaagaatagcaggttgtcaatcacctgggaggtgggcagtactttcccgatcatgagagcgtggagaaagaatgaatgggatttctgctgctgtcccagcttcttggtgcaagagttggaattaattccaggggagctcagtgtactgcatagtgttctcttcctcatcatttctcactttgaagatgtttcaaagagaagaatacatagtgaatatctggtgtatcttccacctttatctgacaaatgttgacctgtttttgctgaactgtttgcgaaaggaaattgtatacatttggtacttagaatgagacatccaagtcttgtgcacgcattgcctgaaaagactcctgtccagtgcagcactgtcagcacacgcgacctcaccagaccaaggcctgatgccatctgccgtctgtccatccatacttagacttgcccacttctccaaaaatatgttttaaaactgaggtttttttatttttgtttgtttgtttttatttttttttgagacagagtttcactcttgttgcccaggctggagtgcaatggcgtgatcttggctcactgcaacctctgcctcctggattcaagcgattctcttgcctcagtctcttgagtagctgggattattacaggtgcagccaccaggccagcaaatttttttttttttttttttttttttttagtagagatggggtttcaccatgttggccaggctggtgtcaaactcctgacctcaggtgatccacccaccttggccttccagagtgctgggattacaggcatgagccaccgcacccagcgttgttttgttttttagtcagcaatggttttggattccaaagctctcaggaccaaggcccacgcattttgtctagttgtcatgtactcttcagtttctcaaactggaattgtcccccgctatgtgtttttcataacatcagcctcttgcagagtccaggcagtttgtcttgtgtgggatgatccatcatctggagttgtctttcctgatgttgtcccctctgtttggtgctgggtgaggcattagagttggaagtccacatgcttgagttgcctgtactgagcttgtccaagggaatgagcctaatttctttctgttgcttcattctaggactgtgaggaatgtatccagctggagccgaccttcagtaagtgcctttctgctgcctgtcccctgtctctagccaaaagattagagaaggaaagggcaagccctttgtctacctgtgtgtccttgggacctgtaggatttaggatccaacatcagcaggtgtgaacagtgttggtgtgcaggtgaagaggtgcaaggagcagccttgggcgctgcggttggataacgcgccacctttcctgtttgtagtcaagggttatacacggaaagccgctgcgctggaagcgatgaaggactacaccaaagccatggatgtgtaccagaaggcgctagacctggactccagctgtaaggtggggctgcttctggcctccaggggccccccctgcctctttctctgttggggcttttccatgttcagtccctgatttcttccctgtcacctccatttctctctgtttctctcttacttgttctctctccccttgtcagttacctctgttatcttggacctgctgaagcagtgagctgggtggtcctaacacgcttcacctttgtctcttctggactgcaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgagtacgtagagtcagagaggcggccttgctggaaatggagaacaaaagcaggcagatgagtgcacgcggctggggggtggtatgctcagtctgcgaggaagaggaattctgtcattcttcctaaacttaaggagattggcagtgggtggcgagctggaagggctttgttagtcgtgatagcttaagcagtcatttggaaaggcccatttagctgggagaaaggtcttgactggaagctgtgtcgtgggctcaagagtaggactggcaagttctgcgaagtggagcaggcctctgcagctcggcgccccgggcctcgccaggacccctccctgccggggccttctgtagagggggttgaattggggcttgctctgagagcaagtaagactttaaaggttgtctcatttcaagtaactgcgtcttcctctgtagacacttaaagaatcctgtaatagcacagaagatccagaagctgatggatgtgggtctgattgcaattcggtgatgacttgttcatccccccttcccttcgccctcatgtggaaagaggagctgggaccgcggcgagcagcacggagcggaagggagagcaggggagagaaggcctcatctctctatatttatacataaccccggggaagacacagagactcgtacctgcgctgtttgtgccgccgctgcctctgggccctcccagcacacgcatggtctcttcaccgctgccctcgagttccatgtctctttcccctgcccctagttgctgtctcggctgctctcccatagttggttttttttttatttggggcagtgggcatgttatggggaggggagggggttcttccagcctcaggtcccagctgtctcacgttgtttattctgcgtccccttctccaataaaacaagccagttgggcgtggttata

SEQ ID NO: 37600 - DNA, 332704 bp, Homo sapiens; identical to SEQ ID NO: 36747

SEQ ID NO: 37601 - DNA, 45214 bp, Homo sapiens
gggctgcggagaggcgggccgggccaagcggagccgagcgagcgggagcgcggcgtccgggaggcggcggagacgcggggctcggagggtcagcctcttatcgtagcaggtctcctcggcacgccccccttgtttcgccccacggccaagcccgccgcgggccggcgtgcgctggtcactgaggcccaggtcgccgccgcggcgcggtgagtgggggcgggcagcgggcgactgcgcgtccaggccggaagtgcggcgctttgtgcggccggctcggggcggcgccaaggtcggcccgcggctcggggtcgctgggcgtctggaccggcctgggctgcgctttgtgccgcgggcaaggccgggcgggggccgggggcggagctcggccggacacgtacgcgtgcaggtgcggtccgggcggcgcgggcctgccgcctaggtggccgaggtggcttcgcggcgcggggcgttctcctaaaggtcggggtcacagccgtcaggaatgcgagcgtgaaacccgggggcagagctttgtgacaatagtcatttccaatgtgtaactgctcactttgtctacccacgaagtaaagataatttttatttttatttttttgcttggcggaatctgagcgttctccttccagcttgaaaaggcacgatttaaattacagatttttaagatttccttcagaaaggacgtttcgtggcctagcctgggttaactttgaaaaaagagtgcagtgcgcctttacgacgtccacaaataagggtatttctgttttatagtgtatgtgaacatgaagtgtgcatctcatgggctgtttgagttaatgtttaatcattaaagtcaaacaagaatattttgcagtgttttcgcatgcaaggaagctttataaataaaaaggtttatatagtttccactccttaaactttcaggtcatccttgtgtaatttgagatcacttttctcaaatactatggatgaaagattctagattaaataaaactttttggttttggcaaaaacaggacacatttttaagctcttgtagatgaaggagtgggttatttttgctttgacagccaagatttgagcagtgtaaggctattctaattttgaagctagtgttgcagaaattgtgaagatcttgcttctctttgtctttacaaagcaggcttactttggtggagttccgtagtttaaagggaaattatacccaagttgtcttagacagtttcttttcctggatcaattgagcacttttttttttttttttgagacggagtctccctctgtttcccagactggagtgcagtggcgccatctcggctcactgcaagctccgcctcccggattcacgtcagtcttttgcctcagcctcccaagtagctgggactgcaggcgcccgccaccacgcctggctaatttttttgtatttgtttttttttttttttagtagagacgaggtttcaccgtgttagccaggatggtcccaatctcctgacctcgtgatccgcccgcctcgaccttccaaagtgctgggattacagacgtgagccaccgcgcctggccgagcacaattttaaaagaacagtacaccagcgtaatagagtaatagttttttcatgccttgtgtccagtctgttaagtctgtctgattgtactgtgcagaaatacatgaattcctcccagtaaaatgcaaacccaaaccttggtaatgaaggtaaagtttgggggagagaacttcttttcttttttcttttttttttttgtgagacggagtgtcgctctgtcgcccaggctggagtgcaatggcgtgatctcggctcactgcaacctccgcctcccgggctcaagggattctcctgtctcagcctcccgagtagctgggattacaggcacacaccactgcgcccagctaattttttgtatttttagtagagacggggttttaccatgttgcccagtctggtcttgaactcctgacctcaggtggtccacctacgtcggcctcccaaagtgctggagacaccaccgcgctcggcctatatgctttattttttatttattcatttatttttttgagacagttttgttctgtcgcccaggctggagtgcagtggagtgatctcggctcactgcaacctcctcctcccgggttcaagtgattctcctgcctcagcctccggagtagctgagattacaggcacatgccaccctgcccaggtaatgtttgtgtttttagtagagatggggtctcatctcactatgttggccaggctggtctcgaactcttgacctcaagtgatccacccgcgttggcctcccagagtgctgggattacaggcgtgagccaccgtatccagcttcttttttaaaaatatatttttgtccaggtgtggtggctcacgcctgtaatgcctgcactttgggaggctgaggctggcatatcacgaggtcaggtgatcaaaaccatcctggataacatggtgaaaccccatctctactaaaaataccaaaatattagccgggcatggtggcaggcaactgtagtcccagccactgggggaggctgaggcaggagaatggtgtgaacccgggaggtggagcttgcagtgagccgagattgtgccactgccctccagcctgggcaacaaagcgagactccatctcaaacaaaaaatttgtatatattatacatatatatgttcattttgtagagatgggagtctcactatatcgcccaggctgatctcaaacttctgggctcaagcagtcctcctgccccagcctcccaaagcactggtgttacaggcacttgccaccaagtctacaagctcttgttgatgttgccagacattactgagaatttccaatgttgatttttctgagtattgtatcttgtatattggtgtttctgagagtgaatctaaacctcttaaaattagatttgttgatataaaattttaaaggcctcgtgttatagtatttcatacttagtgctctgtgtggaactttgtttagagatggtatgtttccaaaccaggaaacaatagtatatagtgataggtctttctttcttttttttttttttttttttgagacaagagtctcgctttgtcgcccaggctggagtgcagtggcacggtctgggctcattgcaagctcagcctcctgggttcacgccattctccagcctcagcctcctgagtagctgggtacaggcgcctgccaccgtgcctggataattttttttttttttttttttgtatttttggtagagacggggtttcactgtggtctcgatctcctgacctcgtgatccgccctcgtcggcctcccgaagtgctgggattacaggcgtgagccactgcgccggcctctttttttgagatggagcgtccatgtcgcccaggctggagtgcagtggtatgatctcggctcactgaaacctctgcctcctgggttcaagtgattctcctgcctcggcctcccaagtagctgggactacaggtgtgcaccaccaccgctggctaatttttgtatttttagtagagacggggtttcaccatgttggccaggctggtctggaattcctgacctcgtgatctgcccaccttggcctcccaaagtgctgggattacaggcgtgagccaccatgcccagccaggtctttcttttttctttcttttttttttttttgagatggagtctcgctctgttgcccagactggagtgcagtggcgccatctcggctcattgcaagctccgccttccgggttcacaccattctcctgcctcagcctccccaagtagttgtgagtggctaattttctttttgtatttttttttagtagagacaggtttcaccgtgttagccaggatggtctcgatctcctgaccttgtgatccacccgccttggcctcccaaagtgctgggattacaggcgtgagccactgcgcctggccaggtctttcattttaaagatagagttttcttctgattatgatttgattttcaagttaggaatttttgctgtcatctttttaaaggtaatctgacatttgtctattctaatgcaggtgtcaaaccacccataagaattctgacagttgagtcatttcaaatgggaaactaaaaatgtggtaagctcggcccggtgcagtggctcacgcctgtaatcccagcactttgggaggccaagactggcggatcacctgaggtcggaagttcgagaccaacctgaccaacgtggagaaaccccgtctctactaaaaatacaaaattagctgggtgtggtggcacatgcctgtaatcccagctactcaggaggctgagacaggagaatcgcttgaacctgggagtcagaagttgcggtgagctgagatcgcgccattgcactccagcctgggcaacaaaagtgaaaactctgtctcaaaaaaaaaaaaaaaaagtggtacgctctagatccagccttgggtttgggtttcttagtccacagcaaattagactggaaagttggtggttgcagggagattttagtagcactaacatttcaggtagattggtgatggtgtgttttttctttagttttgcattatgcagaattgaaaatgcggcagtacagtgcataaccttatatgcaacatcttgatgtaaagattattagcatttacataatttctacttgatgtagagattatttgctctttttgtagaaatattttaaagtatagatgtatcattttcgactttatatactttattgtatctttacaaatttatgtaactatacataatcacagtactgttaccaggattaaacataattgtttcataccagctgatacccagtattcagtcgtgtcccagatatctttaaactctgtttacagttgtttcagtctaaatcgagtccaaacaaaattcagctattgcttttatgtctatatctattttaatttagaattatctggccttcctcctctcccgcccccttttccccccaccattgccttattgaagaaactgggtcatttgtcctctggaatgtcccacttttggggtttgtctgattgtttcatggtgtcattcagcatattccctcctactcctgcgtttcttgtaaactggaagttagatgtaaaggctccatttgatttttttttccccccagacagagtcttgctctgttgccccatctggagtgcagtggtgcgatttcagctcactgcagcctctacctcccaggttgaagcggttctcatgccttagcctcccgagtagctgggattacaggtgtgtgccaccacgcccagctaatttttgtatttttagcagagactgggtttcaccatgttgcccaggctggtctcgaacgcgtggtctcaagtgatccgccctcatcggcctcccaaagtgctgggattacagggatgagccactgcaaccagccaagtagagttttattattattggtctaggctataagtcaggtcattatggaaggagagcctcctaacatccttcagtacttcatttgaatttgcagtttttggctgttaggaataatgctgttacaaatgttcatgtccaactgtaggtgtagcatgtgttttcacttctcttgggtatgtacctaggagtggaattgtggggtcatgtggtaactctgtttacctcagagttgctcaggagcttctttgcctaccagaggacatctccactcaggcctgtatttaagggtctccacttggtggttgtacctaagctgtgtctccacaatcatctattactgattccctacatagagcctaagctccaaacaaactcagttgcttaatgttcttaaaatgcatcttgcttgttctcatttctgaggctgatttgatcctatccattgtttattggaaatgctgccctttaattattattattactattttttgagacggagtcttgctctgttgcccaggctggagtgcagtggcacgatctcagctcactgcaacctctgcctcccagattcaagtgattctcctgcgtcagcctcctgtgtagctgggattacaggtgcctgccaacacacctggctaatttttgttgtatttttagtagagatggggtttcaccatgttggctaggctggtctccaactcctgacctcaagtgatcctcccaccttggcctccaaaagtactgggattacaggcatgagccgctgtgcctggcctaacgctgccctttaatcaagtttttcctatttcttccctcctccacagaatttttgctctcccctctcagccctcagaacactttattctcttgtgactcttttttttttttttttttttttgagacggagtctcgctgtcgcccaggctggagtgcagtggcgcaatctcggctcactgcaggctccgccccctggggttcacaccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctttctcttgtgactcttaacacttgttgccttgtatcagaaagtattcatacttttaatcttattatgtatatgtttgcactgtccaatacgatggctgtcacctacataggactgttgaagttaattaaactaaaaattcacttaccatatttggatagtacagacaggctttcatctttgtttttgagatagggtcttgctccattgtctaggctggactgcagtgataacgatcatagctcactgcagcctcgaactcctggactcaattgatctcaagtagctgggaccacaggtgtgcaccaccgcatccagctgatctttttactttttgtagagacagggtcttgccatattgccagggctcgtttccatctttgtgaacagttctgttggacagcgcttttccagattgtaaaactcagaagagattgtgacttgccattttgttttctctgtggcctttgtgtagtgctttgcttatctggaattcaattaagaaataaaaattagtagctcctggcacagaagaaagaaataacatttgggaaatatttgcttcttgagagatgatagttgaaccagagaagtaggtgaagtatttgcagacccccacaatttcttggttgcagatccgccaagcatgggttaaaagtacaggggactagggattggcagttgctagtatgtttattcctaaactgtagggtaagacacacaattgattctcctgcctacctgctatgcctttgtatacttgtttcctccctactctgaactgtaggcctgcactgtccagtatagtaaccactagccacatgtgactacttatgttgaagttaaataaagctaaaagatcaatctcacagtagcctcatttagccttacttttcagatgctcagcactcttggcaggcggctgctgtaggggacagcacagatggagaaggatgtggtcattgtacaaagttttgttggtcagtgctggtcaagacctatcacgtagctgtagttgtgaatggcatgacaaatctggcatttggatttggtttagaagtttaaaaaaattagacagttcaggtaatgaatgttttagttactaaagttgccagtttattcctgatttaatccagaacttcctgttacagaggctaaggatgtgacctaatattttcttcttactacaggattgcttggttgtgaatattctaaatgagacaaatgagctgaaaatttgaagtggtttctttttgtattttgtcttcgtaatggattttgacacctagagtgttctgaaaggcatttgttttttagaaagtcggtaggtagttgcagctattttgtaccagatgttgttattgatgctggagatattgcctttaaacagaaccaagtgcaactgttccctgcttgttttggctacattctaaatggggatgtggggaagacagacataaaatgcacattttgtgttttgttacttattacatgtttttcagagatggaaccttattatattgcccaggctggtcttgaactcctggcctcaagcgatcctcccacagtgctgggaatacaggcatgagccattgtactcagcctaaaaatagacttttttttaggtctagcagttttaggttcacagcaaaattgagcagaaggtacagagagttcccatatacccccctacccccacacatgctgttttaatcttaaagatcaccttaatctttataaccacatacgtcagtgagtgatttaccagatgaggaatagtgaaagcttacactttaatacactgcattttaggaggccaaggcgggaggatcacttgaactcaggagttcaagaccaaactgagtgacgtagtgaaactctgtctctactaaaaatgagccagacgtggcgatgcacacctgtagtcctggctactctggaggctgaggtgggaagatcacttaagcttgggtgatcaagtctgcagtgagctatgactggcagagcgagaccacgtctaaaaaataaataaaagtaaataataccctggataagattcagaggagcttactagagagctgaatgggaatcagttcccaacagtacttctgttggggaggggtagagtcctggttgtggctgtgcaagttcttgaacttgtcaggaaaaagaaagatccatggatgataaaacattgaatggattcatagaggtgctgggctgtaaccagttagtctttcttaggaaaaaaaacttaacaagtttttgaagaaatacaggaaactagagtggcatggtggcacacacctgtagtcccatctactcgggaagctgaggtgggtggatatcttgagcccagcagtctgaaaccagcctgggcaacatgatggaacctcatctctatttaaaaaaaaaaaaatacaaaacttagccagatgtggtggcaccacacctgtagtcccagctcctagggaggctgaggtgggataatcacttgaacccaggaggtcaaggttgcagtgagctgagattgtgccactgcactccagcctgggcaacagagcaagaccctgtcttggggtggggtggggggggcggaggggagaaatacagtcccagcactttgagaggctgaggtgggcggatcacgaggtcaagagatgagaccatcctggccaacatggtgaaaccccgtctctactaaaaatacaaaaattagctgggtgtggtggcgcacgcctgtagtccctgctatgcgggaggctgaggcaggagaatcacttaaacctgggaggcaaagttgcagtgagctgagatcatgccactgcactccagcctagcgacagagcgagactccgtctgggaaaataaataaataaataaataaataaataaataaataaataaatacaggaaattgcaaaaggaccactaaatccactcccatctagagtcaatcactgttcatatttttatatatttcttttcagactttttttctgtttgtgccagggatgcacatttttatacacataggtgtttatatgggatcatactgtgtaatgcaggatgcagtataatactctactttgttttcacttaacattgtattattctgtttttaaacatttcttgaaaagcagctgcgtgatatttcatgttctggatatgtcttggttaacttaactatcctctgttagaagaacattttggttacttgtagggttttccccatgttttttttgcgacaaagtctcgctctgttgtccaggttggagtgcaatggcatgagcttggctcactgctaatctccacctcctggattcaagtgattcttgtgcctcagcctcccaagtagctgggattacaggtgtgcgtcaccacacttggctaatttttgtttgtttttgttttgttttgttttgtttttttgagacggagtctcgctctgtcgccaggctggagtgcagtggtgcaatattggctcactgcaacctccgactacctggttcaagcgattctcctgccttagcgttctgagtagctgggattacaggcacgcgccaccacacccagctaatttttgtatttttagtagagacggagtttgaccatgttggccaggatggtcttggtctcctgacctcatgattcctccacctcagcctcccgaagtgctaagattacaggcacgagccaccatgcctggccaatttttgtatttttagtagagatggggtttcaccatgttggccaggctggtctcaaactcctgacctcaggtgatctgcccacctcggcctcccaaagtgctgggattacaggagtgcaccaccgtacctggcctttccccttgcttttagtggacatatagctaacaatttttactccttagcttctgatggactgaggagaattgtgaaaaaaagtttatcatgccctggtttggcacccattaggacatcgagtgtcccttttctgttcttcgctggttgggggcagcatgaaatgcattgttttatagcagcctagagaaaggactctagctacctgctttttggggactggtactggagaaaaatctgagagcaaaagtgcttggctaaattcccttttttttcttttagtttttgaaatcatgaatcctgtttatagtcctggatcttctggggttccctatgcaaatgccaaaggaattggttatccaggtaagtaagtaaaattttgttttcatttttgaactttgaatacttggtatattttcatgtcactaagaatgctttctattgacaaacgcagctcaaagtggcttagacaagaaagaaaatacctggaagtgaaaaatcaaatgataggactggatttggtcaaaacttgatctagtggctccagcagttgggaccaggatctagtttctctacctcctggtctcagcttcgcttcctcagtattaacttagtgttggtcacaggtcccactccttctcattgtggtctctgaagttcaggcccctcccagtagtccctcactaagagcctctttacctccactctacaggaaagcctgatgggactgcttgttctctattcaaaccagtcctgggctttgttctgattaaactcagcatccatccctgggccacaaaggggagtctgctgattgacttaggcctgatccacatccctttagtggagtcagctagtcaaatatggactgcaagtgagggttgcagcgaaatggatattgaggggataggagctggttggtcaaaaatagcaaatggttgttcccttcggtgactttgcacaaggagtagttatttataatgatacagtttcattttgggttttgataatatggtagaagagataaccccaaaactttgttgctaagactctcagaaagtgaaataaaacattttacaaatgtataactgaacttgcaggaggtaagagagatatctggggtcaaatgtgaaggccatgttaaacccagctaacttggcctttgaactaatgtcgtgcctgtcctgggcacatgtgctatttgtgggttttaacaacccacatggggatagagattgagtattaggacccttgcgacagggaatgagagtgagacttcttatcagtcattctcgtccctctggagggtgatactctcagcaaagagatagactaaacagtctagtcgtccagtggccccataaggaagtttatatgcttgggctctgagaagcgggagatctttactaagactttgtaagcattcagagatgtttggggctctagcttgtattatactccccaggggttcagaagttgagaaattaacgtaaaaatagtctccaggcttggttactcctggggctcctgacagcagcgaatgcagaactgctgtgggggcatatgttcacaacccaggttgcgtgggcttcctgcaggcaaagttctgcctgctagcatgggatgcctcccatcaagtaagaggcaccagccatgacagactgcaggagaagaaccatcaggtagatgctatgtcacatagccaagtttagaagaattgcagatataaaagaaagaatcagaaacataagaggggaacaagatgctgagaaaaaagaactagctggaactttaagaaatgaaacaaaatggcatatgaacaaatttcaggttaatatcaagacaagacactggttaagagagaaccagaatgcaacataaggaaagggaggaaaacagaacagtaaagaaacatctggagctcttctccagaagggctgagtagagaaactgtaagaaaaggagtgacaggctgggtgtagtggctcatgcctgtaatcccagcactttgggaggccgaggcaggcagatcatgagttcaggagatcgagaccatcctggctaacactgaaaccccgtctctactaaaaatacaaaaaaaaattagccaggcatggtggcgggcgcctgtatctccagctacttaggatgctgaggcaggagaatggcgtgaacccgggaggtggagcttgcagtgagctgagatcgtgccactgcactccagcctgggcgacagagcaagactctgtctcaaaaaaaaaattcttttactattcttttagtgcttattataaagattatacctcttttatttttatttttttgagaccgtcttgccctgttgcccaggctggagtgcagtggcacgatctcagctcactacaacctccatctcccgggttcaagcgattctccagcctcagcctcccgagtaactgggattacagatgcatgccaccatgcccagctaattttttgttcactgtgtgagccaggctggtctcgaactgcagacctcaagtgatccgctctcctgagcctcccaaagtgctgtgattataagcgtgagcccctctttttctgttgttgccttaccttaagatattacttgtgtcacagtactccagcctggtgacagagcgagactctgtctcaaaaaaaaaaaaagacgttactgttttaattttgtgcaatcaacagccatttatatttattcacacatttactgtttttggtgctcttcattgctttctctatttacatgtttctctctggagtcattgacctttatctgaacaactctcaacattttttttttttctgagacagagtttcactcttgttgcccaggctggagtgcaatggcgtgatcttggctcactgcaacctctgcctcccgcgttcaggtgattctcctgcctcagcctcctgagttgctgggattacaggcgcctgccaccatgcccagctaatgtttgtatttttagtagagatgggtttttgccatattggccaggctgatcaagaactcctgacctcaggtgatcctcccacctcggcctcccaaagtgttgggattacaagcgtgagccactgctccgagccacatttttttttttaaaccacaagtctgttagtgaattttgttttgtgaaattgtctttattttgcttttcttttgaggcattcttttgccgggtgtgtttgttttttttgtggctgctataacaggtaaccacaaacttggtgggttaaagccatagagatgtagtcccagaggttcgaaatcaaggcgttggcaggtctgtactcctagtgcaggcccagaggaaaatccattccttgcatcttctagtttctggtggctgtctgcagtctttagcatgtggctttgtggctgcatcactcccatttctgcctccatggtcacatcctctcctgtgtgtcttttgtgtgtttgttttgagacgaagtctcactcttgtcacccaggctggagtgcagtggcgtgatcttggctctctgcaacatctgcctcccaagttcaagtgattctcctgcctcagcctcctgagcagctgggattacaggtatgtggtgcgtgccaccacgcccgactaatttttgtatttttagtagagatagggtttcaccatgttggccaggctggtcttaaactcctgacctcaggtgattggcctcccaaagtgctgggattacaggcctgagccaccgtgcccggccctgtgtgttttttataaggacacttgtcattggatttagagccagcctgggcagtccaggattccagaatgacctcatctcaagatccttcacttaatcacatctgtgaagattattttcccgaataatgtcacattatttcctctcagcactttaaagataaaatttgtcatctggtttctgtcaaaataatttttttttttttttttgtgaaagggtcttgctctgtcattcaggccccagtgcagtggtgtagtcacggctcactgcagcctcaaactccttggactcaagggatcctcctgcctcagcctcccaagtagctgggactacaggtgtgcgctaccatgcctgaataattttttaattttaatttttgtagagatcgggtctcactgtgttgcccaggctgatctcaaactcctgtgctcatcccacctcagcctcccaaagtactgggagtacaggcctgagccactgtgcccggcctagaataatttttgcctctttgaaatcatgtttcttctctacatttcccccaacccgtgtaccttgctactttgaaaatatctttgcttttaccatgatgtaactagatgcgattttatttgtatttaccttgcatagtgttcagagaacctcttgactctgagttgatttcttccagcagtagcagtagctcttcaaatattgtttttgtccctttctctcctctcctggaactccatctataagtgttttagaccatttcagtctgtcctttctgtctcttgcaccctgttttatagtttctgtttttttctccatgagctttaatacagatagtttatactgatctgcttccatttgtcctgctaattctgctctaatttgctataattcatgtattgaatcaagtctttttatgtattttctccatcttctgttttttccaacatactactgagttattttaaaaactgtttgctaactgcagtctctggatcacctgtgcgtcagtttttattgtccatttgttctgttcttttgtttttccgtcacatggtcctgtcttggcatgcctggtgtttttcattaactgtctcacgcagtgtattagaaattatgggtggtttcactgatgatgtcttcttttgctgggaaggtagcatgctgaatggtcttcttaatccacttggagctgggcttagatgcatttcagttttggcaaggcttggtctccctttgttctgcccttattctggagcgcagggtttccataagcctgacatgctctgcacagtccatccctcttgtggatccgtaccctgatctttgtctcttacaccaggggagtaaggaaaactctgcgtttcagagatttttggtttttgctgtctgctggggtagctttagaatttgacatatgtcttaaagcagactttaactggttttgaagctcatctgaggtccaattttatcactacagcccttcaagatcaccaaaacccatgtttctctgtcctccagccacggccttctgtccagggagaacctagacttggcctcttgcccatgctgagaattgacaagcaccgcccaggtcaacaaggctgtagatcctaatttctcctttgttccacaaatggtagtggacactgggatggagttaggaacataaacattttgggggggctatcacataggaaaatccagcagggaggaagtagaattagggagagcctcagactgtgaggcacatttgccgaactcatggccagcccacgggtgctctggggcaagggttagcagttggaggccgacatgaggcaccagcggcctggtcctgctcctgagactgttgacccacatacttctcctggctgaacagtaggttctttctggaaaagagatgcaggcggcgttgctcacttcgctttgtaaggaatcactccataacagttcacagaagtttgccttgttcttttttttttttttttttttaaatgtaatagcgttacatacactccatcttgtgggcttccatagttgattgagccagtttccttgtgatgggcattggagttgtttgaagtgtgtgctattttagtaatgattctgtgaacagccctatgtttgtgtgactctgggaattctcctcagggtgggttcctagagctggggttgctgggtcagagagcaaatgcacatgtgattgttaggatactgctgagttcttatcagcagtgtgagacgatttccccacagcctggctaacagaatgtgttttccagcttctggatttctgctagtcggaagttagtcagcgtagttgtagtttgcaattctgtgtatctgtgtctattgatttgagtggtgggggtggggcgggatgtttgtttttgtggttttaaaagttacttacgtattaagtgtactagccctttgtctaaataatttagatactttatctgaatttgtccttttgcttaactatggtattttttgctgttctgaagcttttacttttgtaaggtgatcagtctttttttttttttttttttaagacggagtcttgctctgttgcccaggctggagtgcagtggcgcgatctcggctcactgcaagctgcgcctcccaggttcacgccattctcctgcctcagcctcctgagtagctgggactacaggagcccgccactgcacccggctaattttttttttgtacttttattagagatggggtttcatcgtggtctcaatctcctgacctcgtgatccacctgcctcggcctcccaaagtgctgggattacaggcgtgagccactgcgcccggccaaggtgatcagtcttgtagaaatgattcaggtttgggatcgctctggtgccttgatgtagggagtctggcctttccagcctaccatgccagaagagggctagaatagatgctgaaggagacggtctctgtgtctgctgggggttggggtacccagaaagatcaggaataggaagaaacagtgattcttaactccattgcttggaaccctgcagattcactgtctggagagaatgagaaaaaagaggctggtgcacccgagaccagctaaagcagtgttgggggtcctcccaaagctgcccctgtgggttttgtgcagtccaggtagaaaccattggagatagtgaggggagccacgctgcggcttgggtcagagtggtgacagagcaagtgggatgtggctgatgggatgaggcgatgggagcacggaagcagcagaggctgtctaggagattgggagtctttgatccccataccagagaccaggtatgtagtgcatcttgttgctggtggctagtgatgccatcttaaatactatcgtgtgtgtttgctgtttcattataggatgtgttaacttcttgttagaaactggggggccgggcgcggtggctcgtgcctgtaatcccagcactttgggaggccggggtgggcggatcacgaggtatgtagatcgagaccatcctggctaacatggtgaaaccctgtctctactaaaaatacaaaaaattagccgggcacgggcccctgtagtcctagccactcaggaggctgaggtaggagaatggcgtgaacccaggaggcggagcttgcagtaagccgagatcacgccactgcattccagcctgggcgacagagcaagactccgtctcaaaaaaaaaaaaagaaagaaagtggggatgggaaggactaagcaaagaagacagtagtttttcagggaccgttaaacacaatcttcagcaaacaaatccagagcagccctcttcccatgagaatatattggtagagttttagggagagatgaggaatttggaatttctggaaattattgcagaggcctacaggatatgatctaggtcagtggtagttgaaactttttttttttttttaaaagaaggaaaccattggaaaaaaaaatcttgctggttccctggtctctgagggcagttccagacctttcttggtcttcctgtgctcacaattgggcttctgaggagtctctcagcatccccagaactgctgtcctggtctttccagtggccattgtgggtctctttgaagttgaatctgcccttgacgtccaccacactctgttctctgactaattagagagggcaaacgggagggtgagagtccaggagggaaacccggaatggcttctgctgaggtagagggggatcagtttgaagtgaggaaagcaactttgaagcaaggataaagatgagaactgggcacttggagggattctggggctagggcttggtgacactgatgcctcctgttcccacagaaacctgcaagatggcttagggatgcagggcaatagagcaagggatccaggctgagggggccgaagggaggcacgtgaggagctgtattcagaactttctgtcccacctacaaagattttccttttggcattccactcagatcccccctgtttttacctcaaccttagggcttccttgctttggttactgttagcaccatgatttgttcctaagggatcgtaacaccttaaaaatcccagtccaagtgctgtaagagacacctttctccaggcctcctcaacacagtttcttttgaagactgctcttctctttcaactttatttacaggtgaaggaagtgtgcagtagagaagttacagcttctcacagctagtgggaacagtaatcaaggctaggaaacctgagtcatcttgttggctgtgtgccccaaatagaaagaacgctttctggccaggtgcagtggctcacacctgtaatcccagcactttgggaggccgaggagggcggattatgaggtcaggagatggagaccatcctggccaacatggtgaaaccccgtctctactaaaaatacaaacattagctggacatggtggcgtgtgcccgaaatcccagctacttgggaggatgaggcaggagaatcgcttgaaccagggaggtagaggttgcagtgagccgagatcacgccattgcactccagcctggcaacagagcgagactctgtctcaaaaaaaaagagagaatactttctaatacctcagctgtcacaagtgatgcctcctgtactgtgagccagaggggtcagcccaaagggaagggaggccttatcgaaaagggcagatgcctgaggccccctctgttggttgcaccttggggccaggattctgactgtagcactcaatgtcttatttgatgtttctgtttcgttcatattatgaattactaggtcatggtttagtcttaataagattcctcatttgtattaataaaggtcagcttatttgcacgtggactgtagttggatttttcccatttctgtgtgtatgcattcccagttagagctccttctgtaagaagactgaagcttaagtaagacacagcctgggtttatgactggtgtcttaatttgttttctgctgctttagcagaatatcaagctggataatgaacagaaatttattaggctcttggttctggaggttagggaagtccaagagcatggcgatggcatctcgtgagggcttttgggctctatcctcttgtgatggatggtggaagggcagcgagtgcgtcagagagaaagggggctgaacttgtcctttttatcaggaacccactttcataataaagccgtcacctattaaatgtcccacctctcagtgctgttaaaatgacaaattttaacgtgagctttggagaggacatatgaaaacatattagctggtcatgctggagaagttggggatcagaacatcaaaatatggcaaggcgtggtaactcatgccggtaatacccgcactttgggaggccgaggcaggtggatcacctgaggtcaggagttcgagaccagcctggccagcatggcaaaaccccatctctactaaaaatacaaaaattagctgggcgtggtggtgcacgcctgtagtcccagctactagggagactgaggcaggagaaatgcttgaacccaggaggcggaggttgcagtgagccgagatctcaccactgcactccagcgtaggcaacagagcaagactctgtcttagaaaaaaaaaagaacatcagaatgtgaaaaaacctgaaatgaatttagaagtttaaaacagtttcttacaacaaaaaataatagcttttaagtcaaaatatgtaatgtaggaaatgtcggaattcagtgaaaatgagtgacctttacataggcttagctgttcactggtagcagcaaaaataggcccttgagtccaagctagacttgaattctgattcttccagactttgtgcagtgaagtcagatgagggtaacaggacctagcgtgtgatacccttagcactcttactactcttgctaagtaattatgtgattagagtttggaatgaaacttccagaaatgttataattgaggcttggcgcggtggcttatgcctgtaatcccagcacttcgggaggctgaggtgggtggatcatgaggtcaggagttcgagaccagcctggtcaccatggtgaaaccttgtctctactaaaaatacaaaaattagctgggcgtggtggtagatgcctgtaatcccagctactcggaaggctgaggcaggagaatcgcttgaaacggaggttgcagtgagccgaggtcgcgccactgcactctagcctgggcaacaagagtgaaactctgtccccctccaaaaaataaataaaaataaaatatataattgttacctatcaaaattctgagggaaagccaggcgtggtggctcacacctataatcccagcactttgggaggccgaggcgggtggatcaactgaaatcaggagttcaagaccagcctggctaacgtgatgaaaccccgtctctactaaaaatagaaaaattagccaggtgtggtgacacacacctgtaatcccagctcttcggaaggctgaggcaggagaatcgcttgaacctgggaggcagaggttgcagtgagccaagatcatgccattgcactccagcctgggcgatgaaagtgaaactctgtctcaaaagacgacaacgataaaaaaaacaaagttctgcgggaagaagacaactagagacatgctgttggccacacatagtgctcttggggctgcttaagtctgtggagttctggggaagaaggtaagagcgatggctttgcaggagctctagtgattgtcgctacttcagttgatgacatgagattgttctttatttttcttcagctggttttcccatgggctatgcagcagcagctcctgcctattctcctaacatgtatcctggagcgaatcctaccttccaaacaggtatgtgctgggtggtaaaatgctttgtacgtacagctgggagagaaaggtgaaggggtggattttgagaggggtgggtatagaattaggacttggttgagtcgatttctcaagttcattaagttagcctgttgataagtgcaacaaaagcttaattcttactgcactgaagctttatatactgtgtttctcatgtcctcccacaaggcaaatctgtaatcactaggttgttaactctgccagagcatctgttcatgaaatagtatcacctactagaaattgaagaatttcttgccatgccaacaggtggaatttccatgttaatgtttttagagataatttttggttagactactttagcactctgataatattttttaaaaaagtattattttccatgtaatgtatagatgaatatttttagattttggaaatcactgttaatattaaaagtggaattggtttgggtctgaatcttgaggagattggttatttagtgggatttcctgctaggagcctgcactctctggtgttggttccttttggacttttttcacccacacggggctttgcctttctgccgcagcagtggtggtgcacactctgatctgaggctgtggtttggccttaatcctgggactgctggggcaactttatccctcaacagtagcttcacacagttaactttgacagaggaggagacaacagcagtgtcctttccccagattcttcctgttttgttaatcataaaattctgcctttatattctgtccttacatccatctcttcgtttccatttccacttccactatgaccctatatgaccacccttgttcagaccgtagttcacaccctgagaaaaacgttcttgacttggtcttcctgctcccaagctttctttccccgggttagtgttcttcccatttaaaccagagcgatgctcccagatgaatttttctcagtggtttcccatgactgtgagacacagttatgcctagagtctcgactttcagtccctagctgtttgccatattggcccattttttccctttagagtggttttccttttgtgttttgccttgaaagaaccatccatctcgtagtgtatattagcagttcattcctttttattgttaggtagtattttgttgtatggaaataaatacttcagtttgcttatccatttaccatgtgatgaacatttgggttatttgcaattttgggctattacaaatgaaaatgctattaatatttatatgcaggttattgtgtgaacatacactttgatttctcttgagtaaataaatacagaggatttgagtggctggttattatggcaagtgtatatttaactttgtgagaaactgccaaactgtcttccaaagtggtggtaccattttacattcctaccagcagtgtttgtgagttgtcgttcctccacatccttaacaacacttggtgtggtcagtctttttaattctagccattctagtgaatgtgtagcagtatcttttcatgtgcgtatttgccttctgtatgtctttggtgaagaatttgcttttactgtatgtcagttattgttttcttatcgttgagtttttgagagttcttatcagatatatgcgtgttttctcccagtctgtggctttttcattcttttaacaacgtcttttaaagagcaggggttttaaaagtttaggctgggcgcggtggctcacgtctgtaatcccagcaatttgggaggctgaggcgggtggatcatgaggtcaggagttcgagaccagcctggccaacgtggtgaaaccccgtctctactaaaaatacaaaaattagctgggcttggaggcgcactccggtaatcccggctactagggaggctgaggcaggagaatcacttgaacccaggagacagaggttgcagtgagccgagatcgtgccatagcattccagcctgggcgacagggtgagactccgtctcaaccaaaaaaaaaaaagtttgatgagggttagtcgttttatggatcatgcttttggtaccatacttaataaacctgtgtaacttggctgggcgcagtggctcacgcctgtcgtcccagcactttgggaggccggggtgggtggatcatgaggtcaggagatcgagaccatcctggctaacgcggtgaaaccccctctctactaaaaatacaaaaaattagctggtcatggtggcgggctcctgtagtcccagctactccagaggctgaggcaggagaatggccagaacctggaaggcggagcttgcagtgagccgagattgcgccactgcactccagcctgagcgacagagcaggactccgtccccaaaaaaaaaaacaaaagagaaagaaacctgtgtaacctaacttcacaaagattttcttcttttttcttgtagaagttttacacttgtaggttttacatttatgtctgtgacccatttgcagttaatttttgtgtatgatggtaggaatggattgaagtttatatctttggcatacgtatcaatgtggcatgtgatgatcatgccgtagaccaccataacgtaagttactcttctaggattttcagaggtagcccacttttactcatttcttcatggagcacaaatcagtgtgaaaatgtacttaaaactttcaacttttttattttacaagaagaaccttgagttaatttcaggctgagagctgttcttgccaaaaatgtgcagcactgcctagcagaggcagggtggagactgagtgctgctgacaccttccccccttgggtgcctgtgggggccaccctgtggaacatgggccacccatctcattattattttgagacagggtcttgctctgtcgcccaggctgcagtgcagtggtgcaatcacgcctcactgcagcctcgacttttcaggctcaagcaatgctcccacctcagcctcccgagtagctgggattacaggtgcacaccaccacactcggctaatttttctatttttttgtagagatgggtttcactatgttgtctaggctggtcgcaaactcctgggcttaagtgatcctcctgcctcagccttccaaagtgctgggattatagccgtgagctaccatgcccagcttgtcacccatcttctcgaacatctctcctttctcatagggaggtaaggcctgtgttgtcccttttccaagactgctctcaaattgttcctgtaatccagaagctgggacaggcaggtagcaactgcagctgcccaaacggcctaccttgtttagaggggcatctgctgacgggtgccaggcagttgttaggtgccagactgctggctcaccagtgccagatcttctggtcttgtaggagaagctgtgaaattggtgaatgaaaaatataaggcagccgggcacggtggttttcattcctgtaatcctagcactttgggttgccaaggtgggcagatcacttgaggccaggaattcaagaccagcctggccaatacagtgagaccccatctctactaaaaatacaaaaatgagccgagtgtggtggcacacacttgtagtcccagctgttcaggaggctgaggcaggagaatcacttgaacctgggaggcagaggttgcagtgagccaaaatcgcaccactgcactgcagcctgtgtgacagagcgagactctgtctcaaaaaaagaaaaaagaaaaagtctttctgatgtcccacaagtgctgttgtccatctaacctgagtctggaccacagctgtgtgcccatctttttctggtatcctctctgttttcatgtcttgggtgtttgtttttaagagatgggggtcttgtggtttcacccagggtaaagtccagtggtacagttacagcctttttctgctgagttcaagggattttcccaacgcagcatcccaaagcgttgggattacaggcataaaccaccacacccagcttcatgttttgaattttataactcccttttcagtgagcctttccctttttctgatgagcaagccaaaattatcagtataaaaaatttaaaagagaagtttttctcccttcctgctgctttttctctgtctttctctgaaggtgtgtggaggtgggtgtgtatgtgtgtgtgtgtgtgtgagtgtgataggatctcactttgttgcctaggctggagtgcagtggcatgaacttggctcactgccaagcaatcctgcctcagcttcccaagtacctggaaccttaggcacaagtcaccacacctagattattttttaaaaatttttgtagagatggggtctcactgtattgcccaagctggtttcaaattcctgagcacaagcagtcctctcatcttgacctctcaaagtgttgggattacaggagtgagccactacacccagcccctgctgctttcttgatcttgccgttcagtttgcacccaatgctgacttgtggtttcaacgctgtatatgcggagtctgacttccagagcacttttgtaatccaaatgccacgtatttcttagccctcttccaattgtgatataagaggattccgagacccttgtgatgagatgtcttttgctgaagaattctgtttttcagaatctgggaatggagaaggtgtcattcattttgtcctcctgaacaaggctgtgtatgcacacatcaagagtggtggtgatatggtttggctgtgtccccacccaaatctcatcttgaattgtagctcctgtaatccccacatgtcactggagggacctggtgggaggtaattgaatcatgggggtggatttttcctgtgctgttcccatgatagtgaataagtctcacgagatctgatggttttataaagggcagttcccctgcacacgtttgctcttcctttgccttccaccatgattgtgaggcctccccagccatgtgtaactgtgagtccattaaacctctttcctttataaattacccagtctcgggtatttctttattagtagtatgagaatgaactaatacaactgggctgtccatttttggaatcagagctttgaattgtggagttagctagatgtggattatactcctgactgtgtcactccctgggaaagttgtttaacttcacccttggcattggaataatgaataaataactccttgatttcttatgggaggatttcagccccaagcctacgatcaggcatagatgtcagctgggccagcacattgaggcctctgttctggtcctacttagagtcacaagtacctgtaactaatattggtaatgatgatctgaaattgtcaaaacagtctgttctttgtaataagctctacacacaaggttgtttagatatttattacattagcacttatttttaaaaggtacaaatttaggccgggtgcaatggctcatgcctgtaatcccagcactttgggaggccgaggcggacggatcacgaggtcaggagatcgagaccatcctggctaacacggtgaaaccccgtctctactaaaaatacagaaaattagccgggtgtggtggtgggcgcctgtagtcccagctactcgggaggttgaggcagaagaatggcatgaacctgggaggcggagcttgcagtgagtgagtcgagatcgagatcgcaccactgcactccagcctgggcgacagagcgagactccactcagtctcaaaaaaaaaaaaaaaaagatacaaatgttgcaaagagtgatggagtgatgaaatagcttccatggtcattggtgtgtatggctgggtggagggtaaattggagaaacttctttggagggcagtttggtagtgtatgttagaagcttaaaaatgaaccctttcgacccacttctaggaatgtattctaagggcaataattggatgtgcaaacatttatgtacaggtacacatgcatttaattacgaagtgatggtttaattaaactgtttatcacacagtgtttatctggttttggtacttgtttatggagaatatttaatgataagtgaaaatggtttacagtagagctttcttttcttttttttttttttctttttttcttttttttttgagctggagtctcgctctgttgcccaggctggagtgcagtagtgcgatctcagctcactgcaagccttgccacctgggttcaagcgattctcctgcctcagcctcctgagaagctggaattacaggcgctctccaccacgccggctaatttttgtattgttagtagagacggggtttctccatgtgtgtcaggctggtcttgaactcctgacctcaggcgatcccgcccacctaagcctcccaaagtgctgggattacagacatgagcccccatgcccggcgtttcttttctttttgaactcagaattatagccataaaatgaaacccttggtttgtttaaaaattaaacttcatgcatggcagccgagggggagagaatagcctttggaatattaatagtctgtgaggtcttgtggagcctgtttctttccctcttaaaggtttacattcatagaggtaaaagattgcagtgctccacaaggcttttaaaaatgaacaatagcagttgcctgctcccttgtgggagcccccacatttcactccccatgggcaaactccagctctttaactctttaaagctgcttttgctcgtgccttccgtgcttccacatgacatgtttctgctgttccctgcttctttttttgtttgtttttgtaaagtggcactgctttactgacttctcactttgctgccccgaccttccttcacagttctattattgtggccgcatcagcactgttcacggctgtgtcttctgtgcggcgatcctgttgtcctgtgccctgttgcagtttcttctgcatctactgcggtgtccctggaattaatactgtacttatctggtgtctttgattaggtttctgtgaccatagcattaattaaacctccagctacccccgatgtgttgagatctcttcttagcaatttcagatacttgtgtgttgttttcctggtgatctctgaagccctcccttcctctctcttatctggactggttgtcctctgggccagaccctgggggggtcactgttctcatcatcccagggcttgcttttgcctttcccttctgcctgagttcttttcttttttcctcgtttactctggttttggcgggggattttcttcagtaaccacctgggagagtatggaaaagtcacaattttgagattttccatgtctgaaaacattttattctgcacgcacacttcgttgatggttgtctggatacagaattctagagagcagttatttccccccagaatattcgggtgtttgctcaatggctttccagcttccaccactgttgctgagaattggggtaccttgttggtgcctgattgagtgtaaccttggtttttctttgctattctgtaggatttttgcctccagtgttcagaaatttcatgatgctgtgttttggcacagatcttctctcctcacatgtacttcaggcttctgaattttttaaattttctaaataaatgtctttttttactcaaaaaattattataaaaaaatccgcgtggtacacagtacttttgaaaaaaaaaatgacctatttaaataaaaagtttctggttcccgaacagttggcattctaaaatcagtgaccctgtgcatgtcctcttccctgagggcacagccagggtcactcacaggtctggtgaagtggaaggagggagcgtctgttgtctgcgccgcctgggttgcatcagtacagatgggcttcctggggagggagaatctgaaaagctgttgttttggaaagacctagcactgaatgaatttgatatttcagggaggcagtgtatatttttgggtacgatgaggtaattgtgtgtatttatttaaagtttgtgaagttcctgttgagttactatggagggatatggtggacttagtgctgaatgaaaaaaaaaaggtggcaagcacacactgtctatttttaattaaaaaaatttttttacttagtgttttaaatttttaaaattattattattagtttttagagacagggtcttgctcagtcgcccaggctggagtgtggttgcacaatcatagctcactgtaacccagaattgctgtgctcaatgagcgatcctcctgccttggcctcctaaatcgctgagactacaggtacaccccaccatgccttgctaatttttattttgtagagacaaggtctcgctatgctgctcaggccagtctcagaactcttggaatcaagttatcctcccatcttggccttctaaagtgttgggattacaggtgtgcaccatagctcttggccccacactaagtcttaaattgatagggagacctgtttgccttacttgaaatgcacttgtcttaagtgctggctagaaaatggtgtaatattcatgcctaaaccaaagaccaaaagttttctggtgagcattagaacgtagcctcacagtcataagaataaacagtaagataatatatattaaaaaccattgttgtgattagaaatcgttggtgacttttttcaacattttattgtaaaaaatttcagatgtcacagaaaagttgcagaaatttcacagtgatcacctatatatggactgctaagattctacgattaaattttttaaatttaaaaaatttcagatgtcacagaaaagttgcagaaacttcacagtgatcacctatatatggactgctaagattctacgattaaactttttaacgtcaacttttacaagtaacattttacttgtatcacatacacattactccatccatccttcagtccatcttattttttgatgggtttcatttcagagtaagttgtggtcctcagtatatcttacctcaataacttgagcatgcacatcattatttgtttagttcctttttggttttgtttttaagtaaaatgtgcatgtgtgaaatgcacaagtttagcatcccatgcattgcatgctgagttgcatatgcatgcttccttggagcagtcgctccttttgcttcagcaacgcctacctgtaaagtaggtgttgtaagacaccttgggtaggccggacgcggcggctcatacctgtaatcccagcactttgggaggccgaggtgggtggatcacttgagatcaggacttcgagaccagcctggccaacataggtgaatccagtctctactaaaaatacaaaaattagctaagcatggtggtgcacgcttgtaatcccagctactcgggaggctgaggtagaagaatcgcttgaacccgggaggcagaggttgcagtgagctgagatagcaccgctgcactccaacctgggcaacagagcgagactccgtctcaaaacaaaaacaaaaaagacaccttgggtgattggattgggaaacctagggctagctgcagggatttctgcagtgggaggcttccagtagaagaaaaggaagacatcgtaggtgggcccctcgactgtgtatcctaaggaaatgaggcatgaaaaaggacttcaccttttttcagtggctgtggtgggccagatgagcacttgtggctgagagactccctctttggagagaggtgttctcagattttcctcactttggttttatactctgtattagaggtttgtttgggttggcagcttgcatcttctcttcactctgagctctttctgcagtttgaagagtgataaaaaggtcaaggactttcttattagcaatgttgatggatgtgggtcgtgggtttattgcttgttttgacttcttttaacagcttttcctttttcttctcattctttctttagtgaatcagtttatcagatagaactgtaacttcttgttgcacattggctgtatatattgaacatgtccagtggcatagtttaactttttttccagcctatgcctaactgccaggccatcttccagatcagcatctttcagactgctatagaatccttcctgctgatggcctttttaaaggcttggcaaaattttgtattcatcttcttcttcttttttttttttttcgagacagggtctccctctgtcgcccaggctggagtgcattgccgcagtctctgctcactgcaacctccacctcccaggttcagctgattctcccacctcagcttcccgagtggctgggactacagtcgtgtggccaccaagcctggctaacttttgtatttttagtagcgatggggtttcaccgtgttggccaggctggtttcaaattcctgacctcaggtgatccgcctgcctcagcctcccaaagtgctgggattacaggcatgagccactgcgcctgactataattcatcttctaggggtgcgtttgggtgtggtgatccgtgggccctttcagctaacttccttgcttgttcttttacctcatgcatgactgttgtttccatggagattttctggctagcgtacacgctctcagttgtgtgtcagcatctgaaagtactgtatacttttcaccttgcttatttttactttttttttttttttaaattttggaggcgaggttttgccagcttggctaggctcgtctcaactcctgggctcatgtgatctgcccaccttggcctcccaaagtgctgggatgacaggcgtgagccaccacgcccggccttccaccttattaaaaaaattgggccaggcgcggtggctcacgcctgtcatcccagcactttgggaggccaaggtgggtggatcacaaggtcaggagatcaagaccatcctggctaacacggtgaaaccccgtctctaccaaaaaaaaaaaaaattagccaggcttggtggtgggcgcctgtagtcccagctactcaggagactgaggcaggagaatggcgtgaacccgggaggcggagtttgcagtgagctgagattgcgccactgcactccagcctaggcaactgagcgagactccgtctcaaaaaaaaaaaattacgtatacagaaaagttgagcggacaatacagtggatgtccatagtacccaccacttagattccccagtgatctttccccatatttaccttatgtaaggatgagtgttgtgtggtttttcttttattcttgtggaatcaattcagaatcctttgtgtcttgtccaatggacttgagtgtagccctccctaacatgagtgaggtgtgcttttgcctgtccacacttagaaacagcaggtctctaattttaaaagtagctcctatttacatttgcccagttaccccctaagttttaaaaaacgtttggaatcagaataatgtactcagcatcacatagtgaattttttataaagttgaatttatgtctcttatctctttcaatctgtagcagtcttccttgtattttttaatactttgacttcaaaagagtgattaggaaacgtttcagatatttacagaaatacatgggaacataattcccactcacacattgccttgctttagcacaagtacatgggaatattcctactcacggccgggcgcggtggctcacgcttgtaatcccagcactttgggaggccaaggcaggcggatcacgaggttgggagttcgacaccagcctggccaatatggtgaaaccccatctctactaaaaatacaaaaattagctgggtgtggtggtgcacgcctgtagtcccagctacttgagaggctgaggcagaagaatctcttaaacctgggaggtggaggttgcagtgagccaagatggtgtcagcactccagcctgggtgacagagcgagacagcgagactccatccaaaaaaaaaaattcctgctcacacatcacctggcttaagcacaagtacatgggaatatacttcccacctacacatcacctggctttagcagttaccaccttatggctgatctttttcatctgggcccctgccactttcctctgtattattttgaagcaaatctcagacattatattcatcagctttttaaatattatctttaaaagataaattagaactgtgtcattgtcacacctaaaaattttttttatcactactgagattgtaatcagtgttcatatttccagttatctgtcatgaatgtttttaattgtatgaagaaagggaaccctgtgggtttgtttgtttaaactgttggaagtttggaatgagattcccaactttgaagtctagcatctgttctcaggatgtgacacacagagggtagctctatgttttgacatttttataaaaaaaatatcatcttggtcagataagagtttggtgactcctgggaggatctcttttcaggctagtggaaatatgaggcagaaaactgggattaagccgtacagtggggatcccattcggcagtgtctcctttaggtacagctgaaggtacccgctggtgtctggctgctgcatggtggtgggaaatgaaagaggtggtgtggctggggagaagggagctatccaagatgacccttgacgtccctcatccccacagtttctttcatttgagacatccttgccccacctgcccctctctgagctgactcctcattgcttgccaagactgcataaaatgctgctatgttggtggtttgttttcctgtgatttcttttccccctgaagccaagcaccttatggagagggctggatctgtcctgatcatctccgctgtgacagggcatggccccatgttgatggtgaatagcctctctgtgttggtacaatgccccagtcaccattcactagtcacatgtgtgcccgccacacaccatgcttcctttttgcatttcttccctgagttagctagtcacttagggggaattggactgtcccgggtctcctgggagtatcagtacatggccggacacactaccttttcctttataattctttgatggcattcacactacctttttctttataattaaagaaaatgttatacaacctcgttgtggcgtaattggcatacaactaagtgtacagatttaaagcttcagtttgatgagttttaacctgtgtacacctgtgaagctttccttttcactttccttttttagccttcttaaagacgaggagatgagcagccagagaaggaaactctgtaactgctcttgtcttgaaacttgcttttccaaatcctaatggaaaatctgcgtattctgctttcctttggccaagcaccagtattaaaaagttgttgtattcaaattttggcagtgtttctatttacggttaacatagcggtgagcgaatttcaaaatacagggagccctggaggaatcttttctttcttcaaatggagactagctgaggttgggagttgcttggtttgggtagaagggtcaggactctggatgcagacaaatctgggtgtgagcacccgctttgctgcataggacaggaccacctgttgtttggtctgctgcagatctcagccacagcacctcccaccgtgagaccatgaaagggcatgcaggggagtatgagaaggctgatgttgaaggcttcgtgttgcttaattgatacagtgtgcagtatttaggtgaaaaagcccagacttcaccactgtgcaatatatccatgtcacagaattgcactggcaccccaaacaaaaggccccagactagtgaatttcccagggggccaatcattctctttccctttcaaattaaaacaaaatatatggaccaggcacatatatatatacaggctcacacctgtaatcctactactttgggaggctgaggcaggaggatcatttgaggccaggagttccagactatcctggccaacatggcaaaatcccgtctatactaaaaattacaaaaattagctggatgtggtggcacatgcctgcaatcccagctactcgggtggctggggcatgagaattgcttgaacccaggaggcggaggctgcagtgagctgagattgcaccactacactccagcctagggaatagagcaagactccatctcaaaaaataaaaataaaaaaaaaatacacacacgtacatattgctaacagcccagttgtgtaaaattttttaaaaattaactttaattattattactatttttctgagacagcgtcttactttgtcgcccaggcagaatgcagaggcataattacagctcactgcagcgttgacctccggctcaggtgatccaaaattctttatactcagctcattttttcaaacttgaggtataatttatgcacaaaacacccacatattaagtgctcaactgggtgggttttgacagttgtacatgcccatggaaccaccactccaaataaaacatggaatactttgatcatcccagaacgctttcttcgccctctcccctctgatttccgtcaccgtaggtaaatttctttgttgttagggaataaacgggatcattgctctatgtgctgttctgtttccagcttctttggaaagctcagcatgttgtgagattcatccatgttttttccttttgattgctgagtaatgtttatagagacatatcatgatttatcctttctccagttgatgaagatttggattagttcccatttttggctactaggaataagattgaacactttttacaagtctttcgtggacctgtgttttcatttttctaggggaagttttgggagtggattgctggatgttgcgggatgtgtctctggcttgcaaagttgcactgtctgacacggacagtgtgtgagtgctccacccctcctgctctcacccatgggaatgtgagatgccataagcacttgtatggaggtctgatttacatattataagttaatccttctcagtgtacagtttggtatgtttggacagtcatacacagctgtatgaccgtcaccacatttgagtgaatgcactctttggaaaggttctcgcatgcccctctggcccctggcaccattgctggggttttgatgactctggattaggttggtctttcctagagcttctgtcagtacatgcatccagcatgtgtccttgtatctggctcctttgacatggtgtggctttgtgattcattcatgtgcttgtatggatcagcagtttgtccctttggcttgctcagtaggatttgtatggatgcaccacagtgtgtttacccatttgtctcctggtgggcatctgggccattgccagcttttgatcattgtgaatatagctgctgtgaacatagctgtccagagaccctctccctcccctgagaccaaacccctcttctctgttggggtcaggaagggacacctaactgcttattcagcaaactcaaccactctactagatggggtctctttatctgcttctggagacgggttggtggccagcagtttgcagggctttggggaacggctctcttggtgccagctgctcctcgctgctggctgagtgccttcttctcgagtctgctcaatcatcctccacttcagcttgccaggcttcaacatgctgtcttctcttccattcttggtgagttttatgtcttttttctcttaatctgctttattgtcattttcatgtcattttgtgtggggacaaaagcaagtatgtgtgttcagctttctcccttaacccagagggctttttaccatagagtgcttagccagtcctggtgctgggcaagtttctcctgtttttgctgtaacaaacaacactatgatgagcatgcttacagttaagtctctgtgtgtgtatagatccatgtgtattgctttaagacagacttctagaagtggaattgtgggattaaaaggcatatatactttagatgccaagtttagccccaggaatgccataccaatttaaattccagcaggacaagacagtttttatttcctgtccttgtgtgagcattccatctgtagaacgttctcttttggtattttttcctcctccccaacaccctgccaccacacacacgtgcatgcacacacgtacacaaagtaagaatgaagtcagatcttagtggaggagagtgggggcggcagtggcagcaggtctggcgagttgcgtggggctgacacgcagcttagctcctccctgcctgtgtcctctccctgcgcctggaccggcttgggtgaactcaggccattgccttctttgttccaggttacactcctggcacaccttacaaagtgtcctgttcccccaccagcggggctgtgccaccgtactcctcctccccgaacccctaccagactgccgtgtaccctgtgcgaagtgcctacccccagcagagcccgtatgcacaggtatgcttgggtacacactgctgtgtgggaaggggtgataccacctgggcgttcatcctttggccctgggaccctgtgtcagttgtctctcttctccccacagcaaggcacgtactacacacagccgctgtatgcagcacctcctcacgtcatccaccacaccacggtggtgcagcccaacggcatgcctgcaacggtgtaccctgctcccatcccccctcctagaggcaacggggtcaccatgggcatggtggctgggaccaccatggccatgtcagcaggtaagtcctcgttcctgcggtgtctgtcctatggtgtaccctagagctgggggaggggagagctcacgaatcctctgacccttggctctaggttttcatagctgtagttgtgtggaaggacagaaaattctttggggaagaaacagcaggttatcttttattttgcctacctgagtgaccccttgtggaggcctctctgaatctgatggactcgctttgttggtgaactgagccatttggcaatgcaggatgtgccccctctcctcccaccccctatgaccatgtaagacttgagtagaaggaggacactttgtgtaccggggttgctctggccttcttcctttcccttgaggggagcttgtctttgcaggtcagttgtcttcatcgggatgttttcatgcatctaggagagctggtcttgcgttgatagaagaaacagctgcctgtagaaatcctttggcattcatctaccgtactttactttgcaaggcctcctctaaggaaaataaaccatggaaagatgaggcccctggctgggatgggcacatctccgcggaagccctgggggtttgatctgatgtctagggattgggtgaccacccaatctgtatgaccacccatgtggattcacctcctggtctctgggtcaatatgaccacctttaggtcatgcccacacaaaagcgtactgttccctccttgtttttctggacttgacttcagtgtaaggaaattatgccagagagaaaagcattccgggttattatgtgtgcttcaatgtagactctgatttggttttccccatacttatctgtcaaggaacaggaaactgggcatagacagaaactgctggtttgaggcacagggagggagggcagcaggcaccaggttgggtgccactgtgttggaggtggtgctggtccataaagggactcaagtagttgttgagtttctgcagttgtaggaaaaatagatttctcttaaagaactcagaagctcatgtagtttagaatcctcatttcttttttttttttttaattttaaaatttttaatatttttttttaagacagggtctcatcctgtcagccaagatggagtgcagtggtgtgatctcagcttactgcaacctctgcctcctaggttcaagtgattttcccacctcatccttcccagtagctgggactacaggcgcctgccaccatgcctgcctaatatttttttgtaccttttggtagagatgggatttcaccatgttggccaggctggtctcgaactcctgacctcaggtgatccacctgcctcggcctcccagagtgctgggcttacaggcgtgagtcactgttgccagcctcttgttttttatttatttgtttttaccatcttaacttttttttgttgagacagggtcttgcccttttgcccaggcttgagtgcagtggtgcgatcacagttcactgtagtctggaactcatgggctcaagccatcctcccaccttagcttcctgagtagctgggactataagtatgctaccacacctggctaattttaaaactttttgtagagctgggatctcactatgttgcccaggcgcatctcaagctcctgaacttaagctatcctcccaccccagcctcccagagtgttgggattacagacatgagcccctgtgcccagcccatcttaaccctttttaagtacggttcagtagtgttaagtatattcacattgttgtgaaacagagctccagaacgtctttatcctgcaaatctgaactcctgtactcattaacgctaattccctgttctactttctttctgtctctgaatttgactactccaggtacttcatctaagtggaatcattaagtatttgtcttttagtgactggcttctttctttcagaattatgttcttaaggttcatctatattgtagcatgtgtcagaatctccttccttgttaaggctgaagcatactcatttgtttatcatctgacctataaaaattattgggtgtgctttatgaaggggacacacaaaaggcttttacgaacatattgtctgtggagcttgctgtgtggagacaacttttgggtgtgggggattatctaatcagagttctgacagtatctgggtcaagactatccctcttcctgtataccctcctccttgcaaagaggccaggcttgtgtgcgtatcaggcagtgtggagctgtgcaggaggtcagcctcatgtcatgtgctgctctttcttccaggtaccctgctgactgctcactccccaactcctgtcgccccccacccggtcactgtgcccacgtaccgggccccaggaacgcccacttacagctatgtgccccctcagtggtgatcacctgcaaatgtaagtgaccagggaaggctgggctagcctttgatgaaagggcatttccatgggacagtggcaaatttaccacatatttaagcactaacgaggaaagtgtgcctgaccctggatccagaggcaatgtagtgtttaaattttttgtttttattgagacattacagagtagaaggaaggaaggaaccattgaatacctactgttgacactgtccatcttgagccttgcctggaatgtgctctaaccccccacctgcctgctacaggaaatagggctccagttgcaattgggggtctctaggaaggaagtgagaaccaggtccagcagttttgcccattgctgccctttccgaccctgctgggcctcatcctacttgagattttggaatagcggtgccggaagagctctgtgtgactgagtgtctgtcttcctttctgcaggtttgaggacggagctgtgcagtcacattattggggattccacagctggtgctgcaggccttgcgcctccaaccaggactttcttcttaatgctctcgacacttagctaaacacgactatatcccggcccagcaggccccagcgccgttagtctccagctgactctgtgggttggtcttaaagcaaattctgttttgtggactgcctggcaattttttagctaactgtaatgataaaaagggagtattaatctattctgaatcatatctagttgaatgcatgtttaaaaaaacaaacacaaaaagcttgctcaatctacctgcagtgactgatgcaaaaccatcatatgcaaaatccaaaggaatggaaacgtattttacaacttgtatcactaatgcactgttgtaatgtatgcaaagtcttacagttataagtgttaaagtgaatttcttcatagagcatctgaaatatcttagatgattcttcaaccttttggggttgatgtgggttgccagttagggatgtggacattttagttttcagcgacctgtttctttggcactgactgtcctgggagggagttgcgaggtttgggagagagtagggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttatatgtctttattggaaaagtcctatgtaaaactaaattattttcctgggatggaagaaatgtgaaagagaaacagccatgcttgcaggaggtattgtcctctgctttatttagcttagaaaatcattcctttttttttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaa

SEQ ID NO: 37602 - DNA, 13901 bp, Homo sapiens
ctcgccccggcgctccctagcccggcgcggcccggcagcgagagcggcgccatggaggccaccggggtgctgccgttcgtgcgtggcgtggacctcagcggcaacgacttcaaggtgagccgggccgggcgcgtgccgggcctccctgcaggccttctcttccgcccggcccgcttggcctccgcttcctgtcccgctcggctccaggccctgcgtgtcccagggactgcggccggggcggggtggggctctcccctggccaggaatggacctccgaggcctccgcccagtgcctgtacggggagaccgaggctgggcaggccggggacggacgcttgggctcggagtcccgccgggggcccggccgggagcccccaccccgcgtccgtgttctcggtctaggctggatggtggcctggggatcgggcgagcctccccgcccctctgaggtcacacgcccaagccaggccctgactcagggatggctgcccggctgcccaggggcgggtgtggagccgactcatcactgccctctccccgccaccgccacccgccatactgtgtgatcctgggcctctcagatcacttcccctctcagagcctaggctttctcagccggtgaaggggcttaaaagtctcctccttggacgcaaggagtatagtgagatttgttggtgtggagagtgtgtcaggccggtgtgccaggtgctgggtggcagttgtctgagcagctgctggactgagagaaaagggaccggagcccagccctccgcagccagtgggtggggcggcggggtggttccaggactcaagaatgagacaggcattgcctgaccaaaggggaagcagagaaagagagggagggagagctggctggagggtcagcctcaccttcagggtgggtgactggcagggtcggcctgggttgttggtctggggctggggccgaggaggcaggtttttcctgcgtttacctgcctgtgtacacacctttgaccccaagtacaagtggctacaccacttttccctgaccccatccccaccaccctaacctggggtccccgttcctctttgctgaactgggagagtccgagtcaccagctgggaatgtggcgctagggggaaaggaatatcagccgcaggcactgaaggcacctactgccccagacttggtgccacaagggctggaggtgccgaggtgggcgttcacacaccaggggagtgcagtgatgctggcctgccctgcagggtggggagccacggtctccgcaagcaagggtttgaccctggccgtgagttgccagtgtgctgatggcaggatgagggcacaggtggcgcctttgcaaaggcttggaagggggatcccccaccccaggcagccagtcagagtgtggaatgctaggtgaaggaatttgagccgagctaaccacagagccggatgctgggctttcacctgaaacaagccagttttgtcctggccctcctggggcccagaatccagtaggagagacaaatcttaggccaacacttttgtcacgggggggcttaaaattcccattctatgggtgaagaaattgaggcacaatgatgaaatgacttgtctgtgttctcacagatggtgagagttggttctgtggctccccaaaggctcccatgggctggaggagccatagaaggtggtgagcaggggctctgtgcttcaccttgacatccttcccccagggcggctacttccctgagaatgtcaaggccatgaccagcctgcggtggctgaagctgaaccgcactggcctctgctacctgcccgaggagctggccgccctgcagaagctggtaagggggtttgggcgggcaggggagggtccctgtggatgagccaggtgggcagagcctgtggagaaggcagacaacttctccagagagaggaacaccgacagctatgagcagagctggaagaaagggagtgggcaccctgtccagggaggtgtgcaagaagaggccgggtgagtgagggagggaagctgcaggggtagttgggccagtgtggctgaggccttcctggatggtgcagagttgtggaggcaggcagggactctggacaccccacccaccctgctgagcctgtgctccccattccggcccaggaacacttgtctgtgagccacaacaacctgaccacgcttcatggggagctgtccagcctgccatcgctgcgcgtgagtgctggccgggaggccaccgagcttggggttggggccaaggtccggtcagggacgtgaagcctgggctagacaccaagctgggccagcatttctgcccacctccgtgtcaggctcagaggctcaggtgtcacagaggggccctctcattagaggttacagcagtgccctgtgtaaagtaacccatgtggatcagagaattccatcaggaaaaaggtaaagaaatccaaaatcttaccagccgttatggacaataactacagtaataatagccaagactggctgagcaatgttcccactattctgttaggattttttcatatgctctagccctccactaatgttgcagaagagaaacttggccaccaaggcagattacttgccccaggtcacagagccaggcagtggtagagctggtgttgagtggggtttggccgggagcaccgtgtaccttctacccaagacttgaacgtcccagaacatcaggcccttggccagaccctgtaggcctcaacgagggccatcccatctgaagtcagagccctggagatgtttagggcacagcttctgacttggactctctgagttcaaagctgggctttgccacttcctggtgatgtgactttgtacaaatcgcttctaccttctgggcctcctctgcaagtgcagtggttgggaggggcagcagtgaccccgtgaagcagcagcagggtgccgcacaggcattcagactggagaagtggcggggcagctccggtgactcccgttgtcacttggagtcacgacaccattctctggccctgttccctcatgctcaagctttctgcatgtctgtaaggtatgaggaggtgtcagtcttaagttagggagagaaagcagacttcctctccatccagattctgatttctctgtggtccacttctctccctctgttctgaaaaccctgactcagaccttacccctatctcaccttctggaattaagaagaagagaaatggtttgaacagaaaaggttccctgagggccctgtgctggggctccggggcacatttgagctgggctttgaggcatgaataggagctcactgggaggctaggaagagcgctccaggagagggagctatttgatcaaaggccagaggtgagagagtcctcaggcctggcctctggtgagctgcctgaggaggtgtccctctctagactctgttccttcctgagagtggaagccaggaattatagactcttatggtttattcccaggccatcgtggcccgagccaacagtctgaagaattccggagtccccgatgacatcttcaagctagatgatctctcagtcctggtcagtggctacccactcacctggcccctgtgctagccggaccattcaatccccactcactataaaagtccctggggccattgttatcccattttgcagatgggaaaactgagtcttggagtggataataccttgcctgaggtcacttttggagtcagatccctaacacaggcactcttcctcccaagtccctggctgtctccctttggccctgaagccccctcatctacccccacacccaactcagtgccctgcctgatccccaagcttggcagacgcctggtggggaggagactcccctgacctgggtcttgccccttctacccaggacttgagccacaaccagctgacagagtgcccgcgggagctggagaacgccaagaacatgctggtgctgaacctcagccacaacaggtgccaggccagtggggggcagggggcaggtgggccctgtggggtggctggtgctgactcaggtggctcctgctccccacccgtagcatcgacaccatccccaaccagctcttcatcaacctcactgacctactatacctggacctcagcgagaaccgcctggagagcctgcccccgcagatgcgccgcctggtgcacctgcagacgctcgtgctcaatggaaaccccctgctgcatgcacagctccggtgggcgccccctcggaccgcactcctgcagaagccaccctgaggagtctggccgggccccttcacttcccagggccctaacccttctcccttaggcccagccatccctccgtgcaggcagcacccctcagtgtacaacctcctaagtatcatgtccacctctcagtcctgtcttcccgcttacacaccccgcaaccacccttgggcttgtcccttcaaccagatgtgacctcacacctaccctctgggccctgtgcttttggtcctgccctgccaagccccacccttaacactccctaggtgggccctggccctgaccactcacgtcaccctggcaggcagctcccagcgatgacggccctgcagaccctgcacctgcggagcacccagcgcacccagagcaacctgcccaccagcctggagggtctgagcaacctcgcaggtcaggcagccccaggagcccctctgagctcgggccccctctgggccctcttgcttccttgggtggaaggggttgaaccctgctcttcggaccaatacccagagggaaaaggctggagttatgttacagtgacttttgcgattatgatgatgccttaacactgactttatgcctagaaaactcccccgcaacccccatgtgagggagtttgtccaaatggagaaacttgggcgcacagcagttgtcacttgcctaagccacacagctcagaggtggcagagctggggttcacactagggctggctgccctggcacctggtgtatgggccccagctgatgcaccccaccctgcaccccagacgtggatctgtcctgcaatgacctgacacgggtgcccgagtgtctgtacaccctccccagcctgcgccgcctcaacctcagcagcaaccagatcacggagctgtccctgtgcatagaccagtgggtgcacgtggaaactctgaacctgtcccgaaatcagctcacctcactgcccgtgcgtctgaggccctcagtagggggatgggaggaaggccgtgagcctggccctgacctcccacccctgcccgttccccctccagtcagccatttgcaagctgagcaagctgaagaagctgtacctgaattccaacaagctggactttgacgggctgccctcaggcattggcaagctcaccaacctggaagagttcatggctgccaacaacaacctggagctggtccctgaaagtctctgcaggtgctgggcagggctggggctagcagaggcacttgcagcacagagaaccccgggatcgtagtcagagcccaccttgtggtctgtgcaagtcagacaaaatgaagatgggttaattcaccttttcttttcttttcttttcttttttgtttttgagacagagtctcgctctgtcgcctgggctggaatgtagtggtgcaatctcggctgactgcagcctctgtctcccaggttcaagcgaatctcctgcctcagcctcctgagtagctgggattataggcgtgcgctaccacgcccggctctttttgtatttttagtagagatggggtctcaccatgttggccaggctggtcttgaatgcctgtcctcaaatgatcagcctcccaaagtgctgggattacaggtgtgagccaccacgcccggcccagttaactcacctttgtggatgaagaccacagtcccatgccagccattcccaacttgagcccctgagagcacccttcggggggcactgttagggacaaggccacatgacgtgggaacgcagtgttgcttctctccccttctggagatcacagtgcccgtaacatggtctcttggctctgagaagtccttcaggcagagaatggagacccccgccagttcctctgaccctacctgcctcccctccccaggactaggggttttcttgcccacttccccttgtctgtcacctgcctgaggccctggctggccctgtcttcacaggtgcccaaagctgaggaaacttgtcctgaacaagaaccacctggtgaccctcccagaagccatccatttcctgacggagatcgaggtcaggcatgctgggtttgagagggctcaagagagacaagcaaggggtgtgccctggagcaagggggacccagcagaggcctcctgagggaggtggccagtgccagggtgcccgtggggagaaggtgggccccacctccctgcatccagagtacattccacagtctcatttaagcccccagccagccccagaggtgggtgggaggagaacccagttccctgacctctcagccctggcggctgcagacaagagcaagaaactggattggtgtgtctgggaggtaggacccaggctcagtgccggctctgctcaccctatggggcaggtcctggatgtgcgggagaaccccaacctggtcatgccgcccaagcccgcagaccgtgccgctgagtggtacaacatcgacttctcgctgcagaaccagctgcggctagcgggtgcctctcctgctaccgtggctgcagctgcagctggtgagtggggaaaggtctggcctgggaacgggggctcctctccaggcctcaaatgacacatctgtaaattgggtggcatacagctttctggaccctggtgggtggagttggcccctggttggtcgcatgcccaagggggcagcaggcccagtgagggctcagctgtttgcccctcccctaagcagggagtgggcccaaggaccctatggctcgcaagatgcgactgcggaggcgcaaggattcagcccaggatgaccaggccaagcaggtgctgaagggcatgtcagatgttgcccaggagaagaacaaaaagcaggaggtgagccaggccagggttgggacaaggcagggagccttagcttctgctgaaggccgaccctggccttgaccctggccaagagggacggggggtgctgggcagaaagaacagctgtgcaaaggccctgaggtgtgggtagcaagtaaagactggcctgagtggcttcacagagtcaagccgtgctctgtgactctgcccccaggagagcgcagatgcccgggcccccagcgggaaggtgcggcgttgggaccagggcctggagaagccccgccttgactactccgagttcttcacggaggacgtgggccagctgcccggactgaccatctggcagatagagaacttcgtgcctgtgctggtggaggaagccttccacggcaagttctacgaggctgactgctacattgtgctcaaggtgagggctgggcatgctgttaggggccatgtggcccagtaccttcctctaagatggctcagtccccaactccagagttttgttcagggaggccaggtgggaggtgggcaggctgcaggaggtggtccaggcacaggggcagtacaaagcccctggggctgggaagcctgtgctgttcagagtggcgtctccggggtggccggaagaccaggatgaaagctgatgtggccggtgccttggcttccagacctttctggatgacagcggctccctcaactgggagatctactactggattggcggggaggccacactcgacaagaaagcttgctctgccatccacgctgtcaacttgcgcaactacctgggtgctgagtgccgcactgtccgggaggagatgggcgatgagagcgaggagttcctgcaggtgccagcccgttaaaattgggggtgggcagagtggggttcccagggaactctggtgcaggggcagtgggcccaaggcaggtaggcagaacaggtgggcaggcagggagctggggttaaagggggtggatcaacgatactgtgcgggacctaaggcagaccgcagggtgaggtctaaggtggccaaagcctgggtcagcaaaggagagttctggaacgcggggcagaattcagccgggcaaggataagggtacaggctgggcatgggagctagaccagtgggctgacacaggggagctgagagtagggtggaaggggtgttgccaagagcagtgagaaggcagggccaaaacctgttattaggaggcaaggacacacctggatgccaaggaggtggggccaagggcgggaccagagtccagtcttgaataaattactgagcagtgttagccgccagctggttacacctagacatatgttcgcatgtacacacacgtggagtttatgcacacaccccacccgccccgagttttttttacccacattcacccaggtttccactcttccatgaacccacttgcttgtgtaccctgatatgcgtgcatctaaacatgctgctggcatctttacaaacgtgggtgaacgtgtccatatttttcatacatcccaacaccccgacgtgtgtatgtttatagacacagatgtgtatgttttattttagacagactctcgctttgttgcccaggctggagtgcagtggcacaatcttggctcactgcaacctccgcccccagggttcaagcgattctcctgcctcagcctcccaagtagctgggattacaggcatgtgctaccacgcctagctaatttttgtatttttttagtagtgatggggttttgccatgttggccaggctggtctcgaactcctgaccttaggtgatccacccgccttggcctcccaaagtactaagattacaggcatgagccaccgtgcccagccagatctgttttttttgttgttgtttgtttgtttgtttgtttgttttaagacagagttttgctgttgttgcccaggctggagtacaatggcacaatctcagctcactgcaacctccgcctcccaggttcaaacaattctcctgcctcagcctcccgagtagctgggattacaggcatgcaccaccacgcctggctaatttatgtatttttagtagagacagggtttctccatgttggtcaggctggtctccaactcctgacctcaggtgatccacccacctcagactcctgaagtgctgggattacaggcatcatagatttgtagcactcaattcacctgtatgcaactctgtacccccacctgaggggcagtggttggtgggggagggggcagctcagtgatgaagaaccacaccctcacacacacaggtgtttgacaacgacatctcctacattgagggtggaacagccagtggcttctacactgtggaagacacacactatgtcaccaggtgagggtgtgtgggcagtggggggtatggacctggagtctgctggcaaggggtggaggggagggtgttggggctaagttaggcccttggtgcctacactgagccactcttgccctgcgcccaggatgtatcgtgtgtatgggaaaaagaacatcaagttggagcctgtgcccctcaaggggacctctctggacccaaggtgagccccaacaatgtgaggtgggggtgcttcatcctcagcctcctccccaccagtgggggcaggtgtgggcctcttagaagaggaggccctctagcaattcctgcccacgagcttggcggggggtccctggggcttacccagaaaccccatagtgagggattttttttggtggggtcaggagcatggggtgaccattgccccatgcaccatcacagctccttcctgccccttcttgtccaggtttgttttcctgctggaccgagggctagacatctacgtatggcggggggcccaggccacactgagcagcaccaccaaggccaggtacaaggacaccgtggggtcttttgtgtgaaggaaaggggtgtgagcctcgctgatgactttgcatcctgctctcaggctctttgcagagaaaattaacaagaatgagcggaaagggaaggctgagatcacactgctggtgcagggccaggagctcccagagttctgggaggcactgggtggggagccctctgagatcaagaagcacgtgcctgaagacttctggccgccgcagcccaagctgtacaaggtgagccctgctgctgaggcccaccttggcctcccaagttcacccaccgactgggggaatggactacacaccgatgtagttggctttgggctccatctcgactttggtggggagagggtgccaccttctggacaaggaacagtatgagcaaaggtctggaggctgcttttgagaagtagcctcacggagtctttccaggatggtggggccgtaggggagacagaagcacctagtgccagggctgggaaccttggctcaattatctagattcttgtgaacaggaaagggacacgttaattagaaatggcatgaagggcctggagagggcaggcagggaaaactccatttaaaagcccttctgaaaggatatccctaaaaagaccttgaaggggagggggaaacagaagcagtcagtgagccacgctgcagggcagggctggttccagagcagagggctgtgtgggtgaggttcctgtctccagatcccttccctgccatgctcatccttcctgccaggtgggcctgggcttgggctacctggagctgccacagatcaactacaagctctccgtggaacataagcagcgtcccaaggtggagctgatgccaagaatgcggctggtaagagatgcaggaggagggcgtggggccagatccctccccgttggctgggctttgacctccagactcccggtccgcagctgcagagtctgctggacacgcgctgcgtgtacattctggactgttggtccgacgtgttcatctggctcggccgcaagtccccgcgcctggtgcgcgctgccgccctcaagctgggtcaggagctgtgcgggatgctgcaccggccacgccatgccacggtcagccgcagcctcgagggcaccgaggcgcaggtgcgcttgcagcttcggaggcccctccccaggatccttcgcaccctgacatgccctgacccctgtggcttcactacctccctacagagctgggcccaaacccacctcctctttgctgactctgcccaggccccgccccctctgcaagctgcccctcctattcctacctccgtgtccgaggccccgcctcccaagccccgccctagatctcccttgggtcccgcctcaagcctcgggctacttcctccaactctaatcatgccgcacccctcatggttagttgatggcctccctggcaggtgttcaaggccaagttcaagaattgggacgatgtgttgacggtggactacacacgcaatgcggaggccgtgctgcagagcccgggtctctccgggaaggtgaaacgcgacgccgagaagaaagaccagatgaaggctgacctcactgcgcttttcctgccgcggcagccgcccatgtcgctggccgaggtgggggcagggccgggaccggggcgcgggggggggggtggggggcaggccgagggcggggcctatgcgcagagcgcgctcagacctgccgcggggcgggtccctctcacctgcaggcggagcagctgatggaggagtggaacgaagacctagacggcatggagggtttcgtgctggagggcaagaagtttgcgcggctgccggaagaggagtttggccacttctacacgcaggactgctacgtcttcctctgcaggtaccacctcagcactcccttccccaagtccctcccctggtgctgggggctcgagcccctgctcacaaccttccaacccggcaggtactgggtgcctgtggagtacgaggaggaggaaaagaaggaagacaaggaggagaaggccgagggcaaagaaggcgaggaagcaaccgctgaggcagaggagaagcagccagaggaggacttccagtgcatcgtgtacttctggcagggccgtgaagcctccaatatgggctggctcaccttcaccttcagcctgcaaaagaagttcgagagcctcttccctgggaagctggaggtgtgcctggcagccccgcgagcccgaggccaggcggaggggtgtggtggggctcagacccagcgaaggttaggctcccgaggggcaggtgggggtccagggagctgcccctaacacttccacatccccaggtggtacgcatgacgcagcagcaggagaaccccaagttcctgtcccatttcaagaggaagttcatcatccaccggggcaagaggaaggcggtccagggcgcccaacagcccagcctctaccagatccgcaccaacggcagcgccctctgcacccggtgcctggctgggggaggacgcagtggcgagcaagcgtcagggagccaggcctgaatccttgctgatgccccatcccttccacaggtgcatccagatcaacaccgactccagcctcctcaactccgagttctgcttcatcctcaaggtggggttgtgggtgtgagccaggactccgtggaccaaggggtggggtgtttgggggctgagtcagctgcgaacacccccacccctgcacactccccaggttccctttgagagtgaggacaaccagggcatcgtgtatgcctgggtgggccgggcatcagaccctgacgaagccaagttggcagaagacatcctgaacaccatgtttgacacctcctacagcaagcaggtcaggaggcgggcgggcaggcgggcacacacagaggagccagggcaggcaggggccctgggctggactggcctttcccgcaggttatcaacgaaggtgaggagcctgagaacttcttctgggtgggcattggggcacagaagccctatgatgacgatgccgagtacatgaaacacacacgtctcttccggtgaggccagggccctgaccctcccctcagtcctggcactgctgcttatgacctctggcctcaccttgacccttgattcccaggtgctccaacgagaagggctactttgcagtgactgagaaatgctccgacttttgccaagatgacctggcagatgatgacatcatgttgctagacaatggccaagaggtgtgatgttgccactagccctgcccatccaaggaggcgcccatagacttacttacaaatgggaattctcgggccaggagcaaggggctgttcccaggcacccatgcaaccgtatctcccctgctgcccccacaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatatt

SEQ ID NO: 37603 - DNA, 13901 bp, Homo sapiens; identical to SEQ ID NO: 37602

SEQ ID NO: 37604 - DNA, 9516 bp, Homo sapiens
ctcccccgaagccgcgcgcccgcgcccgcgcccctcagtcggtggagcccgcagccccccttgtggcccgcggcagctccccgcccgctcggcccgcgcccgccatggtccgtccgcgccgtgccccgtaccgctccggcgccgggggccccctcgggggtcgcggccgccctccgcggcccctcgtggtgcgcgccgtccgctcgcgctcctggcctgccagcccccgaggcccgcagcctccgcggatccgggcccgctcggcccctcccatggtgagccccccgccctttttccagagccttccacggccccgcccccccagcccctatcccgggctcacgcctttgtccgcagcccccgccgctccggggtgtcccctgtggcccgaagggtggtcccgcccggggccgggttcccccgtggagcacccggtggttcgcgccgcgctctcccctttgttgcgcgttcgggccggggtggggggttgggggacgggggcggggcgggctcatattactgctgactccgcggcccgatttaaacgcgggctgggggcggcagacaggcagccggcacgctcgcttgtttttcctattggagagttgctcgctctccgggcaggaaacctggaaatgggggcggttttgggggacagcggcgagggaggggcccgcgctttgtaccagcgcccccagatgtcgcacccgtgggcgttctcccctggcggccgctccgtgcccgtggagtgcgcacctagaatacgcgcccgcgcccacatgtgggatgctttgatggactgccgtgagcccagaccttaaacgtaaacattcagcttcgcaggtactttgggctgcacacgcttctccggacccaaaagatgcacatgcttttcagaaaccgtaaggtttacctggggctgtaaaaccgcacatcgcgactttgcaccgtgcacacgcttgccccgatgtgagatttcccctgggttcgcgctcgggtccgcttcttaaatacactgcctcagcggtgtggatggcacagagctgtggcagccctactgaaaccttaaacaggcttcctggggtcataaacatggataccgagacttagatcacctcccacaacttaaacgtaccccttcactccactgccttcgccccttcctgcagcattcgcatctagttgttcaaaagtgctttccgggtcctcagacatgcaccccaaggttttaaacctcagtgcaagtactagatgggcttccctgtgcaatagggatgtcaggcgcgcagttttgcacacgattgccaagatgtgagatttactttaggttgcaccttaaccgtcgtttttaaatatgatcgtcccatcttgatgtgctgctcctgctgtggaaggtatccctgggttttaggcaagcatatgtgttctttactatggctccagatcccagcatatttgaagtcctgagtcaacctgctctcctagacaagcagacattaagtatgtcgcttgggctcttaagtgcgttctcctgacttttacccatctttgtggcagtaaatgcatacgtgtcactgtatatgcggactagatacctcaggtcccagcgccataaacaacttgtatgttgtaagtgtaccctcatctcgaaagtcacctccagctgtgcgttttaactcatctcagatgctggatgtccggtatggtgcctgaagcccccggggcaacatccactctctgtccaactcattctaacgccaagatactcaggttttctatctgatcttctgacgactgcccaaaagtcagaatcacctgcgtgggtgaagaatcacctgcgtgggtggagaatcacctgcgtgggtggagagcaagtttgttcaggtttttctctttttaagcactcacaaaataaaattttttgtgtttgctagtattctggaaggaaagatctccttgtgcttcatagaaaatttggaaaatacctgtttgtaataagataaaaataaatcacccttataatttgttttcccccgcctggaggcgcctattacggggaaactctcgtgggtttcctgctgccaggctgtttgcggagctttcccttgtttgctttgagatgtttttggttttaaaaaacaataagtgaggtcaggcttggtggccctcgtctgtaatcccagcactttgggaggccgaggcgggcggatcacttgaggtcaggagttcgagaccagtctggccaacatggtgaaaccccatctctactaaaaaaaaaaaaaaaaaaaaaattagccgggcatgatggcgcggcttgcagtgagcgaggttgcagtgagctgagatcgcaccactgcactccagtctgggaaatgagtgaaactctgtctcaaaaaaaaaatagtaataaaaatagtggggagagtgcctgtgagtagcatttgtggcgttgcttggctttattgctagaactttctcttggtgttctacatgttttggtctgtgagacccctctgggggtggtgtcccagctgtcttccaaatgtttcccccttttcctcgctgtctttctcctggatggtttagtcccctctgtgtttcttgtcatctccttcctgcctccccccggggtcagacttataaggccagagaggtgggcactggcctgagccagaggaaggaattgaactttgggatgacagggagctttaggagagtttcagcctgggaaagacagggcaagctggtgtgtgggacagacacagcgcaagccggcttgtgcctgtggaggctgcaaggaagccctgggcccagcctggggcacggggaaagccccctacagctggcttctaacttgggtctcaagaatcgatcaggcgcacagctggggcaaaggctggaggtggggctggctgaaggcttcaggactctgctgggccagtgtcaaggtgacagcaggctctgggaaggaagggtcctgagggtgggcagcgggaaaggacatgaggaccagcgtgtgggggtcctgaggggtgagcagagggtttggacatggccccgtgggcttccagcaggggatttggggctgaatattgggacgtcccctctggggtgtgtggggactgcctgtccttgcaggccccggcctcagttttcccacctatcccccactccattgcaggaaggtgctcgggtcttcggggcactgggtcccatcggtccctcctcacctgggctcaccctcgggggtctggccgtgagcgagcaccggctcagcaacaagctgctggcttggagcggcgtcctcgagtggcaggaggtgagtctctgtggggctgcggctggcctccagggtcttgtcttgtccctgcggggacaggccagggcatctaggctgtgcacagtgacgcccctcctgcccccacagaagcgcagaccctactctgactccactgcaaagctgaagcggaccctgccctgccaagcctacgtgaaccaaggcgagaacctgtgagtgccggggcgtggcagccagggcggtggcaggggcagtggctgtggccgtggggatcagggcagccctttctgaccagctccttcccatagggagaccgaccagtggccgcagaagctgatcatgcagctgatccctcagcagctgctggtgagacccgcccctcccaccccatccactctgagcacccccatgcctggctgacccagctgtctgtcctgtcgcccccagaccaccctgggccccctgttccggaactcccagttggcacagttccacttcaccaacagagactgcgactcgctcaaggggctctgccgcatcatgggcaacggcttcgtgagtggggcgggctcccttgtagcactgtggtgacaagtacagctggaggcagcgctctgctcacacagtccaggcgggggtcggggggtctcccctggggccgagggtagccctcgtggcctctcggaccccatctggaaatgactgactccaggcaccctccgtagagcacagggtgaaggaactcagcctgagaggcctccagtttctgcatctgtgcccagcttcgaggtggccctgggggcgtgagtgcagggagggactggggccagccctgttggggcccaggagcctgtcggggacacatagcgtatggcagggacctggtaaatgggtgtgctaggcacaagagccagccaggagggagtggcacgttggggcttggtattctggtctgtaaaatgggctaacctccccgagtggcctgagctggccgtgagggagcagagctgagggtgctgaagcaggcgcggtgagtaggtcctcaggcctggctccaaggggacccaggtatccagccagtggctgtgcagggactgagtggggcaggcgcggccatgacctggacccggggggctgccaagggatctgagagcggcttccgcagcactccagggttgggctggttgaggggtagagatgacattttctgaggtagggaggacaggggagccgtgcttcctagggccaccgggaggctggagggagggaatttgtgtaaagcgcttgagatggtgactttagtacctagtgagtgctgggtgaacccagctggtgaggctgttcaggtgactgagattctggcgcagggcaggtcagaaagggggcttgggctgtgaaagatggcaggtgctggagaggaggcaggggtggggtgggagcgagttgtctgcccagaggacctggctctgggacattcccagtccctgttccctgttgggacagtctgcctctacccgtcccagctgccgttgagcgccctgggttccgctagggcctcccttctccctcaggagaccaggggcagaccagggcttgtgcctggcatgaggtctcttaagtgacccgttcccccttcacccagcaccgtttgttgagggcctgccatatctgggccccgagtacccagtctgtagggaaagtggacatccatactcaccccccaggcatggccctgggaggctgactgtgcatggctccagggaggccagggacagggccctgagcgggtgatccctgggctggacaccaaggttgagaagttaggccggcagcgtggaggggacagcactgtgggggtggcccggtgtggggaggggacatggggttttgggacggtcacaccacttcatctagacaccacagccaggcacatctgtcaggcttagttctcccatgcgccatcctcaagaggcaccagcactttatctgttgagcctttatgtggcaccaactgtgtgcactattacccggttttacagatgatggaggcccagaagcaggaggtggctggtgttaggtcacacagctaggaggcagcagaacggtggggcgctgcctgtgctcttaacccccaggccaagtcaccccatcaggcagtcaggagggctggcggcagggggtgatgtgggtgggaggtagtgccttcttggcattctcaccgcagcctgggtgccgggtgccactctgacctcagccatggcagggtcgggggatgccgatgggcgctgcacgggctctcagaggcccctcacctatggccatggccttgactgtgggggcctctgtccaccgatgatctcccttcatcccctacaggtggggcggtccagggtggtgggggcacagtggccccgggcagtgaccacagggtcctgacccgcggcccccgcaggcgggctgcatgctgttcccccacatctccccctgtgaggtgcgcgtgctcatgctcctgtactcgtccaagaagaagatcttcatgggcctcatcccctacgaccagagcggcttcgtcagtgccatccggcaggtcatcaccacccgcaagcaggtgtgccagccaagcacagcccctctggggacagagggggattagaccccactgccctggttgggcagccagacttggtgtgggcggagtgtgatgcgatggctggagcaaggagctgcaggggagcccggaggatgccgggcgggttcccaccagggctccatggaaaagcggccactgggcggctctgcagggctggagggtgggtcttggcgcggcggcagggaagccagcggagcggggagctgggcaggggttgggatcgtcctgcggctggaaggccctgcctggtaaccacgtgtcctggtcatgccttgccagttgaggcagactctgcaggtcctgtgcaccaggtgagggccgggacctgtctcaggccactggggagccatggggggctgtgagcagatgaggggcagggcctgttcccctgggactagagaatggacccagctggggctaacaggccaaggctcggagggagggatggcaggccccaggacagacagacaggtttcccaggagcctgggcccctcttcccaccccgttcccttccaacaggcagtgggacctggtggtgtcaactcaggcccagtccagatcgtcaacaacaagtttctggcatggagtggtgtcatggagtggcaggaggtgagcactcggcagcccagggacttgggacccccagatcctcacggactgtggctgggaggggacactggcattgggggtctccagccctgagggctcctctttgcctctcccccaaaagcccaggcctgagcccaacagtcggtccaagaggtggctgccatcccacgtctacgtgaaccagggggagatcctgtgagtgctgggctggggggtggaggcagcatccaggggagctggggcttcctgaccctcgtccctttgtgccccacaggaggaccgagcagtggccaaggaagctgtacatgcagctcatcccgcagcagctgctggtgaggggctggggccgggtgctggagcctgcacgcagtagctcttccagagggcggggctgggggcaagagcgcctccccaggtggcctgagctggctgtgagggagcggagctgagggtgctgaagcaggtgtggtgggtagctcctcaggcttggcttcaaggggtcccaggcagccagctggtggctgtgcagggactgagcggggcaggggcagccacgacctgcacctggggggctgccaagggatctgagagcggcttccacagcactccagggttgggctggttgagcggtggagatgacgtttcctgaggtagggaggacaggggagtctcagtttggtcctgggcccgggggactcagcgggctgggagccgggaggccgtggtgggagaagccagagctgggggtcccctcgcttccccgcagaccaccctagtgccgctgttccggaactcgcgcctggtccagttccacttcaccaaggacctggagacactgaagagcctgtgccggatcatggacaatggcttcgtgagtggtgccagcagacgcaggggaggggccggccagggcagagcgagcccggaccgctcacgggggcggacatgggagaggaacagagcaccatgtcccagaccagctggggagagagggtggctagtgtgggcgtgacttctgggggctctgtgctgtccccacggcactggatggggcactgaccctggttctgcgggggcctgctcctcctctgccacatcagggctgactcagcaccaactccgcgctctccactcctcagggacaggcgcccttgtcactcctggtttcccgggagcttgtgccacatcccaaaggcccattgctgggcagggagggctgtctgcccccagcaaggtcccagaatatttggcgattgtcttatctgggggaggctcagctgactcctcttctctctctcgggctcagtttctccatctgtgaggtggagaaggttggactttggtgtttctgagccctccccccgatgtccaccttccagctgggccatacttgggtaatatcccgaaactaccttaaaattaccttcgactcagtctgagtaaactgtccacgaagctgttcgtgggtggggggggcctgggtgtaggtgcttttacatgaaagcaatttcaagcattccctcaggggccgggtgcggtggctcacgcctgcaatcccagcactttgggaggccgaggcgggtggatcacctgaggtcaggagtttgagaccagcctggccaacatggtgaaaccccgtctctactaaaaatacaaaaattagccaggcatgatggccactcaggaggctgagtcacaagaatggcttgaacccgggaggcagaggttgcagtgagctgagatcatgccattgtactccagcctgggcgacaagagcgaaactcagtctcaaaaaaaaaaaaaaagtttcctcaaggaaacccagaaaggctccatgtacctcagcccttgcttgtgctgggccggccgctgcagatccctcgggctcctgagttgaagccatggccggttggctcaggtggctgtggtgaggtggccccagacacagcctggcctgcccaggagctctgaaatgcaggttcttgggcccttcccgacagagcctgttggcctttggcccacccattgctcttggccaccgtgtcatcccaataagggggcccacctccagggtgggtggggggtgtgaggacagagcagttaggctgtgcctggctcatggagcccacggcatgatgccgtggttggagggatgctggtccctgtggtgctgtctggtgacaccacgccctgtgcctgccaggccggctgcgtgcacttttcctacaaagcatcgtgtgagatccgcgtgcttatgctcctgtactcttcagagaagaaaatcttcattggcctcatcccccatgaccagggcaactttgtcaacggcatccggcgtgtcattgccaaccagcagcaggtcctgcagcggaacctggagcaggagcaacagcaacgaggggtgaggtggccggcctccagggctgctcagtctccctccacccccgctgcctgctcaccactggcctctgatttctcgccgtagatgggggggtagtggttaccccgggctgggcccctccaggagtcacagatgaggcccccgcagagactggtgagtggtgaccctgtcatgtacaggagggaccctggggcatgtggggggggtggggttgggaaagaagcagggcgaccttggccttggggagagcagagcagagggagaggcagcagtcccagcggtcctaggctgtcgggaaactgcagcccagcctcagggccatgggaggtggtatccaggcctgggtggggccaggcctctgctcacagggatgtggggtcagtgcttgggagcctgtggccagcagcccccactgcacccctgcccccaggtgacacgcttctgagcaggggcccctggggacttcaactgcccagcaacatggaggatggtgtcctgaggcctccaaggacggtccccacccctctacgtttccccaataaagccttttaaaaacc

SEQ ID NO: 37605 - DNA, 43164 bp, Homo sapiens
cttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagagggtgagccggggccgcgaaaggcggggatagaggctgtccggggcctgagggttcagaggtgtaggccgggaagccggaagggggggtcttgaagggcctgagaggcctctctgggaatcctggggctgatagcggacgcgcaggagcgggatctacctctagctgtggctcggcgcgggcccaaactcaaacaaggctttaagaaccgcagttgttcgcctctgcttgggccaccttttctctcgctgtgctcaccctgcagtttgggaggagggggtgtttcgggggtagttggtcggtgcgaggtgtggccatacaaacctctttaccctgacgtagcccgagagctgtcgcgtagcaacccttagggaagctaagcggaaaagtcccccacctcttccccctccccccgccaagacactaaggtctttgggatcatcgtgtcttcgcgttggcctgcggggtgagccttcctggggaattgctgagccagtttatcgagggttttctcccaactctgaactgctggctgggcagtatctcctgaaggcaatgtttgggagaacaagggtggcccttgcaggtctggaagttcatatacaagtatttggccaattaatcccaccccctcagcgagggggatgcctgttgggacagggtttctgagcacaagagtaatgagaaaccgagttcccctttcttctcagcacacagctccagagtggcgttgacttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtggcgttgacttctgaggcacagctccaacagatgtactgagttagaggtgtccctaattccagtctttgccaaccactcccgctccaggtggtagggaagggaagggtggccaggatgtgaggggattcctgatcctcaagtggtactcttgagcagaggtgctgatagcctcgtaattggtagctgggtggggggaggatggccagatgtttcacccactagagaacattttctcgtcagaaacttcgtgaggttaaaagtgagctcaaatgaaaaagtcatttattgtttgccttgcaaactggaccagtaaagtgaaaataaatacctttaaaatagaaaacttaccgttaaaatacaataattgtaggtgttatgattttaatgtaaatctgcagtacaggccaggcgcggtggctcacgtctgtaatcccagcattttgggaggccaaggcgggtggatcacaagggcaggagttcgagaccagcctggccagaatggtgaaaccctgtctctactcaagatacaaaaaattagctgggcgtggtgacaggcgcctgtaatcccagctactcgggagactgaggcaggagaattgcttgaacctgggaggcaaaggttgcagtgagccaagactgcaccactgcactccagcctgggcaacaacagagcgagaccccgtctcaaaaaaaaaaaaaaatcggcagtacaataattgtaggtgttatgatgttaacgtacatctgcaagaaaagttgtttaccttacttatgtgagtggaggtggggaaggagagcactttaggatgctgggtagtaggcatctgccagcaaccgattacccttactgtggtaaaaaggggagaatagagggaggctgcctgggacagggcctggcacacagttggagcttaatgtgagttttgtggactgcctgggacttgtcgaaggtctttatttgcctaaatctaaggtgaacatcattgatcatcaatagacattcggttggttgtttcccttcttgactttcctcactcctgctgctgtccgctctcctgtaacagcttctgggggcacagggttcttcccatcttcccaggggaccctctatcatcccccatgaacatgttaggccattctttctacacatttttcctataacactgctcaacataggcacccaccctcccgccctctgccccaccttgtagaataccatccagatctttagtgtggcattcaggtatcctttgctcattcacacacatttctttctttctttcttttttttttttttttttgagacagagtctagccctgtcacccaggctggagtgcagtggcgcgatctccgctcactgcaacctccacctcaccagttcaagccattctcgtgcctcagcctactgagtagctgggattacaggcatgtgccaccatgcccagctaatttttttgtattttttagtagagaggattttgccatattggccaggctggtctcgaactcctgacctcaagtgatccacccaccttggcctcccaaagtactgggattgcaggcgtgagccaccacgcttggccattcacacacatttctatccctcatatccctcatgcaagccatccctccagcacttggtgcacaaagtgtggtggactttggagttaggcaaacctgggttgaattccaatcctgccaattactggactactttagataacctatttaacacctccgggccttgggtttttcaactggtgtattaacagcacctatctcatacaggttgtgaaatgtcaacaagctacaacatgtaaaacacttagcccagcaccaaggacagaataagcgctaggtaaatgttagcccttgttttcagtattgtttgtacctgtaccctccagaatttcgctttcctcttttctctttaaaactgtttattgacagggcgcagtggctcatgcctgtaatcccagcactttgggaggctgagacgggtggatcatgaggtcaggagatcgagaccatcctggctcggtgaaaccccgtctctactaaaaatacaaaaaaattagccttgtgtggtggcgggtgcctgtagtcccagctactccggaggctgaggtaggagaatggcgtgaacccgggaggcggagcttgcagtgagccgagatcgagccactgtgctccagcctgggctatagagcaagactccgtataaagaaaaaaaaaaaactgtttattatggatactgtcaaacatatacaaataagaagcaataatataatgagcccctaagtaataatcatctaactacaacaatcataaattcttattgataaaataattatctgtcttgtttcaatactagttccatttatacccccactcccaaattattcagaagtaagtcccagacagcataccctttcagttgtaaatatttcagcatctctgaaaaaagtcatgagtattttaaaaaaatgacaatattattcctccttccttaaaaacagtaatttgttaatgtaatcagatatccatttagtattcaaattcccctgattgtctcaaatttttaaaatatgatttatttgtttcaattgggatgcaaatatgatccatacatttcagttgatactctctcaagtattttaatatatagattgaagttagatcacttgattaatagattttccatccatctcaattttactgatcccatctctgacatatagttgaacttgttcctctgtcccttgttcccactttaaattagtagtagatctagaggcttgctcagattttggttcaattcttttttttttttttttgtaaatacttaataggtgatgtttgtacttcttttttttttttttttttttaatttgagacagagtctcactctgtcacccaggctggacatctcggctcactgcaacctctgcctcccaggttcaagtaattctcctgcctcagtctcccaagtagatgggattacaggcacccgccacctggctaattttttggtacttttagtagagatggggtttcaccatgttgcccaggctggtctggaactcctgacctcaggtgatccacccacctcagcctcccaaagtgtcaggattacaggtgtgagccactacacccagccaatgtttgtacctctattgggaggcacataatacctagtttctctttttaggatgtaaggaataattgacatttattgactgaagccatcgtttcatcgggggttgcaaaatagtgctattctaattctgtttccttctgtagttgccagcttgactacttctatgcctgtaaacttccagtaatcaagtacttagttatcctgagatacagtctgtataggagaggttaagataaatgcttatttctttccaatagttaccaggtttcaaaataaagagttgtttcactgacatcctccaaaaatgactaatgaggttttgtgactaaaccaaccaagatttgtttagtattataacacactaatggtttttaatgtatttgttatgtttcagttgattaatcttattgatgcttaaattgtctcttggccagtggaagctttttcagttgactgccaagtcttttttatataaccctgtagccattgaaagcttccttactatctgagatgtctggttttttttttttttggaatggaatcttgttttcttgcccaggctggagtgcagtggcacgttctcagctcactgcaacctctgcctcccaggttcaagtgattttcctgcctcagcctcctgagtagctgtgactacaggcctacgctaccacgcctggctaatttttagtagagatggggttacaccatgttagccaggctggtcttgaactcctgacctcaggtgatccacccacctcggcctcccaaagtgctgggattacaggtgtgagccactccatctggcctgggatgcccatatgttctaatcttaccttgaagatttcttgacccagacctagagtcttcatttctcttaggagacttggttctttgtattacaaaattgtatttagagaccataatctgagtcatatggggttctcattgatactgtattggacatcagtcttggttttttccatggctagtttagctcttctcttactcagaaacttggaaaatacagagaagcaaacagcttgctggattatgtagcaccacttcagctgatgagtaccagaatgccagtttcctaatttggaataggagctctacctgatacttgggccagtcaggacatcttcctcctgttgcaaagaaatataattaacactcaagaggagtcctgtgaccttctcagcttccatgtgagctagtggtcctggaaattgttcttctcagccagagagttagatcgttggaggccatgggtgaagggcccatgtttgatgtgctggctgttgtccagaacacttttatccctctctaccctgattgatttgtcttctgtccattacatctctttgtgcctttcaacattatttcacaagagacaattttatgcaggaagaagagagactccaggctggacttggccaatcgccagtcgcaatgtcacatgaaactgcagatgcaaatgttgatggtgtggcaggtcgtttagcacagactgtggggtggttaggactgtggctggaaagttaaggagagattagctctagaaggatcgtaaaaaccatagaaaggactctgtcctgagtgcagcggatgggatagtaaaactattagacttgtactttaacaggatacctgcaatttgaaggtggaggccaccctggaggcagaaagaacagtttgcaggttcttatagtaatccaggctggcggtgaaggcagcttgacctcaagcattggctgggagtattgtaggagaattttaggaaggggatttgataggacttgagcgttgggcaagaaggctgggggaagaataagtcaaggtcgatgtcctcatcttggcttaggcaactgtgtaggtggcaaaatgaaatgatggtggcatgtaggagaaggaacacgttgtagaagtgagaagatgaaattgagggatctgtgagccatctgagtggagatatgaaggctatttttggtgctcaggtgtgacagttctgagcttgggaaattgagatagcggtgtgtccacggtccccaagagataaccatggaatcagaagactagaggctgaagatgggaccctcccccaggaagcacttcagttgatcacaggacttgggggaaaatgatggtcctgccaaaaaggccaaaggcattccctgaaatgtgggtagctccaaaggagagcctgaaaataaatgaggtagtgagtgccaaatgtggccaagagattgataaagtcagccttccatttggttttgccattcagaggtcataggagaccttaatgagaacagaagaaggtgaggctagaaggtgaccgcagtggatgggcagagacaatgtctagacagttagagaagaccttactgatggactgatcccagcgcagccacttaactggttttgtgaccttggacaagtcatttatcctcagctgtaaaatgggaataatattagggtctctgagatgtttgtgaagtgtaagcacagggcctgggaccaagtgaacagttggagaggccaggtgctccactgtggtcattccctgctgtcactcctaggagacaggtgccatggtgggccttgagtggctaatacaagtatgtcacacaggtcttgcttagggcaagtgtgcctgtctaacaggcagactgagtgaccatcaaaacagcattgagtgcacagtaagtgcagggtactttagggaggggatgttatgtggtgggtgacggttaatgggtatgggctttatttttggggtgataaaaacgtcctaaaactggccagaaacggtggctcatgcttgtagtcccagcactttagaaggccgagtcggggggatcacaaggtcagttcgataccagcctggccaacatggtgagacccccatctctactaaaaatacaaaaaattggctgggtgcagtggctcatgcctgtaatcccagcactttgggaggccgaggtgggcagatcacgaggtcaggagatcaagaccatcctggctaatgcggtgaaaccccgtctctactaaaaatacaaaaaattagccaggcatggtggtgggcgcctatagtcccagctacttgggaggctgaggcaggagaatggcatgagcctgggaagtggagcttgcagtgagccgagattgcaccactgcactccagcctgggcgactgagcgagactctgtctcaaacaaacaaacaaaaccacaaaaaattagttgggcgtagtggcgggcacctgtaacctcagctacctgggaggctgaggcaggaaaatcgcttgaacccggaaggtggaggttgcaatgagctgagattgcaccactgcactgcagcctgggtgacagagtaagactccatctaaaaaaaaaaaagtcctaaaactgattgtggggcggttgcacaattctgtgagtatgcttaaaaccatgaattgtacactttaagttggcaaattgtatggcaaatgaattatatctcagtaaagctgttgctgcgccaccccccccagccccaaattagccaggccaagaggtgggaagagcatagggagaaggaatggcattagtagtctcagaaacacgaaactgcctcgtgcatgacagcagccttgggaggtggaaggagaaagtagagtgtgtgtcgaggatttgcagcagcgaggtctggatagatgcattgggctggttcctggaaggctgtgggtgtcttagaaggacatattgctcaggaaggatgaaagttatggtaaaaaattgttttaaaaagagagagattcttagattaaggttaatgtgtaggaaatgtcttgtttaggattttctgtgtatgctcttgcctggaaatatatatatatttttttgagacagtcttgctctgttgcccaggctggagtgcagtggcgcgatcttggctcattgcaagctccgcctcctgggttcacgccattctcctgcctcagcctcccgagtagctggcactacaggcacccgccaccacgcccggcaaattttttgtattttgtttagtagaaacggggtttcaccgtgttagccaggatggtctcgatctcctgacctcgtgatcctcccgtcttggcatcccaaagtgctgggattacaggcatgagccaccgcgcccagccgcctggaaatattttatacatttcattttgtttgtcaaaggaaactctattgaattggtgaaattagatgaccacaacttggacagcaagatgagcttagctcagtcctaaattcctctgagtcaaacgtgatccaaaggaagagatgacatggtactggcaatctagtgactacaagcaagagagaggagctgggggctgggggagggcattgggagaagggtgtgcagaaggcaataatagaaggaacatttactctgtggaagaaagggaatgagcatgttgagttgtgagagcctggaccccacacaagcctgaagtttttccctcttgttggccccactgccctgggcagtggcattgctgcacaaggggaccccagtgctcagtggcggatgaactggcacaggttgttggtggtgtctggcagcctgctgcacctgttgctcccctccagcttgctgctgctgctgcctgcgagaatgaggccccagagcaggaatggaggctagggctaggcaggggggaggtttggcatctcgctgtcatgagccagtgtgggaacctaacccctcactgggtgaagaaaaggggaattgtggaggaggtagggttggtggtatgatacaattagaaactcactgggcctggtgtggtggctaacgcctgtaatctcagccactgaggaggctgaggtgggagcatcacttgagcccaggagtttgaggccagcctgggcaacatagtgagaaccaccccccggcccaatctctaaaaaaataataatatgggaggctgaggtgggaaggtcgcttgggcctgggaggttgaggctgtagtgagccgtgatcacaccactacactccagcctgggcaacagagagagaccccgtctcaaaaaaaaaattaataataattttttttaaaaaagaaacttgctctgagggaggggatgattaatctgtataaaattacagctagataggagaagttctattctataccatagggtgactgtatttaacaataattcattatatattttcaaactgctgtaagagaggattttgaatgttctcaacacaaagaaataataggccacgtgtggtggctcatgcctgtaatcccagccctttaggaggctgaggcaggtagatcgcttgaggtcaggagttcaagaccaccctgggcaacatggtgaaacccccatatctactaagaatacaaaaattagccgggcgtggtggcgcatgcctgtaatccccagctacttgggagggtgaggcaggagaattgcttgaacccaggaggcagaggttgcagtgagccagggtcacccccactgtactccagtctgggcaacagaaccagactctgtctcaaaaacaaagaaataataaatgtttgagttgatggatatgctaattaccctgaattgatcattcattacacagtgtatatatgtatcaaaatatcacatgtatcctataaatatgtgcaattgttacacgtcaattataaacaaaaaagaaacttgctctgaggctctagaggatggatttgtgggagcaggccagaagcaggacacttgctagctgctcttgcagctctctaggtaggagaatatggactaaccagggctggagtggaatgaggggggatgaaggaccaggtcagagatcagcttgggagatgaaacccacaagattggtccagtttttattagatgtgggtgaagagggttagaagtcaggctgctggcttaataaatgactgggtggatgctggagctccttttgagatacgggctaccagagaagggataggaaagttaggggtgcagattggggggtgggaggggaagtattctatctcagatgtctgagggagtccggcaggcagttggctgtgtgagatagtaacactaaagatattaacctggaagtcaccagtacactggctggtggcagttaggcccgcgccaggccatctgttggctcatagccgggcaagcctgccttggaagcctagctctgcccacaagtcctgccaggaggctagagagcagccttaactgtgggccaagtggacacaagtgtggcctaacgaggacacctggcatggagcccagtttggcaagcggagcagagagagggacagctgggctctccctccagattcctgccgtgtctcttcctgcatgatgctggggcatggtggttttttgttttcttgttttctttttgactaaatataattttttaattccaaaaagttggtagaaggatgacttggtgtagactctccaaggggtatacattgtcacccctttgtcaaaacactgcatgtatataccgtgcgaccctgcaacccaacttataagattgtgtcccgtagattaacatgggatagcatgtacagaggtgtttatgccagccttgttggtagcagcaaactattagaaccaatggaatatccggtgatttggttatggtctggttaagtaaaccatggtctattcttacaatggaatactacgagagagtgctcaaaagcatgaagttccataagggctgatttagaaatatgttgttaggtgaaaagttgcaaagcgttacatgtaatccctcatcttggtagactaccagatggacatatatgcatgtttttggaagcataggcgccaagttgtcatgagtgacaacctctggggagagggatttatagaggctggtagggggaagatttcaatgttgactttttatgtactcttctattgtttaaatgtattacagtgaacacattttataatttgatacattcaataaagatatttaaggaaaattaggacatataggtaagcaaagagaagggtacccacacccagcagccatcaaagctgaggcctgtgctggagagcctgggacctttgtggtccaggttttgtttcgcattgtggggcattgtagggctggtctgagtcttagggaacccccatgaagccacttctctttacacctgaagactcccaagtcctatgggggtgcttgagggcccaggccagagctggacccttctcatgtcagctggccagagctgcagggcccctgtccaggtatagccactgtgagcaggtgaccacttaactggctgtttttctgtctgtcctttgcctcttcctcctgacccctactcctgtattccctttgttggttacatcttgcactggcatatactttagcccgattttattatttatttatttatttatttattttgagaaggagtcttgctttgttgcctaggctggagtgcaatggcgcaatctcggctcactgcaacctccgcctcccaggttgaaacgatcctcctgcctcagctttctgagtaactgggattacaggcgtgtgccaccacgcctggctaatttttgtatttttagtagagatgcggtttcaccatgttggtcaggctggtctcaaactcctgaccttgtgatccacctgccttggcctcccaaagtgatgggattacaggtgtgagccaccgcgcctggcctttagcccgattttatctgagaagctatttatggtcaagtcagtaagagtccccacaggagccaataactgctgtttccaaatccctgccacaggatgtcttgtcagaacttgctctggtgggtgataacatatactttttcttgggtttactcagcgatttcttgggcctggtttccgaggtggagccagtgcttgaacccctgctaggccttttgaagtaccctcagcctaggcagatgtcagccattcagggcccttagtaaataaggctttctgggtgactagggtttcttgatggcagagacggaaatgcttcaacaccttattttaaacattgcataatacacttctggaatatattagtctcatttccctgcttgcttgcttcctttcctttctttctttccttccttcttttttttttttctttttctttttgagactgggtcttgctctgttgcccaggctggagtacagtgacccaaacacaactcaccgcagccttgacctcccaggctcaagcaatcctcccaactcagccccccaagtatgtagggctacaggcatgcaccaccgcacttagctaatttttgtatgttttgtagagaaggggttttgccatgtttcccaggctggtcttgaactcctgggctcaagtgatcttcttgccttggcctcccaaagtactgggattacatgcatgagccatcacgcttagctccttttccttttttaagacagggtctcactctgtcgcccaggttggattgcagtggcatgatcatgacccactgcagcctcaacctcctgggctcaagtgatccttctacctcacctttcccaagtagctgggagtacaggcatgtgttaccatgtctggctaattttttattttttagtggagacagggtctcactatgttgcccaggctccctgctttcttaagtggcatacactgaacatagcagagtctctcctgcattaacggctgttagacttggaatgagatggaacagaaccactgtccctgagggcccaggtctgcctcccatagttttgtccctggccttctgtcaggccacccattcactcttcctgctgtggtcaggatgcctgctatagcaccagggtccccttcccaacctgtagctgctcttgggctttgagctcagtgatcagacacactgcagcttgttaggaggatctgcatccagaatgaacaggtgcaaggacatgatatgactgtctctaagtcatctgcgcctgctcagggtcaggaccctagtgcccctatgggttgccagaacctttcttgagttcttctgtgtggagccaggcatcaggcagaccatggctcccttccggacagctgtgtgatgcagagatgtatttgcccacttgtaaaatgaaacagaaatcacttactcgtaggttgtaaggattcaacagcgcagtcctagccagagtggatgctcaatagatatttgcctgattggatgagtgacagctcttttttttttttgagacagagtctcactctgttgccaggctggagtgcagtggcatgatcttggctcactgcaacctccgcctcctgggttcaagcgattctcctgccttagcctcccaagtaactgggattacaggcacccgccaccacgcccgcctaatttttgtctttttagtagagacggggtttcacgatgttggccaggatggtcttgatctcttgacctcgtgatccgcccacctcggtctcccaaagtgctgagattacaggcatgagccactgtgcccagccatgacagctctactggcactggctgagtactaggctttgggggtgtgggggaggaaaagccaagtctcccaccccccaaccccagggatgcaccatatcatagatttccctgtttctgagttattaagcacttgcttttattagacacatactaggcagtagagacaaaaggagttgagacttagataaagggaattggagacttgggagggtctggctgagagggagagcaagagtgtagagggctgaggatgcccatgcttccctccacgtcctcttcagccttgtccctctgaaggctttgtcttcactcatgcaagacagaccagttccttatgaccgactcaggtctgtgtggtctccggtttggctttccaggcttatatccacctattgttctctttcttttcttttcttttcttttttttgagacagggcctcactctgttgcctgggctggagtgcagtggctccatcatggctcactgtagccttgaccacctaggctgcaaaccatgcaccacgacgcccagctgattttgtttatttttggtagagacaaggtctcattatgttggccagtctggtctcaaaacttctgggctcaagtcatctttcagcctcggccttccaaagtgctgggattacaggtgtgagccaccgtgcccggccaacttctgttcttttttttttttgagacagagttttattcttgttgcccaggctggagtgcaatggcacaatcttggctcaccgcaacctccgcctcccgtgttcaagtgattctcctgcctcagcctcctgagtactaggattacaggcaagcgccaccatgcctggctaattttgtgtgtgtgtgtgtgtgtgtgtgtgtgtgtgtgtgtgtgtgtgtgtgtgtatgtgtttactagatacagggtttctccatgttggtcaggctggtctcgagccctcgaccgcaggtgatctgcccatcttggcctcccaaagtgctgggattacaggcgtgagccaccgcgcctggcccaactcctgttctttatgagacattcctgcatagctctgtgggtacctgtagtcccactccctcagaggttgatgactgggagatgctgaccaggagtctgaggcagtgattaaattggagggatgtgttgaaggggaactggagctggcgtaccctcttcccaccagaggggcccctcgctgtggacaatgccatcctcccaccacaagggggtgcgccaggatcactccacttctcaaggagcctggggagggaggtgtggctggaccccgtgagtcatccaggctctctctctgcttttccgtggggcagctgccaccagcactgtcccttgggtctctgctctgggccctacttccctcacttaagtctcagttggccttctcagatgaggtagggcttgtcgcttagtgtctcctgtctgtgtacctctacccatcctcacctccctgtgccctatcttcctgggttgggaaggagaaggccaggggacatttcctgatgctctttgccttggtgcccagtgcaggctgctccagccttgcccaccacaccgtcctcatttaccctcacctgggtcatgccagcagctcagagttggagctgcaggtacagcacagtgtgctatgaacccatgggtcttgggagctccaagtaggagcttgaggcagcccagggatcagggctacacttctcaggctcctagaaccatgcacctccctaggtagtcaccactcttgtcttgccaccctggcctctccaggagagggaaaatttgtcttcaggacagaggatgaatttttctctctcctcaacctcatttggcactccctctgaggggcatgtaggatgtatgtggcatgtataggtacatatatgcagggtgactccgggagatggccaaaccaggcacctgaacaccatgtaagcactgcaggtccacacggtcaggctggcgatgggttatcagttgattgacaagtctctcctaccctgtaccccagtttggaggcctctccattgggctccttggcgtctgcctcatccaacacctactccctggctgatgttttaaaaaatctatcctgcactagaatgttggtcttcctccttttcagaggcaggaaagtcaaggccccgaagggtgctttagtaggctaggctgctgctttgtggcctgggcacctgctctgtgtgtccaaacctagcaactcccctgaaggaccaaggagtaggcacaaggggcagtgctgggattgcccctgtgtgaatgtgtgtggtcctgaggaccgctgggcagattggtggcaggggaaaggaatatgtggaggagcagccctgactggtgctggacactgctttcctggccagctcttgcctggccctgggcacttgcccagaccttgccccactttggatgctcaggcaatggttttcaggccttgacctcaacagaggctttcgtgcttggctggtggatggggcttttccctctgaggagtcatctgaaactcagcttttactgcctgcccttgtccctgtgctggtggccactcagaggctccacagccccagggtctcccctgcagctgtcatcagttcttctgaggctgttccatgggtatccaggccactggtctcactgggagcccctgagtggccctcaggggctgggttgcagggagtcaatgtggtctgggcctgacgaggctagaacagtgtcatagctggacaggctcctggaggtaccgttatccagctctcttcatctgggaagctgggtccaaggtaaggcccaagggcgtaattatggtctcctgacacctgtcttggcagttcctgaccaatcactctatgttctttgatttttttccccctttatctattcttccatttgttcactcaaggatgcctggactatatctctgtgaactggcccccaactcaggaacgggtagtcatgcaaaaaggaccctgtttctggggcccttgtcttttcctcaggccttgccacatgggatctagcttgaaacttgaagggttgggagctgatgaatacagatgagctgcagtccatgatgtagcacacaaggccctgaggctgccaggtcatgggttcagctctgcctgttttcccatgcccccaaccctttaaccttcaaactagataccatatcacaaggcctgggagagcacagggtcctggaatgtcacccttcggtatctgcccaggctccatgcctcccacctcccccagtggcttcagtcatttggacctagcttccactgtgtggtcaagcaggtgaccacgtccctcccaggggccagcccaggtccacagcactggctcactctggcatgttactgttgcccccgcacctgtcccacaaggcccttgagcagggccgctgaggggagggctgaaaggcagggtgggtggggtcctgggggtgctgtactggaccagcttgtatagttactgcttctgccatcttcttgcctggaccaagcctcttggctctgccagcgaaaggtatgggatggattaactctacctctggcctgggctgctctgtccagtttcttttttcttcttttttctttttctttctttttttttttccccttcttcctccctccctccctctttcttttttctttctttgtttctttcatgaaagagtctcattctgtcacctaggctggaggacagtggcatgaacactgcagtcttgacctcctgggctcaagtgatcctctcaccttagcctttcgagtagttgggaccacaggcacatgctgccacatctggctaatctttgtattttttgtagagacagagtctctctgtgttgctcaggctggtcttgagcttctgggctcaagtgatcctcccacctcagcctctcaaagtgctgggattacaggcatgagccaccacgcccagcctctgtccagtttttatgagccgcagggaatgggactttatgctgacagtgcatgagctcacagccccagatgaggtttgatcccacgagcccaaacacagggcctaggtcaaagcaaaatgagtatttcctacttttctcctttgggctggctctaggcaccgtggaactggcaggatgctcctgccaggatccagcctgacctgcttattctcactgagaacagccacctctagggagccctagaaatcccctccacctccaactgagtgagccccaactttccttcgtgtccttctgaagatggctgtgcgtgtggaacaggagcccagcatcaagagctgacaggattgctcaggtggtgcaggccagcagacccagaagctagacatgggcatgggccaggttttttttttttttttgagacagagtctccctctgtctcacaggctggagtgcagtggcatgatcttggctcactgcagtctcaacctcccagactcaagccatcctcccaccttagcctcccaggtagctgagactacaggcatgtaccactgcgctgggctcattttgttttattttttgtggagactaggtctcactatgttgcccaggctggtctcaaactccctggggtcaagtgattccctcaccttggtctcccaaaacgctgggattataggtgtgagccactgtgcccagcctcggccagcttttgagcacagcacattgccataactggccttccttgggctacctggcatctggccaggccagaccactttacctcttactcatgcccaggcaaactcacatctttgggaaaatgaaaagaagctcttcttcacagttccagatccaccccaacctgccggttctataaccgtggtggcaaacctggagaagaaatagcttgcttcggtcaaagtgcagggcatcaacagaggagggtgtggcccccacctcccagggtgaggctgggttgtctgattctcaggctgggctgtggccagggaacataggaaagctgccctgcaagccctgtgtctcctgggacatgccagtcccatggagccttcaggcctgggtggggacggcctggtgacgggctgtccaggcggatctccactcagtcagaggagagcttcttggaacttgccctgggtgcagcagtaaccagttctgcccctccctttggcacatgggactgtcgcctgcctggcaccctcctgactgtcaaacgagttgacttcctcctaggatgtgagaaatgctttcatcctcccagcctcagggacaaggtgttcctgagagtatgagggtaattaaatgtgtctctgccaccacctaccacctgtcccagagcagggagtggggtgatgaacccagggcagacatccttttgcttcctggacttgggaggtgactctcccatttgatccctgtgtctgatgttgctgatggtcggtgccgctggcccctggtgtcagctggaccatctctgcagattggccccattcccctactgtgagtgcctcacctcactgaaaaacctctagcatgaaacaaaatgtaggtccagggaccgaggaaggagaacttactgtcttttccctgcaggagctctgccttagccacctgaaacctagtaacttgcatgtgaccgtgccagcaggagactccaggttcttcccaagactactggcctgccagcccagaggtttcccatgaagcaagagctgtccttggctatactacctcctacctgctcctgagaccctcagggcaactcagggtgtggtgggtggtgcagagttctgtccttgcctctctctatccaggttgctggggctgctcagagctctctatgatcttgctgataggtgagatgtaggtttggggacagaagccccggctcttgagccagccctgtttctctttccccaggagatagcagagtgttagcatgctcatgctgcacaaggtcccctgcaggctttatgacagggaggacagcatgctagaggcctgggaaagggttgggacagaccatggagaggaggaacaggtaccttctgtacaggacttagtaggacagcctaagcaacagcctggagtcaaggctacacactgctgggctcatggtgtctgccaggagaaatggactgtggtatgctgtgctcagctctctgtaaaccgctgcctttgctcagtgtctgtgcagtgccctgggaggctggcactgcagaacctgttacctggtgactggccaggggcctggttccagagagattccacaagtgttttagggccaatttgtagacaggatttgaacccaggtccttgtggctctgaagcccagattctttctcccctgtcccactcagctgcctaaggaataatgtcttgaagccagtgatctggcaaaatggatctgcagagggggctggggctgtgggatggatcagctgatgggtgatgggtgggcctgcactggccagggaaaggtgccatggataccccagttgagggtgatagtgccaaggttccggatggggaatggcagatggcatggggggaggggggaaagctggcatttgataggaagtgttggaacttggggttactcagtcaattggtgttacgtgaggtttgcagagagcctgcgaagggccctggcagaggcctgggggctgaagaggacactcatactgtgctgcaggccccaggtaaacccagggttaatggtttctatgctgtggctcccacactgagagttccagatgtggtgctctgaccctgcagatccagccagccagtgcacacatctgctttggagctgatatgaaaaaaaaggtctcctcccactcctgagcctagggaggaggtcaggcgcagcacattcaccgaggaggggcagggcagctctcgctttgttgggccaccagcctggccatctgtccacattggtccatctgtctgagttttcctactttgagccagtagaagttgtagcattggaggtagagcccaggtccagtcccttcgaagccgacttctcagccaggcccaggggagtggtagaacaggctccaagactctgccacccttgcagagaatggcattgtgggcacaccagagtctagggagcatgttctcacatctggttccattcagtgggcctcaattcctgaaaacccctgagctccccaggagagcctcactgagtgacctctggaaaagcagaagtaaagtctgggaacactctgtcctctcacactgtgctgtggccagctggccagcaagacccctccatgggccggccatgaggccatgggggagcctcaagcgggtctgccccgcccagtatgctggccaggggctgcctccatgcctactgggccctggggcatgtgggaccaaccccctggcacgggccaggaccctcctttctgcctccctatggcccttggggaggaactgcagaggcctgggggctgaaaaagccgtgtgccatctgagcctgggagccctggagaggctgaaagatccccttctgggttggcaggatctgggaaaagtttcaggaagtgggcgggggcagggctgcccagctgccacctctcaaggcctgtctggggttagctgccaagcccatactttgtcacacagagagcagaaagcactgggcaggctgagtgtcccatgccctcctattaatcaagggctagggtgataggggtgccagctggggctcagtgtggccagcctgagtctggtgcagcctggcgacccctgagaggggcagccatgccaggtgggtcttgggctgcagccttcccaggcctcttcaaagacctcagctgcccctgctggagccagggcaatggtccttgacacaggcaacctcagggtggacagggccggcctgtggaggtgggagggcagggactctcactttccaggctgggggtgtgtcttcccaacccagcctctctatgggcctgagaaagcagcactatttcctgcacttcaagggcttctctctccggcagcctgtggacttccctggagcacttgctggagcagagatcacaggaaggtcactctggccagcaagtagcactgttagaccagtcaagggctgaggtaatgctagggctgagggcacggggcctcacaggctgtgggggagaggcagaactccagcttcagggctacatggactgctgggtgaaggtgacagcgaaccattcaatttggaggacttcattctggtgatggtatggagagtggtcttgggagtagggagccaagatgtggggcagaaggcctgggtagtgccaggagatggagctggggggagagtcatctgaacatggggacaagaatgtgggaagcagaggagttgtgggaaggtcctggggtgcagactgaggagcaagcctaggcctgagggaaggctggagataccgggagaccaagttggtctgctgcttctgagttggggttcaggtcagacagcagagagaacttcctgagagcagcagcatcttttgaacatgagaaatcagccttcaaggaagtcttttactgtgagagatcccaagctggccagacattcctgttgttgggccatggatgggaggatttggggtagacagctgggcttgtgggtagaccagagcggtcccccgagtctgtgctagccagaacactgcttgctcatgccttggctgggcacgtctgggcctctcagtggccatcactgaggctgtcaggctgctgagcccaaggcccagagcagaactagcccctggcttcccagagcccctgccgtccttggctgccctcagaggctgggccagggctgggtggccaggtctcccacaaagctctcaacaagttccaggcctctccttctgtgcttagatcctgctcccagtcacgtcccctcccagtcacatcccctcctccgcatccctcagagagagcaggaagctggggaggagggagcatcccaaccagccttgtcctaggcctgaccagtactgtcttagggcttggggctgccagccactgggtctgggagccaggtttctccaacagggccagagctggtttagaagccctgtgtggtctcctcatgggtgagctgagggttcagcaggcctccttctctaagtcgccttcttggctggcaggctgtcccccttccctgggtcacagggagatgtggggtttggccagggaaagtggtctggaacggccctttgacatcgtccctgggggcttttaaaaaataagtttcctggtaaggaagactcctcaggccttgggcaggattctcagtagagtctcccgggtttgctctgatctgacaaatgccagcagaaaccacccagccgcctgcgttccagcagtgcttggagccgtggcttccccagatgcagtgtcagcagaatgcagcagccaaggcacaggggtgtttgcttggaggcccttgctgagcccaggagtggggggcctgcagaagagagccctctgcttggctttgccccctcattcacgtgcacacattcctggcttctctaggaatggatggtgccacaagggatgccagagggacttgtccctgagtgatgacagtccagtgacagtgctgatggtccatgcctgtcaggtgagcagtgagtgttcaggctgcctccgaggaggggaagaaggcatgccctggcttctcccacccctctgccaccacctgccagctcatctgggactgaaatctgtctggacagctgagtctgtatctgaaaagcctgtcctgggtcaagggctggggaatagagcggtaaaggaggtgcagagtggggaggagaggaggaaactagatctggggacagatagaatcccccaggcctgctccacatcccagcccctctatgccccaactctgggactctggacaggtttcatgttctgtctgatttctgttcctgaggctgagatgggcatggttgagaggtccagcacacaggttgctcctggcatggggatgagtacaccgtacagcccatgtgtttccagttagagtagatctgggttgcccgcttcatgttgggatgaggggactcccccctggccagtcccaggtgttggatagagagtcatggaggcctagggaggggaaaggtgcttggcagtggggaagttgctgagctagggagagaagccatgtggagcaaagtgggaggctggagcagaggaagtttcatgctgcttgagagctcatgaggatcctgagtaggaggtgacagctcactcggggaagcctcccagcagcttgtgccagggcctggaagagcagtgtgtacacagatgcccgggtgaggcccagcccctgatgctttggaggggagggatcaggaggccagaccggggtccagactcccagtcccagggaatagtggagtcactggcaggagtgccaccacccaaaggactgagtttttctctggagctcaccctgtacatctggcccggcctctaggcccaggctatagctgaaaaggaagaagtctcctggcctgagaagggctcttggctggctgcagtggctgtgtgaataagcagacaggtttggtctggcagctgccgcaccagtgcctgggtctgacccagagaactgtattccagtcttggctcccagctgccatccgctctgcagcttcccctagtggagatttcagcacttgctgggcctgggccagaaccccaagtatataaaatcagagcatgaacatgactttgataaattaagaaggcttcattttaataccacagtaagaggaaccagttaatattcttaccatttcacatccacaaaaaccacatcaggggcattaacaatctctcagttttgtacaaataaaccatgtttctcttaaaaagacttgcacacgtggttcacgcctgtaatcgcagcactttgggaggctgaggcaggtggaggctgaggtcaggagttcgagaccagcctggccaacatagtgaaaccccgtctctactaaaaataaaaaaaaattagccaggcatggtggcatgcacctttagtcccagctactcgggaggctgaggcaggagaatcgtttaaacccgggaggcagaggttgcagtgagccgagattgtgccactgcactccagcctgggcaacagagcaagattccatctcagaaaaaaaaaaaaaaaaggcttgcatacttgcccaagctcaaggatattaaaatctagcacatgaaacccatttctagaggtagaaatacaggcaatatattatttcagcaatgaccatcaattacagttaagaacagttaacaaccaaatgggtaatgaaataatgcaaccacccaagtttactgagcaaagcatcttttctcacccatgccttactctaggagtagctggggcttggttagatgtggtgaggatgtgggagaagagatctcagggcaagggttcattgcagacggcctggggtaaggatgtaggagagtgcacatttcccaggcaaaaaggcattggggtccacagagcagaacaggggctggtggcttctgcctgccctgcctgactttctcttctatgcccttttgggtggccatgggagaaaagtagtggtcaattgcagagtaatggtgaaggcagcaggtgtctcctgcaggcctcaggaggttgaagttcactccatgagtgcccaggagccacagaggtcatgagtgtggcctgctaccagccccccagagatgcaggtggaaggcatctattccagagacctgctgtattccaacatgctgtgttccatctctcctttagctcgcctgactccaggttggggctgtcttctcctgatggagtacagcaggaggggcatcacaggggtcccctaagcttgtagagggtttatgtgccccacttcccttcttctctaaacaacccaggctagcatggtctcctgagcctcaaagacatctggggaggccgtggccaggacagcgtgtggaggtggtcccaagtgcagctccgcctttgatcccctgggcagcctccccaggggacagagaggcatgtagtcttccaagccagcctccgccaccatgtgcctgggtatcttctcagccactgtccttggtactgtccccagggagcttctgtgtcctgtatcaggtgggataagtactgctaagaagaataacacaagggacagtgatgggctgctggagaagcctctgaagagggggcgtgtgaggaaagatctgaaggaagagggggagacagctccactttcaggccaggggacggggaagggccctgaggtggggacatggctggggatagtgagcatgggggaatggcaggacctaagtcagagaggttaagcggggatggtgggaccaccacatgagggctctggaagggactctttctgagtaaagtaggagtagcggagagtttaaggccaatgaatggcatggtctgccttgtgttttaaaaagatcactctggctggcacatgcctgtagtcccagccacttgggaggctgaggccagaggatcacttgagactaggagttcaagttcagcctgggaacctagcaagatgccatctctaaaaaaaaaaacaaacaaacaaaaaacaaaaacaaaaacaaaacactctgggagactgttgttaggttctcatcaggatcccactgcctctcccttggcctgcttcccccgggcccttctgctctgcctctccttccttttcccttaccccatctctgaatgctcaagagaaccctcaggattggtctgcctgtctccggccactctgaagggacgctcagtctttcctgccagcctcacctcccccgcatgccactcatttgccctgcaggccacttgtcactcacaccatcctcctggctgtttcctttgtactttcttgcccctgccctttgctgtggcccagccttttgtggccttctcatcttctcagtctgatctttggtgccctctccactccactcccacagcttcaggcatctcttgtatttcatgtgcctcggggtgtgttggcttgcccctctgaccctgaggccctggagtgcagggctcatgacttaccctgctctagattagggccagcctacagcttaacatacagaagggcttcaaaggctgtgggttgtggattggaccttggaatttcccaggctttcttgtcatcttggggaggaactgttcctcttatgctcgaactttggggctccatgtgctggattgtggcccaaagatctggtgcatctccagggccttagctgattgccctgtggtaggccctgagccaacagggagatggagatcagggtagtagcgggacacaactgcaggggagagctggggctgagttggggtggggatggggacttgggacccttggggaggcccagcaaggctagcccttaccccctacccttgggtttcagacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacgtgagtgtgctttgtagcgccttcttctcttacctgggcaggatagctacacctgcaggagctgggttcagtgtggcttaggctagctgccttcgtgcctgtgtcagctgtcagagctgatggcagctctgtcaggccaggtgtcccaggaccctaccttcagagtcctccctgactgtgtgcgtggtcattcaacaaccctggacttccaggccaccacctatgaaatgggtcaccagcacgttcactactggctgaagatatgatgggcaggcaagagtgtcccacgcagtagtgctggatgaagcctcttcccccagtcacatagactggggcagggaaacctgggaaggtgggagccctttttcttaccctacagcacccaaacagaacactcaccaggccccactccccatgcgaggggtcaggtgtcgggatggacagagctctgaaaggccaaggtcttaggataggcccattctctatctgctctgaccatggccctgggtctcagggagattggttcggagtagagttgaggggcaggctgaacgtctagctgcctttctcagttctgacgcaagccctcaggaactcaggtgggcaggctcccattcttatgactcttggctgccccagcttcttcattgtctgacccttgggcacagctctgccttcatcaagctcctggagaagctgagtggaggaaaggaccttgggatctgcaggctcggggagggcacctggactgcacggggagggcacctggactgcacagggaggtagggagggtccctttgcagggatgtcccaagagccatgagccaagtcctggtggacaaagaaatagtcccagcctaggtggtggccccacaggggtggtgagcagaggcatgctcagcggctagcgtctaggagagtaccctgcattggcagagtgtgagtgtgcagtatggtgaagcatttccctgagctctctgggtattgtctaacttttaccattccttgattatggtgcccccactcttttccttgggacctggcacacctgccccacttgtccctgcagggacagagttagatgcctgctgcctggcctgattcttatcccctgcagttaggagccacttgcccaggatccacttgctcaagaagtgctgcagccaaagggctccattctcaggcaggagtcagaggctgggacacctgaagggccagggaacatgcccaagctaggaagcaggccctctcctggccacaggcctcctttcctgagagtctccttgctgccctggcctccatcaaggtatgccaacatggacctactggggcaggaggctggtaatggggtgtctcttgtggtgctacattaggggtcacattgcagctccccatctgttgatcattccctggccttggtctctgtgttccttgctgcaaagccagagctgaggacataccaggaagcagtacatttattgctagagcccagcctgagacttgtttgcacaaggctgcttcagcttcctggtgaatgttctggccttgccagctaggctggccagaggaggcctgaccccatgcccatggtcagagggtagatatcacccaccccactgcccactggcccacctgcctgtgcagctagcctttggcctgtcttggtcttagcctgccaggccatgaaactggagagggctctgagcgtgactgaggctgcacaaccacagctggaggttggctgcaagcaccaagggtgcttaaagcagccaagtgctgtcctgtggaaggctgtccgaatctgccacttcccaccccttccattcatgggtgattgtggcttccagtcctaccagccactcactcctcccctcactcagaaggagctcagcagtcacgtgtcagcccatcagggcctgtgtctgcttggtccatgacctcgtcatctccaatgacctgctcctttgctcctctgctctgcacttcagccatccccactgatggctgcccaggcccatgtcaccacctggaactgctccacccctgaaattgctgaatcaggcacctctctacccacagccttcaggccctccagcccactctcagtcccttgtgggacacgggttccagactcagcgggacactaggccttgcttcctcccctgctaccccttctgtcttcatttcccgccctccccaactgaagttccctggtccatcattcgagcacttttctgccaacatccgcagctctcttggccgcccgactcatggtcccacccggctggcagccccccagccctggaggaatcccagcagcctccagcctggagccgctctccccctacctccactgccgggaggaaagctggggaagccagccttgagtggggggtcatccttgctgccaggcttgcatgctcaccctcttagccagcctcaagcttttttctgcctggcagcctctggctctacctactcagcaccctgcagaccccaccagcactgcaaagaccaccttcccgtcttaaacaccattgctctcctgcccccagcctcctcttgggcaggtggcccaccttcttcacaaagacagtggaagccaataatatgcctcccagtgctgcttctgccccccaccgcccgaaccctattccaatggcagaagtgcccttccttttctcttggatccttccaccaatgttctgagtgccctcaccttactccctggatgctgagtggccactcatttgcattcctgtctgtgcaggcaccttcccttccgaattcttctcttcagtatctaagcaagctcaaataattaaaaaacatctcgtgggacctaaacttttacattcactgtctgttctctcatttcccctcatccctcgagctttcaacagtcccgtcactccaccacaaggccctggctaaagccacccctgaccttcacgtagccaaggtctccaggcgtgaccactctgcggtgtccaccccccagcccccctagctatttctttgctcccatgatgcctctctgacttaactcctacctctctggccactctcccttctccgctctgccccagcaggccatccccagtgtgtgtgtggagtgttgcaggaaggggtgaagccttccatagaggcctgagctcccccaggctggggctcacgattggcttccctgaggaggtggctagtttggctgaggggaaaagcatttaagggaagcattggaatagggggtttttaggttgagggaactatacatgtcctgagtagcgagcatggtgcacctggctctgtgccccacacaacagcctccagatatgggtgcccactctgggaatgaggaagctaccctagaaaacgcagaggaatatactcaggagagtacagtcctccaggcagtagaagcatcagcgagaggccctgtcctgggtgtgaagacctgagggaacagtgccctgactgcccacagacaaagttggcccagctagggacagaggttgggaccattacagaggtcaccttagctccatccctcagggcctcatagttgcttttggagctgccccaggctggctggagcaggcttctgccaggaggtgatgaaagcaggagctggctgaggctgcctctgcccttctgtgtgagagacagtgtccactgctttcgtaggtcctggccagccttcagccgcacacataaccagtacctgctctgggccaggcctggggctgggagggaggtgcctggatgcagtgggatggcaccagtgatagtatagacagtgcctggagaggactgtgagcagctttagcaaatggaactgggggtcacaggtggcttcacagcattgggaggactccaggatcaggtggggatagagaagccactggagagagtaggtggctggagaagaggcagctgtctggcatgaggcagctgtctggcatggggccgacagcctgagtgagatagggcccctgaagtagactgtcgtcatgtgctcttgagaggatctggctcagtttcatgccactaacatgttgttatgtcaccatgcccaagcccagtcattaccttgctgtgggacttgggatggtgtctgtcagggttttttggccttggaggggactttgatctgggccattccatgatgttttcccttgagagagttggtcctagaagacatgctgagagacttgtgggaggagtgagtgcggcctctggggagtcccaggtgggctttaaaggcctttgtctttgaatgagtgagcctccctggagggggcctagcccaggtgcccattggcagagcctgggcatgggtaacctgcaccacctgggggatctgagggcccatatttctcttgtgtcaggggcctcagtgccaccagcctggagtgggcaactggtaagaggctttgtcccaggacagtggcctcaaatgcctaatgggcctgtcagcacatctgtgattttctccaggacctgtcaccccaaccttggggccctgcttggtcacagagggacatcaggttcctctggcccccactcccctggccagttcctgtctttgctatctacagtcactgtttctgggtccatggcaggactctgcagttgggggctgtaggcctgctgtggtttcagggtcctgggctagacctggctcctgccttgaaggagtgccagcactttcactcttctcctggggtcaagcatgcaggagctccgtgaggcccagaaggctcagaccaggtggaaggacccaactgggccttggggagaggcaggacttttatgagcaggttaaagctcactatctctgttggagccacacctcactcatatgctttttttttttttttttttgagctggagtctcactctgtcgcacaggccagaatgtagtggcacgttctcggctcactgcaagctccgcatcccaggttcaagtgagtctcctgcctcagcctccagagcagctgggattacaggtgtgcgccaccacacccgactaatttttgtatttttaatagagacaggatttcaccatgttggccagggtggtctcaaactcctggcctcaagtgatccgccctcctcggcctcccaaagtgctgggataacaggcatgagccacagcacccaccctcatcttctatttattttattttttgagataggatcttgctctgttgcccaggctggagtgcagtggcatgatcatagctcacctgcagccttgatctcctgggctcaagtgatcctcctgcctcagcctcccaagtgtctggtattacaagtgcatgccaccacacctggctaatttttttgattttttaatagaaatgaggtcttgctatgttgcccaggctggcctcaaactcctgagctaagagagcctcccacctctgcctcccaaagtgctgggattactggtgtgagccaccatgcctggccctcactcatcttgatatggaggagaaactaagtctcgagaggtggtgtgctgaggccatggacagagctcagaaacagtgatatttctgttcactttccactctgcacagggctcttcaggacccagaagtgattgaatacagatactgtcattagcagctcactggagcacctgctggggactgcagtggacaggctggcagggttacccaggcatcatggctgcctcaccagcaccagaccagccacccggggttgagaagccatattgttccagcaggtggcaccaaagggcgcagcagaggggcagagttggctagggactctgaaggcttcttggaggaagtggcttcctaaactccaacccaagatgtctgtgggcccaagctgagttttgaaggcacagggcaagggagggcctctgggcagaggaatacagacggccccacccccaccccacaagggcctctttggcctggcgggcagccggccctccactccccagctgtcttcccctggagggagatgctgaccagctggaaccttattccctcctattgaggccaaatgaggggaggaatggtggagtggctttctgggggcagggaggcagctgctgaagccaggcaaggaggaagaggaggatttccctgcctgccgaaggcctcggccttgggagaaaggcagactgctgggccagccttatctctgccaggcctgtccagcctctcatctcctgaaaaagaggattctgcccctcactgggcaggagagaaaagcagggctgcagcagcaacaagcttatagccagcccggcaagggaagtgctgggcctggcacaggatcgcccacgattggcctggcttgggtttgaagagggccttgaaggggctggggtagtgcgattgtgagtggcccttactaggctcagcatttcccccacataaacagatgccctgagtggggggcgcaaggagggggacgttgaaaaagaggagattggctggtggggatccctctgagaaaatgagactaggtggggtatgtagagccaggcagggggccctggtcatgggtggaggtgtgtggacattggccatggggacgtggagctcctctgctttgtggtgtgttagggcctggtgctggccctctctgggccttatctgctctgacagtggggctggtaatgctagtggttgtgggatcacttggataaggtgggccttgggtgtgctttttctccctcttcccgtccgaaagggagggagagcataagaaagcatccttctgcttgggggcaggggatttgtgactgtctcagggagcaccaaggctacattggggctggatggggtgcagttagagtattgcggggtggcgcatatgcagcatgggttctggggtatgtgagatgttggaggcctcataggcaggaggcgtgtgtgctgtccggggtagaaaatatgcaggctggagctgcagaccatggcccaaagctctggcgagctctgaggtccctcactctgccagcactgtggggttgggggcaggaggctgcccatttgggcctcttggcttgcagctgcaagtgggccctgcttaaggctctcagttatggttgggagttaggggactgtctcttctcagtgcacatcctgtagctgacccagccagattgggggtggagagagggcagttgcctggctccaggcccaggagagcaaaggtcttcgcagggcgccaggctgggtgggagctgggggagtgcagagcaagcagggggagtgggggtcaggccaggacaggagctggggccttttcctcctgccgcctttctagagggccctgtgggagctcccccagtggccagtgctttgagccgtggcctgggccctgggctgccacctcccctcctttctttcttcagtatgggggaagacacctcctaccaaggtcttctctggacagcctgagcactagttgcacaaggtcctgtcacagggcaggggcctagctctggcccactcagaagctaggacaagacccgtgttcagtgcccagctcagaacagcagcctccaccccaacttttatcccataggtgcctcaccttgaccttggaggaatttcccctaggcctcatttagctccctcataccctgagttcatctttggtgacagactggaggatagttgtggctactgcagcctaactgtggaatggggcttactgccttcactgcatccccacacaggtgactacacagaactctctgccccagcccctttgtagctggttggaggcagagccttgtcccttgccaagtctgaactgggcagtctcacccctccccagctccacagccccctctgctgcccatgtaccccacagagctggccttctgcagggcagagtgatgggagcctcggcctgggatcgacctgacccagcctcctgttcaggtctctgggtcttatccaggccgtcctgggtgaatgcccagccctggcctcaggccctaaaagaagaggacagttctctatctctggcataggctgtgcaggtctgcctgacctgggccttcattccagagaacccccactggctccttgctggccttccctggagaagcttctctccactccactcctcagcctttcctcctgtcgctatctctgcctcttcctcttctgtccccactgggggacagagtgaccctaactggatggcgattcccctgcttacaccctgctcatagatccctagtgctcaaaacaaagccagggccctccaggcccagcctctgccccccgcctgctgcagccccgtgctgccggctgctgcgcctttctctccctctgccagtcctgaccatgccagttcctccaatgcatccgtcactcagtgagtgcctccaggcctttgcacatgctgttccctcttcccagaacacactttcttctcccagccctttaatttcccaggctctcacgctcttcaccccctgggctgggctgcatgtctcacctcctgtgccccattcctgtgtcctgttagaacactgttcatgctgtggggtagttagctcgtgtcccagtccctcacagggcatgaatcccctgcccccgcccgtttggggggcctgtgtctgtcctaggcctctggcagtgggggtggtcagaagcttgagaggaacatggggagggagaggagacactggtgcttatccgcagcacccatgagtcagcatacattgttaaggggtgatggcctgtgcaggcgggcgagggcatggtgctatgccaggacttcccggcccccaccttgatgggctccttgctattgcctgccccctgtagttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttggtgagccgctgtggtggtcatgggaggtgggcagtggtgtcagcatcagcgcatcagggtggggtttgtggacccgctggggggcgaccctgagccagaaagtgagacctgcccactgctgcttacctttgtctcccttcaacttcctcctccgattctctcctcacttcacccctcttctgctcctgtcctgttgcttttgctgggccaggcaggctacccagggcctgactgggactgtctcactttgtgaagcagtctgatctcccagagtgcagaggagggctgagctcatggagaagagtgagagaggcccaagtcccttggagtcccgagagctctgacagactgtggcccggagctggagcctgagtaaagccagagtggctgcctgtgaggcaaggagcgaagcaaacactgccacttccctccaccgagcaggtcccctgggccaggtcagacagcatccagcaggatgcaaggtccgtatcagaagccagggaaggggaatcaagagcttcctgcagagccctgcttaggcagtgctagttcctgcctgcttaggaggccgaggagaaggcattaagtgtccttgtagccagagtcctgggcctggggtaccacctctaagaagccaccagggttgaactacagggctctaagctgcactgggttctgagctaagaggcctgagccctacctgctgaccttgtctgccgtaggctctcccagcaactctgagctggttctgggctgtttgtggcttcttcagtttctccatctttaatgaagagatagaccagtgagtctgcaggccctcttgggggatgggggtgctctatcctgctctggcctctctttccaaccccacagtggccccctgggtcgctggtctgtgcctaccctgctgttggacttgtcctaaggaggaggctggttttccaaatgtggacgccaggccttcctgggaggtgtagagaagtaggcgttaggccccgaatccacagctgcccctccagaagggaggatgtcatggcctcttatgcaagcctgtctttggcatggtctgagcttgggtctgccccagcggtgattagatcatgttatggctagctgcctcctttataaatcaattttaggagcaaggaggcaggagaagctcaggtcagtgtacatggcccagagcattgcttctgccacttccaaggcaacagcctaggctggggacccctcaatacccagccctgtgggccttgtggcacgggcactctgtgccgtgtagggcatttgaacatcaggattctggcctaggccacctgcccacccctcaaaccatgtttcctccccagcggcttttttccaggactgcatttcagagcaggaccttgacgagatgaacatcgagatcatccgcaacaccctctacaaggtaatgccccacacaagccatgggggattggcctgtcggtgggtggggctgtgggaagtggtagggtggtgatttatgtgaggtgctgggacaggatgcagctatgtcaggctcctatcccagggacttactgcttattctctggctcccatgctgggcacaaggctgtgtggaacaggttctccatcccatagtgcctgtgacgggctcagataaaatcagcaggagtggctggtgctccaccgctggcctgttacagctggctcctggacagccgctcccccagcatccaggagggtcatggactaccacccaggccgtggcccctggaaccgccctacctaagctattgccagcaaggacaggcacttgagcaaaggcaacagtgtgctcacttatggtggggggagggatctggcgaggcatagctaggtcctcatgtccctcgtaggttcccaagcttggagtcagtgccacttcccactgtcctcatcccctgcccacctcttgcctcccaccaggctgtagcatagactgggcaacccctgaggatttctgggtcagcactaccctggcccaaagagattaaagagccaggggaccggagaggagaggaaagtttaaaaatttaaaaaaaaaaaaaaaaagcccgagaccagttaggttaggggtgtctgggatagactctgctctggctgcggtgaggcactgagctatagcgccaggaccccagatgggctgcagtcaggaacatggatccgcagtgggcaggccccaaagcagggctgaggatggccctggccgagggacctgctgacctcacctgtctattgggtgagagtcctctcctgccctggttggagcgagctggctgacatttggctgcagcctgagcccaggcctgccaatctccctgcaggggcctgggccagagcacagtgagggttggtggtaggggaagggcctgcctggaggttgcagtggtgtcggcaagggaccagcacgtgcagaaggaaagcatagagcatgggccaagtggcaggcagtttgctgtggaaggacacattccagatggacaggggagaagtctagaagaaaaggcaggcatgggatcaagttacccagggctttgaatgtaaggccagaagtttgaacatagtcccgtgggcagggtcagccagtagaggtttccaacagagcagagtcttctcagaaagccccttctagccacaatgtggagagcagattagagggcctgaaaccagaggtgggaaggtcgtcagcttctttaatccttcagactgcgctaggaactaggaaggtgtcattatccccatgtgaaaatggggaaaccgaaggctcagagaagtagggtgggttgcctaaagccacataataagtcactggcagcgccagggatcacacctggctcagcttgtttgcaaaagtgagtgctctcacccactccgctaatagggcacaggccagccagttagctgagaggagagagagcatacacacgtgtgtgtttgtgtgtgtgtgtgtacgcacgcgcctagctggcctgttgccgggttgcctgccctgagacagggtgaggggtgcggctgtccgccagcctcacccatgccctcaccgggcctgactggttctagctggagtcgccggcgagggctgcccaggcactagctcataaacacagacccaatgctgtgggccttgtgccaggactgccagcctgtcaggcgatgtcccagcccggtgaccacagatgggagattaggcggaccctcaaccacccagcaggtgggaacagtaggcagctggtgcagcagccgtggattggcagactccaggggacagggcgggggtgggaaggtgactttggtaccggggttgctgggatcttgccagtttctttagctgccctagcctccagaggagagtcccaccagcctccctgaccctgggatcagcctctcctgggattggtacagattggctaagcaattgggtgggtagcagggcatggagcccaatacctggttggttggttcccccacaaataggaagtgcagggccccactggggcaggctgtgggatttttgacatatccagcttggctggccacagggaaggaggtggctggggacagacccctagagggactgtgaaaggtaccaccaagccatgggaggggttggcagctgtctctgccacccaggccctctcattcctgggatcctctgtgctggggtcaaccctcttttccaggcttcttacttcctgacctgtcctagatttttgtttcccgtgatcccagaggtcactctcaggccttcccctgagttgggcttgcccagcattgctggccagggcaggcctgggctcacagactcctgggtctcatctcatctctcttggagcaccacccagcagagcttgtgagcccaagttggctgatggttggtggaaaggtctccacaccttggagttcagacctcggtatgaaaagctttccatgccatccaacccttgcctacaatctagaagaatagtctctagcctgtggagccagggtctctgagcccatgccagcagatgggaccagggaggtctgagtggagggtggccattacaagggagctccccatggggcccgtaagatcatccaccttccttggcatggagaggtgttgggaggaagcatggctgcttttgtgagtgagcgttgggagggacctggggcctgggctgacctcttctttcctcatgcccagcagatccaatttgcctgggcagggagtgcttgttcccgccggcagcccatgtgcctgccattgtactgtgcccagctgacgtccgtgtaggcaataaccatccctcagcaggaactggcctgacaattttgttcctgctctgtgatgctgaggggctgcctggaggatgggaggaggaggtgttctgtaagggaaggtggcagagagggccgggggcactcagtccctgccatccctgtggactttcaggcgtggcctttcctcaccagcctacggacacctgtttttttattcttttctgagacggagtctctttctatcgcccaggctggagtgcagtggcatgatctcagttcactgcaacctccgcctcccgggttcaagcaattctctgcctcagtctcccgagtagctgggattacaggcacccaccaccatgcctggctaaattttttgtatttttagtagagacggggtttcaccatcttgaccaggctggtcttgaactgacctcgtgatccacctgccttggcctcccaaagtgctgggattacaggcgtgagccactgcgtccagccacacctggttttcagaggctgaggaaggggaggtttggaaagatttggggaaaaggaaggcagagcagcaggggaaagtcagaggacccctgcgagcccagccttctgtgaggtgagggggtgaaggagactgtagcctgaagcagacagtcgggtgggccctgccctggcactcctgggtgggaggctgtgggcagctgccacttggctgattcacagaagtgtttcattggctttgctgtaagggctgccccggcccatccatgggtgtgcttgtacccaccttgaaaggggctagggaggggaggagggagctgtgagggcttgtgcctagcaagccctccagagcttccttgcctgtgctgagcaagctccatactctctacaggcctacctggagtccttctacaagttctgcaccctactgggcgggactacggctgatgccatgtgccccatcctggaggtgagtgcctgcccgccctcctgcctgctggtgcccgctagccctggcctggggaggctctgccaactgactggctactgcctccttcttcctccctctcttcttacctgtgcactggctccacagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggtgagtgccccggctggcaggacagcggttggatgtgttgtcaccaagcacccccacccagaaccctcatgcttgtgcttccccccacccccctggccaggagtacaagctgctcttcgagggtgcaggtagcaaccctggagacaagacgctggaggaccgattctttgagcacgaggtgagtctgcagggtctgcttgtcagagggaggccaacctggtggtttagacctgactctgtggccatggccacctggacaccacatctgcccgtgtccacaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggc

SEQ ID NO: 37606 - DNA, 10228 bp, Homo sapiens; identical to SEQ ID NO: 36491
